United States Patent 7,745,391 (HUMAN THROMBOSPONDIN POLYPEPTIDE) - sequence listing, part 240

SEQ ID NO: 658512 - DNA, 443 bp, Homo sapiens
ctgctcaatagctaaagcgccgggaaagagggcatacggagtggtgtccatgtgcatcgggactggaatgggaccccctcccgtctttgaataccctgggaactgagtgaggtcccaggctggaggcgctacgcaaacagtcctgttgttttagcagcaaggcagtaaccccccaaaagcaaacccccatgggaaaactcagccctggtggtggtggcagtggacagatcaaggcccttcaactcatttggaaaatgtgacccctaataacatggtataggagtgggtggggtgttgagccacccatcagcccctctttagttgtgcaaaataaaaccagcctgggtcccccaggccccaaggccatggttaatttttaaggcaaggcaaatccatggatgaaaagtgcaatgggcatagtaaaagggcatgaatttttttta

SEQ ID NO: 658513 - DNA, 486 bp, Homo sapiens
catggctagaggtgggaggatacttgagcccaggaggcagaggttgcagtgaaccaagactgcaccactgcactccagcctgggcaacagagcaagactctgtctcaaaaaaaaaaaaaataccataggagggcaaggtcaggaagagactacttaggcgattaaataatgatccttaccacaaggccgggcatatagtaatctccccttaacaggtggctaccaggcggggcgtggtggctcacacttgtaatcctagcacttggggaggcaaggcagcggggatcacagggtcaggagatcaagaccaccctggttaacgcagtgaaccccggtctctactaaaattacaaaattagccaggcggggtgggcacgcgcttgtagtctcagctactcgggaggctgaggcagaagaatcgtttgaccccgggagccagaggttgcagtgagctgagatcatgtcatggccctccagccttgtcgg

SEQ ID NO: 658514 - DNA, 241 bp, Homo sapiens
  misc_feature (22)..(22): n is a, c, g, or t
  misc_feature (37)..(37): n is a, c, g, or t
  misc_feature (86)..(86): n is a, c, g, or t
  misc_feature (100)..(100): n is a, c, g, or t
gagcagcccccgcgccagtagngcgcggggaggcagncggcgcgctggggttccgccgcgccctcgcggcactcgcagaagccggnctcgttgcaccggncgagcacggagcctatctggttgcagatacactcaatgcagacgttctcatcatccagctctgccgagccgctgcgagacgagcccagccggcagtgctggcagagctgacctcgcgtgttgtgcttgcagctgacgcagg

SEQ ID NO: 658515 - DNA, 619 bp, Homo sapiens
ttactccagttaggatggctataatagaagagacaaaaataacaaatgctgacaaagacgtgaagaaaagggactttttttttgtcagaatctcactctccgtccaggctgaagtgcagtggtggtgtaacctggctccctctgcttctagggttcaaatagttctcctccctcagcctcctgagtagctggagaaaaaggaactcttatgcactgttggtaggaatgtaaattagagcagccagtatggagaacagtattgaaacacctcaagcaatcccactactgggaatttatccaaaggaaagaaaagcattatattgcagagacatctgcatccccatgtttattgcaacagtgttcacaatagccaagatatggaatcaacctaggtttccaacaacagatgagtggatttttaaaatacggtatatatacaccaaggaatgctatttagccataaaaaagaataaataaaaccctgtcattctcagcaacatggatggaactggaggatataatgttaagcaaaataagccaggaatagaactttaacaccacatgttctcactcacgcagaagctaaagaaagttgatctcatagaagtaagagtagaca

SEQ ID NO: 658516 - DNA, 111 bp, Homo sapiens
  misc_feature (33)..(33): n is a, c, g, or t
  misc_feature (36)..(36): n is a, c, g, or t
  misc_feature (106)..(106): n is a, c, g, or t
gatcgactatgagacagcaaaggggcctacctnctnatggagttagccaagagccaggacaagagtctcaagatttatgacggtgcctaccatgttctccacaagnagctt

SEQ ID NO: 658517 - DNA, 225 bp, Homo sapiens
tcttaataagcataaactattacatgcataaactattacagcataactattacagcataaactattacagcataaactattacagcataaactattacatgcataaactattacatgcataacctattacagcataaactattacagcataaactattacagcataaactattcccgcataaactattacatgacataaacttggaacacttctggacttccata

SEQ ID NO: 658518 - DNA, 958 bp, Homo sapiens
gcgtgcgtgttctgtcggtcccgataccgccgagtgacgagtgctatatgcgcgcccggcgatcgccggacctgttgcgaatgcgagagaatagcggagtacgggaaccttcggtcaggcgcgccagattggtgccggagacgcaggtatagatcatggaatgggaagactgaggcccgtagtgtttgaggccatccgaagtagtcacatcgtcaggcacaattgcgacgggagggaattgtggattgatgtgatcagtggattcgaggatcgagcaagaatatatgtgagtgtaggactaattatttatgggagcggtattgggttgcagagggaacaggggagattgtgatatgggatttggctctgagatgaaaggagtttggcagaagatggtggcgtcccatcgtctaggagggctacaggcaagccggcgaaggcatacaggctctatgtatagtcaaggcgagcgtgtgccaaggaatcatgcctgcaagcatggggggagccttccgtgggcgctgacgattccttgcagaagcatgtcagtgcgggatgggatgtcacggatttgtagcaaggaccaccggtgattgtgaatcctgcgtggagcatgcgggggagaactgatgcctctatgcggaagaatggtggtctgaaagcgtatctgggatgcccaacaggttttccagggagaaaggtcttgaagcccagggcggttggttagtggagccaagtgagacatgtccaggaagcagtctggagccaaagaaagaagcgacgtagcgtcaggacacgtttactaagggccctcagaactgtggttggagcaattggagagagtgaggccccaccaaggttaagaccgccaaaaaaacctcgggggttcccacgggctattcgaggagggtgggccctttacccagccggtctggagaaccccggggatcacctggac

SEQ ID NO: 658519 - DNA, 257 bp, Homo sapiens
tgttttcaatccggattggcgttcatgtagcgcgagtagttctcgacgtagtcggtgaggttctcctccagcatcaggcggaactcctcaaggaaatagtccaccgcctgctgcttggacgctgccagttcctcggcattacggcagccgcaggcgctgacccaggcgctgaagcgcgcgttggcatacatcagcgaggcgctggccttgccgcggctgctgtcggcgatgtgggagttggtcaactcgatgatggc

SEQ ID NO: 658520 - DNA, 189 bp, Homo sapiens
atctctttttttggaatggtacacaaacatttcctacataatccaacatacaacagagaaagggtacatctttttctttcaattggcatacaagggaaaaccaagttatatattatattttacaaagtttacctaataagacactagagcaaatggacagtttaagtctataggtgagaaattatctag

SEQ ID NO: 658521 - DNA, 205 bp, Homo sapiens
ggctgacctagaggatccaagctccaacaagatagctgcagccccagagagagctctgacgtacaagtacaggccagctcaggcccaactcgccagctctcccgctctgatctgcactctaacactcgactctgctgctcatgggaagaacagaattgctccttgcatgcaacttaattcaataaaactgtcttgttgggagctt

SEQ ID NO: 658522 - DNA, 131 bp, Homo sapiens
atagtaggcttgtatccaagattctcagcagatagaaagggatatttctacagatacgagatacatggcaataaagcaggataaaggaaagatcaaaacaaggctgtgaaccaaactataaatccaagagc

SEQ ID NO: 658523 - DNA, 93 bp, Homo sapiens
aaagagcagcccagcccaaaggggggctttggtggccttttttggggctttgttatatgttcctaaccccccataaaagcaatgttggctcca

SEQ ID NO: 658524 - DNA, 333 bp, Homo sapiens
agccccaaaaggccctggcagggttagctgtcttcaagatgagcaagacccagccgggcgcggtggctcaagcctgtaatcctagaacttggggaggccgaggcaggcggatcacctgaggttgggagttcgagaccagcctgaccagcatggagaaaccccatctctactaaaaatacaaaataagccaggcgtggtggtgcatgcctgtaatcctagctactcaggaggctgaggcaggagaatcgcttgaaccctggaggcggaggttgtggtgagctgagatcgcaccattgcactccagcctgggcaataacagcgaaactctgtctc

SEQ ID NO: 658525 - DNA, 995 bp, Homo sapiens
gtcttgtcttgtttagggtcttatccgcgtggcattgagggcgccgtgactgctgcttatggacgatttggtattggagtgggcggtttctatggtggacccacatgaactcaggtgtgggatcatccccgcgaactgagcctgaggtggcctcgagacagtcgacatttgtcaggatgcatcctcagaccaataagaagggcgtgaagatcccacatccccaaagagggtggagagactatctcccagttggacagcggtatgcctgggtactcgtttctattgctttcacaagtcccttttgcaagatcagttctgatcctagtaaactgtgactccagaacgaatggcttttctacccctcttgtgatctgtatttagcaaaatccgatgacatcgaactgaagagcttggactggattatcgatttaagaatatactcaaacgatgttaataaatagcagagggattttggcaatgaaaagcatgattcgttatgggtatagaagtgtttcatcacgtcttggatcatcaacgtgtctcttgaatgactgagtacatagtattttaatattttcatggaccacgcatgcttgaatgggggtatgttctgaaaagaactgaattgaacgaattgtggataaaatgtgtagttggtggttcaactggtacccaatgtgtgtataggagcgactggctaaccacagtttgcagactattgtctgactcgatgtaaaacggcgtgacggcccgcattgagtgcctgttgacttgcttccagtaaggtggccgggggaccttggctaggcaggtgataccactatttttgaacgaacttagaaaagggcctaatcataccatagattgggacattcccgggtgggccggggtcaagcaggagtttgcaaaagcccagcgagtcttcattcgaccggggtacacacttaggctggtgtaacggacgcaaggggatcctcaacacgaccacacgggct

SEQ ID NO: 658526 - DNA, 1217 bp, Homo sapiens
atgtgctcttgcccgccccctgttattttggtgcccccaaagtttttttgggagaagagtttttgttggtgttgaaattattttaaataggggagccactctttcctccgggccatatgtgtttactgaccggagacagttctcgactgttatttttccccgggggacactaattggcgcacacagagttttttgtgtgagcccggacgcgttttcctccaggggggacacagtctgcttgtgtgccaccagggcctttttgtttgggagcttctccccacccccacgattttctgttgtggaccacactctcccgggatggcgagtgtgtttcccgggggcccacgtgttctgctttccctcgtgtcacagcactggcgcgtgtgtgtgcccccctttttttccccccctcaggctatgtgggcgcccacgatggtgggtttccctcggggccgcgtttgggttcacgggagtaacccctctcggagatgtgtgataggcccacccctcaccccgtctcctccccacgggattttgtggccccaaggttctgtggaaggcccccacgcggttttttgcccacattttgtgcccttttgagaagagaagagagttttttggagaagagagttccacaggggtcacacatttgtgagcccctattctaacacacagtgtttcgcccctttccacgtcccttgagatgggacacacgagggctatacacgcacaggcgcgccgcgccgagaagaattggtttatacctccccgtgatttcccactctatactctttcgagacccccacgtaatcttttgagaatcttgagagtttgtagagggctctataagaaagtctcgcgaattttccttcccgggccttggtggcgtacacaggcccttatattcccacccacctcttttttttataaggcacggcggagtcaccctcgaaggtaccaggagagtttataagaaccccgcctgagccacgcacatggaggaaacctctgtttttatcttaaaaatatccacaaatttatgcccggcacatggtggcacacacacgccctgtatgtcccacgctatactcgggagaggctgaaggccaggagagaaatcaaccttgaacccgggagaggacacaaggttcccgtgagactgagatcacgtccttgcactccctcctgagcccaccagggccaaactccctttccta

SEQ ID NO: 658527 - DNA, 1507 bp, Homo sapiens
  misc_feature (219)..(219): n is a, c, g, or t
gtgacgcgctggcatccatattgtgcaataatactttctatcttactaccagagcaaccttagtccaagccatttactctctacatgcacatcgtattaagtgtccgactacgcagaatttggatggacgcttggccagcgacaataacattagttaggtgatcagcgaatggtgcaatcgtatgcaaccgctgtatatctgtatcgccaaggcactanatcaatatgctgatgggatctatacttctccttcatatcggtatctgacactaccttgaataattcacgcggtaagggaaatattagagcgtattttgtcgcaagtgaatgtatccccccatatagcatataatcaggcgctcgccgcatagagtcatagtacggcatgtattactcctcagtagatcaggagctacaaatgaagcgactagctcgcatgcttcttattagttatgccgacatacattcattctctgtaagctaccattgtatatcatcgtgtgcctagatgcgtgactgacagatagagacccgtgaccccggacgctccttgggagttagcattgaggggcttgagagctttcgtttcctaaactcgacgtgaccacatctgctatgacttgtgtgcaaaccttatcgtacatctactgtctcagctcggcatcagacgcatagcctcacttactaaatacctttacacgcactattagtggaactagtcacctgtactaatctggcgtcttcagtggtctccgcagttcagttgatgcggataccaaagtactctcctttactgggtggaggcacacttgacagcagtactttggacaataccactttaaagttccagggactgaattggacttgtttacatcacatattttctaactcccgttctggccgcattttaaagttcaccgggggcgcttaattaccagaaggtacagggccccaccatccaatattctgaatgacgttaggatattgccccggtttccccattaggcgtttcgaaagaaagaccaggattcatttaaaccctttacttaacttattttccctatcatacccacttaagtttcatcttaggaacctctttcccttggcaaatatccgcgcgttaatttagggggaacctcaaaagtccatgaattccgaggccgccttatttaggaaaacgaaacctttcagtttgtttatcgcagagttacaccgtttaccagatggaaaagtggacaagtttatcctccccattttccgggcagtttcacagaccatagccgtatattatggaatgtagtaaaggccagcacggggtagaaaccatcggaacgatgaagaaagtaaagatacatagcgcccccagggtaagtacgcaataaccacacagatagctcctcacagacgcagagagttacagttattctacaacacacactctgactagtcgttatagcaccacaaacaagttccacaggggagcaaagtgtacaccacaacacacggg

SEQ ID NO: 658528 - DNA, 321 bp, Homo sapiens
tcgcctatgagatccggacagtgacctcacgaacaaaaagaaatgatcctcttcactccaaagtgtgttcgtgagactcatgactccatgccctcacatggccacatcctcttacaggagacagcttcactaccgctccagccccggtactgcggtctgtggtaatttacatgggcaatgggctgcagcatctagtcagtttcagcatccgcatgcaattttgaggcagggttagtcaataaaccaataaatccaatctatgcagtcatttacacaatatccattgcagcagttgtgccccacttcgcattctccgcacgg

SEQ ID NO: 658529 - DNA, 437 bp, Homo sapiens
atatatacactctgtatatccatgtgccagcagaaagcttgtatcgatgggaaatctaactacctataaaaagtgatcagagtacggataccacctacttaaagaatgcagaggactctgtgtctatcatgcaggtctatatgctgaatgtgtgttgctgtattcttctatcatagtgctttacctctgctcaactaatccaggtatcagccttcgttctgcggtagaatgagacacacggtaggcatatgcttagttgtttactggttagatctatctcactactgtaaaaaaagctaacgcttgtcacagacgccaagcatactagtgacaagcacagcacacaccaccacagattcaaacaacagtaatgtacagactatatttatacagaagtaggaatagatccaacagtcccaggcaatcactttaatcag

SEQ ID NO: 658530 - DNA, 159 bp, Homo sapiens
agtcgacggcgagagataggctatctcccactccacctactccccatatatcccgtttgacagcttagcctctagtgccctctcactttggcatccaggcacatcagattctcctccactggagccctagcttccttgtccctcttccccataaactct

SEQ ID NO: 658531 - DNA, 196 bp, Homo sapiens
cctccgccatccctggtatttaaattatttaaggtttttgggaagggctggggcaaagcatttgtggggtggggttttccccttgctgctattgtaagggtggggactggtttttttttgccccagccagtttgggggtggttcccccattttgaattgtttatcccttttttataattaaagttttaaaacatca

SEQ ID NO: 658532 - DNA, 1651 bp, Homo sapiens
  misc_feature (1154)..(1154): n is a, c, g, or t
gtccagttccggcgttcgggtttcgtctgcacggtcggaatggaatgaagagatcgcacgcgctggtcatcgacaatgtgctaccgggcatgtgcatagagctgggttgtcgctggggatcgaacggctccactcgcagccagtggtgtgtcctttcgcagtgcggtcgtggcggctcctcatgactagcagggtgcggtcactggtggggcatggtgcgcagacagggactgccttacggtggagctgacgacggtggccagagacagaggcgtgtgcatcgcatgacccgtgtagagtgaccgcctatttggaggccgacttggacaatcgttccgagcgcagatcctgggggaaccgacgagtaggtacgtagatgaatcattggccaacccaacaaccgtgtcctaacagatggacgcttgcagacggtggcaccctggaaggactggacgcgcgatgggcactagcgtggaactcagagaggcctcgcgcgcttgtagaaccctcataggggcccacaacaaggaagaacgacaatgaactgatcgtacaaagactatcagtcgtgtttgaggaacccttgtccaaaacaaacgacaccgggacactacttgtaagcaggttgggcccgatacccagagggtccagactgtccttgatgcgcgcatcttaaccgggccattccttgaggtgacggcaacccaccgtgggccagtgtggtaacactagggacaacatccatgggctacgcaacagggacgtgcttcaatcgtacgaaacaagggggggtggacccgcgagatccttaaacctggacggggggacctgaactggcgcccccgtacacacgccctcacatcagcccctaattccgcctggacagaataaccttggggaccgcgtgggggagtatggagacacgcggggaccccttgaaacccgtagacagcttaaggccctcccacctgggacgatggtagattacgctcacaccgtgggaagtgccggcacgggcattaaaccgagcagcgttatccacccgcgaaccaccgaagcgggggcctcccggaatagcgggggggacaaacgaactaccgaatgggccgggccgggaaacacttctgcacaggcggactgcgaaacgccctcgngtcgggcctcgagacaggaactaggccacccctagggggagacactgtccggaagtggcgagcggacaacacgtgggggcgccacactcggggccaggcacaaattgcgcgttgcccatatccttctcgacactctgggggacacgaaaaaacaaggcctaacaggaaagacagtggggctcccgcgaattgtgtcacacagcggtcagaatcaacccgagagtgggggccaccatgcaacgccgggggacacgggccagcgtaccaggaaaacgacggacaatgatacccgatacccacgacagtcaacctgcgggcatcgggaccatccggtccacgcacacaccccagggaggaacccacacgtcaagacgcacagcacagacaaagttgtgacacagctgtggagaaccaatgcgcacgacaaccaagcagtgacgcagcacacacgcaagcaccatcacatgagtggtgacgacaacaaggtgaaccactga

SEQ ID NO: 658533 - DNA, 648 bp, Homo sapiens
agcgctgcggagccttgcagtacgcgcatcccgaggccgtgggcgtgcgccatgggggtgccgatgtacgcgcccacgaccgtgtgctgcaaacgccgctcagccgagaccctgtttaagatctgaagtgcacatccttgggcgcggcggtgacctggcgtgccttaggtgcgccagtcgtcccgaagacatggtcaatttcatcaatcatgtgtccattcaaccaaagggaggacgagtagccacttacttggacccttcgcttggataagtgaaagccctagcctttgaatcttcatcccacgcctcttaactatttacatgtaccttcgcgaacagtcttgtgtctcgcctctatacaagctcactctagtaacccgatcgtgccaccaaggctgggcacatacctagaaactaacaactcaaagtgactgttgaaactagctgtggcacagtgatgtagccaagtcctttgcatccagaccacactgctgcaacaactcgtatgtcccaataccgtgcgctcaccttgcactgacaccttcttgtgttgcacgttcattgtccgcacatgaatcatacactttcctttgaccaacaccacaaatagtatggaaacaactacgtgacgtactacacttaatctat

SEQ ID NO: 658534 - DNA, 550 bp, Homo sapiens
  misc_feature (542)..(542): n is a, c, g, or t
ccgagcttaagggctaccccctacttagagagatgaacattgctgattttacccactacaggtcttggacttaacgtgtgcggacgacgtagggccctggcaacactcccatacatgcccaggcacacacacacagagactttcctttcacaaaagaagtttaacttgggacaagctaataacaaacttactattagaaacttcagaatgctgttatgtaggtttcagcatatgcagaattttgtcttttgatgattagtatttttattttgaagtccgcactgaggagagagagtgagaaacatgaagtcatttcactctgtggggactctaaagagcttctttccaccctcaggatggtgggtccagcgtgtgttgcttaagggtgggaatattttctgggaagtgcatcttcaggcaacttcatagctgagcaaacatcatagaggtacctacacagacctggatggtatagcccactatacacctgggctgtgaaggatcgtctcttgctcctgggctataaaacccgaacagcatgntactgtac

SEQ ID NO: 658535 - DNA, 181 bp, Homo sapiens
gtcttttaaaaaaaccttttatttttcggtggccaagattaacttttaagtttattagaagaggatcctgattatagtgaataaaaaaatatagatgagagaattccaatattaggttataccaagttagtttttttaaaatccttgtccccccaaattttcagggctttggagttttcca

SEQ ID NO: 658536 - DNA, 228 bp, Homo sapiens
  misc_feature (55)..(55): n is a, c, g, or t
  misc_feature (200)..(201): n is a, c, g, or t
atgccccgtgatgttatcgcccacacctaccaaccttacaaatgttttctcaggncagtctcccaaagcaacagaaataagagcaaaaataaaccaatgggacctaatcaaactgacaagctttcgcacagcaaaggaaaccaaaaagaaaacaaaagacacttatggaatgggagaaaatagtttcaagagcactgaannggctaatccgtgttggggataacatca

SEQ ID NO: 658537 - DNA, 234 bp, Homo sapiens
ggttcaggttagaacacacaagttcgggacctttgtaaaacagccgcaacaggcgcgtatgggacaaatttataaaaagaccactaaaaagaaagattaaatggcttcttgccagtttgagcctaatctgattcttacagttttaccttcttgaaccaatgtaaaagtttttttaatgttaaatgattaaattctcagtgaggctaaaaaaaaaaatctttttttttggcctca

SEQ ID NO: 658538 - DNA, 172 bp, Homo sapiens
tctattccgtcataaaaagcactcatactttatgcatccccgcagctacacacagacggacacacagcacacgcataacacagcagacacacgagcacagcacacacacgagcatacagcacacacacaaacgcacagcacacacagcacacagatgagcacacagcacaca

SEQ ID NO: 658539 - DNA, 140 bp, Homo sapiens
tacgggcttgtaccttcgaggatgtggccgtggagttcaccaggaggagtgggcgttgctggaccctgtcccaaagggacactgttacaagggatgtgtatgcttggaggacttcagggaccctcggcctcactaggggg

SEQ ID NO: 658540 - DNA, 911 bp, Homo sapiens
taataataaaacacagtaaacattctatttctctatggtctacagcatgccagtaaataatatgtaggaccaataataaattatcaattacacattttgtgttaactaattaaaagcatagtgtataagtgagtacactctaattaacttgcttctgttgcactttagttttctacctgcatatggactgcatttttttttttttaacacagtcagtatgtaaaaggggatgtatccttctgcggcggcttattaaataaagaaagcctgagtgtccttagatggggtatcctgagaatgagggtcttagccaacagtccttttcggaacatgaaaggtgcttggtttttcaattcatatccatcttttcagggtaacattggttcttcctgagttctcgtaaggctcattttacatgcggctactagctttttttttcaaacaaacgtaaaacgtggcggcttctaaaatattaatggcctatattcgacaagtgccattgcgccgtaagtagactatgtattcctataaaggatgtcggatattctacatagggcaccccgaccacccatatgccgacaggttgaagcctataaacctgtatttaagctggcctaaatccctgtgattcacaaactggctggctcataaaatatctctcatttattttgcgccaacgacggagatctctaccccgtggtaaacaacatattgcctcagcgtaagtagtctctaacaaatcggacggtcactgacacaacacctgactcagtcacaagattcgtgggcaaccgccggcgtaacacattgtgacacacatacgcaacgcaagccacaccgtatcatacaaactaaatggcgcaccactatgagcgagacctcaatgtcagagcgtagccacatgcagcata

SEQ ID NO: 658541 - DNA, 915 bp, Homo sapiens
  misc_feature (1)..(1): n is a, c, g, or t
nacagcaacaaagcggagggtgcgacagcgtgttgctggcagtgcgtcgccaccgcagtgttctgtcatgttgtggaccgcgttttgggcacgggtcctacgagttttcgccagacgtgagagtgtgccgccgcacggatgcgcgtttctagagactggaccctccagcaaactcccgcgtcctttaagactgtgcgcgattttttcctccttgtggcatcttgaggccccttcgtgggttgtcttggagagctctccggctgtgcccgcttagaggagctccccatattcgcggctttccactgtttatcggcgaacacgggccggtttgttgtgtccataccccggcagagttatgatagtggcccgtgtgacccgggcgctttctcttaggagttcctgccccccgcggtttctcccgcggatccaccctcgcgggggtcctgttgcccccaatgctatgaaggtgttgtccccccgcagccttctgctgcaggactttattgggccctgccatgatgtcgcccttcagtccttcttgttggtggtcttattgcccgctcgccgccgcttgtttttgattcctctcggtctttttgtgatggggttaaccgctaaacatatgtttcgccaaaaatgggagaggttttctttttatgataaccccctcggaaatgcgtgaacaaacttgggttgtaaaatctagaactgggcgctaaacaatcaagtgaaaatgggcgctagagttatgagggctgtattacaaaagtgaaacctcggtcccctaaatgtggggggccaccacccctctaggggtcaaaccccaatcttgtcccagttcttcttccgcttgatgtttttcaaaaacagggcttcccccccttttttttaaaaaaccttttcaaaaccaaaaca

SEQ ID NO: 658542 - DNA, 474 bp, Homo sapiens
  misc_feature (121)..(121): n is a, c, g, or t
aggatcccgctgctccctcttcatttgtacagctccacaaacagctctctccaaagttcataaccacctgcatattccagaatacgaaggacacttccccattcttatctcacttaatctntctgtgcacaacccttgactgcatccttcttgagggtctctttcctcagcttacatgttctcacactcctctagttttcctcctccctctctgccaactgagatgaagtcttctttgatgctgttcttcttgtgctcaaaatttacatgctaatattattcagggtcccaggattattctttctcactcttctcagggtgatctcatccactctaatggttaaaatacatgctgatgtttcctttactcagggataccactagtgaatacattcctttcctcttggcttctgtctcccctaaaagactgggagcttcctgaagagggagcagcagggatcctctagatcaccc

SEQ ID NO: 658543 - DNA, 440 bp, Homo sapiens
  misc_feature (440)..(440): n is a, c, g, or t
ccaggataggtatgacgagcttcatacacaggtaggtctactaatttgaggcatggacacggtcactctgacgatcctgacgcccatcaggatgtaactacagttgtcagtctgtccttgaggttgacatgaccaggctggactggccctttcttaacagtgagagtgcatattcgtggaggcagacgtaagataaactggctgctccatgttcggtgatgcgagcattcatcttatgcttttactcatctttatttccttgttgatttacactttcttcgcagataagatgctgtgttacactaaaaagttccagctactgcaatagtttaaaagcaccaggttttgcgtattgaactttgaaagtctttttacattacaagcaagttctcttgtagaatcagccagctaaaggcgtctaatttttgcccttgaggttn

SEQ ID NO: 658544 - DNA, 308 bp, Homo sapiens
  misc_feature (117)..(117): n is a, c, g, or t
acgggtggaggggcggtgaggtccatcgccggggaggcgaaaggccttggtggaactgtagctcagtattggcagcattccatactgcctcatcagaaatggggcaccagcagctanccatcggggagtggggacagaaaccagacctctgaccttagtagcaacatccaatggcacccagattgcagttcagcttggagaacagccatctctggaagaagccatgagaatagcgtctagaatccaacaaggagaaacgccagggttggatgattaattctgagaacaatggagcaataaagcagaag

SEQ ID NO: 658545 - DNA, 100 bp, Homo sapiens
ggtagcagaagcaggcggcggtccgggcgtccagtaggctgcagatgcatccaggctgcgggtatatacctactggcagtggcctgcctctcgcacagca

SEQ ID NO: 658546 - DNA, 298 bp, Homo sapiens
tttaaaaaaaaggggggcccaggggctcccccccctggggtggggggcaaaaaccaccccccaaagtttggggcccttggggcctggggtggtgtttcctttaaaacggctttgggccggggccctacttggtttttttggtttttagggccctcccgggtgggcccgggtcccccccccccctaagggggtttgggggaaaaccccccccccccccccttcctttttccccccctttgggggcccccccgggcgggtggttttagggccccccggttggtcattaacccccggtgga

SEQ ID NO: 658547 - DNA, 129 bp, Homo sapiens
cggcacagtatcttgttgcaagcaggcataggttcagcaaggcattcatggcatgcgagttgctttgcgttgcaatccatcactttgcttgggctaggtgtcccgcagctcgcaattcgtcaatccatg

SEQ ID NO: 658548 - DNA, 492 bp, Homo sapiens
  misc_feature (462)..(462): n is a, c, g, or t
tcctgcgtcccaacccggtccctgagagggcactgcgccctctccaccactgcgttccctcggctaagaatcccccgaaccccagccccgcgatcgcggcgcccacctgatggagtgcctgccctgaggatgtgtgtgctgctggtggtgtctgcgaatgccctgcagcccctggaacaccaggaccccagcctgagactggagcctggacccagccgcctcccgggcccttccaccgcagccatccgcacgggaggcctcgcgattgctcggaaccatcccgcaggagttcagctgatatttactagtgtggggcgagagattatgtgagagcgcatttaaggggtaaaatgttgtgactgctgccttgtatatatttattttctttcttggaactggcctcgccctcctcccactgacatgatggcccagtccaagccaatggctcgcactatgcgctgnacgccatcggcttggggatgctggtccttg

SEQ ID NO: 658549 - DNA, 142 bp, Homo sapiens
  misc_feature (47)..(47): n is a, c, g, or t
  misc_feature (93)..(93): n is a, c, g, or t
  misc_feature (102)..(102): n is a, c, g, or t
gttagtgcaccgtacttctctgattttctttcagctgcttcaagganatccatgtgttcaaaatgcttgctcgcagttagctccataccaaanggttgcttnacccaaatatctgagcagcaaattgagctgatccttctag

SEQ ID NO: 658550 - DNA, 166 bp, Homo sapiens
tagtggttgatatgacacgtgaaggtgtgatttatctcaggagctggaatcttagacaaagccttgtaatgcctatattgtgcgcttctaacgtctttaatggcagcacttaagacgagattagattggctcttctggatttgttcctcatttgtcacaggtgtct

SEQ ID NO: 658551 - DNA, 434 bp, Homo sapiens
ttttttttttctccaacagttagtttttaatacattcaggtaggttatacaaagagtgggtcccgaggccggggctggcggctggggcccggggaagtgacagcagcccggttgtagggttttcaaagatcaggcggggggacccacacctgggcctccaggcctaaggaggagggttacgtgcagtagcaccggggggtgtgatcccaaccaggacggggtctgccggggtgctccacacaccaccagggcctagcccgggttcggcccatggactctcccttaacttcctcggggcctgggggttctcctcggtaaaaggggggggagagaggggcattttcactttctcgcacattacggagcccacatcatgagccagacggtgggccaagcacaggtaagatgatgaagacggcaaaacaaggtctgga

SEQ ID NO: 658552 - DNA, 364 bp, Homo sapiens
  misc_feature (23)..(23): n is a, c, g, or t
  misc_feature (33)..(33): n is a, c, g, or t
  misc_feature (237)..(237): n is a, c, g, or t
  misc_feature (286)..(286): n is a, c, g, or t
atttagatgtatccatccttttnctattaagantacaaatgctgggctgggcacagtggctcacgcctgtaatcccaacaccttgggaggccaaggcaggcagatcacgacatcaggagatcgagaccatcctggctaacacggtgaaacctcgtctctactaaaaatacaaaaaaaattagtcggatgtggtggcaggtgcctgtagtcccagctactctggaggctgaggcaggngaatggcgtgaacccaggaggcggagcttgcagtgagcagagatcacgncactgcactccagcctggatgacagagcgagactccgcctcaaaaaaagagtacaaatgctccaacattattttttat

SEQ ID NO: 658553 - DNA, 995 bp, Homo sapiens
  misc_feature (285)..(285): n is a, c, g, or t
  misc_feature (339)..(339): n is a, c, g, or t
gtgcgaccactcgggggcgcgcggtgcgagtggcatggttcaagatgccgataggggtgactgagcgaagtgcgtggtctggaataatgcgggctcctcacctgttgccaacgtctgccgcgggtgcccaccgaagggtcgcgtagagatgcagatggagttcggaaggcatcacggggttcgaatatacgggagatcgcagcgggagattgcaggtgtgtgagttagacgcgccactgccgtgtgcggtgtccactaaggacaggctgtggctacttggtatgngaaaatgtgccgccaatggaaaggacagagaaggtgggagcgtcttcgtcgaancaactcatttcaggaaggaacactattttcttggttggcgcttgcttgagccttagtttgcatgaaggtataaatcagggcctcacataaattgctagtagtaggggctcttgttaggtttattctcaagggggtggagtgtccatagacaatagtgccaagggtcggccaaggaatgtgatggcttatacatgtatggtggggggccatggtgttggtgagatgattgagatgccagtgtatggtaaggtggtgaatttgatgatgactcggggatgatgtacctggtgcggtctacagctggtatatggtagaataatataccgtggtttagttagtacaaattctgacactgaaatgaaggtcaaatgtgcatattggattccaatcccacaccaatgataatagaacacctatttaggcgtgaaactcttgtgataaggacatggcgagagggggtgactgaatatgacggcgtactgagacggagacggttgtcgaaccagatggttttgcagacacgtagactcgtggacctagggggaaaggacagggggatgggaatgcatcgggggaaaggtatccgcgcgagaacgatgggtggttagagcatggtttatagagaaagagagacaagtgcggtagataggggagat

SEQ ID NO: 658554 - DNA, 483 bp, Homo sapiens
ccttaatatcacaccaccatgcttttgttactatctctaaacgtatgtctgcttcttctagagagtccacatctgacttatacccaataaaggtgacccttgcctatgattgcgctcctggctttcagctgtgatctcagctgcttcaatagcttcaattgttacctgtgcgaagatgaccttcaaaagggcatctgtgtgtctatctgtaccttgagcctaccactatcccctaactgggccaattgcaattttctgataactctgccacctggagatgttagctccatttcacattaaccaagtctcaggccacacccattcccactcctgtcccaaacttcacgtttgttacctgtagttctgctgaagatgccaccaagcatatgactgactaagatgtgcaatattagactactgtctctcccttatcccattgtccataccgcttttgcaaggactttagcatgcatctttttctat

SEQ ID NO: 658555 - DNA, 527 bp, Homo sapiens
  misc_feature (192)..(192): n is a, c, g, or t
  misc_feature (194)..(194): n is a, c, g, or t
  misc_feature (329)..(329): n is a, c, g, or t
  misc_feature (365)..(365): n is a, c, g, or t
  misc_feature (458)..(458): n is a, c, g, or t
ccgcccagcctcggcctcctgttttgttttctagaatgttacacatcgattaggtaatggctatcagtctcacttcatacactctggaacatgaaagactccatttctgattttttaaacccattttaacctgccttgcattcctatggccctggacaggtaagcaatctcatcctggctttactgggatcncngggcttggaggggctatgagtggtcgcagcagtggagggaagcctggctcccggtgccaaagagccccgtggcccccccaggcccaccagcaagaccctctgccctgttttagggctggggttgcaagacacgantacaaggacaatccaattgaatttcaaatttcaagntaaataaggaatcattttttaagtgtaagtctatcccatgcagtaatgttggacatactttgacctaaaaaatgattcatcattttttctggnaattcagattttaatgggatgttccgcagttttcttttgggttaactccgggaagcctgttgcagaata

SEQ ID NO: 658556 - DNA, 970 bp, Homo sapiens
  misc_feature (970)..(970): n is a, c, g, or t
tgacgcccccgactgaatggtgttatcctgcctggagtggtcacgacatgagtctactggacatggctcagacctggggtgagttccgggtggctgagagcagcacgatcaccaatgaagcagttgctgcgagtgccctggaggagggccgcgtgcgggaagatctttggctcgggctccgcttgccatgtctgcccatgtgcaccgaattcctgtactagacagactaggatatcactctccacatatcccgaccgatgtgtagatagatgtgtgccttgatgctgtatcctccgcttccagaaaggagctgatggagatccagtacgcgatatcaggatgtccctagctgagtggatgttcccggtgtgaatgcttgcaggctgtgctccagatccacctgaatccgtgagcatctcgttcacgcactacgtcaactcggctcttccctaacgcatattgactctagtctgaaatgtgcaagtggcagaatagtattaaatggcccagcgggactggtaggtctgaggctctctgggtgccccctatgtggtagctagcgcatcccgaatccgtgcaggtgctcgtcccagcgcagtcttgttgcgtcccacaagccccttcgtttgcggggttccggagtccagctccagttaacttgctgtgttcggctgcggtcagagtgactcgcagctgtgggcccccgatttccggcgatgctactccgttgcttcaagtgctcaagcactccccattgtgtttgcttcgcgcagttttgaacttttttatcttattacttccttgatcctttgtggccttgcaacatttttctaggaaaccatttaacattatttgcccagggaaggaaacatataactcggctacacataccacattcggaacagcccctcactaccaagacaaccatagggcgggggtgatgagcttcctacatatggtggcaccttcn

SEQ ID NO: 658557 - DNA, 132 bp, Homo sapiens
ctcgactcgcggtactggttggatctctagagtctgacaggctccagcttaacgatatttgcaggtcagcactggtgctcactgtgttgacggaacttgtacagggaggcatgcaccgcgaggggtgaatac

SEQ ID NO: 658558 - DNA, 550 bp, Homo sapiens
  misc_feature (26)..(26): n is a, c, g, or t
tctcttaatgcctcctgttttgtganccccccccttttacaacacgggaacaaccctcaaagttcctgggttggaaattgggaccccagaaaatgacctatagctttaaccttcctaatatttgtgttgattaatgccttgaaaattatatcctaataattccatagtcacctaaaaagaaaaatttgaagtgaaatatttgataagtagcttatccctcttaaagtttacagaccctcaggcccaggctgattcctcattagggcccaggcatgctggctcaggcctgtaatcctcagtgctttgggaagatctcttgaggtcaggagtttcagaccagcctgggcaacatagtgagagcctgtctttaaaaatacatatattaaaaattaggtgggcatgatggcgtacatctatagccctagcttcttgggaggctgaggcaggaggatcacttgagcctgggagtttgagtttacagtgagctatgatcacgccactgcaccactccagcctgggctacagtgaggccctgtgtctttaaaaaaaa

SEQ ID NO: 658559 - DNA, 121 bp, Homo sapiens
tcatcgagctcggtcccggctttcgggtggcgcatggggtggagagggtgatttgggggagaggacgccacacaggtgcaggaactcgcagcaggtgactgagagtggaaggcacaaggag

SEQ ID NO: 658560 - DNA, 3750 bp, Homo sapiens
aacgaatattatagcgcgatacctggtgtaatttcgtacgagggccgtcgttcgttgtagagcttggtgaactgtctccgccgagagcccggcgggaaccgcctccggtgtgtgctgctctccaacctcagcagcacctcccacgtcccggaggtggacccgggctccgcagaactgcagaaggtgttgcagggagacctggtgatgaacgtctaccgcgacggggcctggggggctttccgccacttcctgctggaggaggacaagcctgaggagccgacggcacatgcctttgtgagcaccctcacccggggggacctgtcctccatccgctgggtctgctcctcgctgcgccatgcccagcccacctgccctggcgcccagctctgcacggtctactacgcctccctcaacttccgcgacatcatgctggccactggcaagctgtcccctgatgccatcccagggaagtggacctcccaggacagcctgctaggtatggagttctcgggccgagacgccagcggcaagcgtgtgatgggactggtgcctgccaagggcctggccacctctgtcctgctgtcaccggacttcctctgggatgtgccttccaactggacgctggaggaggcggcctcggtgcctgtcgtctacagcacggcctactacgcgctggtggtgcgtgggcgggtgcgccccggggagacgctgctcatccactcgggctcgggcggcgtgggccaggccgccatcgccatcgccctcagtctgggctgccgcgtcttcaccaccgtggggtcggctgagaagcgggcgtacctccaggccaggttcccccagctcgacagcaccagcttcgccaactcccgggacacatccttcgagcagcatgtgctgtggcacacgggcgggaagggcgttgacctggtcttgaactccttggcggaagagaagctgcaggccagcgtgaggtgcttggctacgcacggtcgcttcctggaaattggcaaattcgacctttctcagaaccacccgctcggcatggctatcttcctgaagaacgtgacattccacggggtcctactggatgcgttcttcaacgagagcagtgctgactggcgggaggtgtgggcgcttgtgcaggccggcatccgggatggggtggtacggcccctcaagtgcacggtgttccatggggcccaggtggaggacgccttccgctacatggcccaagggaagcacattggcaaagtcgtcgtgcaggtgcttgcggaggagccggaggcagtgctgaagggggccaaacccaagctgatgtcggccatctccaagaccttctgcccggcccacaagagctacatcatcgctggtggtctgggtggcttcggcctggagttggcgcagtggctgatacagcgtggggtgcagaagctcgtgttgacttctcgctccgggatccggacaggctaccaggccaagcaggtccgccggtggaggcgccagggcgtacaggtgcaggtgtccaccagcaacatcagctcactggagggggcccggggcctcattgccgaggcggcgcagcttgggcccgtgggcggcgtcttcaacctggccgtggtcttgagagatggcttgctggagaaccagaccccagagttcttccaggacgtctgcaagcccaagtacagcggcaccctgaacctggacagggtgacccgagaggcgtgccctgagctggactactttgtggtcttctcctctgtgagctgcgggcgtggcaatgcgggacagagcaactacggctttgccaattccgccatggagcgtatctgtgagaaacgccggcacgaaggcctcccaggcctggccgtgcagtggggcgccatcggcgacgtgggcattttggtggagacgatgagcaccaacgacacgatcgtcagtggcacgctgccccagcgcatggcgtcctgcctggaggtgctggacctcttcctgaaccagccccacatggtcctgagcagctttgtgctggctgagaaggctgcggcctatagggacagggacagccagcgggacctggtggaggccgtggcacacatcctgggcatccgcgacttggctgctgtcaacctggacagctcactggcggacctgggcctggactcgctcatgagcgtggaggtgcgccagacgctggagcgtgagctcaacctggtgctgtccgtgcgcgaggtgcggcaactcacgctccggaaactgcaggagctgtcctcaaaggcggatgaggccagcgagctggcatgccccacgcccaaggaggatggtctggcccagcagcagactcagctgaacctgcgctccctgctggtgaacccggagggccccaccctgatgcggctcaactccgtgcagagctcggagcggcccctgttcctggtgcacccaatcgagggctccaccaccgtgttccacagcctggcctcccggctcagcatccccacctatggcctgcagtgcacccgagctgcgccccttgacagcatccacagcctggctgcctactacatcgactgcatcaggcaggtgcagcccgagggcccctaccgcgtggccggctactcctacggggcctgcgtggcctttgaaatgtgctcccagctgcaggcccagcagagcccagcccccacccacaacagcctcttcctgttcgacggctcgcccacctacgtactggcctacacccagagctaccgggcaaagctgaccccaggctgtgaggctgaggctgagacggaggccatatgcttcttcgtgcagcagttcacggacatggagcacaacagggtgctggaggcgctgctgccgctgaagggcctagaggagcgtgtggcagccgccgtggacctgatcatcaagagccaccagggcctggaccgccaggagctgagctttgcggcccggtccttctactacaagctgcgtgccgctgagcagtacacacccaaggccaagtaccatggcaacgtgatgctactgcgcgccaagacgggtggcgcctacggcgaggacctgggcgcggactacaacctctcccaggtatgcgacgggaaagtatccgtccacgtcatcgagggtgaccaccgcacgctgctggagggcagcggcctggagtccatcatcagcatcatccacagctccctggctgagccacgcgtgagcgtgcgggagggctaggcccgtgcccccgcctgccaccggaggtcactccaccatccccaccccaccccaccccacccccgccatgcaacgggattgaagggtcctgccggtgggaccctgtccggcccagtgccactgccccccgaggctgctagatgtaggtgttaggcatgtcccacccacccgccgcctcccacggcacctcggggacaccagagctgccgacttggagactcctggtctgtgaagagccggtggtgcccgtgcccgcaggaactgggctgggcctcgtgcgcccgtggggtctgcgcttggtctttctgtgcttggatttgcatatttattgcattgctggtagagacccccaggcctgtccaccctgccaagactcctcaggcagcgtgtgggtcccgcactctgcccccatttccccatttccccgtggggtgctgcccttatgcccggcgccgggcaccaactccatgtttggtgtttgtctgtgtttgtttttcaagaaatgattcaaattgc

SEQ ID NO: 658561 - DNA, 149 bp, Homo sapiens
ctccgtatcactcccaattaatctttccattttcgtctgcgtttagtaaatagcgttaactaggctttcaaatgacgccacttctccctgcgtcatggattcaaggtcttataatcaccttaggtaaactctctattttcaacagcatc

SEQ ID NO: 658562 - DNA, 7434 bp, Homo sapiens
  misc_feature (7341)..(7341): n is a, c, g, or t
  misc_feature (7343)..(7343): n is a, c, g, or t
  misc_feature (7351)..(7351): n is a, c, g, or t
atggaggaggtggtgattgccggcatgttcgggaagctgccagagtcggagaacttgcaggagttctgggacaacctcatcggcggtgtggacatggtcacggacgatgaccgtcgctggaaggctgggctctacggcctgccccggcggtccggcaagctgaaggacctgtctaggtttgatgcctccttcttcggagtccaccccaagcaggcacacacgatggaccctcagctgcggctgctgctggaagctacctatgaagccatcgtggacggaggcatcaacccagattcactccgaggaacacacactggcgtctgggtgggcgtgagcggctctgagacctcggaggccctgagccgagaccccgagacactcgtgggctacagcatggtgggctgccagcgagcgatgatggccaaccggctctccttcttcttcgacttcagagggcccagcatcgcactggacacagcctgctcctccagcctgatggccctgcagaacgcctaccaggccatccacagcgggcagtgccctgccgccatcgtggggggcatcaacgtcctgctgaagcccaacacctccgtgcagttcttgaggctggggatgctcagccccgagggcacctgcaaggccttcgacacagcggggaatgggtactgccgctcggagggtgtggtggctgtcctgctgaccaagaagtccctggcccggaaggtctacaccaccatcctgaacaaaggcaccaatacagatggcttcaaggagcaaggcgtgaccttccctcaggatatccaggagcagcctatccgctcgttgtaccagtcggccggagtggcccctgagtcatttgaatacatcgaagcccacggaccaggcaccaaggtgggcgacccccaggagcgtaatggcatcacccgagccctgtgcgccacccgccaggagccgctgctcatcggctccaccaagtccaacatggggcacccggagccagcctcggggctcgacgccctggccaaggtgctgctgtccctggagcacgggctctgggcccccaacctgcacttccatagccccaaccctgagatcccagcgctgttggatgggcggctgcaggtggtggaccagcccctgcccgtccgtggcggcaacgtgggcatcaactcctttggcttcgggggctccaacatgcacatcatcctgaggcccaacacgcagtccgcccccgcacccgccccacatgccaccctgccccgtctgctgcgggccagcggacgcacccctgaggccgtgcagaagctgctggagcagggcctccggcacagccagggcctggctttcctgagcatgctgaacgacatcgcggctgtccccgccaccgccatgcccttccgtggctacgctgtgctgggtggtgagacgcggtggcccagagtgcagcaggtgcccgctggcgagcgcccgctctggttcatctgctctgggatgggcacacagtggcgtggaatggggctgagccttatgcgcctggaccgcttccgagattccatcctacgctccgatgaggctgtgaaccgattcggcctgaaggtgtcacagctgctgctgagcacagacgagagcacctttgatgacatcgtccattcgtttgtgagcctgactgccatccagataggcctcatagacctgctgagctgcatgggacctgaggcagatggcatcgtcggccactccctgggggagtggctgtcggtacgcgacggctgcctgtcccaggaggaggccgtcctcgctgcctactggaggggacagtgcatcaaagaagccccacttcccgccggcgccatggcagccgtgggcttgtcctgggaggagtgtaaacagcgctgcccccctgcggtggtgcccgcctgccacaactccaaggacacagtcaccatctcgggacctcaggccccggtgtttgagttcgtggagcagctgaggaaggagggtgtgtttgccaaggaggtgcggaccggcggtatggccttccactcctacttcatggaggccatcgcacccccactgctgcaggagctcaagaaggtgatccgggagccgaagccacgttcagcccgctggctcagcacctctatccccgaggcccagtggcacagcagcctggcacgcacgtcttccgccgagtacaatgtcaacaacctggtgagccctgtgctgttccaggaggccctgtggcacgtgcctgagcacgcggtggtgctggagatcgccccgaccccgtgccctcaggctgtcctgaagcgggtccgtaagccgagctgcaccatcatcccccgtatgaagaaggatcacagggacaacctggagttcttcctggccggcatcggcaggctgcacctctcaggcatcgacgccaaccccaatgccttgttcccacctgtggagtccccagctccccgaggaactcccctcatctccccactcatcaagtgggaccacagcctggcctgggacgcgccggccgccgaggacttccccaacggttcaggttccccctcagccaccatctacacatgcacaccaagctccgagtctcctgaccgctacctggtggaccacaccatcgacggtcgcgtcctcttccccgccactggctacctgagcatagtgtggaagacgctggcccgcgcctgggctgggctcgagcagctgcctgtggtgtttgaggatgtggtgcagcaccaggccaccatcctgcccaagactgggacagtgtccttggaggtacggctcctggaggccaccggtgccttcgaggtgtcagagaacggcaacctggtagtgagtgggaaggtgtaccagtgggatgaccctgaccccaggctcttcgaccacccggaaagtccccaccccaattccccacggagtcccctcttcctggcccaggcagaagtttacaaggagctgcgtctgcgtggctacgactacggccctcatttccagggcatcctggaggccagcctggaaggtgactcggggaggctgctgtggaaggataactgggtgagcttcatggacaccatgctgcagatgtccatcctgggctcggccaagcacggcctgtacctacccacccgtgtcaccgccatccacatcgaccctgccacccacaggcagaagctgtacacactgcaggacaaggcccaagtggctgacgtggtggtgagcaggtggccgagggtcacagtggcgggaggcgtccacatctccgggctccacactgagtcggccccgcggcggcagcaggagcagcaggtgcccatcctggagaagttttgcttcactccccacacggaggaggggtgcctgtctgagcgcgctgccctgcaggaggagctgcaactgtgcaaggggctggtgcaggcactgcagaccaaggtgacccagcaggggctgaagatggtggtgcccggactggatggggcccagatcccccgggacccctcacagcaggaactgccccggctgttgtcggctgcctgcaggcttcagctcaacgggaacctgcagctggagctggcgcaggtgctggcccaggagaggcccaagctgccagaggaccctctgctcagcggcctcctggactccccggcactcaaggcctgcctggacactgccgtggagaacatgcccagcctgaagatgaaggtggtggaggtgctggctggccacggtcacctgtattcccgcatcccaggcctgctcagcccccatcccctgctgcagctgagctacacggccaccgaccgccacccccaggccctggaggctgccaggccgagctgcagcagcacgacgttgcccagggccagtgggatcccgcagaccctgcccccagcgccctgggcagcgccgacctcctggtgtgcaactgtgctgtggctgccctcggggacccggcctcagctctcagcaacatggtggctgccctgagagaagggggctttctgctcctgcacacactgctccgggggcaccccctcggggacatcgtggccttcctcacctccactgagccgcagtatggccagggcatcctgagccaggacgcgtgggagagcctcttctccagggtgtcgctgcgcctggtgggcctgaagaagtccttctacggctccacgctcttcctgtgccgccggcccaccccgcaggacagccccatcttcctgccggtggacgataccagcttccgctgggtggagtctctgaagggcatcctggctgacgaagactcttcccggcctgtgtggctgaaggccatcaactgtgccacctcgggcgtggtgggcttggtgaactgtctccgccgagagcccggcgggaaccgcctccggtgtgtgctgctctccaacctcagcagcacctcccacgtcccggaggtggacccgggctccgcagaactgcagaaggtgttgcagggagacctggtgatgaacgtctaccgcgacggggcctggggggctttccgccacttcctgctggaggaggacaagcctgaggagccgacggcacatgcctttgtgagcaccctcacccggggggacctgtcctccatccgctgggtctgctcctcgctgcgccatgcccagcccacctgccctggcgcccagctctgcacggtctactacgcctccctcaacttccgcgacatcatgctggccactggcaagctgtcccctgatgccatcccagggaagtggacctcccaggacagcctgctaggtatggagttctcgggccgagacgccagcggcaagcgtgtgatgggactggtgcctgccaagggcctggccacctctgtcctgctgtcaccggacttcctctgggatgtgccttccaactggacgctggaggaggcggcctcggtgcctgtcgtctacagcacggcctactacgcgctggtggtgcgtgggcgggtgcgccccggggagacgctgctcatccactcgggctcgggcggcgtgggccaggccgccatcgccatcgccctcagtctgggctgccgcgtcttcaccaccgtggggtcggctgagaagcgggcgtacctccaggccaggttcccccagctcgacagcaccagcttcgccaactcccgggacacatccttcgagcagcatgtgctgtggcacacgggcgggaagggcgttgacctggtcttgaactccttggcggaagagaagctgcaggccagcgtgaggtgcttggctacgcacggtcgcttcctggaaattggcaaattcgacctttctcagaaccacccgctcggcatggctatcttcctgaagaacgtgacattccacggggtcctactggatgcgttcttcaacgagagcagtgctgactggcgggaggtgtgggcgcttgtgcaggccggcatccgggatggggtggtacggcccctcaagtgcacggtgttccatggggcccaggtggaggacgccttccgctacatggcccaagggaagcacattggcaaagtcgtcgtgcaggtgcttgcggaggagccggaggcagtgctgaagggggccaaacccaagctgatgtcggccatctccaagaccttctgcccggcccacaagagctacatcatcgctggtggtctgggtggcttcggcctggagttggcgcagtggctgatacagcgtggggtgcagaagctcgtgttgacttctcgctccgggatccggacaggctaccaggccaagcaggtccgccggtggaggcgccagggcgtacaggtgcaggtgtccaccagcaacatcagctcactggagggggcccggggcctcattgccgaggcggcgcagcttgggcccgtgggcggcgtcttcaacctggccgtggtcttgagagatggcttgctggagaaccagaccccagagttcttccaggacgtctgcaagcccaagtacagcggcaccctgaacctggacagggtgacccgagaggcgtgccctgagctggactactttgtggtcttctcctctgtgagctgcgggcgtggcaatgcgggacagagcaactacggctttgccaattccgccatggagcgtatctgtgagaaacgccggcacgaaggcctcccaggcctggccgtgcagtggggcgccatcggcgacgtgggcattttggtggagacgatgagcaccaacgacacgatcgtcagtggcacgctgccccagcgcatggcgtcctgcctggaggtgctggacctcttcctgaaccagccccacatggtcctgagcagctttgtgctggctgagaaggctgcggcctatagggacagggacagccagcgggacctggtggaggccgtggcacacatcctgggcatccgcgacttggctgctgtcaacctggacagctcactggcggacctgggcctggactcgctcatgagcgtggaggtgcgccagacgctggagcgtgagctcaacctggtgctgtccgtgcgcgaggtgcggcaactcacgctccggaaactgcaggagctgtcctcaaaggcggatgaggccagcgagctggcatgccccacgcccaaggaggatggtctggcccagcagcagactcagctgaacctgcgctccctgctggtgaacccggagggccccaccctgatgcggctcaactccgtgcagagctcggagcggcccctgttcctggtgcacccaatcgagggctccaccaccgtgttccacagcctggcctcccggctcagcatccccacctatggcctgcagtgcacccgagctgcgccccttgacagcatccacagcctggctgcctactacatcgactgcatcaggcaggtgcagcccgagggcccctaccgcgtggccggctactcctacggggcctgcgtggcctttgaaatgtgctcccagctgcaggcccagcagagcccagcccccacccacaacagcctcttcctgttcgacggctcgcccacctacgtactggcctacacccagagctaccgggcaaagctgaccccaggctgtgaggctgaggctgagacggaggccatatgcttcttcgtgcagcagttcacggacatggagcacaacagggtgctggaggcgctgctgccgctgaagggcctagaggagcgtgtggcagccgccgtggacctgatcatcaagagccaccagggcctggaccgccaggagctgagctttgcggcccggtccttctactacaagctgcgtgccgctgagcagtacacacccaaggccaagtaccatggcaacgtgatgctactgcgcgccaagncntgtggctnggggcccctctcggccggccttggctcagcccgctgagtggggggtcgtgggccacgtccccggaggaggctggtggccttta

SEQ ID NO: 658563 - DNA, 254 bp, Homo sapiens
  misc_feature (170)..(170): n is a, c, g, or t
gttccctatacacgagatacactggctgggtggtttataacctgtataacccaactaagtaatctttcccctctctttaacttttatgcaccaccctggcgcttctagatactatacactcacactaaataataataaaagaccacaccttccatctgatcattctgggncggaaactgaatacagttttgagccgatctttcgagaaagattcatatacacgagaaattaactagttctgttggtggtatcag

SEQ ID NO: 658564 - DNA, 7990 bp, Homo sapiens
atggaggaggtggtgattgccggcatgttcgggaagctgccagagtcggagaacttgcaggagttctgggacaacctcatcggcggtgtggacatggtcacggacgatgaccgtcgctggaaggctgggctctacggcctgccccggcggtccggcaagctgaaggacctgtctaggtttgatgcctccttcttcggagtccaccccaagcaggcacacacgatggaccctcagctgcggctgctgctggaagctacctatgaagccatcgtggacggaggcatcaacccagattcactccgaggaacacacactggcgtctgggtgggcgtgagcggctctgagacctcggaggccctgagccgagaccccgagacactcgtgggctacagcatggtgggctgccagcgagcgatgatggccaaccggctctccttcttcttcgacttcagagggcccagcatcgcactggacacagcctgctcctccagcctgatggccctgcagaacgcctaccaggccatccacagcgggcagtgccctgccgccatcgtggggggcatcaacgtcctgctgaagcccaacacctccgtgcagttcttgaggctggggatgctcagccccgagggcacctgcaaggccttcgacacagcggggaatgggtactgccgctcggagggtgtggtggctgtcctgctgaccaagaagtccctggcccggaaggtctacaccaccatcctgaacaaaggcaccaatacagatggcttcaaggagcaaggcgtgaccttccctcaggatatccaggagcagcctatccgctcgttgtaccagtcggccggagtggcccctgagtcatttgaatacatcgaagcccacggaccaggcaccaaggtgggcgacccccaggagcgtaatggcatcacccgagccctgtgcgccacccgccaggagccgctgctcatcggctccaccaagtccaacatggggcacccggagccagcctcggggctcgacgccctggccaaggtgctgctgtccctggagcacgggctctgggcccccaacctgcacttccatagccccaaccctgagatcccagcgctgttggatgggcggctgcaggtggtggaccagcccctgcccgtccgtggcggcaacgtgggcatcaactcctttggcttcgggggctccaacatgcacatcatcctgaggcccaacacgcagtccgcccccgcacccgccccacatgccaccctgccccgtctgctgcgggccagcggacgcacccctgaggccgtgcagaagctgctggagcagggcctccggcacagccagggcctggctttcctgagcatgctgaacgacatcgcggctgtccccgccaccgccatgcccttccgtggctacgctgtgctgggtggtgagacgcggtggcccagagtgcagcaggtgcccgctggcgagcgcccgctctggttcatctgctctgggatgggcacacagtggcgtggaatggggctgagccttatgcgcctggaccgcttccgagattccatcctacgctccgatgaggctgtgaaccgattcggcctgaaggtgtcacagctgctgctgagcacagacgagagcacctttgatgacatcgtccattcgtttgtgagcctgactgccatccagataggcctcatagacctgctgagctgcatgggacctgaggcagatggcatcgtcggccactccctgggggagtggctgtcggtacgcgacggctgcctgtcccaggaggaggccgtcctcgctgcctactggaggggacagtgcatcaaagaagccccacttcccgccggcgccatggcagccgtgggcttgtcctgggaggagtgtaaacagcgctgcccccctgcggtggtgcccgcctgccacaactccaaggacacagtcaccatctcgggacctcaggccccggtgtttgagttcgtggagcagctgaggaaggagggtgtgtttgccaaggaggtgcggaccggcggtatggccttccactcctacttcatggaggccatcgcacccccactgctgcaggagctcaagaaggtgatccgggagccgaagccacgttcagcccgctggctcagcacctctatccccgaggcccagtggcacagcagcctggcacgcacgtcttccgccgagtacaatgtcaacaacctggtgagccctgtgctgttccaggaggccctgtggcacgtgcctgagcacgcggtggtgctggagatcgccccgaccccgtgccctcaggctgtcctgaagcgggtccgtaagccgagctgcaccatcatcccccgtatgaagaaggatcacagggacaacctggagttcttcctggccggcatcggcaggctgcacctctcaggcatcgacgccaaccccaatgccttgttcccacctgtggagtccccagctccccgaggaactcccctcatctccccactcatcaagtgggaccacagcctggcctgggacgcgccggccgccgaggacttccccaacggttcaggttccccctcagccaccatctacacatgcacaccaagctccgagtctcctgaccgctacctggtggaccacaccatcgacggtcgcgtcctcttccccgccactggctacctgagcatagtgtggaagacgctggcccgcgcctgggctgggctcgagcagctgcctgtggtgtttgaggatgtggtgcagcaccaggccaccatcctgcccaagactgggacagtgtccttggaggtacggctcctggaggccaccggtgccttcgaggtgtcagagaacggcaacctggtagtgagtgggaaggtgtaccagtgggatgaccctgaccccaggctcttcgaccacccggaaagtccccaccccaattccccacggagtcccctcttcctggcccaggcagaagtttacaaggagctgcgtctgcgtggctacgactacggccctcatttccagggcatcctggaggccagcctggaaggtgactcggggaggctgctgtggaaggataactgggtgagcttcatggacaccatgctgcagatgtccatcctgggctcggccaagcacggcctgtacctacccacccgtgtcaccgccatccacatcgaccctgccacccacaggcagaagctgtacacactgcaggacaaggcccaagtggctgacgtggtggtgagcaggtggccgagggtcacagtggcgggaggcgtccacatctccgggctccacactgagtcggccccgcggcggcagcaggagcagcaggtgcccatcctggagaagttttgcttcactccccacacggaggaggggtgcctgtctgagcgcgctgccctgcaggaggagctgcaactgtgcaaggggctggtgcaggcactgcagaccaaggtgacccagcaggggctgaagatggtggtgcccggactggatggggcccagatcccccgggacccctcacagcaggaactgccccggctgttgtcggctgcctgcaggcttcagctcaacgggaacctgcagctggagctggcgcaggtgctggcccaggagaggcccaagctgccagaggaccctctgctcagcggcctcctggactccccggcactcaaggcctgcctggacactgccgtggagaacatgcccagcctgaagatgaaggtggtggaggtgctggctggccacggtcacctgtattcccgcatcccaggcctgctcagcccccatcccctgctgcagctgagctacacggccaccgaccgccacccccaggccctggaggctgccaggccgagctgcagcagcacgacgttgcccagggccagtgggatcccgcagaccctgcccccagcgccctgggcagcgccgacctcctggtgtgcaactgtgctgtggctgccctcggggacccggcctcagctctcagcaacatggtggctgccctgagagaagggggctttctgctcctgcacacactgctccgggggcaccccctcggggacatcgtggccttcctcacctccactgagccgcagtatggccagggcatcctgagccaggacgcgtgggagagcctcttctccagggtgtcgctgcgcctggtgggcctgaagaagtccttctacggctccacgctcttcctgtgccgccggcccaccccgcaggacagccccatcttcctgccggtggacgataccagcttccgctgggtggagtctctgaagggcatcctggctgacgaagactcttcccggcctgtgtggctgaaggccatcaactgtgccacctcgggcgtggtgggcttggtgaactgtctccgccgagagcccggcgggaaccgcctccggtgtgtgctgctctccaacctcagcagcacctcccacgtcccggaggtggacccgggctccgcagaactgcagaaggtgttgcagggagacctggtgatgaacgtctaccgcgacggggcctggggggctttccgccacttcctgctggaggaggacaagcctgaggagccgacggcacatgcctttgtgagcaccctcacccggggggacctgtcctccatccgctgggtctgctcctcgctgcgccatgcccagcccacctgccctggcgcccagctctgcacggtctactacgcctccctcaacttccgcgacatcatgctggccactggcaagctgtcccctgatgccatcccagggaagtggacctcccaggacagcctgctaggtatggagttctcgggccgagacgccagcggcaagcgtgtgatgggactggtgcctgccaagggcctggccacctctgtcctgctgtcaccggacttcctctgggatgtgccttccaactggacgctggaggaggcggcctcggtgcctgtcgtctacagcacggcctactacgcgctggtggtgcgtgggcgggtgcgccccggggagacgctgctcatccactcgggctcgggcggcgtgggccaggccgccatcgccatcgccctcagtctgggctgccgcgtcttcaccaccgtggggtcggctgagaagcgggcgtacctccaggccaggttcccccagctcgacagcaccagcttcgccaactcccgggacacatccttcgagcagcatgtgctgtggcacacgggcgggaagggcgttgacctggtcttgaactccttggcggaagagaagctgcaggccagcgtgaggtgcttggctacgcacggtcgcttcctggaaattggcaaattcgacctttctcagaaccacccgctcggcatggctatcttcctgaagaacgtgacattccacggggtcctactggatgcgttcttcaacgagagcagtgctgactggcgggaggtgtgggcgcttgtgcaggccggcatccgggatggggtggtacggcccctcaagtgcacggtgttccatggggcccaggtggaggacgccttccgctacatggcccaagggaagcacattggcaaagtcgtcgtgcaggtgcttgcggaggagccggaggcagtgctgaagggggccaaacccaagctgatgtcggccatctccaagaccttctgcccggcccacaagagctacatcatcgctggtggtctgggtggcttcggcctggagttggcgcagtggctgatacagcgtggggtgcagaagctcgtgttgacttctcgctccgggatccggacaggctaccaggccaagcaggtccgccggtggaggcgccagggcgtacaggtgcaggtgtccaccagcaacatcagctcactggagggggcccggggcctcattgccgaggcggcgcagcttgggcccgtgggcggcgtcttcaacctggccgtggtcttgagagatggcttgctggagaaccagaccccagagttcttccaggacgtctgcaagcccaagtacagcggcaccctgaacctggacagggtgacccgagaggcgtgccctgagctggactactttgtggtcttctcctctgtgagctgcgggcgtggcaatgcgggacagagcaactacggctttgccaattccgccatggagcgtatctgtgagaaacgccggcacgaaggcctcccaggcctggccgtgcagtggggcgccatcggcgacgtgggcattttggtggagacgatgagcaccaacgacacgatcgtcagtggcacgctgccccagcgcatggcgtcctgcctggaggtgctggacctcttcctgaaccagccccacatggtcctgagcagctttgtgctggctgagaaggctgcggcctatagggacagggacagccagcgggacctggtggaggccgtggcacacatcctgggcatccgcgacttggctgctgtcaacctggacagctcactggcggacctgggcctggactcgctcatgagcgtggaggtgcgccagacgctggagcgtgagctcaacctggtgctgtccgtgcgcgaggtgcggcaactcacgctccggaaactgcaggagctgtcctcaaaggcggatgaggccagcgagctggcatgccccacgcccaaggaggatggtctggcccagcagcagactcagctgaacctgcgctccctgctggtgaacccggagggccccaccctgatgcggctcaactccgtgcagagctcggagcggcccctgttcctggtgcacccaatcgagggctccaccaccgtgttccacagcctggcctcccggctcagcatccccacctatggcctgcagtgcacccgaggcaggtgcagcccgagggcccctaccgcgtggccggctactcctacggggcctgcgtggcctttgaaatgtgctcccagctgcaggcccagcagagcccagcccccacccacaacagcctcttcctgttcgacggctcgcccacctacgtactggcctacacccagagctaccgggcaaagctgaccccaggctgtgaggctgaggctgagacggaggccatatgcttcttcgtgcagcagttcacggacatggagcacaacagggtgctggaggcgctgctgccgctgaagggcctagaggagcgtgtggcagccgccgtggacctgatcatcaagagccaccagggcctggaccgccaggagctgagctttgcggcccggtccttctactacaagctgcgtgccgctgagcagtacacacccaaggccaagtaccatggcaacgtgatgctactgcgcgccaagacgggtggcgcctacggcgaggacctgggcgcggactacaacctctcccaggtatgcgacgggaaagtatccgtccacgtcatcgagggtgaccaccgcacgctgctggagggcagcggcctggagtccatcatcagcatcatccacagctccctggctgagccacgcgtgagcgtgcgggagggctaggcccgtgcccccgcctgccaccggaggtcactccaccatccccaccccaccccaccccacccccgccatgcaacgggattgaagggtcctgccggtgggaccctgtccggcccagtgccactgccccccgaggctgctagatgtaggtgttaggcatgtcccacccacccgccgcctcccacggcacctcggggacaccagagctgccgacttggagactcctggtctgtgaagagccggtggtgcccgtgcccgcaggaactgggctgggcctcgtgcgcccgtggggtctgcgcttggtctttctgtgcttggatttgcatatttattgcattgctggtagagacccccaggcctgtccaccctgccaagactcctcaggcagcgtgtgggtcccgcactctgcccccatttccccatttccccgtggggtgctgcccttatgcccggcgccgggcaccaactccatgtttggtgtttgtctgtgtttgtttttcaagaaatgattcaaattgc

SEQ ID NO: 658565 - DNA, 1221 bp, Homo sapiens
tgatccgctgctgaatctgagcgcatctggcgatgtatctccgcagggctgtgtccaagactctggcgctgccccggagggcgcccccgggtcccgcgccgctggggaaggacgcatctcttcgccgaatgtcatccaggaaattccctggaacatctggctccaatatgatctattacctggttgtaggtgtgacagtcagtgctggtggatattacacttacaaggctttaacatcaaagcaagtgagacgtacagaacatgtagctgaaccgaaagaacaaacaaaggcggagttgcaaccacttccaggtgaaaaggaagagcatgtggcagaagccgagcaagtgtgttcagagcctggagacactgctgtaacggaagctgaatcggtagatgctgaggaagtcccagaggctgcagttgtgcttccagaagagtctcaggcctccgccccctccgaggtccctgccgaagctgccgtggtggaggcatccttatcgagctcagagcctgagctgaagataaccgaggcttccctggtggagactaccgagagtgtccctgagtctactcaggaggtggagagtgcagccccagaccaggatgacgtttgcaatgagggggctgatactagccaggagggcgctgataccagccaggagggggctgataccagccaggagggcgctgataccaccaaggaggaggctgataacagcaaggaggctgaaggtaccactactgaggacccgcgctcgatctccgaggagagtgccgaactagaagaaagccctcccttaggctcagaaccccctgcccagcctgagtcacaagaagaagaaacccaggtcacagaggaaacagcatcaccccaaggttgatctgcaaaattctatagttgcttttgtatttttagtgaccttagcccttcttcctagaatattttaatataccttaaagaatttaactttactaatagatatttgattgggagttggtattttacaagtcttaatagtttttccaccctctaaaatcaggctgtgttaagaccttaaatagtgttaagtttggatttaagttttacgttttagaaactgagttatctatgcaaccggtgtcactttgattttcctttgcctttctcttactttgttctatgtaagaccagattactgggtttgctgtgaactcatttaaataaaattagaaaatcct

SEQ ID NO: 658566 - DNA, 357 bp, Homo sapiens
cttcaccagctaaagacagtaaggacaaataacatcaccatttaaaaaaaaacaaaaaacaaacaggctgggaacggtggctcacgcctgtaatcccaacactttgggaggccaagcgggggcaggtcggatcacttaaggtcaggagttcgagaccagcctggccaacatggcgaaatccgcctctatctaagaataacaaacattagctaggcatggtagtgcagtacctgtaaccccagtctactcaggaggcttgaggcaggagaatggcgtgaacccgggaggcagagtgtgcagtgagccgggattgcgccactgcactccagcctgggtgacagagcgcaactttgtatc

SEQ ID NO: 658567 - DNA, 7523 bp, Homo sapiens
atggaggaggtggtgattgccggcatgttcgggaagctgccagagtcggagaacttgcaggagttctgggacaacctcatcggcggtgtggacatggtcacggacgatgaccgtcgctggaaggctgggctctacggcctgccccggcggtccggcaagctgaaggacctgtctaggtttgatgcctccttcttcggagtccaccccaagcaggcacacacgatggaccctcagctgcggctgctgctggaagctacctatgaagccatcgtggacggaggcatcaacccagattcactccgaggaacacacactggcgtctgggtgggcgtgagcggctctgagacctcggaggccctgagccgagaccccgagacactcgtgggctacagcatggtgggctgccagcgagcgatgatggccaaccggctctccttcttcttcgacttcagagggcccagcatcgcactggacacagcctgctcctccagcctgatggccctgcagaacgcctaccaggccatccacagcgggcagtgccctgccgccatcgtggggggcatcaacgtcctgctgaagcccaacacctccgtgcagttcttgaggctggggatgctcagccccgagggcacctgcaaggccttcgacacagcggggaatgggtactgccgctcggagggtgtggtggctgtcctgctgaccaagaagtccctggcccggaaggtctacaccaccatcctgaacaaaggcaccaatacagatggcttcaaggagcaaggcgtgaccttccctcaggatatccaggagcagcctatccgctcgttgtaccagtcggccggagtggcccctgagtcatttgaatacatcgaagcccacggaccaggcaccaaggtgggcgacccccaggagcgtaatggcatcacccgagccctgtgcgccacccgccaggagccgctgctcatcggctccaccaagtccaacatggggcacccggagccagcctcggggctcgacgccctggccaaggtgctgctgtccctggagcacgggctctgggcccccaacctgcacttccatagccccaaccctgagatcccagcgctgttggatgggcggctgcaggtggtggaccagcccctgcccgtccgtggcggcaacgtgggcatcaactcctttggcttcgggggctccaacatgcacatcatcctgaggcccaacacgcagtccgcccccgcacccgccccacatgccaccctgccccgtctgctgcgggccagcggacgcacccctgaggccgtgcagaagctgctggagcagggcctccggcacagccagggcctggctttcctgagcatgctgaacgacatcgcggctgtccccgccaccgccatgcccttccgtggctacgctgtgctgggtggtgagacgcggtggcccagagtgcagcaggtgcccgctggcgagcgcccgctctggttcatctgctctgggatgggcacacagtggcgtggaatggggctgagccttatgcgcctggaccgcttccgagattccatcctacgctccgatgaggctgtgaaccgattcggcctgaaggtgtcacagctgctgctgagcacagacgagagcacctttgatgacatcgtccattcgtttgtgagcctgactgccatccagataggcctcatagacctgctgagctgcatgggacctgaggcagatggcatcgtcggccactccctgggggagtggctgtcggtacgcgacggctgcctgtcccaggaggaggccgtcctcgctgcctactggaggggacagtgcatcaaagaagccccacttcccgccggcgccatggcagccgtgggcttgtcctgggaggagtgtaaacagcgctgcccccctgcggtggtgcccgcctgccacaactccaaggacacagtcaccatctcgggacctcaggccccggtgtttgagttcgtggagcagctgaggaaggagggtgtgtttgccaaggaggtgcggaccggcggtatggccttccactcctacttcatggaggccatcgcacccccactgctgcaggagctcaagaaggtgatccgggagccgaagccacgttcagcccgctggctcagcacctctatccccgaggcccagtggcacagcagcctggcacgcacgtcttccgccgagtacaatgtcaacaacctggtgagccctgtgctgttccaggaggccctgtggcacgtgcctgagcacgcggtggtgctggagatcgccccgaccccgtgccctcaggctgtcctgaagcgggtccgtaagccgagctgcaccatcatcccccgtatgaagaaggatcacagggacaacctggagttcttcctggccggcatcggcaggctgcacctctcaggcatcgacgccaaccccaatgccttgttcccacctgtggagtccccagctccccgaggaactcccctcatctccccactcatcaagtgggaccacagcctggcctgggacgcgccggccgccgaggacttccccaacggttcaggttccccctcagccaccatctacacatgcacaccaagctccgagtctcctgaccgctacctggtggaccacaccatcgacggtcgcgtcctcttccccgccactggctacctgagcatagtgtggaagacgctggcccgcgcctgggctgggctcgagcagctgcctgtggtgtttgaggatgtggtgcagcaccaggccaccatcctgcccaagactgggacagtgtccttggaggtacggctcctggaggccaccggtgccttcgaggtgtcagagaacggcaacctggtagtgagtgggaaggtgtaccagtgggatgaccctgaccccaggctcttcgaccacccggaaagtccccaccccaattccccacggagtcccctcttcctggcccaggcagaagtttacaaggagctgcgtctgcgtggctacgactacggccctcatttccagggcatcctggaggccagcctggaaggtgactcggggaggctgctgtggaaggataactgggtgagcttcatggacaccatgctgcagatgtccatcctgggctcggccaagcacggcctgtacctacccacccgtgtcaccgccatccacatcgaccctgccacccacaggcagaagctgtacacactgcaggacaaggcccaagtggctgacgtggtggtgagcaggtggccgagggtcacagtggcgggaggcgtccacatctccgggctccacactgagtcggccccgcggcggcagcaggagcagcaggtgcccatcctggagaagttttgcttcactccccacacggaggaggggtgcctgtctgagcgcgctgccctgcaggaggagctgcaactgtgcaaggggctggtgcaggcactgcagaccaaggtgacccagcaggggctgaagatggtggtgcccggactggatggggcccagatcccccgggacccctcacagcaggaactgccccggctgttgtcggctgcctgcaggcttcagctcaacgggaacctgcagctggagctggcgcaggtgctggcccaggagaggcccaagctgccagaggaccctctgctcagcggcctcctggactccccggcactcaaggcctgcctggacactgccgtggagaacatgcccagcctgaagatgaaggtggtggaggtgctggctggccacggtcacctgtattcccgcatcccaggcctgctcagcccccatcccctgctgcagctgagctacacggccaccgaccgccacccccaggccctggaggctgccaggccgagctgcagcagcacgacgttgcccagggccagtgggatcccgcagaccctgcccccagcgccctgggcagcgccgacctcctggtgtgcaactgtgctgtggctgccctcggggacccggcctcagctctcagcaacatggtggctgccctgagagaagggggctttctgctcctgcacacactgctccgggggcaccccctcggggacatcgtggccttcctcacctccactgagccgcagtatggccagggcatcctgagccaggacgcgtgggagagcctcttctccagggtgtcgctgcgcctggtgggcctgaagaagtccttctacggctccacgctcttcctgtgccgccggcccaccccgcaggacagccccatcttcctgccggtggacgataccagcttccgctgggtggagtctctgaagggcatcctggctgacgaagactcttcccggcctgtgtggctgaaggccatcaactgtgccacctcgggcgtggtgggcttggtgaactgtctccgccgagagcccggcgggaaccgcctccggtgtgtgctgctctccaacctcagcagcacctcccacgtcccggaggtggacccgggctccgcagaactgcagaaggtgttgcagggagacctggtgatgaacgtctaccgcgacggggcctggggggctttccgccacttcctgctggaggaggacaagcctgaggagccgacggcacatgcctttgtgagcaccctcacccggggggacctgtcctccatccgctgggtctgctcctcgctgcgccatgcccagcccacctgccctggcgcccagctctgcacggtctactacgcctccctcaacttccgcgacatcatgctggccactggcaagctgtcccctgatgccatcccagggaagtggacctcccaggacagcctgctaggtatggagttctcgggccgagacgccagcggcaagcgtgtgatgggactggtgcctgccaagggcctggccacctctgtcctgctgtcaccggacttcctctgggatgtgccttccaactggacgctggaggaggcggcctcggtgcctgtcgtctacagcacggcctactacgcgctggtggtgcgtgggcgggtgcgccccggggagacgctgctcatccactcgggctcgggcggcgtgggccaggccgccatcgccatcgccctcagtctgggctgccgcgtcttcaccaccgtggggtcggctgagaagcgggcgtacctccaggccaggttcccccagctcgacagcaccagcttcgccaactcccgggacacatccttcgagcagcatgtgctgtggcacacgggcgggaagggcgttgacctggtcttgaactccttggcggaagagaagctgcaggccagcgtgaggtgcttggctacgcacggtcgcttcctggaaattggcaaattcgacctttctcagaaccacccgctcggcatggctatcttcctgaagaacgtgacattccacggggtcctactggatgcgttcttcaacgagagcagtgctgactggcgggaggtgtgggcgcttgtgcaggccggcatccgggatggggtggtacggcccctcaagtgcacggtgttccatggggcccaggtggaggacgccttccgctacatggcccaagggaagcacattggcaaagtcgtcgtgcaggtgcttgcggaggagccggaggcagtgctgaagggggccaaacccaagctgatgtcggccatctccaagaccttctgcccggcccacaagagctacatcatcgctggtggtctgggtggcttcggcctggagttggcgcagtggctgatacagcgtggggtgcagaagctcgtgttgacttctcgctccgggatccggacaggctaccaggccaagcaggtccgccggtggaggcgccagggcgtacaggtgcaggtgtccaccagcaacatcagctcactggagggggcccggggcctcattgccgaggcggcgcagcttgggcccgtgggcggcgtcttcaacctggccgtggtcttgagagatggcttgctggactcgctcatgagcgtggaggtgcgccagacgctggagcgtgagctcaacctggtgctgtccgtgcgcgaggtgcggcaactcacgctccggaaactgcaggagctgtcctcaaaggcggatgaggccagcgagctggcatgccccacgcccaaggaggatggtctggcccagcagcagactcagctgaacctgcgctccctgctggtgaacccggagggccccaccctgatgcggctcaactccgtgcagagctcggagcggcccctgttcctggtgcacccaatcgagggctccaccaccgtgttccacagcctggcctcccggctcagcatccccacctatggcctgcagtgcacccgagctgcgccccttgacagcatccacagcctggctgcctactacatcgactgcatcaggcaggtgcagcccgagggcccctaccgcgtggccggctactcctacggggcctgcgtggcctttgaaatgtgctcccagctgcaggcccagcagagcccagcccccacccacaacagcctcttcctgttcgacggctcgcccacctacgtactggcctacacccagagctaccgggcaaagctgaccccaggctgtgaggctgaggctgagacggaggccatatgcttcttcgtgcagcagttcacggacatggagcacaacagggtgctggaggcgctgctgccgctgaagggcctagaggagcgtgtggcagccgccgtggacctgatcatcaagagccaccagggcctggaccgccaggagctgagctttgcggcccggtccttctactacaagctgcgtgccgctgagcagtacacacccaaggccaagtaccatggcaacgtgatgctactgcgcgccaagacgggtggcgcctacggcgaggacctgggcgcggactacaacctctcccaggtatgcgacgggaaagtatccgtccacgtcatcgagggtgaccaccgcacgctgctggagggcagcggcctggagtccatcatcagcatcatccacagctccctggctgagccacgcgtgagcgtgcgggagggctaggcccgtgcccccgcctgccaccggaggtcactccaccatccccaccccaccccaccccacccccgccatgcaacgggattgaagggtcctgccggtgggaccctgtccggcccagtgccactgccccccgaggctgctagatgtaggtgttaggcatgtcccacccacccgccgcctcccacggcacctcggggacaccagagctgccgacttggagactcctggtctgtgaagagccggtggtgcccgtgcccgcaggaactgggctgggcctcgtgcgcccgtggggtctgcgcttggtctttctgtgcttggatttgcatatttattgcattgctggtagagacccccaggcctgtccaccctgccaagactcctcaggcagcgtgtgggtcccgcactctgcccccatttccccatttccccgtggggtgctgcccttatgcccggcgccgggcaccaactccatgtttggtgtttgtctgtgtttgtttttcaagaaatgattcaaattgc

SEQ ID NO: 658568 - DNA, 453 bp, Homo sapiens
ctttcgtcatagctgactcttgaggataaacaactgacgggcgagccgcgaagctggagctggctgtttcccgggctgaaaacctcctgccatagataccttttgctgcaagggagccttctgagtcattagctcctgttgatgcagggctgtggccagctgttgctgttgctgttgttgctgctgctgctgctgcagaagaaattctgcattagctgctgttgagagcctacttgggacaccacagggaactgagcaattgctggttgctgggttgctggatgtactgcctgaaactgctgagtctgggcctgctgctgctggtaaaacgtgcctgccggctgctgctgtgctggcggtggctgttgctgctgctgttgctgcttgaggaagagttgctgctggtgctggggtgtggcctgggcctgagcgggcagaccctgggcctgagta

SEQ ID NO: 658569 - DNA, 209 bp, Homo sapiens
tcgagctcggcaccacttaggacgagataccccaagtagcggcgagcgtaacggggcccaagcccaaaccggatgaaggaaactttgccggggttgaggactgccatacgaactagcccattagccgaaattcctgggaaggaatgccgaagaatgtgaaagccatgtaagcgaaaatggaaaagggacaggcagctcgcccctgagtt

SEQ ID NO: 658570 - DNA, 1597 bp, Homo sapiens
cgggtgccattctgagcgttcttaccccgactcccacctgacgtagcaccgtggggacctgcgtgcgtgtctgtgtgtccttgcgtgggtgccagggctctgcacccagaccagcctggcatctgcccctgtcttcacagagctggcatgccccacgcccaaggaggatggtctggcccagcagcagactcagctgaacctgcgctccctgctggtgaacccggagggccccaccctgatgcggctcaactccgtgcagagctcggagcggcccctgttcctggtgcacccaatcgagggctccaccaccgtgttccacagcctggcctcccggctcagcatccccacctatggcctgcagtgcacccgagctgcgccccttgacagcatccacagcctggctgcctactacatcgactgcatcaggcaggtgcagcccgagggcccctaccgcgtggccggctactcctacggggcctgcgtggcctttgaaatgtgctcccagctgcaggcccagcagagcccagcccccacccacaacagcctcttcctgttcgacggctcgcccacctacgtactggcctacacccagagctaccgggcaaagctgaccccaggctgtgaggctgaggctgagacggaggccatatgcttcttcgtgcagcagttcacggacatggagcacaacagggtgctggaggcgctgctgccgctgaagggcctagaggagcgtgtggcagccgccgtggacctgatcatcaagagccaccagggcctggaccgccaggagctgagctttgcggcccggtccttctactacaagctgcgtgccgctgagcagtacacacccaaggccaagtaccatggcaacgtgatgctactgcgcgccaagacgggtggcgcctacggcgaggacctgggcgcggactacaacctctcccaggtatgcgacgggaaagtatccgtccacgtcatcgagggtgaccaccgcacgctgctggagggcagcggcctggagtccatcatcagcatcatccacagctccctggctgagccacgcgtgagcgtgcgggagggctaggcccgtgcccccgcctgccaccggaggtcactccaccatccccaccccaccccaccccacccccgccatgcaacgggattgaagggtcctgccggtgggaccctgtccggcccagtgccactgccccccgaggctgctagatgtaggtgttaggcatgtcccacccacccgccgcctcccacggcacctcggggacaccagagctgccgacttggagactcctggtctgtgaagagccggtggtgcccgtgcccgcaggaactgggctgggcctcgtgcgcccgtggggtctgcgcttggtctttctgtgcttggatttgcatatttattgcattgctggtagagacccccaggcctgtccaccctgccaagactcctcaggcagcgtgtgggtcccgcactctgcccccatttccccatttccccgtggggtgctgcccttatgcccggcgccgggcaccaactccatgtttggtgtttgtctgtgtttgtttttcaagaaatgattcaaattgc

SEQ ID NO: 658571 - DNA, 6477 bp, Homo sapiens
atggaggaggtggtgattgccggcatgttcgggaagctgccagagtcggagaacttgcaggagttctgggacaacctcatcggcggtgtggacatggtcacggacgatgaccgtcgctggaaggctgggctctacggcctgccccggcggtccggcaagctgaaggacctgtctaggtttgatgcctccttcttcggagtccaccccaagcaggcacacacgatggaccctcagctgcggctgctgctggaagctacctatgaagccatcgtggacggaggcatcaacccagattcactccgaggaacacacactggcgtctgggtgggcgtgagcggctctgagacctcggaggccctgagccgagaccccgagacactcgtgggctacagcatggtgggctgccagcgagcgatgatggccaaccggctctccttcttcttcgacttcagagggcccagcatcgcactggacacagcctgctcctccagcctgatggccctgcagaacgcctaccaggccatccacagcgggcagtgccctgccgccatcgtggggggcatcaacgtcctgctgaagcccaacacctccgtgcagttcttgaggctggggatgctcagccccgagggcacctgcaaggccttcgacacagcggggaatgggtactgccgctcggagggtgtggtggctgtcctgctgaccaagaagtccctggcccggaaggtctacaccaccatcctgaacaaaggcaccaatacagatggcttcaaggagcaaggcgtgaccttccctcaggatatccaggagcagcctatccgctcgttgtaccagtcggccggagtggcccctgagtcatttgaatacatcgaagcccacggaccaggcaccaaggtgggcgacccccaggagcgtaatggcatcacccgagccctgtgcgccacccgccaggagccgctgctcatcggctccaccaagtccaacatggggcacccggagccagcctcggggctcgacgccctggccaaggtgctgctgtccctggagcacgggctctgggcccccaacctgcacttccatagccccaaccctgagatcccagcgctgttggatgggcggctgcaggtggtggaccagcccctgcccgtccgtggcggcaacgtgggcatcaactcctttggcttcgggggctccaacatgcacatcatcctgaggcccaacacgcagtccgcccccgcacccgccccacatgccaccctgccccgtctgctgcgggccagcggacgcacccctgaggccgtgcagaagctgctggagcagggcctccggcacagccagggcctggctttcctgagcatgctgaacgacatcgcggctgtccccgccaccgccatgcccttccgtggctacgctgtgctgggtggtgagacgcggtggcccagagtgcagcaggtgcccgctggcgagcgcccgctctggttcatctgctctgggatgggcacacagtggcgtggaatggggctgagccttatgcgcctggaccgcttccgagattccatcctacgctccgatgaggctgtgaaccgattcggcctgaaggtgtcacagctgctgctgagcacagacgagagcacctttgatgacatcgtccattcgtttgtgagcctgactgccatccagataggcctcatagacctgctgagctgcatgggacctgaggcagatggcatcgtcggccactccctgggggagtggctgtcggtacgcgacggctgcctgtcccaggaggaggccgtcctcgctgcctactggaggggacagtgcatcaaagaagccccacttcccgccggcgccatggcagccgtgggcttgtcctgggaggagtgtaaacagcgctgcccccctgcggtggtgcccgcctgccacaactccaaggacacagtcaccatctcgggacctcaggccccggtgtttgagttcgtggagcagctgaggaaggagggtgtgtttgccaaggaggtgcggaccggcggtatggccttccactcctacttcatggaggccatcgcacccccactgctgcaggagctcaagaaggtgatccgggagccgaagccacgttcagcccgctggctcagcacctctatccccgaggcccagtggcacagcagcctggcacgcacgtcttccgccgagtacaatgtcaacaacctggtgagccctgtgctgttccaggaggccctgtggcacgtgcctgagcacgcggtggtgctggagatcgccccgaccccgtgccctcaggctgtcctgaagcgggtccgtaagccgagctgcaccatcatcccccgtatgaagaaggatcacagggacaacctggagttcttcctggccggcatcggcaggctgcacctctcaggcatcgacgccaaccccaatgccttgttcccacctgtggagtccccagctccccgaggaactcccctcatctccccactcatcaagtgggaccacagcctggcctgggacgcgccggccgccgaggacttccccaacggttcaggttccccctcagccaccatctacacatgcacaccaagctccgagtctcctgaccgctacctggtggaccacaccatcgacggtcgcgtcctcttccccgccactggctacctgagcatagtgtggaagacgctggcccgcgcctgggctgggctcgagcagctgcctgtggtgtttgaggatgtggtgcagcaccaggccaccatcctgcccaagactgggacagtgtccttggaggtacggctcctggaggccaccggtgccttcgaggtgtcagagaacggcaacctggtagtgagtgggaaggtgtaccagtgggatgaccctgaccccaggctcttcgaccacccggaaagtccccaccccaattccccacggagtcccctcttcctggcccaggcagaagtttacaaggagctgcgtctgcgtggctacgactacggccctcatttccagggcatcctggaggccagcctggaaggtgactcggggaggctgctgtggaaggataactgggtgagcttcatggacaccatgctgcagatgtccatcctgggctcggccaagcacggcctgtacctacccacccgtgtcaccgccatccacatcgaccctgccacccacaggcagaagctgtacacactgcaggacaaggcccaagtggctgacgtggtggtgagcaggtggccgagggtcacagtggcgggaggcgtccacatctccgggctccacactgagtcggccccgcggcggcagcaggagcagcaggtgcccatcctggagaagttttgcttcactccccacacggaggaggggtgcctgtctgagcgcgctgccctgcaggaggagctgcaactgtgcaaggggctggtgcaggcactgcagaccaaggtgacccagcaggggctgaagatggtggtgcccggactggatggggcccagatcccccgggacccctcacagcaggaactgccccggctgttgtcggctgcctgcaggcttcagctcaacgggaacctgcagctggagctggcgcaggtgctggcccaggagaggcccaagctgccagaggaccctctgctcagcggcctcctggactccccggcactcaaggcctgcctggacactgccgtggagaacatgcccagcctgaagatgaaggtggtggaggtgctggctggccacggtcacctgtattcccgcatcccaggcctgctcagcccccatcccctgctgcagctgagctacacggccaccgaccgccacccccaggccctggaggctgccaggccgagctgcagcagcacgacgttgcccagggccagtgggatcccgcagaccctgcccccagcgccctgggcagcgccgacctcctggtgtgcaactgtgctgtggctgccctcggggacccggcctcagctctcagcaacatggtggctgccctgagagaagggggctttctgctcctgcacacactgctccgggggcaccccctcggggacatcgtggccttcctcacctccactgagccgcagtatggccagggcatcctgagccaggacgcgtgggagagcctcttctccagggtgtcgctgcgcctggtgggcctgaagaagtccttctacggctccacgctcttcctgtgccgccggcccaccccgcaggacagccccatcttcctgccggtggacgataccagcttccgctgggtggagtctctgaagggcatcctggctgacgaagactcttcccggcctgtgtggctgaaggccatcaactgtgccacctcgggcgtggtgggcttggtgaactgtctccgccgagagcccggcgggaaccgcctccggtgtgtgctgctctccaacctcagcagcacctcccacgtcccggaggtggacccgggctccgcagaactgcagaaggtgttgcagggagacctggtgatgaacgtctaccgcgacggggcctggggggctttccgccacttcctgctggaggaggacaagcctgaggagccgacggcacatgcctttgtgagcaccctcacccggggggacctgtcctccatccgctgggtctgctcctcgctgcgccatgcccagcccacctgccctggcgcccagctctgcacggtctactacgcctccctcaacttccgcgacatcatgctggccactggcaagctgtcccctgatgccatcccagggaagtggacctcccaggacagcctgctaggtatggagttctcgggccgagacgccagcggcaagcgtgtgatgggactggtgcctgccaagggcctggccacctctgtcctgctgtcaccggacttcctctgggatgtgccttccaactggacgctggaggaggcggcctcggtgcctgtcgtctacagcacggcctactacgcgctggtggtgcgtgggcgggtgcgccccggggagacgctgctcatccactcgggctcgggcggcgtgggccaggccgccatcgccatcgccctcagtctgggctgccgcgtcttcaccaccgtggggtcggctgagaagcgggcgtacctccaggccaggttcccccagctcgacagcaccagcttcgccaactcccgggacacatccttcgagcagcatgtgctgtggcacacgggcgggaagggcgttgacctggtcttgaactccttggcggaagagaagctgcaggccagcgtgaggtgcttggctacgcacggtcgcttcctggaaattggcaaattcgacctttctcagaaccacccgctcggcatggctatcttcctgaagaacgtgacattccacggggtcctactggatgcgttcttcaacgagagcagtgctgactggcgggaggtgtgggcgcttgtgcaggccggcatccgggatggggtggtacggcccctcaagtgcacggtgttccatggggcccaggtggaggacgccttccgctacatggcccaagggaagcacattggcaaagtcgtcgtgcaggtgcttgcggaggagccggaggcagtgctgaagggggccaaacccaagctgatgtcggccatctccaagaccttctgcccggcccacaagagctacatcatcgctggtggtctgggtggcttcggcctggagttggcgcagtggctgatacagcgtggggtgcagaagctcgtgttgacttctcgctccgggatccggacaggctaccaggccaagcaggtccgccggtggaggcgccagggcgtacaggtgcaggtgtccaccagcaacatcagctcactggagggggcccggggcctcattgccgaggcggcgcagcttgggcccgtgggcggcgtcttcaacctggccgtggtcttgagagatggcttgctggagaaccagaccccagagttcttccaggacgtctgcaagcccaagtacagcggcaccctgaacctggacagggtgacccgagaggcgtgccctgagctggactactttgtggtcttctcctctgtgagctgcgggcgtggcaatgcgggacagagcaactacggctttgccaattccgccatggagcgtatctgtgagaaacgccggcacgaaggcctcccaggcctggccgtgcagtggggcgccatcggcgacgtgggcattttggtggagacgatgagcaccaacgacacgatcgtcagtggcacgctgccccagcgcatggcgtcctgcctggaggtgctggacctcttcctgaaccagccccacatggtcctgagcagctttgtgctggctgagaaggctgcggcctatagggacagggacagccagcgggacctggtggaggccgtggcacacatcctgggtgagcactcccagtaggagccgcgccaggtgtttcccctgctggcatcagggtcttgggacatagcagctcgcagtt

SEQ ID NO: 658572 - DNA, 6802 bp, Homo sapiens
atggaggaggtggtgattgccggcatgttcgggaagctgccagagtcggagaacttgcaggagttctgggacaacctcatcggcggtgtggacatggtcacggacgatgaccgtcgctggaaggctgggctctacggcctgccccggcggtccggcaagctgaaggacctgtctaggtttgatgcctccttcttcggagtccaccccaagcaggcacacacgatggaccctcagctgcggctgctgctggaagctacctatgaagccatcgtggacggaggcatcaacccagattcactccgaggaacacacactggcgtctgggtgggcgtgagcggctctgagacctcggaggccctgagccgagaccccgagacactcgtgggctacagcatggtgggctgccagcgagcgatgatggccaaccggctctccttcttcttcgacttcagagggcccagcatcgcactggacacagcctgctcctccagcctgatggccctgcagaacgcctaccaggccatccacagcgggcagtgccctgccgccatcgtggggggcatcaacgtcctgctgaagcccaacacctccgtgcagttcttgaggctggggatgctcagccccgagggcacctgcaaggccttcgacacagcggggaatgggtactgccgctcggagggtgtggtggctgtcctgctgaccaagaagtccctggcccggaaggtctacaccaccatcctgaacaaaggcaccaatacagatggcttcaaggagcaaggcgtgaccttccctcaggatatccaggagcagcctatccgctcgttgtaccagtcggccggagtggcccctgagtcatttgaatacatcgaagcccacggaccaggcaccaaggtgggcgacccccaggagcgtaatggcatcacccgagccctgtgcgccacccgccaggagccgctgctcatcggctccaccaagtccaacatggggcacccggagccagcctcggggctcgacgccctggccaaggtgctgctgtccctggagcacgggctctgggcccccaacctgcacttccatagccccaaccctgagatcccagcgctgttggatgggcggctgcaggtggtggaccagcccctgcccgtccgtggcggcaacgtgggcatcaactcctttggcttcgggggctccaacatgcacatcatcctgaggcccaacacgcagtccgcccccgcacccgccccacatgccaccctgccccgtctgctgcgggccagcggacgcacccctgaggccgtgcagaagctgctggagcagggcctccggcacagccagggcctggctttcctgagcatgctgaacgacatcgcggctgtccccgccaccgccatgcccttccgtggctacgctgtgctgggtggtgagacgcggtggcccagagtgcagcaggtgcccgctggcgagcgcccgctctggttcatctgctctgggatgggcacacagtggcgtggaatggggctgagccttatgcgcctggaccgcttccgagattccatcctacgctccgatgaggctgtgaaccgattcggcctgaaggtgtcacagctgctgctgagcacagacgagagcacctttgatgacatcgtccattcgtttgtgagcctgactgccatccagataggcctcatagacctgctgagctgcatgggacctgaggcagatggcatcgtcggccactccctgggggagtggctgtcggtacgcgacggctgcctgtcccaggaggaggccgtcctcgctgcctactggaggggacagtgcatcaaagaagccccacttcccgccggcgccatggcagccgtgggcttgtcctgggaggagtgtaaacagcgctgcccccctgcggtggtgcccgcctgccacaactccaaggacacagtcaccatctcgggacctcaggccccggtgtttgagttcgtggagcagctgaggaaggagggtgtgtttgccaaggaggtgcggaccggcggtatggccttccactcctacttcatggaggccatcgcacccccactgctgcaggagctcaagaaggtgatccgggagccgaagccacgttcagcccgctggctcagcacctctatccccgaggcccagtggcacagcagcctggcacgcacgtcttccgccgagtacaatgtcaacaacctggtgagccctgtgctgttccaggaggccctgtggcacgtgcctgagcacgcggtggtgctggagatcgccccgaccccgtgccctcaggctgtcctgaagcgggtccgtaagccgagctgcaccatcatcccccgtatgaagaaggatcacagggacaacctggagttcttcctggccggcatcggcaggctgcacctctcaggcatcgacgccaaccccaatgccttgttcccacctgtggagtccccagctccccgaggaactcccctcatctccccactcatcaagtgggaccacagcctggcctgggacgcgccggccgccgaggacttccccaacggttcaggttccccctcagccaccatctacacatgcacaccaagctccgagtctcctgaccgctacctggtggaccacaccatcgacggtcgcgtcctcttccccgccactggctacctgagcatagtgtggaagacgctggcccgcgcctgggctgggctcgagcagctgcctgtggtgtttgaggatgtggtgcagcaccaggccaccatcctgcccaagactgggacagtgtccttggaggtacggctcctggaggccaccggtgccttcgaggtgtcagagaacggcaacctggtagtgagtgggaaggtgtaccagtgggatgaccctgaccccaggctcttcgaccacccggaaagtccccaccccaattccccacggagtcccctcttcctggcccaggcagaagtttacaaggagctgcgtctgcgtggctacgactacggccctcatttccagggcatcctggaggccagcctggaaggtgactcggggaggctgctgtggaaggataactgggtgagcttcatggacaccatgctgcagatgtccatcctgggctcggccaagcacggcctgtacctacccacccgtgtcaccgccatccacatcgaccctgccacccacaggcagaagctgtacacactgcaggacaaggcccaagtggctgacgtggtggtgagcaggtggccgagggtcacagtggcgggaggcgtccacatctccgggctccacactgagtcggccccgcggcggcagcaggagcagcaggtgcccatcctggagaagttttgcttcactccccacacggaggaggggtgcctgtctgagcgcgctgccctgcaggaggagctgcaactgtgcaaggggctggtgcaggcactgcagaccaaggtgacccagcaggggctgaagatggtggtgcccggactggatggggcccagatcccccgggacccctcacagcaggaactgccccggctgttgtcggctgcctgcaggcttcagctcaacgggaacctgcagctggagctggcgcaggtgctggcccaggagaggcccaagctgccagaggaccctctgctcagcggcctcctggactccccggcactcaaggcctgcctggacactgccgtggagaacatgcccagcctgaagatgaaggtggtggaggtgctggctggccacggtcacctgtattcccgcatcccaggcctgctcagcccccatcccctgctgcagctgagctacacggccaccgaccgccacccccaggccctggaggctgccaggccgagctgcagcagcacgacgttgcccagggccagtgggatcccgcagaccctgcccccagcgccctgggcagcgccgacctcctggtgtgcaactgtgctgtggctgccctcggggacccggcctcagctctcagcaacatggtggctgccctgagagaagggggctttctgctcctgcacacactgctccgggggcaccccctcggggacatcgtggccttcctcacctccactgagccgcagtatggccagggcatcctgagccaggacgcgtgggagagcctcttctccagggtgtcgctgcgcctggtgggcctgaagaagtccttctacggctccacgctcttcctgtgccgccggcccaccccgcaggacagccccatcttcctgccggtggacgataccagcttccgctgggtggagtctctgaagggcatcctggctgacgaagactcttcccggcctgtgtggctgaaggccatcaactgtgccacctcgggcgtggtgggcttggtgaactgtctccgccgagagcccggcgggaaccgcctccggtgtgtgctgctctccaacctcagcagcacctcccacgtcccggaggtggacccgggctccgcagaactgcagaaggtgttgcagggagacctggtgatgaacgtctaccgcgacggggcctggggggctttccgccacttcctgctggaggaggacaagcctgaggagccgacggcacatgcctttgtgagcaccctcacccggggggacctgtcctccatccgctgggtctgctcctcgctgcgccatgcccagcccacctgccctggcgcccagctctgcacggtctactacgcctccctcaacttccgcgacatcatgctggccactggcaagctgtcccctgatgccatcccagggaagtggacctcccaggacagcctgctaggtatggagttctcgggccgagacgccagcggcaagcgtgtgatgggactggtgcctgccaagggcctggccacctctgtcctgctgtcaccggacttcctctgggatgtgccttccaactggacgctggaggaggcggcctcggtgcctgtcgtctacagcacggcctactacgcgctggtggtgcgtgggcgggtgcgccccggggagacgctgctcatccactcgggctcgggcggcgtgggccaggccgccatcgccatcgccctcagtctgggctgccgcgtcttcaccaccgtggggtcggctgagaagcgggcgtacctccaggccaggttcccccagctcgacagcaccagcttcgccaactcccgggacacatccttcgagcagcatgtgctgtggcacacgggcgggaagggcgttgacctggtcttgaactccttggcggaagagaagctgcaggccagcgtgaggtgcttggctacgcacggtcgcttcctggaaattggcaaattcgacctttctcagaaccacccgctcggcatggctatcttcctgaagaacgtgacattccacggggtcctactggatgcgttcttcaacgagagcagtgctgactggcgggaggtgtgggcgcttgtgcaggccggcatccgggatggggtggtacggcccctcaagtgcacggtgttccatggggcccaggtggaggacgccttccgctacatggcccaagggaagcacattggcaaagtcgtcgtgcaggtgcttgcggaggagccggaggcagtgctgaagggggccaaacccaagctgatgtcggccatctccaagaccttctgcccggcccacaagagctacatcatcgctggtggtctgggtggcttcggcctggagttggcgcagtggctgatacagcgtggggtgcagaagctcgtgttgacttctcgctccgggatccggacaggctaccaggccaagcaggtccgccggtggaggcgccagggcgtacaggtgcaggtgtccaccagcaacatcagctcactggagggggcccggggcctcattgccgaggcggcgcagcttgggcccgtgggcggcgtcttcaacctggccgtggtcttgagagatggcttgctggagaaccagaccccagagttcttccaggacgtctgcaagcccaagtacagcggcaccctgaacctggacagggtgacccgagaggcgtgccctgagctggactactttgtggtcttctcctctgtgagctgcgggcgtggcaatgcgggacagagcaactacggctttgccaattccgccatggagcgtatctgtgagaaacgccggcacgaaggcctggaccgccaggagctgagctttgcggcccggtccttctactacaagctgcgtgccgctgagcagtacacacccaaggccaagtaccatggcaacgtgatgctactgcgcgccaagacgggtggcgcctacggcgaggacctgggcgcggactacaacctctcccaggtatgcgacgggaaagtatccgtccacgtcatcgagggtgaccaccgcacgctgctggagggcagcggcctggagtccatcatcagcatcatccacagctccctggctgagccacgcgtgagcgtgcgggagggctaggcccgtgcccccgcctgccaccggaggtcactccaccatccccaccccaccccaccccacccccgccatgcaacgggattgaagggtcctgccggtgggaccctgtccggcccagtgccactgccccccgaggctgctagatgtaggtgttaggcatgtgctacgcactctgcggctattacggaaactcggagacactagaattgacgacttgaagactacttgatggtgacaactcacaggtgcctatcgcctaagaacatgtaatgggccctttgcgccacgagatgcttgcgctaggactttgtgatctggccaatcgataattatagcagttgattgaggtg

SEQ ID NO: 658573 - DNA, 4360 bp, Homo sapiens
  misc_feature (4332)..(4332): n is a, c, g, or t
  misc_feature (4334)..(4334): n is a, c, g, or t
atggaggaggtggtgattgccggcatgttcgggaagctgccagagtcggagaacttgcaggagttctgggacaacctcatcggcggtgtggacatggtcacggacgatgaccgtcgctggaaggctgggctctacggcctgccccggcggtccggcaagctgaaggacctgtctaggtttgatgcctccttcttcggagtccaccccaagcaggcacacacgatggaccctcagctgcggctgctgctggaagctacctatgaagccatcgtggacggaggcatcaacccagattcactccgaggaacacacactggcgtctgggtgggcgtgagcggctctgagacctcggaggccctgagccgagaccccgagacactcgtgggctacagcatggtgggctgccagcgagcgatgatggccaaccggctctccttcttcttcgacttcagagggcccagcatcgcactggacacagcctgctcctccagcctgatggccctgcagaacgcctaccaggccatccacagcgggcagtgccctgccgccatcgtggggggcatcaacgtcctgctgaagcccaacacctccgtgcagttcttgaggctggggatgctcagccccgagggcacctgcaaggccttcgacacagcggggaatgggtactgccgctcggagggtgtggtggctgtcctgctgaccaagaagtccctggcccggaaggtctacaccaccatcctgaacaaaggcaccaatacagatggcttcaaggagcaaggcgtgaccttccctcaggatatccaggagcagcctatccgctcgttgtaccagtcggccggagtggcccctgagtcatttgaatacatcgaagcccacggaccaggcaccaaggtgggcgacccccaggagcgtaatggcatcacccgagccctgtgcgccacccgccaggagccgctgctcatcggctccaccaagtccaacatggggcacccggagccagcctcggggctcgacgccctggccaaggtgctgctgtccctggagcacgggctctgggcccccaacctgcacttccatagccccaaccctgagatcccagcgctgttggatgggcggctgcaggtggtggaccagcccctgcccgtccgtggcggcaacgtgggcatcaactcctttggcttcgggggctccaacatgcacatcatcctgaggcccaacacgcagtccgcccccgcacccgccccacatgccaccctgccccgtctgctgcgggccagcggacgcacccctgaggccgtgcagaagctgctggagcagggcctccggcacagccagggcctggctttcctgagcatgctgaacgacatcgcggctgtccccgccaccgccatgcccttccgtggctacgctgtgctgggtggtgagacgcggtggcccagagtgcagcaggtgcccgctggcgagcgcccgctctggttcatctgctctgggatgggcacacagtggcgtggaatggggctgagccttatgcgcctggaccgcttccgagattccatcctacgctccgatgaggctgtgaaccgattcggcctgaaggtgtcacagctgctgctgagcacagacgagagcacctttgatgacatcgtccattcgtttgtgagcctgactgccatccagataggcctcatagacctgctgagctgcatgggacctgaggcagatggcatcgtcggccactccctgggggagtggctgtcggtacgcgacggctgcctgtcccaggaggaggccgtcctcgctgcctactggaggggacagtgcatcaaagaagccccacttcccgccggcgccatggcagccgtgggcttgtcctgggaggagtgtaaacagcgctgcccccctgcggtggtgcccgcctgccacaactccaaggacacagtcaccatctcgggacctcaggccccggtgtttgagttcgtggagcagctgaggaaggagggtgtgtttgccaaggaggtgcggaccggcggtatggccttccactcctacttcatggaggccatcgcacccccactgctgcaggagctcaagaaggtgatccgggagccgaagccacgttcagcccgctggctcagcacctctatccccgaggcccagtggcacagcagcctggcacgcacgtcttccgccgagtacaatgtcaacaacctggtgagccctgtgctgttccaggaggccctgtggcacgtgcctgagcacgcggtggtgctggagatcgccccgaccccgtgccctcaggctgtcctgaagcgggtccgtaagccgagctgcaccatcatcccccgtatgaagaaggatcacagggacaacctggagttcttcctggccggcatcggcaggctgcacctctcaggcatcgacgccaaccccaatgccttgttcccacctgtggagtccccagctccccgaggaactcccctcatctccccactcatcaagtgggaccacagcctggcctgggacgcgccggccgccgaggacttccccaacggttcaggttccccctcagccaccatctacacatgcacaccaagctccgagtctcctgaccgctacctggtggaccacaccatcgacggtcgcgtcctcttccccgccactggctacctgagcatagtgtggaagacgctggcccgcgcctgggctgggctcgagcagctgcctgtggtgtttgaggatgtggtgcagcaccaggccaccatcctgcccaagactgggacagtgtccttggaggtacggctcctggaggccaccggtgccttcgaggtgtcagagaacggcaacctggtagtgagtgggaaggtgtaccagtgggatgaccctgaccccaggctcttcgaccacccggaaagtccccaccccaattccccacggagtcccctcttcctggcccaggcagaagtttacaaggagctgcgtctgcgtggctacgactacggccctcatttccagggcatcctggaggccagcctggaaggtgactcggggaggctgctgtggaaggataactgggtgagcttcatggacaccatgctgcagatgtccatcctgggctcggccaagcacggcctgtacctacccacccgtgtcaccgccatccacatcgaccctgccacccacaggcagaagctgtacacactgcaggacaaggcccaagtggctgacgtggtggtgagcaggtggccgagggtcacagtggcgggaggcgtccacatctccgggctccacactgagtcggccccgcggcggcagcaggagcagcaggtgcccatcctggagaagttttgcttcactccccacacggaggaggggtgcctgtctgagcgcgctgccctgcaggaggagctgcaactgtgcaaggggctggtgcaggcactgcagaccaaggtgacccagcaggggctgaagatggtggtgcccggactggatggggcccagatcccccgggacccctcacagcaggaactgccccggctgttgtcggctgcctgcaggcttcagctcaacgggaacctgcagctggagctggcgcaggtgctggcccaggagaggcccaagctgccagaggaccctctgctcagcggcctcctggactccccggcactcaaggcctgcctggacactgccgtggagaacatgcccagcctgaagatgaaggtggtggaggtgctggctggccacggtcacctgtattcccgcatcccaggcctgctcagcccccatcccctgctgcagctgagctacacggccaccgaccgccacccccaggccctggaggctgccaggccgagctgcagcagcacgacgttgcccagggccagtgggatcccgcagaccctgcccccagcgccctgggcagcgccgacctcctggtgtgcaactgtgctgtggctgccctcggggacccggcctcagctctcagcaacatggtggctgccctgagagaagggggctttctgctcctgcacacactgctccgggggcaccccctcggggacatcgtggccttcctcacctccactgagccgcagtatggccagggcatcctgagccaggacgcgtgggagagcctcttctccagggtgtcgctgcgcctggtgggcctgaagaagtccttctacggctccacgctcttcctgtgccgccggcccaccccgcaggacagccccatcttcctgccggtggacgataccagcttccgctgggtggagtctctgaaggtcaagccctggcccaccttcagggcccaccccaccttccaacttggcgagngngggctgacccttcccgacccgctgta

SEQ ID NO: 658574 - DNA, 169 bp, Homo sapiens
  misc_feature (113)..(113): n is a, c, g, or t
tagaggatcccttctctgcatatctggttagtgaggtgagcctggcgcctttctttgcgctgagctaagctacatcaatggctttgtggcccatttctaccgttcatttctgntactgctctgggttgcctatctcctgagtccgttccaacatatgcccggtgctctc

SEQ ID NO: 658575 - DNA, 1252 bp, Homo sapiens
  misc_feature (136)..(136): n is a, c, g, or t
  misc_feature (139)..(139): n is a, c, g, or t
  misc_feature (144)..(144): n is a, c, g, or t
  misc_feature (147)..(147): n is a, c, g, or t
  misc_feature (157)..(158): n is a, c, g, or t
  misc_feature (162)..(162): n is a, c, g, or t
ggcactcacctatagttccacctactcgggaggagaatcgcttgaaccgggtaggtggaggttgcggagggaggagaatcgcttgaaccgggtaggtggaggttgcggtgagctgagatcgccccactccatctanccngggtnacnaaaatgaaanncgtntcaaaaaaaaaaagcccacccgcagtgtagcacagggcaggccggtgctgtgggtgctgccagcacctgctcagagcccgaccccacacggacatggagcacaacagggtgctggaggcgctgctgccgctgaagggcctagaggagcgtgtggcagccgccgtggacctgatcatcaagagccaccagggcctggaccgccaggagctgagctttgcggcccggtccttctactacaagctgcgtgccgctgagcagtacacacccaaggccaagtaccatggcaacgtgatgctactgcgcgccaagacgggtggcgcctacggcgaggacctgggcgcggactacaacctctcccaggtgcgcaaggggcctgacgggaacggggacagggacaggagtggggtgggacggcagctgatcgcatcccctgcaggtatgcgacgggaaagtatccgtccacgtcatcgagggtgaccaccgcacgctgctggagggcagcggcctggagtccatcatcagcatcatccacagctccctggctgagccacgcgtgagcgtgcgggagggctaggcccgtgcccccgcctgccaccggaggtcactccaccatccccaccccaccccaccccacccccgccatgcaacgggattgaagggtcctgccggtgggaccctgtccggcccagtgccactgccccccgaggctgctagatgtaggtgttaggcatgtcccacccacccgccgcctcccacggcacctcggggacaccagagctgccgacttggagactcctggtctgtgaagagccggtggtgcccgtgcccgcaggaactgggctgggcctcgtgcgcccgtggggtctgcgcttggtctttctgtgcttggatttgcatatttattgcattgctggtagagacccccaggcctgtccaccctgccaagactcctcaggcagcgtgtgggtcccgcactctgcccccatttccccatttccccgtggggtgctgcccttatgcccggcgccgggcaccaactccatgtttggtgtttgtctgtgtttgtttttcaagaaatgattcaaattgc

SEQ ID NO: 658576 - DNA, 161 bp, Homo sapiens
  misc_feature (43)..(43): n is a, c, g, or t
  misc_feature (70)..(70): n is a, c, g, or t
ctctaggatccacacgtacgctcagtcggatgatcagtctagngttttctacacgatcagttgatcatcntctgcgcgagacctgcttaagctgcacgctcctgcgagcgctgaggcacagtcggcattctacagtcacgcggaggacacgtcgttcacga

SEQ ID NO: 658577 - DNA, 127 bp, Homo sapiens
ttttttttcccccaaaacccttttttttcccatgcccctttaacaggatttgttttattcccccccccttcccagggtgatttgaggtaaactttgaagtaaaataaaagctgggtttgggcctcca

SEQ ID NO: 658578 - DNA, 775 bp, Homo sapiens
tcccccagctcaactgagtggtgtccctttgcggagttggtggctggccagccggtcttcgaggtgtgtcgttccatgctggcactcccgtgcagcctggccgaaatgactacacagttggagataacccagcatgctctgggcgtggatgattggcctgtggacgaccgagtgtccctgtagactggtcagctgcatctcatgcgagcgctactaaggcgcgtgtccagactctacgcttgccccctccagtggcccagccctgattggggagcacccgaggcagggggtgggggaagtgtgtactgaggagccgtgcgtcgtggctccctgggcttggtccccgggctcattaatttaaacaggcatgttgtttttgcgcaagtccttccaaaaaaaaaaagggcgacagagaggaaaagaatattaacagaaagcaataaagacatggggggggctgccgctgtcataagaaagtttctccgcccggggggggggggccgccccacagagattttgagccgtagatacccgcgcgttttgttgtgtgtccagccagggggggccgccgcccaaacggggggggcccgcggtatttaaacagccccgcagggatcaggaggccccatggctgggtacaacacaacccagcggtggaccccgcgcggggaaaaaccgcgtgcgcaacacgcgggggacaccccttggtggggaggagacgggacccctaaacctgcgcgggcgggggggagacccaaaaatgtcggcaccacaa

SEQ ID NO: 658579 - DNA, 431 bp, Homo sapiens
cgagactcagatcttggcgtggtgaataatcactctgttctgtcatactaactacaatgagataataacgcgagcattgtaacgcactgaaaataaggctaacagcagcacactccacgatcacaggatttaaatgccagaactgtgaaacattctctgtaggtgccgggacagtctggtggctgacaattaacgtccactccagcaccgagggctggacacttgtggtttctgttcacctttcctggcttggagcccagatctgtctcatgagcagagtaactactgaggaggcttctcggatggaaagttggttttaagccagaaatctggagagatgtcatgccaggcagcagcccccacgggcccaggcctttgtggggcagtgtcactgtctggtgtgccaccagtacccatgctgcaaggagtgg

SEQ ID NO: 658580 - DNA, 654 bp, Homo sapiens
  misc_feature (24)..(25): n is a, c, g, or t
  misc_feature (30)..(30): n is a, c, g, or t
  misc_feature (33)..(33): n is a, c, g, or t
  misc_feature (35)..(35): n is a, c, g, or t
  misc_feature (49)..(49): n is a, c, g, or t
  misc_feature (61)..(62): n is a, c, g, or t
  misc_feature (78)..(79): n is a, c, g, or t
  misc_feature (86)..(86): n is a, c, g, or t
  misc_feature (93)..(93): n is a, c, g, or t
  misc_feature (96)..(96): n is a, c, g, or t
  misc_feature (114)..(115): n is a, c, g, or t
  misc_feature (121)..(121): n is a, c, g, or t
  misc_feature (126)..(127): n is a, c, g, or t
  misc_feature (135)..(136): n is a, c, g, or t
  misc_feature (146)..(146): n is a, c, g, or t
  misc_feature (155)..(155): n is a, c, g, or t
  misc_feature (161)..(161): n is a, c, g, or t
  misc_feature (165)..(165): n is a, c, g, or t
  misc_feature (172)..(172): n is a, c, g, or t
  misc_feature (179)..(179): n is a, c, g, or t
  misc_feature (237)..(237): n is a, c, g, or t
  misc_feature (623)..(623): n is a, c, g, or t
ttttaaaaaaaagtttgatataanntagtnggnantgtgttaaaagaangtgttaaattcnngccaaaattcatattnnaatttcnacttcanttnaaaaaatgtcctttaggnncccatnaaganntagaaganntgatctgtanaatgcaaancaattntttnggcagantggaagnagaaatggactcaacgcgcacaaccccaaataaaacaccccagaattttcgtagaaanaaagacggttgctttcttctcctgaaaggaataaacatgtttcaccataagtacacgtacatagtgttgattatgtctgacacacaatttattcacaaccatcaaatataaaaaagctctacttctttaattagcacacaaattaccctataaaacaaaaaggtcctcggctaaaacaggaactaaaataattaagatcacctttaagataaaaagaaaaagattgaatcaaatgatacttagtttatatcagtttagattaaatattttaaaaatggaaataaaagcaaagaagtggccaggcatggtgactcacacctgtgatcctagcactttgggaggccaaggtggatggatcacctgaagccaagagtttgagaccagcntgggcaacacagcaatatttcgcggcacgag

SEQ ID NO: 658581 - DNA, 523 bp, Homo sapiens
agatgcagctccctttaagcttcatgctctctgttccctgtgcaggaacaccctcccctcgcttcagtcagatctctcctccgagagccgctaagtagcctgaccctagtcatcacttgtgccctccccaactactgtctttttttaattccaaaccattcgtcattccttgtcatgatactgggcgtggtacgctaatctgctgatcattggtattccctttgagaacatcaggtccgtgaaccagccgagagctatgcccagcacacagtaggagctcatgacacgtttactgaattaatgtgtctaccccggacattccgtgtgcctcgctccgtggccgtgtacccatcacctctcttgagcgttggttgacgcaacctagtctatccacagttaacgcctgccatccggccattcctgcagaccatctccatggggctgatgtccttcggggcaactacaaacgcacacgagacaggcctcagtgagtccaagtaaggttctactcgcagcctattct

SEQ ID NO: 658582 - DNA, 146 bp, Homo sapiens
gaaaaaaaaaaaaagagctggttcacttttaaatgtctatagctagtagcctgggccctttaaggtttaattggaatagatatatctgtttcccggggaattatctggaaggttttaaacaggaatgacctcatagttttaaaggg

SEQ ID NO: 658583 - DNA, 221 bp, Homo sapiens
  misc_feature (119)..(119): n is a, c, g, or t
cctgagggaggggcctctagcttgatgggggacaagatccttctgggacccttctagaattggagttccaaagaggcatgccctagttcaatagggacatgagccatgggctggaggcnccaccccccggtccttggggggaggggccctctacccctcattggtccagtgggttaagactccccccgttgggccagaaaaagcctttttgcagcaggtga

SEQ ID NO: 658584 - DNA, 160 bp, Homo sapiens
  misc_feature (21)..(21): n is a, c, g, or t
  misc_feature (128)..(128): n is a, c, g, or t
tgttgagatgacaacaagggntttaaaatattacataaacgacgttgagtagagcagaagcagtcagggttttggcgatggatttcttcaagttgtcaaagatcaggcggccctcctccacccccgtnaacgatggcggcaaagtttgtcatccagcagg

SEQ ID NO: 658585 - DNA, 153 bp, Homo sapiens
agtagccggaaagttaagtcccggagtacgcgcgtaatgtgtacgccagtctgcgcgtaagcacaagtgcagcagtaagcgcaaaggtgtgtcaaccagtggacaggtactccaagtccaagtcaagtcacagactgaggtaagtactcaacg

SEQ ID NO: 658586 - DNA, 343 bp, Homo sapiens
ggtcgacctcttagcttccaaaggctgctgacccgccctccccaaagttgcttccatgcttggactacagaacagagttggatgactttttctatccacgattctcttattttctgtgatccccggtgcccgtgtaacaaggtccagtgcctgggtcccctccttggactcctgagtggccgagacaccgctagtgcgtggacaccactccagcccccattacctttccacccttacaccacgacccacacctggcctcctccctaggctgacccagcgccccaccaccctatctatacactccaagttctcccacgattcctccacttgcagccgcgtcgac

SEQ ID NO: 658587 - DNA, 445 bp, Homo sapiens
ggtaccggtcttcctttgtctgattaaagtaaatattagtctgggcagtgggacatgcctgtaatcccagtactttgggaggctgagacagacggattgcttgagcccaggagtttgagaccagcctgggcaacacggaaaaacaccatctctacaaaaaatacaaaaatcagctgagctggtggcacacacctgtagtcccagcaccttgggagggtgaggcaggaggatcacgaggtcaggagatcaagaccatcctggttaacacggtgaggcctcatctctactaaaaatacagaagaattggccaagtgtggtggcgggtgcctgtggtcccacctactctggaggctggggcgggagaatgggatgagcccgggaggcgaagcttgcagtgagccgagatcgcgccactgcactccagcctgggagacaaagggaaaca

SEQ ID NO: 658588 - DNA, 507 bp, Homo sapiens
  misc_feature (190)..(190): n is a, c, g, or t
  misc_feature (196)..(196): n is a, c, g, or t
  misc_feature (204)..(204): n is a, c, g, or t
  misc_feature (280)..(280): n is a, c, g, or t
  misc_feature (282)..(282): n is a, c, g, or t
  misc_feature (294)..(294): n is a, c, g, or t
  misc_feature (333)..(333): n is a, c, g, or t
  misc_feature (480)..(480): n is a, c, g, or t
ctggcaagggcttcaaatgtgccatcttcacttttatactccttgtgtgtcttatcaaccatcatcctctggtcatttattgacagtcacacaatttcatttcacccaactctattgaattcatgagactttgatttcaatttcaaaccatcggcatgggttcctgctgtccaggagcaatcacgccttntgactnttccctgngtttggtactggagatcggggatgtcattttctcattgtttctccctgttatcttcagggttcctctcagacggtntntgcgacctgctnttcagagagcttccggaggaaatataattaacatgcatntaacaaagttaacctttttaacaatttttattctttttttttttttgagacagtcttgctctgtcacccaggctgaggcagaagaattgcttgaacccaggaagcagaggttgcagtgagccgagatagtattactgcactccaggntgggcagcagagcaagattccgcctca

SEQ ID NO: 658589 - DNA, 889 bp, Homo sapiens
atgaaggatagccccctcctcaatgattaccggggctttctagtgccgagaatgaagcgagtctttggactgggaggaggacgcaggacttctaggccgcggagacccctcgggcctgggtggcgggtgctctggggagggtccgctgtgttactggccggcgccagggtcgccgaccggcgccctctctccgtcgcctccctccccctcgtagccgtcgcgatgttccctgaggcctcctgattgcccgtccggcgtacgtgctgtgccttctgtggtccaggcactgagcggtcctggctcgctgcctgtcgcgcgtgggcctcagtctggtagcgagccgccggcctcttccttcacagccagctcaaggtcgacttccctatgttcactttggacgcggagttggtgcggctgcactacgcgtgcataggctgtggcctcctggtgtacacactggtagcaagactcaaactagacattggcgtccagcttgaccggagcccactcgtccgtacccccactctaagaatggcaaggacaaagtacgaatcgtattctagccgtactaggacctgagctgcccaaagatcgatccgtccatcccattgctaaatttcggaaacgaaaagaggaaatgaggggtttccccttagtctgactttttgtaacatccgaccgtaaagtaatgttaccggtgagtgagcagtggcaatgagaaccctctgtgaacagggagaaacagaggaataggaagtggtgcgggcacctggtaattgggaatggggtaatcgcagcagaacaaaacaccaagtgaagtcagaagactacagacaagagctgccctggttggaaagataaagggtgatgtagtacattacaaaaaaag

SEQ ID NO: 658590 - DNA, 246 bp, Homo sapiens
gaatcaggctaaccgtctgagcagctgggaacttgcttgtccgtactggatgatggttatgatggattatgacacagccgaatttcctgctggaggagacagcggtttctcagtatcactctgcaggtgtgaattagaaggcctttgaacatgcagtgggacggaggagtggtattggtcgtgctgatagggaatctctcgctatcactatataacatggattgatcatgagtttccaaagcaggg

SEQ ID NO: 658591 - DNA, 240 bp, Homo sapiens
  misc_feature (20)..(21): n is a, c, g, or t
gctaagaggatccctatacnncagctatacacctatacaccttacaccaggagtcaggcatagggaatttacactcataccaaaatttcagtatgatcttcccggaaaatgtctgggaaaaacatctaccactccatagcaaaagatgagcatggtcgggcgcagtggctcacgcctgtaatcccagtactttgggagaccaaggcgggtggatggtggtatagagtggtatggtggtat

SEQ ID NO: 658592 - DNA, 751 bp, Homo sapiens
agcgggagacacgccgcatgctgcagaagcgggagacggtgctgctgctgaggaccttccagggccgtcgctgcgagatcgtgcgcgagcactactgcaggtcctgcgtgccctgccacagcccgcgtctgcaccacagcccgccgcactgcagaccacgatgggaaactctctgtctagctgatgtgactcacttaccgtgatccctagacgtgggacaagttgttgcaccatatatctcggagatccttgcgctctcctgcggttgcaggcgccaccccatccagtgcatggcaaggaccagcccgtcgttcccggcacttgcggcacgagcactcaaacacgagcgccccgcggagcaccacgtgattcgatcacaaccctccgcccccacacaccccatgcgcctgtcaaccggcattgcgcgccggtcccctcgcactcatgtcactcttccatccgtgtcggacgtgccccctgtgacaaccttgtcgccaagccccacacggcggccctggcctgacatccgtagcccacacccacagcgcgccagacaacggaacgaggcacgacgctacccacatgggcaccgaacccgaccggagcccccggagaccccacagacgcagagcgcgttcatctcacacagaccgcgccacgcctggccaccacggcaccccccaacatccacatcccacactggccagagggaacccgcgacccggccacccaacagccgagcccacggcgc

SEQ ID NO: 658593 - DNA, 434 bp, Homo sapiens
  misc_feature (38)..(38): n is a, c, g, or t
  misc_feature (47)..(47): n is a, c, g, or t
agccatgacctgggggaaattaccgctgagggggcttngttctttcnagtgggtggaattaaagccaaaagtcctagcagcacaccgagcaggactgaagcagatcataattccgcagaggaacgaaaaggaccttgaagagatcccaagcaacggtcagacaggatctaagttttgttacagcaagctgcctggatgaagttctaaatgcagcttttgatggtggctttcctgtcaagaccagacctggtctcattgacagcaaactataggcccgaacataagctgaatttaattatgaggcaaagcttgtttgaggcaccaaatgatcaagcaaaatatccctaatctgtggatataatcaagatagcaatgagtctgtttaagtagttgtttattacagaaatgttggcttaataaagtcattaaaccta

SEQ ID NO: 658594 - DNA, 372 bp, Homo sapiens
gacgcgaaacgacatcgctaaggagacgatatgtccgtgtccctggagtagaagcagcacatataggcgaattgtgtcatactagcacaacgccgtgtgacgatatccgagactcccctatcaatatatcaatgactttcttcacatacttggaaaaaaaaatcctagaatttatacgaaagcaccaaagattcagaatacccaaagctctccttgagctcaaatgcaacaacactgggggaaccacatgacctgacttccagttatactacagagctattgtaaccaatacagtacggtactgtcataaaaacagtcataccaatggaacaggattgagaacccagaaacaaatatatttatctacaggtg

SEQ ID NO: 658595 - DNA, 125 bp, Homo sapiens
ggtcgggcattctattgatcaagtctcttccatatactgatatatgatggcttggacagctggcatattaggtggcatccatcatgagcggtcactgtcttgcccatttccgacatcttcactgt

SEQ ID NO: 658596 - DNA, 343 bp, Homo sapiens
cccccctggaggccaatgcaaatactgggggaaggttccatggtagctaagtgtgggcaagctaatccctgaagttccctgatgcagagttgataatctctctaaagttggatgaaagactgggctgcctttaagctttgaaaaatgccatgcccattcaaggcagggtttttattgttgaaactcttgggtaatgacatctttattcaggtgaaaaaacaggatgaatttccactatatgatattgtttatgttccccagacatgttatttgtctttacaaaaattggtttcaataaactgggtggctgatattaaataaacatgggatttttccccttcca

SEQ ID NO: 658597 - DNA, 436 bp, Homo sapiens
actggtgcagccacatagacagctgctaggtcccaggagggcctgcaggtcaaagactgtggaaggccctcttggctatcagggctctctccccatggccatcttccccacctctgtattgctggttgtgggccccatagctcatcacccctgtctcctgctgaagtgtgtcagggctgatgctggcactgagcgagctgacatttgggtcaaaggccagggctctgcccagccagggagacttgactgccactgggcgcccatgacccctcccgcgtgcgtgtccagggtccaaagatggagagtcctgcgcgtttgggtttagttcccgaactcgacgaatccgccatcctcgacccagggcgcaagagttctctaagtcttgacgaagaccttacagaagagcaggacgtttctcatagacgtatcaacacac

SEQ ID NO: 658598 - DNA, 435 bp, Homo sapiens
taagcgggttcagagaggagagaaggaatggcagaggagcaaatattcaaagacatcatggctgagaattttccagaattgaaggtgtttgtggatcctcggatgtgacaagcaagatttaaaaagtaataaatcctgatctggaagaccagctgcacgcctcctcgcacctcacattctgtcccagccctgcctccccagggcacttcccagaagctacctgccacgtcctgctgttttggctccaatccgacctggcacagggaggttctgactgtccctgcccatctgctactccccagagtccttgctgagcctcgacttccttccctcaaatggggttggaactagaaccatagaactgtagcagcagaaggggcgttgggtggcatcgtgacagcagacaacggctgagtttggattccgtactcccca

SEQ ID NO: 658599 - DNA, 177 bp, Homo sapiens
gcggcaccgagactccagcttaacgctatttggaggtcagcactggtgctcacagaagcctggaacttgtccaggaggcgtgcaccgcaggggtaactcggcggggaggtgggcggccaggatcaccagcaggcagtggcttaggagcttgaagttgaccgggtccacccgaagctt

SEQ ID NO: 658600 - DNA, 448 bp, Homo sapiens
ggctcggaccgtcgttagcatcaagattactggcaggatcagcaaaaagaatggctctagagactaactgagcctgacgtaataactgctgtcagattatagtatctcagttcatggctgagacagctgccataatcagagtcacctccaccagaggagttcaacttacgaaaaatctcctgcttctttgatttaaccatgggtgatgtattttcaagcttggtgtgagaatgaaggcgagtagctgatactccctggtgtgcgggcatcattcctctgccctgtgatggctctgagcccctctgagacaagagcagcaagctgtcctgtaactcatgcacaagcggaacctgtggtggcgagatgtgctcgttgggctccgaagagacgtgactcctctctggggataagccaggtctacatcccctggatttggcctcgagatttg

SEQ ID NO: 658601 - DNA, 215 bp, Homo sapiens
  misc_feature (109)..(109): n is a, c, g, or t
tcccttgacggcgggtgggtggacacgcagactagagagcaaacagcaagggcgtgagcacctgctgcaggcacttccctgttctttctggagcttcagttatttatgntgtggggatcctggacagttccctcattttctcttctcttctctttttcttttcttttctttttttttttttttgggaacagatttctattatgggtacaccccgg

SEQ ID NO: 658602 - DNA, 253 bp, Homo sapiens
ccccggaaattttttttggggggccccgttttaagattaaatctttttaaagagaaaggggggaaattttccggccgggaatccaaccggtgggggggttggggggaatttttttcatttttctttaaccccctgtttgggggggcaaaaaaacttcccgggctttttttttcaagaaaagacttcccttttttgaaggcaacagtttttgtaaacctaatggggacaataaaaggggttttgaataaatgga

SEQ ID NO: 658603 - DNA, 704 bp, Homo sapiens
gatggatttggagctggtggcccagaagcagcgggagcgtgtagtaatgagtatggatacggtgaggcattggaactgggtaacggcagcgccaggatatcatagggcaagtagttgtcagcagctacgacagtcggctatcatggaatatgagatgcgtccgggtctgctgaggagagcgcggagggaataatggtccgaggtgttagcagccagacataatgagttagtagttaaagatcgagagggacaaagcagagagagccaagaagtactggtgtgcagtagtgggcttctcagcgcatcccccatgtggcaccagagcccaggtcctgattccctcttctcccagccaggagctctcccaccaagcgtgtagtatgaccagtgtcgcatatcaggtcaggctgccagtatgggacctctactgtaccctagacgttccgggcccgggaacatgctgtcagtctgtgaggctcatatgttgagctcctagccgtggggaggaactacgtgggggccaggagccctgtgcaattgctcagtggcttccccagagcgggccttctgcagaagctgacatggacgcggacctctgcaggagctgcgcctcgtgccttctgctgttctcaatgtgtctcaagaaatgtccccagctgagggcctgtgtcccgatgataccgctgggaccagtcatcgtcctt

SEQ ID NO: 658604 - DNA, 108 bp, Homo sapiens
  misc_feature (8)..(8): n is a, c, g, or t
ccgccgcngtaatgtgaaatagtacagaaatacaatgaaagaaatatctatcaaatggcactggccagacaatgacgcagattacgaagcggcggacttgctgggcac

SEQ ID NO: 658605 - DNA, 476 bp, Homo sapiens
ataccaaagtgtagatagtaattgattaggagagttatgggtaattcgtgttttctgaatttttcttaactcaaaaagtaacattaaattgaaacaatattgacatttacaagtactattaactgatttgtacaggataagcaacctagagttatttagcaaattgatcaagtggaaagagaggttctatagcaggcagaggggatgtggttgttcaaatgacaaaattagggaagctttagaataacaaaagctgtctatctatcagtggtggagagctgaagcaagcattataattgttgagtataatatttaacactttgtaaagaggcttaacatttcatttcaaagtacttctatgcattattttcttttagccttatgattactatgggttaggtatactagatatattctacatttttaaaatagaaaaaattttcagaagaaacaacttttacaaggttgtttttttt

SEQ ID NO: 658606 - DNA, 2326 bp, Homo sapiens
ccgccccctcggcgtccgctccgcccccggcttcgcctcccgctgccgccgccgccgccgccgcagccgctaccgccgctgcagccgctttccgcggcctgggcctctcgccgtcagcatgccacacgccttcaagcccggggacttggtgttcgctaagatgaagggctaccctcactggcctgccaggatcgacgacatcgcggatggcgccgtgaagcccccacccaacaagtaccccatctttttctttggcacacacgaaacagccttcctgggacccaaggacctgttcccctacgacaaatgtaaagacaagtacgggaagcccaacaagaggaaaggcttcaatgaagggctgtgggagatccagaacaacccccacgccagctacagcgcccctccgccagtgagctcctccgacagcgaggcccccgaggccaaccccgccgacggcagtgacgctgacgaggacgatgaggaccggggggtcatggccgtcacagcggtaaccgccacagctgccagcgacaggatggagagcgactcagactcagacaagagtagcgacaacagtggcctgaagaggaagacgcctgcgctaaagatgtcggtctcgaaacgagcccgaaaggcctccagcgacctggatcaggccagcgtgtccccatccgaagaggagaactcggaaagctcatctgagtcggagaagaccagcgaccaggacttcacacctgagaagaaagcagcggtccgggcgccacggaggggccctctggggggacggaaaaaaaagaaggcgccgtcagcctccgactccgactccaaggccgattcggacggggccaagcctgagccggtggccatggcgcggtcggcgtcctcctcctcctcttcctcctcctcctccgactccgatgtgtctgtgaagaagcctccgaggggcaggaagccagcggagaagcctctcccgaagccgcgagggcggaaaccgaagcctgaacggcctccgtccagctccagcagtgacagtgacagcgacgaggtggaccgcatcagtgagtggaagcggcgggacgaggcgcggaggcgcgagctggaggcccggcggcggcgagagcaggaggaggagctgcggcgcctgcgggagcaggagaaggaggagaaggagcggaggcgcgagcgggccgaccgcggggaggctgagcggggcagcggcggcagcagcggggacgagctcagggaggacgatgagcccgtcaagaagcggggacgcaagggccggggccggggtcccccgtcctcctctgactccgagcccgaggccgagctggagagagaggccaagaaatcagcgaagaagccgcagtcctcaagcacagagcccgccaggaaacctggccagaaggagaagagagtgcggcccgaggagaagcaacaagccaagcccgtgaaggtggagcggacccggaagcggtccgagggcttctcgatggacaggaaggtagagaagaagaaagagccctccgtggaggagaagctgcagaagctgcacagtgagatcaagtttgccctaaaggtcgacagcccggacgtgaagaggtgcctgaatgccctagaggagctgggaaccctgcaggtgacctctcagatcctccagaagaacacagacgtggtggccaccttgaagaagattcgccgttacaaagcgaacaaggacgtaatggagaaggcagcagaagtctatacccggctcaagtcgcgggtcctcggcccaaagatcgaggcggtgcagaaagtgaacaaggctgggatggagaaggagaaggccgaggagaagctggccggggaggagctggccggggaggaggccccccaggagaaggcggaggacaagcccagcaccgatctctcagccccagtgaatggcgaggccacatcacagaagggggagagcgcagaggacaaggagcacgaggagggtcgggactcggaggaggggccaaggtgtggctcctctgaagacctgcacgacagcgtacgggagggtcccgacctggacaggcctgggagcgaccggcaggagcgcgagagggcacggggggactcggaggccctggacgaggagagctgagccgcgggcagccaggcccagcccccgcccgagctcaggctgcccctctccttccccggctcgcaggagagcagagcagagaactgtggggaacgctgtgctgtttgtatttgttcccttgggtttttttttcctgcctaatttctgtgatttccaaccaacatgaaatgactataaatggttttttaatga

SEQ ID NO: 658607 - DNA, 497 bp, Homo sapiens
  misc_feature (23)..(23): n is a, c, g, or t
ccagaacaacccccacgccagtnacagcgcccctccgccagtgagctcctccgacagcgaggcccccgaggccaaccccgccgacggcagtgacgctgacgaggacgatgaggaccggggggtcatggccgtcacagcggtaaccgccacagctgccagcgacaggatggagagcgactcagactcagacaagagtagcgacaacagtggcctgaagaggatcgacgacatcgcggatggcgccgtgaagcccccacccaacaagtaccccatctttttctttggcacacacgaaacagccttcctgggacccaaggacctgttcccctacgacaaatgtaaagacaagtacgggaagcccaacaagaggaaaggcttcaatgaagaactgtggggaacgctgtgctgtttgtatttgttcccttgggtttttttttcctgcctaatttctgtgatttccaaccaacatgaaatgactataaatggttttttaatga

SEQ ID NO: 658608 - DNA, 295 bp, Homo sapiens
  misc_feature (192)..(192): n is a, c, g, or t
  misc_feature (248)..(249): n is a, c, g, or t
  misc_feature (265)..(265): n is a, c, g, or t
  misc_feature (268)..(268): n is a, c, g, or t
ccggctgatgcacatatggaccctggtccaatattcgtacagcgtatgcaaatgatggtctgcctgagtcagtgctttaagtaacttctccaggtccttagcttttctctgtgtgtttaactgcttcaatgcactttcctccgtaccaggctgcttcctcctaactccctttgcctactttgtaaataaatnatattggcccccactgcctcttcactctgatgataagcatttgcttaactactttnnttcgtttaacacattnttnttcttcaactgatatttttgagccctg

SEQ ID NO: 658609 - DNA, 470 bp, Homo sapiens
  misc_feature (292)..(292): n is a, c, g, or t
  misc_feature (355)..(355): n is a, c, g, or t
  misc_feature (357)..(357): n is a, c, g, or t
  misc_feature (362)..(362): n is a, c, g, or t
ttctctgctgtccctgcacagtgggtggaggaagtgcttcagggccagccagggcaggtctgctgtgacaaggaccccaccaccccacccagcagctggaggacatccaaagagtcctccatcctgggctagccagagctgaagcttattgagcgcctactctatgcagtacctgcatgggctcatttctccttcgcactagcccaggaggcagcgctgcgattatccccctttcacagaggaggggctgaccccagagaggcacagtcacctgcccagggtgagtgtggcncagaggtcgagggtcacccggcaggtcctgatcacccatcctaggaaggtgcctggctctacncntgacncaggaactgatgtttctttctacccttgcccaggagttttaggaagaagcccgggtcccccaccccagcagggcagataaaggcttgggttccaggtttccccttttc

SEQ ID NO: 658610 - DNA, 456 bp, Homo sapiens
  misc_feature (5)..(5): n is a, c, g, or t
  misc_feature (47)..(47): n is a, c, g, or t
  misc_feature (50)..(50): n is a, c, g, or t
  misc_feature (52)..(53): n is a, c, g, or t
  misc_feature (128)..(128): n is a, c, g, or t
  misc_feature (168)..(168): n is a, c, g, or t
  misc_feature (199)..(199): n is a, c, g, or t
  misc_feature (352)..(352): n is a, c, g, or t
  misc_feature (355)..(355): n is a, c, g, or t
  misc_feature (362)..(362): n is a, c, g, or t
  misc_feature (366)..(366): n is a, c, g, or t
  misc_feature (382)..(382): n is a, c, g, or t
  misc_feature (410)..(410): n is a, c, g, or t
  misc_feature (419)..(419): n is a, c, g, or t
  misc_feature (449)..(449): n is a, c, g, or t
gcatncaggggtctaatctctgcctcatgatgcagagattaagcccntgnannagtcgcatgccaccaacaagatccccgtgaagtactggagttcatctcggaatgcatcatccaggttctgcaganaagcatcccggggactttggtgctgatgcccagggcgcantgaacaaggcctggagctgttccggaagacnatggcctccaactacaaggagctgggcttccagggctaggcccttgccgctcccacccccacccatctgggccccgggttcaagagagagcggggtctgatctcgtgtagccatatagagtttgcttctgagtgtctgctttgtttagtagangtnggcaagnaganctgagggctggggctnggggtgttgaagttggctttgcaatgangaggagatnttgggctggcggccacttgggaaagatttnactatct

SEQ ID NO: 658611 - DNA, 2290 bp, Homo sapiens
catccttggagctgccagctgcatcctctgggggaccgcccgtgatgcccctctttgcgggaggggtccccaggaaaggtcctgggagtccatagacgctgagcttggccccaccccctggttgcttcagagggccggatctggctttgctcagatcgacgacatcgcggatggcgccgtgaagcccccacccaacaagtaccccatctttttctttggcacacacgaaacagccttcctgggacccaaggacctgttcccctacgacaaatgtaaagacaagtacgggaagcccaacaagaggaaaggcttcaatgaagggctgtgggagatccagaacaacccccacgccagctacagcgcccctccgccagtgagctcctccgacagcgaggcccccgaggccaaccccgccgacggcagtgacgctgacgaggacgatgaggaccggggggtcatggccgtcacagcggtaaccgccacagctgccagcgacaggatggagagcgactcagactcagacaagagtagcgacaacagtggcctgaagaggaagacgcctgcgctaaagatgtcggtctcgaaacgagcccgaaaggcctccagcgacctggatcaggccagcgtgtccccatccgaagaggagaactcggaaagctcatctgagtcggagaagaccagcgaccaggacttcacacctgagaagaaagcagcggtccgggcgccacggaggggccctctggggggacggaaaaaaaagaaggcgccgtcagcctccgactccgactccaaggccgattcggacggggccaagcctgagccggtggccatggcgcggtcggcgtcctcctcctcctcttcctcctcctcctccgactccgatgtgtctgtgaagaagcctccgaggggcaggaagccagcggagaagcctctcccgaagccgcgagggcggaaaccgaagcctgaacggcctccgtccagctccagcagtgacagtgacagcgacgaggtggaccgcatcagtgagtggaagcggcgggacgaggcgcggaggcgcgagctggaggcccggcggcggcgagagcaggaggaggagctgcggcgcctgcgggagcaggagaaggaggagaaggagcggaggcgcgagcgggccgaccgcggggaggctgagcggggcagcggcggcagcagcggggacgagctcagggaggacgatgagcccgtcaagaagcggggacgcaagggccggggccggggtcccccgtcctcctctgactccgagcccgaggccgagctggagagagaggccaagaaatcagcgaagaagccgcagtcctcaagcacagagcccgccaggaaacctggccagaaggagaagagagtgcggcccgaggagaagcaacaagccaagcccgtgaaggtggagcggacccggaagcggtccgagggcttctcgatggacaggaaggtagagaagaagaaagagccctccgtggaggagaagctgcagaagctgcacagtgagatcaagtttgccctaaaggtcgacagcccggacgtgaagaggtgcctgaatgccctagaggagctgggaaccctgcaggtgacctctcagatcctccagaagaacacagacgtggtggccaccttgaagaagattcgccgttacaaagcgaacaaggacgtaatggagaaggcagcagaagtctatacccggctcaagtcgcgggtcctcggcccaaagatcgaggcggtgcagaaagtgaacaaggctgggatggagaaggagaaggccgaggagaagctggccggggaggagctggccggggaggaggccccccaggagaaggcggaggacaagcccagcaccgatctctcagccccagtgaatggcgaggccacatcacagaagggggagagcgcagaggacaaggagcacgaggagggtcgggactcggaggaggggccaaggtgtggctcctctgaagacctgcacgacagcgtacgggagggtcccgacctggacaggcctgggagcgaccggcaggagcgcgagagggcacggggggactcggaggccctggacgaggagagctgagccgcgggcagccaggcccagcccccgcccgagctcaggctgcccctctccttccccggctcgcaggagagcagagcagagaactgtggggaacgctgtgctgtttgtatttgttcccttgggtttttttttcctgcctaatttctgtgatttccaaccaacatgaaatgactataaatggttttttaatga

SEQ ID NO: 658612 - DNA, 498 bp, Homo sapiens
  misc_feature (5)..(5): n is a, c, g, or t
  misc_feature (47)..(47): n is a, c, g, or t
  misc_feature (50)..(50): n is a, c, g, or t
  misc_feature (52)..(53): n is a, c, g, or t
  misc_feature (110)..(110): n is a, c, g, or t
  misc_feature (170)..(170): n is a, c, g, or t
  misc_feature (210)..(210): n is a, c, g, or t
  misc_feature (241)..(241): n is a, c, g, or t
  misc_feature (394)..(394): n is a, c, g, or t
  misc_feature (397)..(397): n is a, c, g, or t
  misc_feature (404)..(404): n is a, c, g, or t
  misc_feature (408)..(408): n is a, c, g, or t
  misc_feature (424)..(424): n is a, c, g, or t
  misc_feature (452)..(452): n is a, c, g, or t
  misc_feature (461)..(461): n is a, c, g, or t
  misc_feature (491)..(491): n is a, c, g, or t
gcatncaggggtctaatctctgcctcatgatgcagagattaagcccntgnannagtcgcatgccaccaggtacttcacggggatcttgtgcttggtggcatgcgactgtnacaagatccccgtgaagtactggagttcatctcggaatgcatcatccaggttctgcaganaagcatcccggggactttggtgctgatgcccagggcgcantgaacaaggcctggagctgttccggaagacnatggcctccaactacaaggagctgggcttccagggctaggcccttgccgctcccacccccacccatctgggccccgggttcaagagagagcggggtctgatctcgtgtagccatatagagtttgcttctgagtgtctgctttgtttagtagangtnggcaagnaganctgagggctggggctnggggtgttgaagttggctttgcaatgangaggagatnttgggctggcggccacttgggaaagatttnactatct

SEQ ID NO: 658613 - DNA, 530 bp, Homo sapiens
ctaggtggaaagctgacgtgaaccgtctgcacgacgggtggctgggaggtcgaggtggtcactggggtggccacagtgtagtgtgacaggcttgatggcctgtggtagctgccgctggacggtgattaagactggctgactggacagaggtgaccctaggatcaacatcttcctcctggggcgctctgggcaaacctgggcttcctggatgacagcgagtttgggctgtgcatgcgcctgtgctcagtgctccaggtgtgccggtgaaccttccctcgacatgtgctctcaggggtcttgggcgccactagatgtgagcagacagcactcccgcgtgattggggagagggtgtggcaactcctagaagagagcggtccccagaggggttctaaagcagggcatgcccctagtgctgtccgtttcctaaaaagcctgttctattaattttgctttccagaggcttggtctaatcctccaagaaatgaggctttgcctggttcttcctgggaacgcgggactttgatgaaat

SEQ ID NO: 658614 - DNA, 317 bp, Homo sapiens
ccgaccgtatgtgggtggcttactttctgggattgaacatttccagcccctgaggaggctgcagacaagtgctgttgtagaacactcactaagttgtgatattttgaagtctgtggtgtgtgttgatgtaaatctcgacaatttctgctaatcagaactttcttgtttccagggttctcacagtgtgcctactcaggctatcagccgtccaggagactttctgtacttcatttctctccatagtcctcacatcgcagatctccaactgctgtgctaggtaagtacacaccttacctttccctcaggaagcttgtcca

SEQ ID NO: 658615 - DNA, 992 bp, Homo sapiens
gcagactcacttcgacaaaacctgggacacagctactacacgaacatcatatcgtacagagactgtgtgacaacgtacacgaagatggtcagtactggacgacacgtttgtcagccaaacttccaaactcttgactctgacaccgacgaagcatttctactggacttacaaaccatagtgaatgcacagtcatctgctggacaaagtcttatgtacgtacatatccctccttacatacggcatatcctacgctcactacaggatacacaaccatactggaagcgaagccaatataacatgtagacacagtgtgggaacattctatcgacttactgttccaggtgttaagaagacacatgatactgcacagtggaaaatccagcttactcaatgtacgatactgtgggacaacgctctatattatctcaatatcagttgacacgcacctcagagaactcacaacatggagacaaaactcctataaaatgtacacacatgtggataaagcattcaattgtcttcaggctcttgtctaaatacatgcacgaactcacactgaagagaaaagccgtacgacatgtaacggtaatgtgggcacacccttcagactatactatgatacttataagacggcatgaccaggacatcactaatggagacaagaacctcataaattgtacccaactgataatacagatcttccacatgttacccatcttcctatgcattcacacattgtacatcgcatccagataactggtaaagcgatatcactatgtagcatgtactacacacgtggtacaccaaagacttctagtctggcgatagatagccgttataccttacaaggaagagcgaatacataagtgaacaaacagaccgtcatgaatcgtaatgaatcggagagctaaacactaccagctgagtgacgctcgatgcatagtgctatctaacaagaacatagtacaggtcggaggttagagcaacacata

SEQ ID NO: 658616 - DNA, 2625 bp, Homo sapiens
  misc_feature (2346)..(2346): n is a, c, g, or t
ccgccccctcggcgtccgctccgcccccggcttcgcctcccgctgccgccgccgccgccgccgcagccgctaccgccgctgcagccgctttccgcggcctgggcctctcgccgtcagcatgccacacgccttcaagcccggggacttggtgttcgctaagatgaagggctaccctcactggcctgccaggatcgacgacatcgcggatggcgccgtgaagcccccacccaacaagtaccccatctttttctttggcacacacgaaacagccttcctgggacccaaggacctgttcccctacgacaaatgtaaagacaagtacgggaagcccaacaagaggaaaggcttcaatgaagggctgtgggagatccagaacaacccccacgccagctacagcgcccctccgccagtgagctcctccgacagcgaggcccccgaggccaaccccgccgacggcagtgacgctgacgaggacgatgaggaccggggggtcatggccgtcacagcggtaaccgccacagctgccagcgacaggatggagagcgactcagactcagacaagagtagcgacaacagtggcctgaagaggaagacgcctgcgctaaagatgtcggtctcgaaacgagcccgaaaggcctccagcgacctggatcaggccagcgtgtccccatccgaagaggagaactcggaaagctcatctgagtcggagaagaccagcgaccaggacttcacacctgagaagaaagcagcggtccgggcgccacggaggggccctctggggggacggaaaaaaaagaaggcgccgtcagcctccgactccgactccaaggccgattcggacggggccaagcctgagccggtggccatggcgcggtcggcgtcctcctcctcctcttcctcctcctcctccgactccgatgtgtctgtgaagaagcctccgaggggcaggaagccagcggagaagcctctcccgaagccgcgagggcggaaaccgaagcctgaacggcctccgtccagctccagcagtgacagtgacagcgacgaggtggaccgcatcagtgagtggaagcggcgggacgaggcgcggaggcgcgagctggaggcccggcggcggcgagagcaggaggaggagctgcggcgcctgcgggagcaggagaaggaggagaaggagcggaggcgcgagcgggccgaccgcggggaggctgagcggggcagcggcggcagcagcggggacgagctcagggaggacgatgagcccgtcaagaagcggggacgcaagggccggggccggggtcccccgtcctcctctgactccgagcccgaggccgagctggagagagaggccaagaaatcagcgaagaagccgcagtcctcaagcacagagcccgccaggaaacctggccagaaggagaagagagtgcggcccgaggagaagcaacaagccaagcccgtgaaggtggagcggacccggaagcggtccgagggcttctcgatggacaggaaggtagagaagaagaaagagccctccgtggaggagaagctgcagaagctgcacagtgagatcaagtttgccctaaaggtcgacagcccggacgtgaagaggtgcctgaatgccctagaggagctgggaaccctgcaggtgacctctcagatcctccagaagaacacagacgtggtggccaccttgaagaagattcgccgttacaaagcgaacaaggacgtaatggagaaggcagcagaagtctatacccggctcaagtcgcgggtcctcggcccaaagatcgaggcggtgcagaaagtgaacaaggctgggatggagaaggagaaggccgaggagaagctggccggggaggagctggccggggaggaggccccccaggagaaggcggaggacaagcccagcaccgatctctcagccccagtgaatggcgaggccacatcacagaagggggagagcgcagaggacaaggagcacgaggagggtcgggactcggaggaggggccaaggtgtggctcctctgaagacctgcacgacagcgtacgggagggtcccgacctggacaggcctgggagcgaccggcaggagcgcgagagggcacggggggactcggaggccctggacgaggagagctgagccgcgggcagccaggcccagcccccgcccgagctcaggctgcccctctccttccccggctcgcaggagagcagagcagagaactgtggggaacgctgtgctgtttgtatttgttcccttgggtttttttttcctgcctaatttctgtgatttccaaccaacatgaaatgactataaatggttttttaatgaaaaaagaaacacaccaaaanacgtcgggtctccgcggccccgggttattgtaggaaccatcccggcccgcgttatcgtaggaactattcgggcccgcgttactcgtagggtctggcgccgggccgggccccaccagacgggaatccccggcccaaatgggggccgaggaggtccttggccagagttttttgggagccaggccgggtggattggctcgccggggcccgtgttgttcctccgggccggggtttggtcccgaccggtcccgagggccggcccattgttgaccgcgggggttg

SEQ ID NO: 658617 - DNA, 313 bp, Homo sapiens
  misc_feature (112)..(112): n is a, c, g, or t
gaagatggagtcttgctctgttgcccagcctggagtgcagtggcacgatattggctcactgcaacctctgcctcccaggttcaagcaattctcccgcctcagcctcccgagnatagctgggattacaggtgtgcgccacaatgcctggctaatttttatacttttaatagaaacaggatttcatcatgttggccaggctggtctcgaactcctgacctcaggtgatccgcccgccttggcctcccaaagtgctaggattacaggcatgaccatgaggcccagacaatgatttttaaaactcctctattttaga

SEQ ID NO: 658618 - DNA, 842 bp, Homo sapiens
gcggacacccactttctcccgagttttttatggaaaactatgttttcccgcaaatgagaaggtggtgaagccttcccctggcacccccgttctcctataagaggctcttggatagtgcccccactcaagcgcccaaagggaggctttttatataggcgcgcccaacgagagcgcgcacacgctggtctttgtccaaaaaggggttggttccacaccacgcacccacccacatataaatggacagatgatgagagaagttttcccgccactccggtttgtcacgccccaccaccccttttttcctcagcggttgccgcgccccccgacggtaatgtaggccctcctcgggcggaagatccttctcccgcgaggggaaacccacggtgcccccccacattagtttttctctttcgcgagaagaggccgctctctccccgcgagaggatacccacggcttggagccacctatatgggctatattcactctccacgtgttccgcctgagcccctgatgttctgcactgaacgaatgatagaagacacagcacacaccacactctgtggttacacttgttggaatgtttatagccccacccagcacccacgagtgtgtaaccaagggctgtgatagagagagcctgctactgacccattgaatgtggccccacggtcaaccaacaccctgaggttcggccctgattggagagaagaaggcatattttctgaatggctcctgatttcgcatgctttgtgatcagttccccaccaaattgggatcattttaactgaatccccctgcctaattcttgaatatatatatatatatatcttttcccccatta

SEQ ID NO: 658619 - DNA, 996 bp, Homo sapiens
ggcaggatggtaatagaggtcatcgggaaggcacacaagaatggagctggagcccgactcccgagggaagactccgggcgggggacgtttgaggaatcgaggtgaaccagattcttaacgatgctccgagagaatggactgggctcctctgtgtcagaaaatccctgtgctgaggatacaaagcaatgttcaagtctatggtcgatgtgcggaaggctaaaggttccactgcagttaatagtctcccaggtcaatatgcgtgtcgttggactaggttggaacgtcagagggccataacggattccagtatcggcgttcaatgcatgcggactctgcctcacttcatccggaggatgatgtacggcctgtgagcagcgcaggagcgtgtgtggaggaactcctaagctagtgcggtgtcactacccgagctgagttgctttatcctcgacggaggatgtgggggcggtctgtgaagggagctcatggacgacggtgtgagccacgtactggtggagagtggatgacatcacaagcgtgttggggtggatcaagatttgcatggtagtggagtggatgaggtgaagtactgatgacgactgtgtggatacgtccaatcatagggaggatggtggccaggtggtggctgacggacgacggacgagcgctggtccaggtggaagagggatatggtgtcgcggaatctgggtagatgtgtagccggtccatggaaggctgtcgaagaagaacgggcctgggttccgagtggtgacatcagaggaggggcctggggggcaccctggacgaggagctggtgaaggcggtgctggaaaaacgggaacgccacagacgagggagcgggccattgagcccctgcgggagaaccacgaggggccaggcacagggcccggggaacacgcgacgggcgcacaggcgggggaggaagggaggcggcccctcaacagcgccgcacactccccaagagggccggaccaaggg

SEQ ID NO: 658620 - DNA, 1768 bp, Homo sapiens
  misc_feature (855)..(855): n is a, c, g, or t
  misc_feature (1176)..(1176): n is a, c, g, or t
gcccaggtcgcccggtcaggtctgcagtaggaggacagggagggagcagctggggtcttccgttcgaagaaggcgttcgagaatctgggggtcgtgggtgtctcgtgggtatgaatagcagtggcggggccattacgtaggcccggtggtatcgctagcactagtgagtgaagagaggtcagggagtcggctagcatgtagagaaactctcggcaaagatggggtgggctagtcactagagatgtggtctgccgctggcccacgaaggataggaggacgcggcgtaagagtccaggggagggcattggaatggatacgtatgtctcgctgggccagggattgattcataagccatgcttttgcgtgcgcgcgtcgttcctcgattgtgaacagcgtaggttcggggatgaattccgaggataggaatctatacatatgcccttcgcgcgttgagactcgtggccttctgcggaaaggagtactcgcagggcgttccctctgcacctgaattttcatgtggcttcaggggtgacggaggcatagggcggaacgtaccccgcaagtcgccaccggaggtcaaaaggaccaggcaactccgagtggttgtccaaatatggtgaccagtgagggcggatcccggcgtggacttcggtgggcgaagcttcatcggccaagggggccccctaggggatgcggaagctggcgtcgtgggggtgggatccaagaccgggtatggcgtccccctaatcgaggcaccgctggtgggggtgccgaacgcgccggacggaaaccgcggggtagagaggcgttggccacattcggagttgcacgtaggggggttccacaaggagcttntcgttactcgaattcagatgggcgccccgctgggtttgcggacgcaggggctttgtggcattggagaagaggcggaccacccatagggggaaaaccgggggttaattgcgcccgcaccaaaaaacaatggggtccccaccgtgtaggaaatatggcgctttaggagaccaaaagggcggtctggctctggaatttgtgcctttggcctccggttccggccatagagggggtcactctggcgcctgtccgaaatggttccccattgtggcgattcacttgcgaaaggggggggcccacaatggggcgggatatgcccgttanacatttctctgtgagagccctctgtgtgagcccctgaaccaggccaatgtgcctttgtctaccagtagacatcgggggccgagggcgtaaactgcgttgacattggagaacgtatgggtctttatggaaacctcattttaaaacctctcgggggttgtggggtatgagcaaccgcactaggcacaagccctcgtgggtggacatacaacccattaagggcggaacggtgacccaaggcggcaaggaagggggccaacttttcgttacaagacacccctgaagcggggctgctgggctggagaagccccgctcaagaaaaaacctccgtgcgaaaaagcgggaggagcgtggtagtccgcagcgcgacactggtgtgttcgccgtaatgaggggccgatgtacacgtggagtgcccacactttgtggggcggagaaaggcgcgcacccacgagaggtgctcaccagacacgaggggggaaccatccgcgtgcatccacagcggtggtgttaacacacgacacgggggtctgtcacacacagagaaaacacaggggcagatcaggcgcggcgagaagacaccaacgcgcgagaa

SEQ ID NO: 658621 - DNA, 2240 bp, Homo sapiens
ccgccccctcggcgtccgctccgcccccggcttcgcctcccgctgccgccgccgccgccgccgcagccgctaccgccgctgcagccgctttccgcggcctgggcctctcgccgtcagcatgccacacgccttcaagcccggggacttggtgttcgctaagatgaagggctaccctcactggcctgccaggatcgacgacatcgcggatggcgccgtgaagcccccacccaacaagtaccccatctttttctttggcacacacgaaacagccttcctgggacccaaggacctgttcccctacgacaaatgtaaagacaagtacgggaagcccaacaagaggaaaggcttcaatgaagggctgtgggagatccagaacaacccccacgccagctacagcgcccctccgccagtgagctcctccgacagcgaggcccccgaggccaaccccgccgacggcagtgacgctgacgaggacgatgaggaccggggggtcatggccgtcacagcggtaaccgccacagctgccagcgacaggatggagagcgactcagactcagacaagagtagcgacaacagtggcctgaagaggaagacgcctgcgctaaagatgtcggtctcgaaacgagcccgaaaggcctccagcgacctggatcaggccagcgtgtccccatccgaagaggagaactcggaaagctcatctgagtcggagaagaccagcgaccaggacttcacacctgagaagaaagcagcggtccgggcgccacggaggggccctctggggggacggaaaaaaaagaaggcgccgtcagcctccgactccgactccaaggccgattcggacggggccaagcctgagccggtggccatggcgcggtcggcgtcctcctcctcctcttcctcctcctcctccgactccgatgtgtctgtgaagaagcctccgaggggcaggaagccagcggagaagcctctcccgaagccgcgagggcggaaaccgaagcctgaacggcctccgtccagctccagcagtgacagtgacagcgacgaggtggaccgcatcagtgagtggaagcggcgggacgaggcgcggaggcgcgaagcgggccgaccgcggggaggctgagcggggcagcggcggcagcagcggggacgagctcagggaggacgatgagcccgtcaagaagcggggacgcaagggccggggccggggtcccccgtcctcctctgactccgagcccgaggccgagctggagagagaggccaagaaatcagcgaagaagccgcagtcctcaagcacagagcccgccaggaaacctggccagaaggagaagagagtgcggcccgaggagaagcaacaagccaagcccgtgaaggtggagcggacccggaagcggtccgagggcttctcgatggacaggaaggtagagaagaagaaagagccctccgtggaggagaagctgcagaagctgcacagtgagatcaagtttgccctaaaggtcgacagcccggacgtgaagaggtgcctgaatgccctagaggagctgggaaccctgcaggtgacctctcagatcctccagaagaacacagacgtggtggccaccttgaagaagattcgccgttacaaagcgaacaaggacgtaatggagaaggcagcagaagtctatacccggctcaagtcgcgggtcctcggcccaaagatcgaggcggtgcagaaagtgaacaaggctgggatggagaaggagaaggccgaggagaagctggccggggaggagctggccggggaggaggccccccaggagaaggcggaggacaagcccagcaccgatctctcagccccagtgaatggcgaggccacatcacagaagggggagagcgcagaggacaaggagcacgaggagggtcgggactcggaggaggggccaaggtgtggctcctctgaagacctgcacgacagcgtacgggagggtcccgacctggacaggcctgggagcgaccggcaggagcgcgagagggcacggggggactcggaggccctggacgaggagagctgagccgcgggcagccaggcccagcccccgcccgagctcaggctgcccctctccttccccggctcgcaggagagcagagcagagaactgtggggaacgctgtgctgtttgtatttgttcccttgggtttttttttcctgcctaatttctgtgatttccaaccaacatgaaatgactataaatggttttttaatga

SEQ ID NO: 658622 - DNA, 2282 bp, Homo sapiens
ccgccccctcggcgtccgctccgcccccggcttcgcctcccgctgccgccgccgccgccgccgcagccgctaccgccgctgcagccgctttccgcggcctgggcctctcgccgtcagcatgccacacgccttcaagcccggggacttggtgttcgctaagatgaagggctaccctcactggcctgccaggatcgacgacatcgcggatggcgccgtgaagcccccacccaacaagtaccccatctttttctttggcacacacgaaacagccttcctgggacccaaggacctgttcccctacgacaaatgtaaagacaagtacgggaagcccaacaagaggaaaggcttcaatgaagggctgtgggagatccagaacaacccccacgccagctacagcgcccctccgccagtgagctcctccgacagcgaggcccccgaggccaaccccgccgacggcagtgacgctgacgaggacgatgaggaccggggggtcatggccgtcacagcggtaaccgccacagctgccagcgacaggatggagagcgactcagactcagacaagagtagcgacaacagtggcctgaagaggaagacgcctgcgctaaagatgtcggtctcgaaacgagcccgaaaggcctccagcgacctggatcaggccagcgtgtccccatccgaagaggagaactcggaaagctcatctgagtcggagaagaccagcgaccaggacttcacacctgagaagaaagcagcggtccgggcgccacggaggggccctctggggggacggaaaaaaaagaaggcgccgtcagcctccgactccgactccaaggccgattcggacggggccaagcctgagccggtggccatggcgcggtcggcgtcctcctcctcctcttcctcctcctcctccgactccgatgtgtctgtgaagaagcctccgaggggcaggaagccagcggagaagcctctcccgaagccgcgagggcggaaaccgaagcctgaacggcctccgtccagctccagcagtgacagtgacagcgacgaggtggaccgcatcagtgagtggaagcggcgggacgaggcgcggaggcgcgagctggaggcccggcggcggcgagagcaggaggaggagctgcggcgcctgcgggagcaggagaaggaggagaaggagcggaggcgcgagcggggacgagctcagggaggacgatgagcccgtcaagaagcggggacgcaagggccggggccggggtcccccgtcctcctctgactccgagcccgaggccgagctggagagagaggccaagaaatcagcgaagaagccgcagtcctcaagcacagagcccgccaggaaacctggccagaaggagaagagagtgcggcccgaggagaagcaacaagccaagcccgtgaaggtggagcggacccggaagcggtccgagggcttctcgatggacaggaaggtagagaagaagaaagagccctccgtggaggagaagctgcagaagctgcacagtgagatcaagtttgccctaaaggtcgacagcccggacgtgaagaggtgcctgaatgccctagaggagctgggaaccctgcaggtgacctctcagatcctccagaagaacacagacgtggtggccaccttgaagaagattcgccgttacaaagcgaacaaggacgtaatggagaaggcagcagaagtctatacccggctcaagtcgcgggtcctcggcccaaagatcgaggcggtgcagaaagtgaacaaggctgggatggagaaggagaaggccgaggagaagctggccggggaggagctggccggggaggaggccccccaggagaaggcggaggacaagcccagcaccgatctctcagccccagtgaatggcgaggccacatcacagaagggggagagcgcagaggacaaggagcacgaggagggtcgggactcggaggaggggccaaggtgtggctcctctgaagacctgcacgacagcgtacgggagggtcccgacctggacaggcctgggagcgaccggcaggagcgcgagagggcacggggggactcggaggccctggacgaggagagctgagccgcgggcagccaggcccagcccccgcccgagctcaggctgcccctctccttccccggctcgcaggagagcagagcagagaactgtggggaacgctgtgctgtttgtatttgttcccttgggtttttttttcctgcctaatttctgtgatttccaaccaacatgaaatgactataaatggttttttaatga

SEQ ID NO: 658623 - DNA, 3218 bp, Homo sapiens
  misc_feature (2939)..(2939): n is a, c, g, or t
ccgccccctcggcgtccgctccgcccccggcttcgcctcccgctgccgccgccgccgccgccgcagccgctaccgccgctgcagccgctttccgcggcctgggcctctcgccgtcagcatgccacacgccttcaagcccggggacttggtgttcgctaagatgaagggctaccctcactggcctgccaggatcgacgacatcgcggatggcgccgtgaagcccccacccaacaagtaccccatctttttctttggcacacacgaaacagccttcctgggacccaaggacctgttcccctacgacaaatgtaaagacaagtacgggaagcccaacaagaggaaaggcttcaatgaagggctgtgggagatccagaacaacccccacgccagctacagcgcccctccgccagtgagctcctccgacagcgaggcccccgaggccaaccccgccgacggcagtgacgctgacgaggacgatgaggaccggggggtcatggccgtcacagcggtaaccgccacagctgccagcgacaggatggagagcgactcagactcagacaagagtagcgacaacagtggcctgaagaggaagacgcctgcgctaaagatgtcggtctcgaaacgagcccgaaaggcctccagcgacctggatcaggccagcgtgtccccatccgaagaggagaactcggaaagctcatctgagtcggagaagaccagcgaccaggacttcacacctgagaagaaagcagcggtccgggcgccacggaggggccctctggggggacggaaaaaaaagaaggcgccgtcagcctccgactccgactccaaggccgattcggacggggccaagcctgagccggtggccatggcgcggtcggcgtcctcctcctcctcttcctcctcctcctccgactccgatgtgtctgtgaagaagcctccgaggggcaggaagccagcggagaagcctctcccgaagccgcgagggcggaaaccgaagcctgaacggcctccgtccagctccagcagtgacagtgacagcgacgaggtggaccgcatcagtgagtggaagcggcgggacgaggcgcggaggcgcgagctggaggcccggcggcggcgagagcaggaggaggagctgcggcgcctgcgggagcaggagaaggaggagaaggagcggaggcgcgagcgggccgaccgcggggaggctgagcggggcagcggcggcagcagcggggacgagctcagggaggacgatgagcccgtcaagaagcggggacgcaagggccggggccggggtcccccgtcctcctctgactccgagcccgaggccgagctggagagagaggccaagaaatcagcgaagaagccgcagtcctcaagcacagagcccgccaggaaacctggccagaaggagaagagagtgcggcccgaggagaagcaacaagccaagcccgtgaaggtggagcggacccggaagcggtccgagggcttctcgatggacaggaaggtagagaagaagaaagagccctccgtggaggagaagctgcagaagctgcacagtgagatcaagtttgccctaaaggtcgacagcccggacgtgaagaggtgcctgaatgccctagaggagctgggaaccctgcaggtgacctctcagatcctccagaagaacacagacgtggtggccaccttgaagaagattcgccgttacaaagcgaacaaggacgtaatggagaaggcagcagaagtctatacccggctcaagtcgcgggtcctcggcccaaagatcgaggcggtgcagaaagtgaacaaggctgggatggagaaggagaaggccgaggagaagctggccggggaggagctggccggggaggaggccccccaggagaaggcggaggacaagcccagcaccgatctctcagccccagtgaatggcgaggccacatcacagaagggggagagcgcagaggacaaggagcacgaggagggtcgggactcggaggaggggccaaggtgtggctcctctgaagacctgcacgagtgagtgtcccgggccgtggggtttggactcctgagcggcagcggtgtgacgcgcaccctgggtccgagccgctcctcctgtgccagtccctctgggatgggtcccagggatgtcgtccttactcgggcctcccaccttcacagctgaccccagggccccgctggctggcacttccggcggcccctacagagaggcagctccagggctttgagctgcctgcccctggcctcctgggaaggtggcttcttgccgagcctccagggtggcccaggtaggtaggccccgagcacaggcacccggctatctgacggtgcctgtgcccatcactgtgggctgctgtctggtacaaggctcagtggagtcactcacttacccagcagctgccttgtgctatgcctggctggcgccagcgtggggaccctggagatggttgtggtctctagtggcagaagacaggcagataggagggcggcactcgagcctcaggtgccacaacgggggtacactcctcggtgcccatcccacccaaccgccctacaggcagggcaggggcgggagggcatcctcacaccgcctttgctgttcccaccagcagcgtacgggagggtcccgacctggacaggcctgggagcgaccggcaggagcgcgagagggcacggggggactcggaggccctggacgaggagagctgagccgcgggcagccaggcccagcccccgcccgagctcaggctgcccctctccttccccggctcgcaggagagcagagcagagaactgtggggaacgctgtgctgtttgtatttgttcccttgggtttttttttcctgcctaatttctgtgatttccaaccaacatgaaatgactataaatggttttttaatgaaaaaagaaacacaccaaaanacgtcgggtctccgcggccccgggttattgtaggaaccatcccggcccgcgttatcgtaggaactattcgggcccgcgttactcgtagggtctggcgccgggccgggccccaccagacgggaatccccggcccaaatgggggccgaggaggtccttggccagagttttttgggagccaggccgggtggattggctcgccggggcccgtgttgttcctccgggccggggtttggtcccgaccggtcccgagggccggcccattgttgaccgcgggggttg

SEQ ID NO: 658624 - DNA, 2261 bp, Homo sapiens
ccgccccctcggcgtccgctccgcccccggcttcgcctcccgctgccgccgccgccgccgccgcagccgctaccgccgctgcagccgctttccgcggcctgggcctctcgccgtcagcatgccacacgccttcaagcccggggacttggtgttcgctaagatgaagggctaccctcactggcctgccaggatcgacgacatcgcggatggcgccgtgaagcccccacccaacaagtaccccatctttttctttggcacacacgaaacagccttcctgggacccaaggacctgttcccctacgacaaatgtaaagacaagtacgggaagcccaacaagaggaaaggcttcaatgaagggctgtgggagatccagaacaacccccacgccagctacagcgcccctccgccagtgagctcctccgacagcgaggcccccgaggccaaccccgccgacggcagtgacgctgacgaggacgatgaggaccggggggtcatggccgtcacagcggtaaccgccacagctgccagcgacaggatggagagcgactcagactcagacaagagtagcgacaacagtggcctgaagaggaagacgcctgcgctaaagatgtcggtctcgaaacgagcccgaaaggcctccagcgacctggatcaggccagcgtgtccccatccgaagaggagaactcggaaagctcatctgagtcggagaagaccagcgaccaggacttcacacctgagaagaaagcagcggtccgggcgccacggaggggccctctggggggacggaaaaaaaagaaggcgccgtcagcctccgactccgactccaaggccgattcggacggggccaagcctgagccggtggccatggcgcggtcggcgtcctcctcctcctcttcctcctcctcctccgactccgatgtgtctgtgaagaagcctccgaggggcaggaagccagcggagaagcctctcccgaagccgcgagggcggaaaccgaagcctgaacggcctccgtccagctccagcagtgacagtgacagcgacgaggtggaccgcatcagtgagtggaagcggcgggacgaggcgcggaggcgcgagctggaggcccggcggcggcgagagcaggaggaggagctgcggcgcctgcgggagcaggagaaggaggagaaggagcggaggcgcgagcgggccgaccgcggggaggctgagcggggcagcggcggcagcagcggggacgagctcagggaggacgatgagcccgtcaagaagcggggacgcaagggccggggccggggtcccccgtcctcctctgactccgagcccgaggccgagctggagagagaggccaagaaatcagcgaagaagccgcagtcctcaagcacagagcccgccaggaaacctggccagaaggagaagagagtgcggcccgaggagaagcaacaagccaagcccgtgaaggtggagcggacccggaagcggtccgagggcttctcgatggacaggaaggtagagaagaagaaagagccctccgtggaagaggtgcctgaatgccctagaggagctgggaaccctgcaggtgacctctcagatcctccagaagaacacagacgtggtggccaccttgaagaagattcgccgttacaaagcgaacaaggacgtaatggagaaggcagcagaagtctatacccggctcaagtcgcgggtcctcggcccaaagatcgaggcggtgcagaaagtgaacaaggctgggatggagaaggagaaggccgaggagaagctggccggggaggagctggccggggaggaggccccccaggagaaggcggaggacaagcccagcaccgatctctcagccccagtgaatggcgaggccacatcacagaagggggagagcgcagaggacaaggagcacgaggagggtcgggactcggaggaggggccaaggtgtggctcctctgaagacctgcacgacagcgtacgggagggtcccgacctggacaggcctgggagcgaccggcaggagcgcgagagggcacggggggactcggaggccctggacgaggagagctgagccgcgggcagccaggcccagcccccgcccgagctcaggctgcccctctccttccccggctcgcaggagagcagagcagagaactgtggggaacgctgtgctgtttgtatttgttcccttgggtttttttttcctgcctaatttctgtgatttccaaccaacatgaaatgactataaatggttttttaatga

SEQ ID NO: 658625 - DNA, 2919 bp, Homo sapiens
ccgccccctcggcgtccgctccgcccccggcttcgcctcccgctgccgccgccgccgccgccgcagccgctaccgccgctgcagccgctttccgcggcctgggcctctcgccgtcagcatgccacacgccttcaagcccggggacttggtgttcgctaagatgaagggctaccctcactggcctgccaggatcgacgacatcgcggatggcgccgtgaagcccccacccaacaagtaccccatctttttctttggcacacacgaaacagccttcctgggacccaaggacctgttcccctacgacaaatgtaaagacaagtacgggaagcccaacaagaggaaaggcttcaatgaagggctgtgggagatccagaacaacccccacgccagctacagcgcccctccgccagtgagctcctccgacagcgaggcccccgaggccaaccccgccgacggcagtgacgctgacgaggacgatgaggaccggggggtcatggccgtcacagcggtaaccgccacagctgccagcgacaggatggagagcgactcagactcagacaagagtagcgacaacagtggcctgaagaggaagacgcctgcgctaaagatgtcggtctcgaaacgagcccgaaaggcctccagcgacctggatcaggccagcgtgtccccatccgaagaggagaactcggaaagctcatctgagtcggagaagaccagcgaccaggacttcacacctgagaagaaagcagcggtccgggcgccacggaggggccctctggggggacggaaaaaaaagaaggcgccgtcagcctccgactccgactccaaggccgattcggacggggccaagcctgagccggtggccatggcgcggtcggcgtcctcctcctcctcttcctcctcctcctccgactccgatgtgtctgtgaagaagcctccgaggggcaggaagccagcggagaagcctctcccgaagccgcgagggcggaaaccgaagcctgaacggcctccgtccagctccagcagtgacagtgacagcgacgaggtggaccgcatcagtgagtggaagcggcgggacgaggcgcggaggcgcgagctggaggcccggcggcggcgagagcaggaggaggagctgcggcgcctgcgggagcaggagaaggaggagaaggagcggaggcgcgagcgggccgaccgcggggaggctgagcggggcagcggcggcagcagcggggacgagctcagggaggacgatgagcccgtcaagaagcggggacgcaagggccggggccggggtcccccgtcctcctctgactccgagcccgaggccgagctggagagagaggccaagaaatcagcgaagaagccgcagtcctcaagcacagagcccgccaggaaacctggccagaaggagaagagagtgcggcccgaggagaagcaacaagccaagcccgtgaaggtggagcggacccggaagcggtccgagggcttctcgatggacaggaaggtagagaagaagaaagagccctccgtggaggagaagctgcagaagctgcacagtgagatcaagtttgccctaaaggtcgacagcccggacgtgaagaggtgcctgaatgccctagaggagctgggaaccctgcaggtgacctctcagatcctccagaagaacacagacgtggtggccaccttgaagaagattcgccgttacaaagcgaacaaggacgtaatggagaaggcagcagaagtctatacccggctcaagtcgcgggtcctcggcccaaagatcgaggcggtgcagaaagtgaacaaggctgggatggagaaggagaaggccgaggagaagctggccggggaggagctggccggggaggaggccccccaggagaaggcggaggacaagcccagcaccgatctctcagccccagtgaatggcgaggccacatcacagaagggggagagcgcagaggacaaggagcacgaggagggtcgggactcggaggaggggccaaggtgtggctcctctgaagacctgcacgagtgagtgtcccgggccgtggggtttggactcctgagcggcagcggtgtgacgcgcaccctgggtccgagccgctcctcctgtgccagtccctctgggatgggtcccagggatgtcgtccttactcgggcctcccaccttcacagctgaccccagggccccgctggctggcacttccggcggcccctacagagaggcagctccagggctttgagctgcctgcccctggcctcctgggaaggtggcttcttgccgagcctccagggtggcccaggtaggtaggccccgagcacaggcacccggctatctgacggtgcctgtgcccatcactgtgggctgctgtctggtacaaggctcagtggagtcactcacttacccagcagctgccttgtgctatgcctggctggcgccagcgtggggaccctggagatggttgtggtctctagtggcagaagacaggcagataggagggcggcactcgagcctcaggtgccacaacgggggtacactcctcggtgcccatcccacccaaccgccctacaggcagggcaggggcgggagggcatcctcacaccgcctttgctgttcccaccagcagcgtacgggagggtcccgacctggacaggcctgggagcgaccggcaggagcgcgagagggcacggggggactcggaggccctggacgaggagagctgagccgcgggcagccaggcccagcccccgcccgagctcaggctgcccctctccttccccggctcgcaggagagcagagcagagaactgtggggaacgctgtgctgtttgtatttgttcccttgggtttttttttcctgcctaatttctgtgatttccaaccaacatgaaatgactataaatggttttttaatga

SEQ ID NO: 658626 - DNA, 153 bp, Homo sapiens
tcatttgacacaggaggtggaggttgcagtgagcatagattgcatcactgcactccagcctgggacagagtgagactccagctcaaaaataaataaataaaataaatatacataattcatttatccatttctctgttgatatgcattcaggaa

SEQ ID NO: 658627 - DNA, 2225 bp, Homo sapiens
ccgccccctcggcgtccgctccgcccccggcttcgcctcccgctgccgccgccgccgccgccgcagccgctaccgccgctgcagccgctttccgcggcctgggcctctcgccgtcagcatgccacacgccttcaagcccggggacttggtgttcgctaagatgaagggctaccctcactggcctgccaggatcgacgacatcgcggatggcgccgtgaagcccccacccaacaagtaccccatctttttctttggcacacacgaaacagccttcctgggacccaaggacctgttcccctacgacaaatgtaaagacaagtacgggaagcccaacaagaggaaaggcttcaatgaagggctgtgggagatccagaacaacccccacgccagctacagcgcccctccgccagtgagctcctccgacagcgaggcccccgaggccaaccccgccgacggcagtgacgctgacgaggacgatgaggaccggggggtcatggccgtcacagcggtaaccgccacagctgccagcgacaggatggagagcgactcagactcagacaagagtagcgacaacagtggcctgaagaggaagacgcctgcgctaaagatgtcggtctcgaaacgagcccgaaaggcctccagcgacctggatcaggccagcgtgtccccatccgaagaggagaactcggaaagctcatctgagtcggagaagaccagcgaccaggacttcacacctgagaagaaagcagcggtccgggcgccacggaggggccctctggggggacggaaaaaaaagaaggcgccgtcagcctccgactccgactccaaggccgattcggacggggccaagcctgagccggtggccatggcgcggtcggcgtcctcctcctcctcttcctcctcctcctccgactccgatgtgtctgtgaagaagcctccgaggggcaggaagccagcggagaagcctctcccgaagccgcgagggcggaaaccgaagcctgaacggcctccgtccagctccagcagtgacagtgacagcgacgaggtggaccgcatcagtgagtggaagcggcgggacgaggcgcggaggcgcgagctggaggcccggcggcggcgagagcaggaggaggagctgcggcgcctgcgggagcaggagaaggaggagaaggagcggaggcgcgagcgggccgaccgcggggaggctgagcggggcagcggcggcagcagcggggacgagctcagggaggacgatgagcccgtcaagaagcggggacgcaagggccggggccggggtcccccgtcctcctctgactccgagcccgaggccgagctggagagagaggccaagaaatcagcgaagaagccgcagtcctcaagcacagagcccgccaggaaacctggccagaaggagaagagagtgcggcccgaggagaagcaacaagccaagcccgtgaaggtggagcggacccggaagcggtccgagggcttctcgatggacaggaaggtagagaagaagaaagagccctccgtggaggagaagctgcagaagctgcacagtgagatcaagtttgccctaaaggtcgacagcccggacgtgaagaggtgcctgaatgccctagaggagctgggaaccctgcaggtgacctctcagatcctccagaagaacacagacgtggtggccaccttgaagaagattcgccgttacaaagcgaacaaggacgtaatggagaaggcagcagaagtctatacccggctcaagtcgcgggtcctcggcccaaagatcgaggcggtgcagaaagtgaacaaggctgggatggagaaggagaaggccgaggagaagctggccggggaggagctggccggggaggaggccccccaggagaaggcggaggacaagcccagcaccgatctctcagccccagtgaatggcgaggccacatcacagaagggggagagcgcagaggacaaggagcgaccggcaggagcgcgagagggcacggggggactcggaggccctggacgaggagagctgagccgcgggcagccaggcccagcccccgcccgagctcaggctgcccctctccttccccggctcgcaggagagcagagcagagaactgtggggaacgctgtgctgtttgtatttgttcccttgggtttttttttcctgcctaatttctgtgatttccaaccaacatgaaatgactataaatggttttttaatga

SEQ ID NO: 658628 - DNA, 328 bp, Homo sapiens
tgagcatataagaaacattctccttaaacatattagatcacaggcatatcatcatcagagagaatccatatactggaagccaagaaacctactccatcatcagaacgccagcccttggtctgagcctgcggatgtaaaattggaactcacagcatatgcattgttggcccagctcaccaagcccagcctgacatcaaaaggagatagcgaaggccactagcatagtggcttggttggccaagcaacgcaatgcatataggggcttctcttctactcaggatactgtagttgctctccaagctcttgcctgaatatgccattcttgcag

SEQ ID NO: 658629 - DNA, 164 bp, Homo sapiens
tactcccccgggcctactctctaggctccccttgcactgactcactcactgacacgactctgcgcgcgctcgctactccgcgctttaaactttgcgcctgctacgctactacgttctacgacggtacccgcgttagttacaccgttacgaccgcgctaccgtac

SEQ ID NO: 658630 - DNA, 1235 bp, Homo sapiens
gactgaccttcagctgcctcgtgtccagcgccatggcgccctccaggaagttcttcgttggggtgaaactgtgaatgatgaacgggctggcagcagagtcatgggagagagctcatcggcactcatgaactgcggccaatggtgcctggcacgacacctgaggttggtttgttgctccccctacttgcctatatcgactatcgccctgtgcagacgctatgactcccaagattgctcgtcggctgccgccagaactgctacaaaagttgactaatgtgggctattaactggaggaccatcagccctgtgcattgatcaacatgaactgctggaagcccaccgtgggactgctccatgggtgtcacctcacagagatgaacgggcatgtataatgagggaagtcccgcatgaagcagactaggggccagaacaacgagggcgccaagacccaggcaagaacggacctccgcgaagtcacatcgccctgccatcggggcgagaaagctaagaatgacagggaacccgggacccaaagacaagcagtagaccacgagcagaccaagggcccgcagacaagcggaaaggaccgcaccacggacacccagggcgcaagagcccgggcgccccaatgcgacccgacacactcgacaaccacaaggacccaggaataccgagacagccagatagcagagccaacgcagccgagcgggccacaaacccggaaactacccgacctgccagggcccggtcggcaggcacagccaacgcaacaccagacgaggacacaacgagaggaaaacgcacacagaacaccaacatgcccgaaagcacacgacagagagccagcgagcaagacagccaaagaggggagacaaaaagacaaaccgcaaacccaaagagacacatgacacacacgaacgccacaccgaccacaccccgccccccccacctccccgacacctcactcaataccaccctcacatacaccactttcacaccctcttctacacgaggacatcagggagctgaggcgacagcaccagcacgcagagatccacatacgaagcggccgcgaaccgcgcaacaacgacggcaagggacggcgccaagaacgcgagaggtcaaccgagagatacagcgggggggggcggggagagagtggaacaagaaagcagggaagagggcaaaggcacacggtggcacacacgaaacagagcaagaggcctagggaccca

SEQ ID NO: 658631 - DNA, 1192 bp, Homo sapiens
ggtggctgaagttagtggagggccttcggggaccaggaactgggccctcaggactgggtcgaggagctgctgggaagtccgatcaacggcaagaatggagtcgaagaaggatgttggtgcaggattggcactgggggccatcgcgtgtgcgcgggactagatgcctgaggtctggttgccgtgtggggggaccggagtctatgtggcgtacgaggcctcattcgaattggatacgatctcgtcagacacagagatcgccatgtgatggcctctggctagggaatgaatgctgggctggacacagaatttctcgcgggagctaggggtgcccctactactgggggcagccaaacggtggcacttggagtggcacatgtgtccgtcaacatcgttgatctcatacacgaacgggcatgctcaatgagggctctggaggggggcctcgagtgcgacttggctagctgctcaactgggagaaacgaggcatcagggcctggagtcgaagaggtgactggcactgtgagatgcacccgaagacaagtcaagttgacccgcagtgacggtctcgacaccggggaattgtctggggtcagacaacaggagtcctgtcaactaggggtgcaggagcaacaggggtaccttctcaccggcgaatatggtcgtcctaattgaccatgttatttgggggggcccgtgggtggaaggctcaggtgactgccgtttggtgcatgcctttccttgtgctccccttggtggacctgtgtgctcccaaggatgggttttatgggaacgtcgtcaaatctactttgcgctttgcccacttgggggccattaaatcccccattggaaggggccccaaggttggacttccccaaaaaagcgttacccttggaaggaacggggggatgggacgggggtggtcctacaaatctctttccacaaagggagcggctcctttcttgggatgaagtcttcatttggggagcccgttcgccaatcgtgtcaacggaggaaaccggaaaggtgcgtagtcctgattggagggtccccgatcggtgcgatagtaatgggagtaagctggaatctgaagcgaccccgatatgggcgcccaggatacgggcaaaaacagtcacttcatacagacccagaattggtggatccttacaaacacagagatgtacactcatgaaga

SEQ ID NO: 658632 - DNA, 129 bp, Homo sapiens
ccaccgagaacgaggaactcttctgggctctgcgcggagcggctgagtcgttcggtgtcgtcaccaacttctacctccgcactcaggctgctcctgaaatcctcacctacttccagttccagtggggcg

SEQ ID NO: 658633 - DNA, 226 bp, Homo sapiens
agagtggcagtatcagcaacgttgtgtcctacagggttgctgtgctggcacacggagagcctagagagctcatggattgtaactaagaagaaaggttcctttttgtgtttttaaaaatgattttaataccgttttttacaccgttctctcggtacttttttttaagcgtaagtcagcattgtcttccagtgttaaaggcatacctcacctctgcaaggaacccacg

SEQ ID NO: 658634 - DNA, 110 bp, Homo sapiens
  misc_feature (97)..(97): n is a, c, g, or t
gggcacaatcacagcacactgcagcctgaaactctgggattactcgagcctagaagttgctgctgcagtgagctgagatgatgccactgtattctangcattaagcaaac

SEQ ID NO: 658635 - DNA, 439 bp, Homo sapiens
  misc_feature (17)..(17): n is a, c, g, or t
gaggtgtcaggcctctnagccgaagctcagccattgtaacccctgtgacctgcacatatatgtccagatggcctgcaggagccaagaagtctggggcagctgaaaaaccacacaagaagtaaaacagccagttcctgccttaactgattaaccaacattacaacattccaccattgtgacctgtccctgtcctaccttaactgatcaatcgaccttgtgacagtcttcttctggacaatgggtcttatcatctccccaccatgtaccttgtgaccccctcctctgctaacaatagataaccactttttactgtaattttccattacctacccaactcctataaagcaaccccttccccatctcccttcactgactctgttttcagactcagcccacttgcactcaagtgaataaacagccttgttgctcacaaaaaaaa

SEQ ID NO: 658636 - DNA, 1113 bp, Homo sapiens
gctggtgcgagaaagggggcgccgggccggtctagccggtgaggccggtgggctctctgtggctgcggctggggtaaatcgctgcggagagtatggtgcccttggtcggtgggaccgatgcccttggtccaggctgcctccctctctcatccctggactggggacgatgctttggacgctcgtggcttgcaagaccttccgtgtgtgcatgcatgctgcaaggtggcagctggtgccttgggctgcccgtgccctcgggaatttcgtcttgatgccaggtccttgaacctagctgtccctacgtcctggacagaggtgggaccctttgcagggcagcttcaattcgaaggtcttcaaaccctggattgtgtcccgcgcccgtggggttgattcttgtgtacaatggcaataaggacgaccaatgtgctctcgttattgagacactgcccgtcatcgtggaggcggaaaggtaagtcaggcgccccggggagggtcctgcttccacgcgtacaaaggaaattgccttgggaggattagcttcaaggggtctgttgtcgccggtggtggaaggagactctaatttcaagcgattggaagaggagacaggcgcttagaggaacgagacatctccacaggtcaaatggggcagtgggtcccccgagttggaggcggttccgcggaggtagattccaatgggagggacgcacccgttttttccacttattatagtggcccaaggaaagtagccagcgtgggcctataggcacaattcctcgcccggtggactcagggggttggaggggacttaggagaaagtggcaagagcgaacaggcaagggcgcaagtgaaggggaaaccgaaaagggtggtaaagccggcaggcccgtcgttcatggtcggtgggcggagcggaacaaagagcggtttttgaaaggaccggggacattgggcccttctttcaggcataaaaaccaaggccccctcttgcggtggaaagagggaccgcgccattacgttgtgcgaaaggggttttaggttttcagccccattattgggggccccagaaaatcggtggtttgtagcacttgggggagataacccggtggaccaccg

SEQ ID NO: 658637 - DNA, 159 bp, Homo sapiens
aggacaagtcgactacagcaaaatcatgaacggcaaactgtctgctcgaaatagaaaggttcagtgccatgttccaggaaaagaagcaggaagtacagactgcattttaagggtgatcagctagtcagcattggagatttaaagaaaggaaactgatgg

SEQ ID NO: 658638 - DNA, 442 bp, Homo sapiens
  misc_feature (16)..(16): n is a, c, g, or t
  misc_feature (124)..(124): n is a, c, g, or t
  misc_feature (132)..(132): n is a, c, g, or t
  misc_feature (143)..(143): n is a, c, g, or t
  misc_feature (152)..(152): n is a, c, g, or t
  misc_feature (158)..(158): n is a, c, g, or t
  misc_feature (172)..(172): n is a, c, g, or t
  misc_feature (174)..(174): n is a, c, g, or t
  misc_feature (177)..(177): n is a, c, g, or t
  misc_feature (179)..(179): n is a, c, g, or t
  misc_feature (182)..(182): n is a, c, g, or t
  misc_feature (202)..(202): n is a, c, g, or t
  misc_feature (204)..(204): n is a, c, g, or t
  misc_feature (210)..(210): n is a, c, g, or t
  misc_feature (222)..(222): n is a, c, g, or t
  misc_feature (228)..(228): n is a, c, g, or t
  misc_feature (303)..(303): n is a, c, g, or t
  misc_feature (315)..(315): n is a, c, g, or t
  misc_feature (343)..(343): n is a, c, g, or t
  misc_feature (353)..(353): n is a, c, g, or t
tttgctgtgacagccnctgtaggaaaagagcacgcacttccccttgacagcttcaaatgcacagagctgaataaaggctcgacaggggccccggactgtgacgaagttgttaccgttgcccatncagccgcngtactgaaaantctcacagnccatgnatgtaccattatananatncntgntggtcattcccatgcagggncngccaantagcccagctgncaggantcttctttcttggtgacttcagttaccagttgcccaccccgtgatccttcctcttcttggggtagcacagccctncgcactctcggnattaagatgggctctggttcgtgctccncagggacacnttcacctcggtcagccatggtgaagatggagtcctcaggtatgcccacactctgggcaaccactctaaagtcctgcaggagagtttccc

SEQ ID NO: 658639 - DNA, 289 bp, Homo sapiens
  misc_feature (119)..(119): n is a, c, g, or t
  misc_feature (134)..(134): n is a, c, g, or t
gagacagtaatctctcaccccagtggagtgcaacagcggtgtctccgctcactgccagcctccacctccccgattcaaatgattcttgtgcctcagcctcctgagtagctgggactacnaggcatgtgacactnatgcctggctaatttttttgctatttttaagtagagacggggttttgccatgttggcccgaggcaggtggatcacttgaggccagaattcgagaccagcctggccaatgtggtgaaaccctgtatcactcttttaggcccttctgtcgtcttctc

SEQ ID NO: 658640 - DNA, 319 bp, Homo sapiens
ttaggaccacaatgtagtaaacttgaaagaacagcacaggtagacttctcttagtggtgactttgtctgctgcgtttcagttgtgtgacttattcttagacatttcacaagggcaccttgtataggttatacaggcaatttctctccatccactacgtcatttcattaattctccagtgacttgccgctttccccggacaacactcaacaggttgtgtaatttcatggtgaacagagtgtgagctgggaatcatttattggctattgccaaagcaggggaattcaacctggttccatcttcataatttaaagtcgacgc

SEQ ID NO: 658641 - DNA, 166 bp, Homo sapiens
agtgtggtgcgtgtgtgtgtctccccaaagacagaaatgggataaaaaaagagagattcccagctcgcgctctccctcacattctatttcgctctcttcgccacaaaatatatgtgagataagcgggtgcacgtataaagggacggtatagagagaaacaggatag

SEQ ID NO: 658642 - DNA, 708 bp, Homo sapiens
  misc_feature (368)..(368): n is a, c, g, or t
cacgaggctacgatgaagtaccatgtgcgtgcttattataccaagaaatggcggacaccctatatgactaactgagatgcctagaaggaaatatgctagtgagctaattatatgatacggttatgaccctgagcaccctaacaatatttaacagagcacctccgactacgttactaaacatagtggtgtgcgatatggcgaggggactaacctatctagcctgaggatcgctaacttgtcaacgtagactacatacttcaacctacaagtacttcaatgctcaatctaatagcccttcaacaataacacgttacgccacaagaatgagctatttggagcactaggagacaaactcaaccagcgagagnataattattagcattatctcgctttatattttccgccaaatgacaacgcgctaggatcacactcactagcttacagtgcgtcaacatatatacaccgtcttaaactaactaggcgaatgttaaccctacagagaacgaaggtcagggtaagtattctgagaaccgttgtcacgggataaacgtgtcgcatatataagtacttgactgaccatgctcaggcttattaacaccacaagcgcacaactactcatagcctatattggatatcccacagttagtccacccggcgagtgtctttttcatagggaatcagggcggtcccctgtacgcgtagttactc

SEQ ID NO: 658643 - DNA, 141 bp, Homo sapiens
  misc_feature (101)..(101): n is a, c, g, or t
ggtgtggtggtgcgcacctgtaattccagccactcaggaggctgaggcatgagaatcgcctgaacccaggaggcagaggcagcaatgacccccgatctcgntgctgcactccagcagcctggcaacagccagactgtctcg

SEQ ID NO: 658644 - DNA, 793 bp, Homo sapiens
agcggtctaccacatcggctctgtctctgactccatccaagcgtgcaagctggcccaggagaatggctggggggtcgtggatgagtcatcgctcacgagatgactgatgacactttcattgctgacctgtgtggtggggctgttgaacaggcgacatcaacactggtgccccgttgccgctctctgaacgatctgggctaaagtaccacaccaggctcatgagtacattgacgaacatcgtgggtgcgatgacagcgtcgtctttgccggacataactgtccgtattcccagtgtgctgttcattcctctggcttgtgctggcagactgtgtgagacctctgtctcatctctcctgtgtaactcttgcatgtcctgatctgtgatacgttcacccttcctgatatcccctgagccccagcggctgcccacgaacttccctggagttgacctgctcgcgcgtgcgtccttggcttaccgtgacgctcgttggcatgtctcatgtcatcgaccctctctttcgtgtgccgctacgtccatttggggttccagcgctttgccagcttgcttcactctgtctcgtttctctcttccctcagaaactagaaatgtgagatgaggattattataaaagggcggtcgtgttggcaagcaatgatcagccatctgtgatgggagcgtcagggttggcttgtgcctcgaggtgtatagagtagggaccatgtgtcacttgatgcttctgctcttgtcccacgtgtcttccactttgccttatgagccgtgaactgtgctata

SEQ ID NO: 658645 - DNA, 380 bp, Homo sapiens
acaatctcggctcactgcaacctctgccttctgggctcaagcaatcctcccacttcaacctcccaagtagctgggactataggcatgcgccaccatgcccagctgatttttgtaattttttgtagagatggggtttcgtgacattgcccaggctggtctcgaactcttgagctcaagcagtctacccaccttgacctcccaaagtgctgggattacaggcttgagcaaccatgtttggcctttcttttaaatttgttgatgttttttgaagaattaagtcattacttattaggcaagttactattttgtttttttgtcattggtggtagggactaaggaaggaaacagatattttaaaatactcacaacatgtggatttc

SEQ ID NO: 658646 - DNA, 705 bp, Homo sapiens
  misc_feature (3)..(3): n is a, c, g, or t
  misc_feature (97)..(97): n is a, c, g, or t
  misc_feature (104)..(104): n is a, c, g, or t
  misc_feature (109)..(110): n is a, c, g, or t
  misc_feature (114)..(114): n is a, c, g, or t
  misc_feature (199)..(199): n is a, c, g, or t
  misc_feature (210)..(212): n is a, c, g, or t
  misc_feature (215)..(216): n is a, c, g, or t
  misc_feature (227)..(227): n is a, c, g, or t
  misc_feature (235)..(235): n is a, c, g, or t
  misc_feature (253)..(253): n is a, c, g, or t
  misc_feature (265)..(265): n is a, c, g, or t
  misc_feature (269)..(269): n is a, c, g, or t
  misc_feature (279)..(279): n is a, c, g, or t
  misc_feature (287)..(287): n is a, c, g, or t
  misc_feature (312)..(312): n is a, c, g, or t
  misc_feature (314)..(314): n is a, c, g, or t
  misc_feature (322)..(322): n is a, c, g, or t
  misc_feature (324)..(324): n is a, c, g, or t
  misc_feature (330)..(330): n is a, c, g, or t
  misc_feature (341)..(341): n is a, c, g, or t
  misc_feature (344)..(344): n is a, c, g, or t
  misc_feature (346)..(346): n is a, c, g, or t
  misc_feature (355)..(355): n is a, c, g, or t
  misc_feature (360)..(360): n is a, c, g, or t
  misc_feature (365)..(365): n is a, c, g, or t
  misc_feature (371)..(371): n is a, c, g, or t
  misc_feature (378)..(378): n is a, c, g, or t
  misc_feature (433)..(433): n is a, c, g, or t
  misc_feature (439)..(440): n is a, c, g, or t
  misc_feature (566)..(566): n is a, c, g, or t
  misc_feature (662)..(662): n is a, c, g, or t
gtnttgatatttattgccattattttcttgtgattggtacaatttaaaaataagtctatgttttcacattgattttaaaaaatatagcatgtttganttacaantgatnngcanactctattacttcatagctgaccatcttccagaaaattcccacttaattgaatacttagaaaaggatggccagtggccgattganaggtatattannnttnngggccgttttnattctgangacaaatatcttcatggnaatctatttgtnagcntctgcgattnctgctgancgtctaccgtctgtgaatataccantncccctttncncctgangcagatcattntgncntcctggccngcctnccctncccttngggggtnggtgtggctgccactgctacgctctcaattgcacactcatcagttcctctgcggntccggnngtagccattctcaccccagccggtgccccagctgtttttaacaatccagtaatccatcccagaggctgagtcagtgccatagcccacaagcagaacagcatgattagtcagctcaaaggggttganagggtctcttagacccgtgtggtggtagatcccctttttgtagtggaggaagtcatcatatacttcaaaagcaactgccatgggcccatgatggancaactcaagcttcatcagggcttcattgcagcctccatagaaa

SEQ ID NO: 658647 - DNA, 802 bp, Homo sapiens
gagttagtgtctcgcaacgattggagctcgaatccaggagcaacactggatgtcgcttggatgaagagagctctcaacaccatcccggactaccttttgcagtgaatgcttgggagcgacaaagcgtagaacccggcaccctgtagcgtgcttgaactaggaatgtccaatatgcacgcaaatgccctcgcagtccggctgtgcagtaagattcggtcctcagctggtgtgcttccattcatgctgtagtgtccgagccatgacgcctgcgagagatcttcctactaggtaagaacgagacctgtgaacaagttcaaccttggccaggttcagtaccatcatacagcaccagcatgtcaccgtctcctactaacgagttacaactgcggccaacatggcccttgatactgctgcctgatgagctgtccctagcgacgttgccttgcagccctcctgtcccttccccgccagtcagtactaccctgctagaagccccttccctcctctattactcaggagggctgggggggctccgtggcttctgagcactcagccatttccccgccccgtctcgtgtcctccccgtctgcactttgctatgacttgtttggcacagacgtgcggcctgggccttctcagcagccgccttctagttggggtgctagtcagactgatctgccggctcccagcccagcctgtgtagataaggaggcccacgtgcactagggagccgaattctacaatcccgctggggctggccggggcgggagagaaagctgtaccgcccgggtggcctgggggg

SEQ ID NO: 658648 - DNA, 368 bp, Homo sapiens
aagaggaaacgtgaggcccagtcttggctccactatgaaccccaatttccccaggggaagctgaagaggagttggcagaccttcctgtccctgtctgaggttggggtggggcaggaaaaccaaaggtgaggccagtcacaagtcaagggtgaagggaagtcacacgagtggtgggctgggtcccaggacagggtggccgggagcagtgccgccccagggaaaagacgagaattggctgataacaccagggagcaggctagggtgtcgggggctgtcctcagaattaagctacccctgttttcccttgagcattaagcctcccccaaccttatcatcccctcatcactgctgtgacctctgctgagttt

SEQ ID NO: 658649 - DNA, 416 bp, Homo sapiens
  misc_feature (3)..(3): n is a, c, g, or t
  misc_feature (97)..(97): n is a, c, g, or t
  misc_feature (104)..(104): n is a, c, g, or t
  misc_feature (109)..(110): n is a, c, g, or t
  misc_feature (114)..(114): n is a, c, g, or t
gtnttgatatttattgccattattttcttgtgattggtacaatttaaaaataagtctatgttttcacattgattttaaaaaatatagcatgtttganttacaantgatnngcanactctattacttcatagctgaccatcttccagaaaattcccacttaattgaatacttagaaaaggaaagggaagagaagagaaaaaagtattgcaaataatttatgtagatcctctgtcctgaagaaagtagaacgtaactccccactccttaagtatggattgcacatgtgacttccgtccaaagagtgccatgtgcgaagggggaataaaagtaactttacagtggagaaacctgactaatgctacattgccagatgatcaaggtcaacccaatagtgatgtcatggtgatagtgtgtat

SEQ ID NO: 658650 - DNA, 117 bp, Homo sapiens
gtcggtactctgtgcgatttaggtcactggattcatggaaatcttttttttggttgtttgttttttaaagacaggtcttgctctgtcacctaggctggagtgcagtggcatgatctt

SEQ ID NO: 658651 - DNA, 313 bp, Homo sapiens
ccctcagattacctcaaaagttccattatacagacactaatagcatctactaagtgtcaatctgtagtgcctgctatgtgccaggcattggagataatataatgatgaacaagataaacatggcacttggaaaagagagtctagttcccactctcagcccaccccaaagagaagccagaattcagcttccaaagatctcagatgcccttgcatcacctccctgaagagggtgggtgaagctttggtgtctgaagagaatttggctggacaatcccccaggtttggaacaatgggaaggagctgccatctgtgt

SEQ ID NO: 658652 - DNA, 748 bp, Homo sapiens
  misc_feature (442)..(442): n is a, c, g, or t
  misc_feature (523)..(523): n is a, c, g, or t
  misc_feature (580)..(580): n is a, c, g, or t
  misc_feature (587)..(587): n is a, c, g, or t
  misc_feature (601)..(601): n is a, c, g, or t
  misc_feature (608)..(608): n is a, c, g, or t
tccctgaagtgtctttccccatttatcttccatgttctcaagactgggctcagatgtccttaagccccatgccttgtgcctgtctcacagcaccttatctgtgcttgccatttaggattatgtacagctgtagtggttccagatcttgacctagtgtggcagctctgcttcccaaaatcatcagggatccagtgtccttctactttgcacaatgtaactctttgattgccatatcatatccaatttggctgcttaaattccaaccatcatacctttaacccagcacataggaaggatgaatagtcaaagaccagcacacaactcctccccttgaaatacctttttgattagttgcaaatatttctacttacatcccattaaccagaacctggtcatacagctatactctgctgcaagggagtctgagaaaatgtagcctttntctgggaaggcatatattcaggtcaatattgaggctctattatagtactaatgaagaagagataatgctgagggatactgnaggtataacagtctctgcttgcaagatgaacacggcaagccattgctttcatctccntttcagncttcactcaatcanaacttgnctattggagttctactgtctaagaagaaaacaggaccagcatggtcccttgctttatgaaccttcaatccttaaccagtacccaccagatgattcctgatcgctctgttagcccataaggttccggccggcgggggttcc

SEQ ID NO: 658653 - DNA, 100 bp, Homo sapiens
aacattaaagatacagagtgaattctgatcggaacctatctgaaattattttacttaataagaagtggaaaaacactaagtgcttaccattaacattaat

SEQ ID NO: 658654 - DNA, 641 bp, Homo sapiens
ctgtgttatacagcctcatattatcgagctaatgacagctgacatctgattcatctgttgttggacagcgttgatgagacccgctttagcatatcgagagtttctgcgtactactaagatttatcaatctgttgtcgatacattcatgcagtagtgtcagatttacttttacaaaggagagagtgtccctacactcattgaggcttctgcatcacctctaatcctaggacagttgttggaaccaatggtgccacttcagctgccgtcaccattggaacctcctctggtacacaccacagttgcatacagattctcttggtattatctgcctcggatgtgattgaagacgagctgtagtcatgcataacgccaatctagacatacctgtgtaattgttcagcagtatacttcatggatgatacagatggtccacattcaacatacattgtgtctatgagctagatggcattccttattcacttagcattcagatgtaaggccatgtgtgcatgcatgactggagaggcttaagtcttatacacagatatcgatatagagtactcagctgatgctgcgtgcacacttattggaatcagtgcatcatatctgtggtgtccggaccttattatgtgcatacctct

SEQ ID NO: 658655 - DNA, 307 bp, Homo sapiens
  misc_feature (40)..(40): n is a, c, g, or t
  misc_feature (279)..(279): n is a, c, g, or t
  misc_feature (294)..(294): n is a, c, g, or t
  misc_feature (298)..(298): n is a, c, g, or t
gagtaacctaaagaattactctggtgtctgggcacagtantcacgcctgtaatcccagcattctgggaggctgaggtgggcagatcatgaggtcaggagttcgagaccaacctggccaacgtgatgaaaccccatctctactaaaaaaaattcaagaagtagtcaagagtggtggtgtgcacctgtaatatcagctactcaggaggctgaggcaggagcatcgcttgaatcctggaggcaaaggttgcagcgagccgagatcggaccattgcactccancctgggcaaaagagnccgnctcgtctcc

SEQ ID NO: 658656 - DNA, 161 bp, Homo sapiens
gtgacatcaggtgattggtgacaaatatgtgtgtagagtcagggagagtgcgtcatatgttgtcctaggaagattgtagtggtgagggtgttattataataatgtttgtgtattcggctatgaagaatagggagaaggggcctgcggcgtattcgatgtag

SEQ ID NO: 658657 - DNA, 468 bp, Homo sapiens
  misc_feature (21)..(21): n is a, c, g, or t
  misc_feature (25)..(25): n is a, c, g, or t
  misc_feature (43)..(43): n is a, c, g, or t
caggttacccttagcgaaagnaggnacattgcaccattacggnaaagaggatacaaactgtcaggcctctgagcccaagctaagccatcacatctcctgtgacctgcacatatacatccagatgacctgaagcaaatgaagaaccacaaaaaataacattccaccattgtgatctgttcctacccaccctaactgatcaattgaccttatgacaataccccctccccgcccttgcaataatatactttgtcatactcccccgcccctaagaaggtactttgtaatattctccccgcccttgagaatgtactttgtgagatccaccccctgcctataaaaaattgctcctaactccaccgcctatcccaaacctataagaactaatgataatcccagcaccctttgctgactcctttcttggacacagcctgcttgcacccaggtgaaataaacagccttgttgctcat

SEQ ID NO: 658658 - DNA, 693 bp, Homo sapiens
agcgatataacactgggactgaacaggcagccaactggtatctttgaacatgtatgtcacgtacaccacaatggacctagttgaacacagtctactggggaccacctgtcagatgggcgcaactgatgcgcgagtaggatctgaggctagagcatactcatcctggtgggccgagtcaggaactgtcaaaagtgctgctggagtaacagcatcctcgaggtagcaccaatatgcctatatttggttcagaaggctggggtgcccagaccttggactagaagtggctgcaatatttatgcttggtgcgtcgagtatgagagagtagggcatgattgacgcgtcagattatgtttacttggtgggatcattgtgtgtgctcatttccaaagaggtgcaagatcgtgctagttgttcgactggagccaaggagacacgatggtattgttccttgatgaaatcatgcatgggcctattataccgtcacgaggagacgatgcccggtcctgatcagcaggtgtggagaagctgatctgcgaggatgtatgctatggtcgaacaatgggtccgcttaatatcgcaaagggaaaaattcactgggtggatcgctgcattggatttactgcacgaatcaaggagggaaaacccggtacccaaagaggttgttagggtgtggtggggaattgaggttaaaaa

SEQ ID NO: 658659 - DNA, 111 bp, Homo sapiens
attcggaagagaccaattcaccttattacaagaaaactttagcaaacaatttaccaaataaagtataggggttagagattgaaacctggcgcatagatatagtaccgcagg

SEQ ID NO: 658660 - DNA, 774 bp, Homo sapiens
ctggcgctcatacattttcctcccacaagcatgagccacccacggcctaactcttcatcctcctcttcaccatctccacccgcttctctgtgccccatatgggtatatgtcagcttcttctggttcccaaggggaccttcactggtgccattcctgctctctggaacgccgctagctcctaccccttcccatgcttctgacaactcctctgtaaaaatgtcacatcctccgaggggcctcctcgatcacccagtgctaaacactctcctctctctctctttgtttcttttggagatggagtctcgctctgtaacccaggcaggagtgcagtgggtgtagatctacggatcaatgcaacctctgcttcctgggttcaagcaattctcgagcctcaggctcccgagatagctggggattacaggcgcccgccaccacgccgggcataattgtcattaggaattcacaagctagagaccagggtttcaccatctgggaccaggcaggtcttaaactcctgacctcgtgtccacccaccggggctcccaaagtgctggaatgacaggcgtgagcaaccgaaaccgggcacgctctaacaaacggggtacagcactatcatcggactggagcggccacggtggaacaatagccactggaacacggcccctaggtcaagggacactcaggctcagccctaagcagtgggaccgaggccaaccggcaactggcaatagtgccccacggcacacgggggaacgcaggtgcagggggctcgaa

SEQ ID NO: 658661 - DNA, 103 bp, Homo sapiens
gcccgtccgcttgttctacggtggattccggccgcttgtctagggtggaaccccccagcttgcactagggtggaacgcggagcgagagaggcccgaacaccag

SEQ ID NO: 658662 - DNA, 229 bp, Homo sapiens
tgacggtgaatgttagttagaccagaaagtgtgtgtgttctgtagctcagttcccagacagctttttaggtagtggaggaggtggcttcatgtggcacgttgtggcatttatattccactttgggagggtcaggctgttggccttctggcagcaggtggctatgttaagggaacgctcagcagggcatgtgcacgtgaggctccgcgaatagactgtcttcgatcactt

SEQ ID NO: 658663 - DNA, 243 bp, Homo sapiens
ccttcaaaagtggccttgcgcctttgttggaatgccttggttaaagtgcactaacgcatctgctacgttggtaatgttgaattgatccacgttaatggctgcttgccagtccactaaagagttcgcctggttgaatcacataccctaacttggtttgcataaaagccgcggccttttcaggattctgttcccagactgaggcccaagtttcgccacgaaattgctgatccagccatgtttggc

SEQ ID NO: 658664 - DNA, 644 bp, Homo sapiens
aactgtggattaacatctttttatgttatatgtattatatactgtactcttataatcaagtaaactggctgggcatggtggctgatgcaggtaatcccagcagtttgggagacagaagcagcggattgcctgagctcaggagtttgagaccagcccgggcaacaccgcaaaacctcatctctactgaaaatacgagaatctgccgggcgtggtggtgcgcacccgtagtcctagctgcttgtggggctgaggcgggaggatcgcttgagcctgggaggttgaggctgcagtgagccgagatggtgccactgcactccagcctgagtgacagagtgacaccccatttctaaaaaaaaaaaaacaaatgaagtaaactagggaaaatacattcttagaaccacttaatggactaagtagagatcgattactagaaaactatacaggacagtgacaactacttttacagtactgtactgtctttatggataccgaagtttacttcaatctgtttacccagatgttttgtctcgtctcgaactagtaagcaaccaaggttaagaactcaactattagttcaaccagtcattcaagcaccttttcctgaatgtcctgaccctctcggtcttgggaccttcgaaacctat

SEQ ID NO: 658665 - DNA, 515 bp, Homo sapiens
gaagaaataactgaaaaaaaaaacaactctggtaaaacaaggctaaaaacagcattctgcgtgttgcataacaagaaccgacccgtttacgaagacgacgcgtagataactgccacgcgtcgacgggactcgtaccgtacggcgcagtaggctgctgcgaactccgatgcgacacgagaacgaaccggcgaaacgtaaaacgaaaacgcaaacgaaaacttccaaacgaaacggctgcactatacgatgactgtcccgttttgcgattgcacgtttagactcgtggtgggcgggcttcagcagcaaccaagacccccctcagtaaaccaagggcaaaaccccgcagcaattccgccacccagatgcgagggctcagcagtctctggtctttgctcgtcactgccccgaggtcgtctgtacctgggcaagtaacctccaccttctgtgagcgcgtgcagctgccgcggggtgttagaacggattcaagcaaagaactcctgtaagatcttcttatg

SEQ ID NO: 658666 - DNA, 282 bp, Homo sapiens
ttttttcccccccccccgccccccccgggggcccgggggttttttttcccaaaaaggggccgcccccccccccccccccccggtattaagggccccccttaaagggtgaagggggggccccccccccaaaaaagggggggaacccgggtttctccctaaggggaccccccggggttttggcttgaatgggggggggcccctttttttaaccctttttgggggggggggggggggtttaaaatggggggtttttttaaaaaaaaaggggggttttttttccca

SEQ ID NO: 658667 - DNA, 134 bp, Homo sapiens
atgacccatatcagtcaccatgccttgtgacaactgtgggttttatagtaaagtcagtctctagattaaatcttggcagaaaaagccgctttcagaaacttgtctcactacaaaaacaacaacagctgcggccg

SEQ ID NO: 658668 - DNA, 209 bp, Homo sapiens
cgagtccagcatatcaacgaggctgaggtgggaggatctactgagcccagcacagttaaggctgtagtgagccatgcatcacaccactgcactctagcctaggtgaccaagcacgaacttgtccaatttaaaaaacaaattaactcatacattagtaagcaaccacatttttaaatagtctacagagggtacgtctggctgagccgggg

SEQ ID NO: 658669 - DNA, 136 bp, Homo sapiens
ctcaggctactcttgaggatccccacccgtcaacgacataccatctcttctaagaggcaacaactctacgttgcgtcacggctgtggtgtcacacaccttgagcctgcacctgttgcaggcgtatggggctgcctg

SEQ ID NO: 658670 - DNA, 143 bp, Homo sapiens
aactgagtgattaccctgtgattgcttctcctggttcagaagctcccccactgagcaccttgtgacccccgcccctgcccaccagagaacagacccctttgactgtaattttccattaccttcccaaatcctattagaactgg

SEQ ID NO: 658671 - DNA, 225 bp, Homo sapiens
agaggattcactggagctgaactcagccacaccttaacaggctcagactgaagcatgccctgtcacctttacatagcgtcaactgccagcagatgcttctgtggacctggggagccccctgttggtggaagctgtgtttgtggactggaggcagtggaaggtacagcacgtggatccgtggggagctgatgtatgaggctaacagcatacaaccgaaagcctgct

SEQ ID NO: 658672 - DNA, 483 bp, Homo sapiens
tcagctacccccagacccgttttcagaggagggtgttgaggccagagaggggagggaccttcccagtccctgagcctgccaaggtgggcccagcttggggtggggacagaggggctgctcctggctggggcaagagttggaggggtctccgatgggggcatggccacgccctgtgccatgaagcccctcacagaaactagggagtcgtgggcaacaccctgtccctgtgacaggaggggaaactgagtcacggagtgcccagggccccatggcaggagtgggcagggcctggttcttgtgccttggcctccatctgggaggaggcagggagcagagctcagactcctcccagtgagggccccccatgtggctctgctgcacggccccagttggggggctccctgggtgggggggctctgggaagcccacagttacccccaggtagaaatgtctgtggcctgcacctctgcagcctggcctcct

SEQ ID NO: 658673 - DNA, 367 bp, Homo sapiens
ggtcgacttttttttttttgtagagacagtgtctcgctgtgttgcccaggctggtcttgaactcctgagctcaaatgatcatcttacctcggcctcctgaagtgctgggagtacaggcatgagccatctcgcctggctgacatttgacaaaatgattgaatagatttttgttaaactttaattattatgatactatacattcaatattaaaaaataaactcttaggcatgtcttgaggattcactcattatacttaagtaggtatttattattttacagcagctgataaatactggacagtgttgatgatgggcagcatgttctcttggatgaagataatgcaaataatagtctggacttctgatag

SEQ ID NO: 658674 - DNA, 375 bp, Homo sapiens
  misc_feature (319)..(319): n is a, c, g, or t
gggatacctcatgttgagctttttttttttattattatttatttgagacagtcttgctctgttgcccaggctggagtgcagtggtgcgatctcggctcactgcaacctccacttcctgggttcaagtgatcctcccacctcagcctcccaagaagctgggactgcaggtgtgcactgccatgcccagctaatttttgtatttttagtagagacaggatttcaccatgttggccaggctggtcttgaactcctgacctcaagtgatccggctgccttggcctcccaaaatgctgggattacagatgtgagccaccatgtntggccctcatgtttgagcttcgaccataacttgggtgtgccctgggaatggcaaag

SEQ ID NO: 658675 - DNA, 780 bp, Homo sapiens
tcaaatgccatctgctttttaaggccccctctcagtaggaagcagaagaatacaagtatgattctgctgctactgagaggcggacttaataagcagatggatgtgagacaagtggatgaaagcatgtgagagaagaaagggtaaccaacagataagaaaaaatgagggaagcgcggatggagaagtgtgtgaatagtgtacacggaacagaaacgatacacttaactagaagataaagatcttacaacaactgatatcactgccattttagtacacagagaaaatccacaatatcagcaccatgactgaaatcagcatatctagggatgcaaggtcagcataccctgtaatagtcaatcaaagagtcacacacgaaaaattcgaagataccgttaaccaaggatctgagacactattactgtcacaagagacctaggcagtgcccctgacacctaagcacaagacgcggaacgcacaagcgctaaaaacgcgtcacaccacgtcaacctaccaagagccaacccctagacacatccacacgacaccaagagtcagagaaacacctcaacaaccgacacacacgaagaaacccaccatacacaccatccgccaccacgactcaccaaagcctaacaagcagacaaacagcatgacaataccacaagggcatccaacacgcacaacccacccgacacaacacaccaacaacccgagcacacaccgcacagcgcaacaaccagcacgaagagaccagcagacactagacagaacgcaaacaag

SEQ ID NO: 658676 - DNA, 133 bp, Homo sapiens
atccgtatgaggagagctgtgctcgaatatatgactacctgtacctggaagttcttcatcagatatttctaaatttggcacagcttgaagattatcacctttacaaagaataatcagttctcatccttcggag

SEQ ID NO: 658677 - DNA, 124 bp, Homo sapiens
  misc_feature (6)..(6): n is a, c, g, or t
cggaanacacagcgatgataaatgtggaaattataagtgcccagggtaatggtgtgtagaacaaacttcttcacttggggtggtattcgcatcaaagaggatgtccactccaagagtcgctggt

SEQ ID NO: 658678 - DNA, 1262 bp, Homo sapiens
  misc_feature (375)..(375): n is a, c, g, or t
  misc_feature (384)..(384): n is a, c, g, or t
  misc_feature (448)..(448): n is a, c, g, or t
ggccgaggagttgtcggggtttcctgcttcaacagtgccttggaccggaatcccggacgctcgtatccccaccccgggccggtcgcccatagccagccctccgtcacctcttcactcgcaccctcggactgccctctaggccccgcgccggcggcgtccatgcgtccgcgcagtcctaccgggctgccgcctgcccagccatctctcttaggtcgccgctcgagtggatcgaggcgcgtctcgcgctcgcgaggattggcagccggaacgtcactcgagccaggacttcgagaagggcctcgccaatcaaagcacggcacgaaggatccaactcgtgagagcctctgtacgccatccgtactggttctaccttgntcctagtgntcattacttacgtttgcactcgacgatggaatgatggcgttatgaacgtgaacgttgtgccaanatctagcgttatctatcacgcaagtcatcaatggaggcacgcagaggaaccatgcatgtaggaaaacctgtatgcatatgcctgaatgaatccgaaggaagcgtggggcggatcatcatatcctttcgaggactatctagatgagaaccatggacctgtgatctgaactggggaacgacgcggaggcatgaactcgcaactggacggtgttgcatttacctatttttgcgatcaaccacatactgttgaacaatcaaggttctgcgtacattggaacacatggtaactggaagcgtggaaccgcatgaatccaatggataatcccgccaatggtgctgttgactttacagttccgataactaccaattagacttgacatgatgcagggtgaaaggaccagtcgagctgaacttgggggtgaccatggttgatccaatgttaggagccaaaactgcggaagcagcccgatatcatgggctgagcgggcacttatcttgtttggaaccatggacctcgcctgggtgagaccgttgatagatcgaaagttagacgtacggcctaattgccccatagccaggtgggtgactcactgtgtcaccagggtgcgggcatgaactggtgggggtttaccataacctctggtcacaaatgggtatcccgagaatcccctataggtgttctcgaatggtacgctcctcttgacaacacgaatgggccccaaaacaagacgaaacgcgggtcctatcgctgggaacagctacaaagcgcagtctaaactccacagagtctgccacggaaaaagccagagtagata

SEQ ID NO: 658679 - DNA, 988 bp, Homo sapiens
  misc_feature (865)..(865): n is a, c, g, or t
atcttgactcttcggttagagggagtctcattggagatttgtctctgggattaatgagtgtatgcctagctactttctccagtttacttttagaccatatgttgtttgttttgaatatcattccttaggctatgttgagagtagagtggcttcccattaggagaactaatttagggcatgtcttttgctgaatcccgtcagcatatttaacaaattcccaattctagatatttccttttatttctctagtaccctttgccagggctctacacatcaaaggtgttcatgaagtatttgtcaaaggaaagaacagtaatgacacctaacacataatgagtgattagtatgttccaggcattgcgtgagctatttactgtgagtgatttaatgttatcttcccagcagacctctgaggtaggtactagtatgatccccatttcgtacatgaggaaactgacactaagggacataaaataagttttttgaagtcacaaagtgaataaaaggaagaaccaggtttaattgaagcccatagcaatgaaaacattgtggaacttattcttcatgaatggtttacaatttaaacaaaatgtcacctagaaaatagatgaaaatatgttcaaccaggtctggatttttccaagtgtttactactgaattttcattcaataacaagtttaacttccaaaaaggtgttggtatctgattttctgcctgcctcagaatgtgatttgtctgcctttgggtaatccagccttgggtagagaaggaatttgaactcaggaaattcaactccagaactgatgttcttttttttttttacatttaagttcggggatacatgtgcagaaggtgcaggttggtnacattaggtatacttgtgccaggggggttggcggcacctatcactccatcatctagatataaagctctgcatgcataagatattggtcctaaggctctccctcccatggccccgggccgaatg

SEQ ID NO: 658680 - DNA, 135 bp, Homo sapiens
ggtatgtagtatttctgcaggcacaggttacaactccaaatccagacctttatatcatcattatttcaacgcaacaggaggaggctcagccttgctttggctcattcccagagtaagagcgcatgctggagggga

SEQ ID NO: 658681 - DNA, 976 bp, Homo sapiens
tcgctgctcgccagccaggactcggcctggcagtggcggctggtgattcggaccgatccgacctgggcggaggtagccgtgccccgcggatgagccggtgaccaagctgggtgccgagcgggaggcagctgtggcgattgagtgtgatggacgaggctgtctgtgtcattatgtgtgcgtcggtcacgtataatatccggggtcctgccctcatcccaagaatgaagaccaagtcaccgaatctactatatcaccctcttctccattgtcctcctgggcctcattgccactggcatgtttcagtttcaggccccattctatcgagtcctcaaatgactggaatgtaggagaagcgcaggatccgtgatgtgccggttgttaggctgcagtcgagcagtccatcccaaagcggggggatctcaggtagcatgaatggcacacgtgattctcgagtgtctatcgctggtggagttcaacccaaaagaacgaaaatcacaggtgtataatctatgctctggaacaagagtacgtggatgactttggggtcctctgctcaggaatcaccgatctcccgggagtataatgaactgctcatgggccatctcagacagtgactactagagtgatgacatcaaccgggctgtctgtttgttcccgtccatcgatgtgcttaagcagaacacgactgcgcatcaatggagacatgcacaaagcgatggggccaggtctctagtcgggatcgagtacgaatcgcctgtttgttcagcctgttgcctggagttccccagaataataaaaagcctggagttccaaaaacaggcctgtggctgtgcgggttccaaatgaactacgggcaggtacaattcgactccggccaatgccacgaagcgaggggttccaaaagaaggcggggaaaactcgcatcaagggcgccctaaagggacaacccgccagagagttttaacccccagttttc

SEQ ID NO: 658682 - DNA, 1271 bp, Homo sapiens
ggaaagtgccgtgtactcgtcgccgttactccgaggagataccagctcggtagaggagaagtcgaggttaagagggaactgggagagcacgtttgctgtcgtgccaatcggaagttagagtggtgcaaaaatgcagcagtaataaaactttggacacttgagagcaagcaaaaccataactcccaagcaaagcatccatcaacatcacccacccagcaggcaggcaccaccagcacgcaccagacaacgcagaccgcgcacacaccgccaataccatgcaacactagggccaacagagccacgcagacccaacacactgacacgcgccttgacctatatgaacctagcacagcaactcggcagccaacacacccacggcagcacgaagcagccgtatccaaccgcacaccgaacgaccgacaacatcttaatagcggggcaccacctctataccatacccgacccaatcaactgcagcgaacgcaacacgcaggcaacacccaattcatgagaacaactactgagaacacggccccgccgacagccccacccatcccccaccgcgcctacacagcgacaccgcacacccaaccgccacgcgccacacccgccacacaccaacccggcccacccgccccccgccagccccccgcacaacaaccaacaggacccacccccagccccacagccagcccgcactgatgccaccacaaccaccgaccccaccccgccactacccacaacagccccgacaacacctaacacccacccctagagcccccaccgaacacagccagcgaaccaaccccaccccccgccgctacgcgcccaaacacagacgcaggagcacgtacaccacctggacaacctcccctcaacgtaccagacccaaccacgacccacggccacacccgacaaccacacccgcccaacccaaccacccccggccacgacaccgcccccacaccccacaacacagcaaaccccccccccacccccccgcgcccaccgagcgcccggacaaccccacaaggcccacctgacctccaccccgcgcccccccccaccacctgcccacctccccaccgcccgccgaccgcaccactccgaccccccccccagcccgggccccggcccccaaccagcgaggcctgggagcgaccacccaccgcacccccaccacggccccccgcggccggcgcggccgccccccccgcacgcagcaccccccgcccccgccccaccgccccccaccgcccccccccaggcac

SEQ ID NO: 658683 - DNA, 367 bp, Homo sapiens
ccaccaggcgcacttctggccccacatcctccgagtcgcgcagcccaaagatgtcacggagacctgcctaagcatgtcaacgctgacaaatgccttcaaggttgaagaccctggacaccaagccaggcctctacaccgcttacacggcccacctccaccgcgataaggcgctgctcacacgggtgctcccgggcgtgcacgaataagcggccgtcagatctgcagagcgccctgctgcggtggcccctcctggagctcacccagagcttcatcatccccctggagcactagcattgccagcctcatgcccctacagaagtgcgcctgggtgcagaagtgcgcctgggtgcagaattgcgcctcggta

SEQ ID NO: 658684 - DNA, 245 bp, Homo sapiens
  misc_feature (139)..(139): n is a, c, g, or t
  misc_feature (198)..(198): n is a, c, g, or t
  misc_feature (207)..(207): n is a, c, g, or t
  misc_feature (244)..(244): n is a, c, g, or t
ttctcgttgaggtggcgcagggcctcttcggtgagcttgcgttcggtctcgtcgatcacaaagatgtagaaaccattcaccgagccgtcactgctaaaccgcggcaggtacttcatcagcgcatggcggggcggccatngcgatgaggcgtcaccgtcatgaagctgcacgccttgcccttgagcgcgcggcgatctntctgcgcgncgcatacacctcgtcccgagcacttcgcgatgtctgnt

SEQ ID NO: 658685 - DNA, 313 bp, Homo sapiens
gtcctcccgctcgtacagttgcgacatgtgggacgctgacgctaaggtgcgctcgatggccaagccggtgccggcaaggctggagggcgaacgcctgctattcgaccgcccccgaatatggcgtcgcgccggggcaggcggcggtgctgtatgccggcgaccgcgtgctgggcggcggatggatcgaggggacggaggcggcgtaacagctcctccccgtaccggggaggaacttgcagctatcgcacgcaccgcctacagccccgacccgatgctgcccgcgctatcccatgtccgcaactggtacggcggg

SEQ ID NO: 658686 - DNA, 800 bp, Homo sapiens
tgaccacaggagagcctagggggaggcggtccaccagcagccccatacatggacactccgcaggttacccctctgggcaacgtggatgacagcaggtctaaggacatgctcgcaggcaggagagccccaaggtcaggtcccactcacagcacatgtcttggtcagtgagcagctctgtcggatccactgactggcagcgatatagatcaggcctccttcaagacggccagccccaggtccatatcaagcatctggagacaatagacaagagttgtccatgcttgtaaccagatacacggtccatgaagacgagccccagaaatagagatcatgacctactgcttcccagcacaaaatccaagtcccctgcaagtgtctatgagtccttcagaatccagacgtgggacaggcaggttcaagatcgcgaggacaagtcagagtctagctggtttgcccaagttcagctcctgggtaaagacaagatgtcacaagactggcgagtgtgcctgagagagagccggagtcagcccccttctgccccgagtgctgaggctatcaagtccatccaggacatggtaggctcagcccgtcgcagagtgatgctgaccatgatcactagacaggtgcactacactggcgcagcgagtggccctcaggctgccatgtaccaacaagtctgcatgaggagccgagctgagcatccaatggcccacaactctgaagctgaagctttaccgatctgatgagtgccctagtgtgcaagtgggggcataatgtggtggacagacttaggagacctg

SEQ ID NO: 658687 - DNA, 123 bp, Homo sapiens
gtatctctggttactttagtagccaacactcttggctactcagaccttggtcccattaaatccctgcgaaccttgagagcactaagacctctaagagctttgtctagatttgaaggaatgagg

SEQ ID NO: 658688 - DNA, 755 bp, Homo sapiens
  misc_feature (98)..(98): n is a, c, g, or t
  misc_feature (163)..(163): n is a, c, g, or t
agcggggcagtcgggagggcagggagcgagcaggcgaagccgcggaggacggggtgaagatggcggccttctccgagatgggtgtaatgcctgagatngcacaagctgtggaagagatggattggctcctcccaactgatatccaggctgaatctatcccatngatcttacgaggaggtgatgtacttatggctgcagaaacaggaagtggctaaaactggtgcttatagtattccagattatccaggtgtagtttatgaaatctctgacagacctatcatggaaggcatacataaaggataaatacaacaattaagaactggtgcttcaggtgctgaacaatctggcagatgaacccatatgacatgaggatctgctttggcaatttgggtcagatggtcttagttgtcaacagcagacgaagctaaaggaactggcactgggtgtatgagcctagctaagaggattagatgaccagggaaacactactatgaagtatcctgtcatgaccaagggttagtgccgggtcgggtggctctaccatgcaggccctctttggtacctaggtactgacaagtttcggatttaggcttcggtggaacaggatagagatcccaatagcaaacaatttgataactcactggagaggaattcactatgcatgataccattggatgtgacctggatatgcataagggacatgtcaaagttctccgagaatggaaacagatcttggactggcatttgaaatacac

SEQ ID NO: 658689 - DNA, 198 bp, Homo sapiens
gtcagacatgtgtactgagtcgcgaagtcgggaccatcgacgtgcggatcgtgtgcattacaggagtcctccacttggcactggttataggtatggacacagtaagagtcctcatttcagagcgaagagcccagtcagggagccagttgataatctgagtcctgaggcgcgtgatgcccgcacatgttttctgtatgc

SEQ ID NO: 658690 - DNA, 428 bp, Homo sapiens
cgtgcacctgctgtactaaaagtccataaataaccgggttgaggcagcaaacattatatggcgcacacttgatagattaggcaaaagaatgacttgaacccgtgagatgaagattgcaatgggccaagatagtgcctctgtactccagcctgggtacaagatttgttttgagacggagtcttgctctgtcgcccaggctggcacaatctcagctgactacaacctctgcctccaggttcaaacaattatgcctcagcctcccaagtagaggggattacaggcatgcaccaccacgcccggctaatttttgtatttttagtagacacagggtttcaccatgttgcccagtctggtgtcgaactcctgacctcaaatgatccacaaagtgctgggattacaggtatgagccatcacgactagtcctcgtg

SEQ ID NO: 658691 - DNA, 216 bp, Homo sapiens
ctgggcagtagagctactccagccaggtgaagatgtgccagcttccccgttccccttccaccatgattgtaggtctcctgaggccttccaaccatgcttcctctacagtctgtggaactgtcagtcaattaaacctcttttcttcataaattacccaggtctcaggtagttcttttcttttcttttgagacagagtttcagctcttattgcccagg

SEQ ID NO: 658692 - DNA, 188 bp, Homo sapiens
  misc_feature (6)..(6): n is a, c, g, or t
  misc_feature (137)..(137): n is a, c, g, or t
  misc_feature (168)..(168): n is a, c, g, or t
ccactnggcacgagggcggacatttcctttataatcctctttttggaattcaggtcagtcctattaaaccaattaaaaggggacccacctctgggaagatgtaactctccctcttgataaggtgactggaatttgtnaaaaaccgtcattccagttctaacccctctnaccattccccctcacaaatg

SEQ ID NO: 658693 - DNA, 141 bp, Homo sapiens
ttagaaccagatttactacccaatccaccccccccaacaggcccctttaagggcctccttaagaaaaataaggagttgactagggaccggatcaaatattagacatataattttttttgaatttcaatatggctttttcta

SEQ ID NO: 658694 - DNA, 176 bp, Homo sapiens
gggggaatttttaaaatttcccccttttttttttcgggaccaaaaccaccccttaccttaaccttttgggggttatggggaccccccccggcctttagtaaaaaaaaaccctttttttcccccgggtttaaaaaacctaggggaaccctttttttttataaatttcttccctttta

SEQ ID NO: 658695 - DNA, 328 bp, Homo sapiens
  misc_feature (108)..(108): n is a, c, g, or t
  misc_feature (179)..(180): n is a, c, g, or t
gcaaaagaaaagtgacgtggaggatcactcgtttcgttcttgtcgcccagactggagtgcaatggggcgatcttggctcactgcaacctacgcctcgcaggttcaagngattctcctgcctcagcctctcaagtagctgtgatcacagacagggtctctgtgtcatgcaggctgagtgnngtgcgcaatcacagcttactgcagcctcgacctcccgggttcaagtgatcttcccacctcagcctcccaagtagctgcaactataggcacgttaacacacctggctaatttttgtaaaattttttgtagcgatggagtctcactattg

SEQ ID NO: 658696 - DNA, 123 bp, Homo sapiens
ctgagtgagagatttatcgggatgacaattccagtttcccttacattttatttaatcaacattcccctgatgattgtggcctggtatcaaattggacataagtttacagttttcaccttcata

SEQ ID NO: 658697 - DNA, 181 bp, Homo sapiens
ccacgacctcttatctgacaggccaggatatctatcacctggtaggacttgatctggagccctgcagggtgccctgctgtgcagctagtgctatcctgaagcggaacttgtactcagaccttaagaatctatgatactaggatccgggcacagaagaaaaagatttagttccaccagggag

SEQ ID NO: 658698 - DNA, 416 bp, Homo sapiens
  misc_feature (360)..(360): n is a, c, g, or t
gcggctcaggaaatgcgccctccgctggcgctgggtcgcggttctggctgcgttactttttccttgcatctgtggcccggcgcgccagcctggacactagatccgcaagaagggagttttcccagggccggctgaagaatgagaagtccgagctgcggggacgttgggggtctgtgcttagcggccacagcctgcccaccacgggttcccgccaccccgcctccccacctcccttcgcgccagggctgaaagtcccaggcgcccaatgcgtgcccaagaacgagccgtgaaccttttatctacccgtccccttccccgccatggacccaggacgacaccccacacccagacaccactctntccaggggcagatgctccggcgcgccccgcgccctgaagttcaacttggaatccag

SEQ ID NO: 658699 - DNA, 102 bp, Homo sapiens
tgaccagcacttgggaggcagttcaggagagttgcttggggcaggagtttgagacagcctggtcaacagagcaagaccctgtctctacaaaaaagctaaaaa

SEQ ID NO: 658700 - DNA, 739 bp, Homo sapiens
ctggattcttctcgaagaatggctgtcacagcgtcaattcttgataacgcgcatctacttttgaatactcattgctacagggctctgtagttaccccatagcgacatcatctgcacacttcggcaggtacaacgcatactccacacaattgtgaagctgcctcatgtcggaatcacgtccacgcctgtggcttcttccactggcctggcactgattgtgcacaccatcttgtgcgatacgcacgtatatcgtggggctccaggcaatgtagctgcttgcatgctttgtacatcctccaagacttgctctttgactggacggacgtctaaccgtaactcagtccaacaagatcaggacaattatgacttgagtccacaaggacacataacacctgagtatgctgggcatgcccttggcagggtctaagccaggaagtcaagaatgatctggccttagatatttaagggaactcataggaagaggcctaggttctttaaaatcctgtctctttgtcttaccataagaggctgagcctctcttcatttttttgaagggcacacttcgtgttatctgttctgggaacttcattcattatttctactgggttgttgatctatgcagtaatttctaggagctgtttatgtttggaggtaattggtcatttgtccatatatatgagatgtaagtcgttattttccagttatctggcaagctgatttttgatgactttttattgtaa

SEQ ID NO: 658701 - DNA, 311 bp, Homo sapiens
ggggcccaaaaaaagggccaaaggggcctttttcccccccctatacccgtccggctggtttaatcccaaaaaaaaaaatccagaatttccgggtttaattgggggcctggcccccatttgaatttttttttcctggccaaaacccccgttgggtcccccctttggggggggctctccttgtaagtagtaaagttttttttttttaaatttttttttttgttttccaaagtaattaaattttaaaaaaaacccccccttatttttaaaaaatgtttacctttttgggggttttcccctttttgtgggggtta

SEQ ID NO: 658702 - DNA, 404 bp, Homo sapiens
gagagagcgtgagacatctatacgagcgtatgtgtatatgtaatgttataacatacatttgtgtcatgactctattaaactggactgacagctatgataatactgcaacagaatgcacagatgccttgggacacatactgagcacaatatgcagacttcagtgcgtgcatactaagcacgttcatacctcactctagctaatactgtattagaatacgctatactgggctctgctagttgaggaggtacactggagacagcttgatctactgtcaagcgagcattgtcgaatggtcattctgctagtgcgctccttagttgcctgagctgactcactgacgatgatagcatccacggatgctactagacggcacagctgctagaggaagctgcactactagtgg

SEQ ID NO: 658703 - DNA, 409 bp, Homo sapiens
cgcatgtgcattgagagcattagaggaactggcttcaaggccttttcttactgcggaccttagagatatgcttgactgcgtggatataacatctttcagtattacacctattcttctactgtggtttttgcacagggctgtcccacaggatgccgagataggtgcacactgacagttaattgaatacgatgctaatgataggagcatacaaatgatgcgagcattggaccataaattggcagctatacaggctgatatctgtgaattagacagagtcctcatctgaggtgacagcgacaccttctataaagacatgattaatcgcacagattctcggtgatgaccttgagtccacgatgtgttcagaatctgaagcactatgagttaccttagggggatacataggttc

SEQ ID NO: 658704 - DNA, 136 bp, Homo sapiens
ttaagccaccattacgttcctcatttgtgaactgtcttctcatattttaagttcaagtgtattaagatccattttttccctaagttgccaactttgttggaactccttaaaataagcacccatgaaaagccagtca

SEQ ID NO: 658705 - DNA, 163 bp, Homo sapiens
gcttactactctcaacgctttatactttctcaacgcttatacttcctcaacgctttatacttcctcaacgctttatacttcctcaacgctttatacttcctcaacgctttatactgtcctcaacgctttatactgtcctcaaccgcttctcactttcactttg

SEQ ID NO: 658706 - DNA, 134 bp, Homo sapiens
aggctacctgaggatccctttgagaggatctgtccttagtacgagagaccgggatggacagaccgctggtgtacgagttgtactgccaagttgcacagctcggtatgctacgtctgggaaggataagtgctgaa

SEQ ID NO: 658707 - DNA, 858 bp, Homo sapiens
taatttattgtacaaaaatgaaaggaatactaatcagtctcagaagcacctgcatgcataagattatactccatgttaacatgtggctttagagctggtgtacgataagtgtatgatctactcatgactgtatattgtttgcatcacaacgtaattttcttttagacttaagtatccgtgcagacaaagtgggttagtactacagaatttggcgttacttccaagtactaagtatgcacggtttcctggtaccattgagttgctgctattaacagctcacacacgcacaatggtaactagttacaagtgtgcacacttatgactgcgtgagccctctagaaacttaccacatgtataaagcggctcgaacacatgagctgtcaacactagaaagttaggagtgtgttgatatgtaccagagtttgtgcaatagcacaactcagctgtcactagaccagttgactaatgtagttctactcactttttcataattttacgcaatttacgtacacaccactgcacttcattgcgtaactacacctgccagaaatacttcctagctgtctgtaagttcccacagcgctgtcatacaagtgggagtcttacctgtacctaagatgtgcgcccttgtcaaacactctgcgtcgtaccgttgctacgatctggtacctcaacgtgcgccgtcatcaacacttaagacgtcaggacagaacgaagtattcattctgtggtgtgccacatcgtgtgtatagcaaggagggatagaacgaaatgctgaaagtaggcgggggacacagagggttggaaacctcccagggacgtgcttgcacaggaactatccaccatgagagcataaga

SEQ ID NO: 658708 - DNA, 174 bp, Homo sapiens
  misc_feature (83)..(83): n is a, c, g, or t
  misc_feature (101)..(101): n is a, c, g, or t
  misc_feature (165)..(165): n is a, c, g, or t
cgatcaaccttttatgttgctgtgcggatctgaaaaaaaaaaaaaggaaaaaaggaaatggtctttctacccttagttggtcnccttgagggctgagttanagggctggtgagaatcaatactcaggtgcattaattatatccaaattaaacttttctgcagtancgtaaaagg

SEQ ID NO: 658709 - DNA, 192 bp, Homo sapiens
ctgtacctttgatcatcatcttcccatttcctacctcccctacagatccctgccaaataccattctaattctgtactagtttctatgagtttgacttttttagattccgcatgtgagaacataaagtatttgtctttctctgtctgacttagcataatgccctcaaggttcatccacttttgttgcaaatga

SEQ ID NO: 658710 - DNA, 1347 bp, Homo sapiens
cgtcagttgttctcccggtctgatcgctgtatatccgctgggttgttggcgccgcgctcttgggtgtgttaccacaggggttggtgtccgcagcacagggacgctctccctcgccggcttcggtaggacgtctcttgtttcgagaacgtttatttgctctccaagggagatccgtggcgcttgagacgtgtgcccggcggaacacgtttcgaggtcgaagttgttttggctcaatgtgcgcttaaggggctactattcgccccaaagaggtattttttgtcgcccgtgtttccacggggcgcgcaaataccccctgggtgacccacttgggttatccaacccccctgtggggtgaaagatcgcacccaacaggctttatagcaaccacaattttggaagggaaagacccgtccccccgttgggggttgtgtccaattggccgggtacacatctgggctgtgggattatagccgccttaattgggcgttttcacgactttttattgccaggaatgggaccgctcttagtgggaaaatttcaccgcggggggatatgggaaaagcccccacaaacgcccatattgggagaataaattaagccgctctcccaacgtggtgtgccacaaagtttgagacaccccagaccttattttaaagaaatggaagaaaatagcacctcttgaaaattccccgccactcttggctttttagcctttattcccaagtgtactctaaaataagaggacccctctggatatgtttaatttaaaacttctctctctctgcttgaaacaaaattgggaaaatattccaaaccactcttacacacgaaagagaaattgggagaaaaccaccctgataaccacagaggttttctcccacacccacaaaagagaagttggaggccacccttggatctccacacaaaccaccgcagaggagaagaaagagaagctccaaagctcttgagagccgctcggaagagaagaaaaagagaaaaagaacacacgcgaagagaaaaggaataagaatatagaaatccacgaagaattttgaatgtaactccacattttgggggcacccacacttcagcagtgtaaaaagccacacttcctaacttcttccaccacactataggagaaggctttatctttttttaaactggccccacgtgggagaaaatatggaccacttacactactgaaattgggtcctctgtcacatttctgtcccacattgaaaaactttatattgtaaacgaatgaatggttaacccctcaatggaacgtcttaattttccacacacatcccctttttttggaataaaatcttgcggaaatggaaatga

SEQ ID NO: 658711 - DNA, 662 bp, Homo sapiens
gcctagtcggggggctccgtggcccccgcgtggccccttgggctcgtggggttcctgcgctcgccctgacctttctggttttgggcgcgccgcccctgtttccgcgaggctgactcactcttttggctcgcgggtccccgggccactattgccccccggtgatcttcgcgcccacttttccggccccggggtgctcaactccctcgctcggccccccctccctgctagtgtgtctgtgtgcagcatatactgtctcacgccactgtagacggtaattggttctccaaaatgttcgtactgctgctataatgttcctttagacgaaatatttcgtgacccaatcgtcgctccgccgtagttatgatcaacgctctcctggtgaagattcgtcgacgcccccccgagtagggatactttgctggggagcggcgcggccgccctcggtgggttgtatatccgctggagaatactagagacagcttgacgacaccctcccgcgaggccgtggggaaaccccagcaagcttttgtcaattgctccgccagactgtggcaagcttttgtaggtatgtttgtaacctacttattggcacctctggtccgggactggtgggcgcacaatatgcccgctagttattaccaaaaggaaacaaataacaaaac

SEQ ID NO: 658712 - DNA, 1018 bp, Homo sapiens
ggagagaactagtctcgagttttttaggggtttttttactttttaaaaatccttttatattactcttttttaaaaaatgcaacaagagccttacaaaccatccatctgaagagcaagcacaaagaccggatattgtgtggtgccaccgcagttgcaagaaaggaattgtcagctcagaaaatgaattgtgtttcagtcactctgcatgtggttgctgccacgcattggaacatttttaggccaacttttaaaatttcccagttaaggtaagcaggaaatttagagtgatcttcattaaaattccagtggggtgtatctgagctccgtgggtgccaaaggggccacataattacgatgaatttctgtgcattcccaaaaacaagcctcttctcggttttccaaagtgcttcagttatacgtgaagaagaacgtggtgccttatattcccgagaacccgaagccctttctttttgtggacctccaagaggccttaaatataaagtggccaaattcgaggggccaaactttgtaagaaacgagaaagaagaaaaccctccccgattactctcgagtgtctcccctgtagaaaatgtgtaactctaaaacctttgcgccatattctctcaccatagaaaagtgtctccccccagaaatctattccaccgtgtaattcgtgtctcaacgactgtgaaaagccatgtctccacgaaataaaccaagcccccttttgaatttgtcgcaccgttggcgcttaacacgggaatttctaggaggagaaccccgacgagaaggaatttttctccaactaccaattgctgggtgtagttgcccatctttaaagggcggtgggctcaaacacaacaatttgggggacttaaaacttcggtggaaaacgcggtgttggcacactttccccaagaaagttttaaatattttaattacccaacaggagcggccgccggcctccaaatattcgttggtgttacacgtgtgggcggccccaccgaagacacaacag

SEQ ID NO: 658713 - DNA, 715 bp, Homo sapiens
  misc_feature (6)..(6): n is a, c, g, or t
  misc_feature (66)..(66): n is a, c, g, or t
  misc_feature (284)..(284): n is a, c, g, or t
  misc_feature (292)..(292): n is a, c, g, or t
  misc_feature (295)..(295): n is a, c, g, or t
  misc_feature (304)..(304): n is a, c, g, or t
  misc_feature (313)..(313): n is a, c, g, or t
  misc_feature (328)..(328): n is a, c, g, or t
  misc_feature (335)..(335): n is a, c, g, or t
  misc_feature (337)..(339): n is a, c, g, or t
  misc_feature (341)..(342): n is a, c, g, or t
  misc_feature (344)..(344): n is a, c, g, or t
  misc_feature (350)..(350): n is a, c, g, or t
  misc_feature (353)..(353): n is a, c, g, or t
  misc_feature (360)..(360): n is a, c, g, or t
  misc_feature (362)..(362): n is a, c, g, or t
  misc_feature (368)..(368): n is a, c, g, or t
  misc_feature (381)..(381): n is a, c, g, or t
  misc_feature (386)..(386): n is a, c, g, or t
  misc_feature (391)..(391): n is a, c, g, or t
  misc_feature (507)..(507): n is a, c, g, or t
  misc_feature (535)..(535): n is a, c, g, or t
  misc_feature (550)..(550): n is a, c, g, or t
  misc_feature (577)..(577): n is a, c, g, or t
  misc_feature (622)..(622): n is a, c, g, or t
  misc_feature (639)..(639): n is a, c, g, or t
  misc_feature (677)..(677): n is a, c, g, or t
aaagcnagcctgcaaagtattcaaatgtgcaaaaatgacagttcaatatctcaaactattcctggntcagcagactagctccttcactttcacacatcaatatttgatacaaaaagttattttggcaaaatctgtaatgccaagaaaaaggacaatttgcaatttcagtcattaagtccaaaatcctatagccagcagtcagatctctctgttttagctgcaaccagttctgggagagagagaccactgtatttcatttctgtgatgagttctgaccagttttngtcaagangtnttctctganccagcggangacaggatcttagangggcaanannngnngnaagggntangggagcnangggccngaaggggccaggnttggntgagncgcaattaaaaaacacaatgaaaaaataatttcattttcctatccaggatccagctatatccaacagttttaaatgagacagcattttccaaaacagaaataatccaaaacaaaanagggatggcagatctgtcagaattaaanactgaaaaggacggncttaaaaacatttccccactaataaanagtaaaggctctgtttgtaaccagttatatatcaaaattgaccanacagtagtaaaatacanataaaactttctttatgtcagaactggggctattcacntggaaaaggctgaccaggtcaaatgtgtatgggaacga

SEQ ID NO: 658714 - DNA, 922 bp, Homo sapiens
agcggggggggcgcagcgggcggaggcggcgtgtgccgctgggcagaatgtctacgatggacgagggcttggtacgcccctgctcccacgacaggctgtgtctacgcagatcttcctgagtcctggtgccctggctcgactgtgctggccgcacgggcgtggtgtgccgcaaatggcatggccggtgtcagtgggacagagttcctgatggagggatgcgacgttctaccgacgtactaccaggtggccacgcgagcgtgacccgacacccagtggtcactgtcctgggtactaaggatttccatcgggctgatatgactacggtgccctgcgtggaggtgcagacttctgcgggaatcggctcgagaacaggtccttgcatcctctagtcttctcccgattcgggaggttaccacgttcagcagtccatgctcacattggactagcgagtgctgaacgatctgtggaggcatacgacgctggacctatctcagcgtgtgtgcaactatgcgctggactatgacggatcacctacaacctgagaggcaaacgaatccaagtttctcaccgagtttcaaatcagagctagcgagtctgctaacttggcatgggcctctgtgaggaggtgttgcccttggcggccgacagcgaaattccttgcattcacggcgagaaggagttgctggtctatcacgcacttatgatttcactttcagcgcatgcttggtctccagcgagttgcgggaacaatggcccgtagtggacggtgtttgggctgtttggctcacctgacgaactaggcatcactctcgtgggataccttgcacctgagtcgggcagaataatctaccgtctttgactcgggtgtctgtggagtcactccaattggccttcccaggtgagtgttggatgtcttgaagaa

SEQ ID NO: 658715 - DNA, 694 bp, Homo sapiens
  misc_feature (300)..(300): n is a, c, g, or t
gttgggattacaagtgcctgccaccacacctgactaagttttgtattttttagtagagatggagtttcaccatgttggccaggctggtctcaaactcatatcctcaagtgatccaccctcctcgtcctcccaaagtgctgggattttgccatgagccaccacgctcagccatgtttagccatttttaaaaggtgtgaacagataattaagtctattagcaacattagaaaatttaagttaaaatttaaatgactctagcaagaattagcctttaggtgccctgggtccccctcctcaccnccccccaccccgccgccttctgagaagcgttttgtaatttttcttatttataaaatgggtttgattcaaaactgacttttcctcttcacagtctcacaggtccttccccaggtccaagaggctcttctgtgtcctgatgacaagtagctggcctagccgtgggtggcacctcctatcacatgttaaggggaccccttccccagggccacacctggcagaaggtggcttatgatgttcgcagcttgaaagtagtgttaaccaaagataaaattctaagcccactcccccagccattggaatggaccccttctcttggccaggggaccttcaaagtaaccctgaaaaaacccgtttcaagctgtgaaaaaaaaagtggagttggccattggcctca

SEQ ID NO: 658716 - DNA, 1826 bp, Homo sapiens
tacaaaaccccctttttttgggggtgcttgggggggagtgattttttttttaaaatattaaaaaaaacgaaaaagagtaaaaacaataaaaaaaaaatactcaaagtggtgggagaataaaaaagaaccacggtgggtgtgtggggggggagaacacaacgagcaaaagagagagaatagagtaacagagtgtgtgagacaaaaacgagagtgagagaaagagtgtcgcgcggcgccctctatattatctattacagaagagacacccggtggcagaaaaactctcacacgcggcgctctcatcatttaggaggggcctcactgtgtgagaaataaatctctcatatatatcgcgcgcgtgatcaacaaacaaaacacaccagagagagagagggggggaggcgcgcgcgcctacacagaaagaatatctctccgcgcgagaggggcggcacacaaagactacatagcgagagcgataacacgcacgaagcatatctagcggtgcacacaagagagaggggagccgccccctaatatagtgaggagcgcaggctcgctatatatataaacacaagcgcgctgagagcgcaacgcgcgcgcgcgcgcgctgcgtatctcacaccaacagcgcgacggcgagcgcaggtgagagacaacaaacatcgtgtgctaccgacagtgtgcgagcacactctcggtgaggagaagagagagcagacacctcatataacaacacgacggggggggggggggcgcgcaggacgatcccactcatatagtggtggcgacgaacacgaacacacaacaccatacctcccaacaaacagagaaaagcatataatacacaacagcagcccctaccaacacaagacgggaaggcgaacaacacataactacagcacggatcacttacacacacacagcgcggacgcacgtaacacatcacgctcggcgctcgccgaatccaccacacacaacgaccagcgcgatacatacaaacaccttcgccaccgcggcgtcagacaccagtaacagacagcacaacagcagtctgcgcgaggaccaaaccacaagaagagaaagcaaacaatcatccacatcacagacagacagacccaattctacttcaacacacccaggggagagggaggagctgtactacgaatgaatcaaataaacacgcgaagcaacacaacgcacgacaacaacacacacacacacgcagcaagcaacaaaccacgccacgcacaaccacacgcacgaaagcacgaaaagagcacgacaccaagcacgcagcaagcagcaccgacgaacaacacaaagacacgacacgcaaacaacaacatgccaggccgagaggacgcgcgacaagtcaccagaccagacacagcgagccagcctcaaacacacacacacaccacaagacagacatcccagcaatacagagaacccgcacagcacaacacagaacacggcaagacacaacacaccgacacaacaaccgcgacccagagaccgcaggcacgaacgagagcaacacccaacacagcacacaaacacagacagacagacacacgccagaccactaacgcaaacacagcccaagccagcgagaggccaaaccagaccacaagtacctgaccgacacaacacagacgaacggaaagagccacacgacagcagcacaaacaccactgacacgcacaccagaaccgaatgccaagcgacactacacgacaaggcgacggccgagaaggaaagaacacgacagccaacgacaggaccaacaacacaccaagaaacaaggcgtagagcgcgccgacacc

SEQ ID NO: 658717 - DNA, 508 bp, Homo sapiens
tttctcagctagagttgaacagggacatttgccatgactgcagctctgccctgaaccctcacacccagccctagacaagggtgtgttgcaccccttgtaagtggcttgataccacgtcaggtccaacgttgtggtgatcctgtgcgagtggagagtgagttcctccccttttgcagtccccaaaggaccttgttgatggctcgattattttttttatgcctcaatttttgaactgattctaagtccctttggggatccaagcagaaagacaaccttaagtaggaaaacagccaaattattctgaaagaatatgttttgctataactgtaaaattaagataaagaaaggatgtcagttgaaggctacttccagagaggatgtcctgaaaaacacagatggtactattttattagctaatagtgtcactctggggcacaaaaaaatgatttccaattactagagctgaaacgtatcaaagactgaagtaactctttgcatcctattcttc

SEQ ID NO: 658718 - DNA, 540 bp, Homo sapiens
taggtcgtctagaggatccctcctcagtgaaaaagagaagcatgacacctaacatggcccagcctgcttcattctgttctcccctgaaacaacattcctttagtaatactccgaataacagcttcatcagtctgtctaccgaacactcttcaggcttcatcttatatgacctcccaaaccgcactaagggttgtattagagaaaagtggataaagttcggagtcaggctgcttgagcttaaatgccagcttcacttaccagccaactgaccatgagtcagctgcttaaccattctttgccacagtttccttgtctatgaaaagggaaatggctcccacctcaaaaagttgttaacattaaattcaatcatgtattcaaagtcctgagcagaatgtctggccatgactgggacttaacagatgttagcatttattattaagatctgtcagtcttgaaatgttctcttcccttggctttcatgacattccacactctcctggttttctcttacctctcttgtaatacctgtttgcttatcct

SEQ ID NO: 658719 - DNA, 192 bp, Homo sapiens
actacctaaatggctgtatcacagcgctgcttcttatcaaagccggggaaaactcatgcctttcctttttacaaaatgcttttatgtatttgtccatacgtcactatacatctgagctttataagcggaagtttccaagctaggaatggagcaccactgcaatgaaatgtgtccaccaagctcattgtccct

SEQ ID NO: 658720 - DNA, 242 bp, Homo sapiens
  misc_feature (22)..(22): n is a, c, g, or t
  misc_feature (238)..(238): n is a, c, g, or t
  misc_feature (240)..(240): n is a, c, g, or t
ccaccaggtttagtttccgggnacggggctggctggaggaggggcagcccgagacgcggacgccagggcccgacacccatacggcaccgggacctggcttagccgcggcggcagtcggtccgaacccttaagctaggcgggcgccgaagccgggacgcggagatagtgtctcagctggggccacccgccgcgggaggggcggaggacacaggacagagggcgggcctgcgccgggctnantc

SEQ ID NO: 658721 - DNA, 323 bp, Homo sapiens
aagctgttactgcatatgaccaggtcttgggctaaagtggggaaccaaaggggcatctaatataaacggaaaattagtcaaataacaaacaaaaccaaagactgactctacattccttcttcccaccgtgcccagtccccacacacttgtcacaagcacattcaatctttgtgtgcccagagtgccagttggctccatgcctttgtccatccccagccagttttggtgcaccactgcagtgatgccatgcaatccacttccaggtccagtgcagttccaagcactcagccattggcccacaccatgcgcagcacaacccccat

SEQ ID NO: 658722 - DNA, 305 bp, Homo sapiens
tttacaacaggaaactgccgaataacttctgtagttgtttaattagtataggggaaaaaaaaaccttcaaaagcgtatcttcacactttgattctagatgcctttcgtctaagtcatgggaagcccacgtgagtcatctttgccatctccaggagtggatagttcgagggagggaataggaatccccatcagctgagggagcttaactaggctggtcgatgtggtcttggtgcagcccacacgtggcaactgtgcctggtgctgagcaccttggcactatgccacgcacttgagaaagcacctct

SEQ ID NO: 658723 - DNA, 779 bp, Homo sapiens
tggacattttgtgtgccaaaaccttttaattatcccctggtccccaggtttgttttcataaaagcggaacacagaagtgtcttccagtttcttggtccccaggtttcaggttcccttcccagcggaaggttgggagggcacgcccctcaccacctgtggccacccctgtaagtgtgccatactctcctgtggaggaaagttcgtttgagcgtgggcacaggcttgcccgctgtggggggttgcctccggcacaaggcgttccagagggcatttctcctctcgcatcccgagctatattctcgagtctccacgcgaggatacgtgggcggtgtgtctccccctcgagggtccatatagtgtgttggccccatctccaggaccccatgtgatctcaaattttttctttctccacgagtgttctccacagggcgaaagggcggacaggagggctctcagacaccaggagaatcttgcgcccatctcttagattatacgccagcggcgcctgttgacatctcccttgtgggtgaaagttgcagagacctgtgggggtgactctgtgtggctcctcaaagaagggcggagaaaggcaggctctcgtgcgtgctctttcgtcggaagaaacccttttaacgcgtggaaacgccgtatcacttcccaacagcgggggggtttattagcgagggcaaacttcaattcgctgtgtagccatctccttgctccgtgaagaaccccgtattaagggcgcaaaggcgtgggaaggggcaatttccccttaa

SEQ ID NO: 658724 - DNA, 276 bp, Homo sapiens
  misc_feature (19)..(19): n is a, c, g, or t
  misc_feature (41)..(41): n is a, c, g, or t
  misc_feature (139)..(139): n is a, c, g, or t
  misc_feature (158)..(158): n is a, c, g, or t
  misc_feature (178)..(178): n is a, c, g, or t
  misc_feature (197)..(197): n is a, c, g, or t
  misc_feature (235)..(235): n is a, c, g, or t
  misc_feature (257)..(257): n is a, c, g, or t
ccttgataaaatgtttatncccatacaggtcaagtacaccntacttctattcacagtgccgtagccaataacaacaaaccgcgcttacaaatttggggggcgtggattttagtaccttccatttgaagtgtaatcattnctaaattattattattttncctggggcagttatcagtgntttaaacaggaactttagnggcttcaattcgtttaagaaacatattaagtttggagnggaaaaatttcccatggaaatnatttgggaacgttaagagt

SEQ ID NO: 658725 - DNA, 247 bp, Homo sapiens
  misc_feature (37)..(37): n is a, c, g, or t
  misc_feature (192)..(192): n is a, c, g, or t
  misc_feature (197)..(197): n is a, c, g, or t
  misc_feature (201)..(202): n is a, c, g, or t
  misc_feature (206)..(206): n is a, c, g, or t
tcggactgagagacgtgttgcatggacagctactgangacactctcagttcactcacagcgcagtgcccaagaacttaaaacgtacacagtaagacaacatgtaacttcctagacttaacgtttacagttcaaactagttccaattacttttcttttgcttggtgtttttttttttttttttttaaaagagngtctngctnngtgncccaggggggaagcaccagggggggtgaccccggctcattg

SEQ ID NO: 658726 - DNA, 393 bp, Homo sapiens
cgggggacgtggaatggcgcactcccacgttccagtatgcctaattacctctacaaaactctcaacccactctctgttaaaccagtccaacccttctttggcaaaggacgctggcttgcatttctctatcagctaccacttacgttgccactctcattcccacaaaaaactgggtagttactagcttaacctaccaccctcgtaatgaaggaaaaagccccttctaactcctacatatgcagtcattggccaacttctccatcaatgaaatgaccgaaaataccctgacaggtcgtgcagttcaacttttacgctcctacatgtccagcctcacccattacacaagtaatgaaaagcccatacacggccctgtgactacaaacgctgtcttaa

SEQ ID NO: 658727 - DNA, 787 bp, Homo sapiens
aaactgggtcactcatacatagctgctgaagatataaaatggtacagacactctagaagacaatttaataaattctgttataaactgaatgcagaactaccctgcaatactggacatttatcccagtgaaatgaaaacttgtgttcttgaaaaatcatatacccaaatgttcatagcatcttccttcttgataatcaaaaactgagagacaacccagatgtacttcaatgggtaaactattaaaaacactgtggtccatccacagcatggtattcagcaacaaaagggaacaaatcattgagaacaagacccgggtgaatctctagagaattacactgaatgaaaaagccattcccaaaaggttatatgctgtatgattccatttgtatatcattcttgaaattacagaaaaattatagaaatggagagcagaatagtgattggtcagggtttaaggagagatggggcctagagagaagtgggtatggctatgaaagggcaacatgagggacccttatgggaatggaaatattatgtctcttgactgtatcaatgtcaatattctggttgtgatattgtactatagttttgctcgatgttaccactgggaaagggcccctgggaaagccgggttacatcttacaactgcggtgaacatgatttcctaaaaacccaacatacaacttattagagtaaagaaaaacaaaaaacccggggggcggccaatgccaagacgatcaaacgcgcggtaacacgggaaacagccccagggccctagcgatgccct

SEQ ID NO: 658728 - DNA, 908 bp, Homo sapiens
aacgaggcggtctcgcccggcgcgaggccgggctgtgctcgcctcggagatcgctgctctttaggctgggtgcagaaggcggctccgcggctcgcggacgactggtctggggcgcgaatcagatgggggggctttctcccggtaccgcttccgcagctcgtcctgggctcgcggttgtctccggggacacagccgatggccccgagggcggactctcgatgaacagcaacaagtgaaacatggacagcaatgagtggtcatatattctaatttgatcccagtggttattggaagtgtacccatctcagatgaactggactaggggaatcattcaacctacgcatgtttttgccactagcaccggatcgtgagaatcatggtttcgaaaaaggaatgtgctaaaaagggccgtttgatagaaccgaacggagtgaaattatgcacggggaacagatgtcggtcaagtgtgttcagaatagtatgctcaaatacgcgttggtggaaacactggtctagcactgtgtgtccgtggatcgggaaagatgctaatgatcggtgtgatgatggagtaaggtaatgtgccatggttgatggcgagggctaaagtgtggactcaatgatatgattgcttcaagctggagtgaggaggttgatgatgctgattgattttagaatacatgggaatgcactggtggaattgtctttaaaacagaaatccaggcactgccagggtgtgatgcattctgccaggtatgagtgcagtactgctctggtgtggaatgagcaaccaaagaggcagatgttactcttcaagggaagaggtttgggaacctaaaatgaggattgggtgagggcaaaggtggaaaaaaaggggggcaagataatatgggaaaaatgggaaaagtggg

SEQ ID NO: 658729 - DNA, 181 bp, Homo sapiens
ggacttagggagtgggctacaacgtataggtgtcggtgtagtacgatgtctagttgatgagttggctattacaatggccagtcaggccacctagggtgaaaagaaggatgattcctagggctcagagcacggcagcagatcatttcatatggcttcggtgcacattaatgggggtattccg

SEQ ID NO: 658730 - DNA, 290 bp, Homo sapiens
accaagatgtctgagttacttccttccctgtcaaaattttgcctcctttgattttcaatatatatatatttttttgtcttactctgttgcccaggctagagtgcagtgacgtgaccttggctcactgcaacctctgcctcctgggctcaagcaatcctcccacctcagcctcctcagtagctgggaccacaggcatatgctacaaagcccagattatttttttatagaaacagggtttcaccatgttgcccaggctggtcttgaattcctgggctcaagtaatctaccca

SEQ ID NO: 658731 - DNA, 419 bp, Homo sapiens
ttgtctaaaaggtatacggatcttcttctgtctaacaaggtatagtatagggtaaacattctcttgtgaaggctcctatatatatataaaaatttggcaagataagaatgcttaatatctaggtctctgtcccatacttcacgaatttatttattcttagtctaaaaggtataggatcttcttagtctaaaaggtatagtatagggtttacattctcttgtgaaggctccgttgagaagctaaagcttatcaacggattgtattttttaatctcaatttagagttaggggtcgagtctcacaacaagttaaatgaatggccttaagtcaaaaaccaataaaccaaatagcacaagaaatccaactgcaacgtttagataccagttctagattgactcccggtatagtataacgggagcg

SEQ ID NO: 658732 - DNA, 486 bp, Homo sapiens
tgtattctcatgtttattattcaagttgtatgacaatttcatatcagccccccagagagttggcatttggattgaaatcatactgagtctctagattaatttagggagaagtgacatctttataattttgaaatcttcgctatcgcatgtatatgcgagtgttttgtatttcagtggcattttcaattttcttcaggtaggtctcttagtgtttattccaaagcatgtacatctgttaaatgactttatgtgaaatgcaagatgttctaacctcccattgatatttatactgaattgtgagcataaggataaaactatcgcctgaattgtgtaatctcacacagataattagtaaaacctaggtgccacttcatactcaatctatatttaatgaaatttatacatagcttttccatggtctgttactttggaagttttcagagtgcccaattatataaattgcaaataaagaaaaatttacctctt

SEQ ID NO: 658733 - DNA, 106 bp, Homo sapiens
tggtctgaccactactggctgacccacgtacatggccagtactggctacactacgggcttttaactgcagcaagtttaatatacgctattggagctagaattaccg

SEQ ID NO: 658734 - DNA, 251 bp, Homo sapiens
ctgaggatccccaaaagccattactagtagcagcagtttctagagagctcgtgtagccttataacaaacttttttttattttcttttgggcccttagaaccagacatcttccatttttacggtctcaacaattatttcccagggtaccgggtatggcagttcgggaaagggaaaaagagggaaaaaattgaatccaaccgaaatacggcatggcgggaaaaaagggtcaaaagaaaatatgttatatctcg

SEQ ID NO: 658735 - DNA, 454 bp, Homo sapiens
  misc_feature (8)..(8): n is a, c, g, or t
  misc_feature (11)..(12): n is a, c, g, or t
  misc_feature (228)..(228): n is a, c, g, or t
ataccctnatnntagtatgatgatggtcactgagagaccttagagataatttattactttgaaaggattatcatccagcagaaaagatttaaaaattatgtttaaattggcccaaagcagacagggactggtgaggggagttcaaaagagagacctcccttgcagataggcatgagtgacaatgaggtggaggttggagtgggcagatccaggaaggaggagaagggnacccttaagccacccttcccttatgaacagactcttatcagtggggatggcctcatcttctgagtcctattcaatgtgcaagactttcttcactcccctcctgctatctttcttcctgtttatgatcaccagaacaattttaggaagaaattgttctggcaatgttggttaaatagctccatctctggttctctatttgaagccgacttcttaattatgcaccatt

SEQ ID NO: 658736 - DNA, 508 bp, Homo sapiens
  misc_feature (121)..(121): n is a, c, g, or t
cttgacttgctactcatttaatattccgtgtgataaaaacttcccaaactctgactcaaaatttttctctgacttagcatagcttctcagataaagtctctgctgggcattattatcaganttgaaattgcttatacagataaggaggaaagataaattcaaaacccagtgctgttcaataaaaatattgtatgagacattgataaaatgtaaatttttttccagttgtcacatttagttaaaaaaaggtaaaattaatttcaagtatatattttatttcagtaaatatatccaatatattgtcattttgagttgaaaactaatataaaaagtatcaatgagatttttttaaatattatgactttgatctctggagttcattagatccttataacacatcccaaattgaacagcctcatttcattgcacccaaggaccacatgtgactactggtttccatatccattagcaaaattataaattttgtatatgtctttcagttattgaa

SEQ ID NO: 658737 - DNA, 425 bp, Homo sapiens
  misc_feature (69)..(69): n is a, c, g, or t
  misc_feature (377)..(377): n is a, c, g, or t
  misc_feature (382)..(382): n is a, c, g, or t
  misc_feature (403)..(403): n is a, c, g, or t
  misc_feature (419)..(419): n is a, c, g, or t
aatttgagacggagtttcactcttgttgcccaggctggagcgcaatggtgcaatctcagttcacctcancctccacctcccaggttcaagcgattctcctgcctcagcctccctagtagctgggattacaggcatgtgccaccacgcccggctaattttgtatttttagtagaggcggggtttctccatgttggtcaggctggtctcgaactccccacctcaggtgatccgcccgccttggcctcccaaagtgctgggattacaggcatgagccactgcacccagccataacaactttttaaaagcactccaatagcatgcctaaagtctaaggactaccactaattaagtttcaaaaaaattgccaattttatttnagganaaaacatggaaaggaaaccancagaacacaatttttncaacca

SEQ ID NO: 658738 - DNA, 361 bp, Homo sapiens
  misc_feature (144)..(144): n is a, c, g, or t
  misc_feature (201)..(201): n is a, c, g, or t
  misc_feature (206)..(206): n is a, c, g, or t
  misc_feature (224)..(224): n is a, c, g, or t
  misc_feature (235)..(235): n is a, c, g, or t
  misc_feature (246)..(247): n is a, c, g, or t
  misc_feature (255)..(255): n is a, c, g, or t
  misc_feature (270)..(270): n is a, c, g, or t
  misc_feature (281)..(281): n is a, c, g, or t
  misc_feature (299)..(299): n is a, c, g, or t
  misc_feature (301)..(301): n is a, c, g, or t
  misc_feature (307)..(307): n is a, c, g, or t
  misc_feature (310)..(311): n is a, c, g, or t
  misc_feature (322)..(322): n is a, c, g, or t
gggggttttctttttccccccatcccttgaggggttgggccttcccaaaagggttttgtttttttgtttcttttgggggtgaagcagaccaggttccccccgggccccccggttgggggggggccgggtttttttttaaaaacntcccctttccccccggggtcctcccccttcccagggggccaatttttacccgcaaanggganttgggggttgtttgtttngtttggggtanaaagggaaggnnggggggangcccccccccggggngggggggttcntttcccttttccccgggncnggggtnttnnggggggggggnccggtaggggccctttgttttaaaaaaaaaaggcccata

SEQ ID NO: 658739 - DNA, 122 bp, Homo sapiens
tagttatacgagtcccctgggctggcgacacggtttgcgcctacgtgggtctcctgttcccagtgctaccctgcatcgctggctccttcccaggctctggggcagcgcaggcggggtaggct

SEQ ID NO: 658740 - DNA, 331 bp, Homo sapiens
gagttccccctggttttaggacattttaacaagttttgtccaggggtttccccattcccaccaggccttgcacacacccattcggtaacttttcccctgtacttgtgccaagcctagcacttgtgatgcctccatgccccgagggccctttttcagttttgggaggatgactccagtccctgcacgccctggcacacccttcagggttgctacccagggggccaagttccagcccgtgccagacccaggtgccccagtgcctttgtttatattttgttcccagcctgccaggcccaggaggaaataaacatgccccagttgttgtttttta

SEQ ID NO: 658741 - DNA, 220 bp, Homo sapiens
cagattcggcttcataggtatgaaggcagtgttcattccatgagcagtgggtatgagtgtccattctagacattataatataaaaaaaaatctttgacagacctactaggacaagaaatggtatactatattttttcttgctggatttctataggttagtcaagaataggcttttaatacaatctttacgtgataatggatattgcgttactttattggg

SEQ ID NO: 658742 - DNA, 321 bp, Homo sapiens
agcttcttttttttcttttaaatataaggattttttttaggctgggtgtggtggctcacatctgtaatcctagcactccctcaggctgaggtttttggattgcttgagcccaggaatttttttttttcctgggcaacatggcaaaaacccatctctacgaaaaatagaaaattacccaggtgtggtggcaggcgcctgaagaacaagctacttgggaggctgaggtaggaggatcacccgagcctgggaggtcaaggctgtggcgagctgtgatcgtgccacttgactccagcctgagtgacaagagggatccttgttcaa

SEQ ID NO: 658743 - DNA, 681 bp, Homo sapiens
  misc_feature (600)..(600): n is a, c, g, or t
  misc_feature (681)..(681): n is a, c, g, or t
tcaaggctgtggtttcctcatctatgaaatgtgggaattgggccaggtgatttcaaagtcctttgcatcttctaatttttaatgagtttaaggttttgtatgaaatctctgattatagcccagccgtcttgttatgagaagtcggactctccccactttctctctttcctggcttagtctcattccagtccagctgtatgaaatgagcaatgcagttgtctatgaattcttttcttttaaaaaaattatgtgacatttgacatatatagaagatacatatgtaacttgaaagtgatgaagcagaatgatagcaaatactttgataggtgtattttatgcttccttttccaaaggtagtaacacctaacatttagtgactgttaacagtgttacaggaactgctgtttatgtgtattgactcatttacacgtagtagctcattcatacaactacctcatgaaataagcactaatattatccccattttacatatgagaagactgaggccaagagagtaagcaacttgacttaaattagctgtaagagggcagagctgcgatcatgctcctgttctctctgctgcgcgcacactttactganaacacacaggccgtggattacagtgccctgtgtgtactcttagttgccaggccccttattttaccattgggatctgggtcn

SEQ ID NO: 658744 - DNA, 336 bp, Homo sapiens
agcactgttgcaggaaatgttttgaacaccaggagctctgttctaggcgaggggcgcgggatgagagttgtgttgagcctgtgtggctcatacacagggatattttatgaacatatagggatactatgagcggtgaggggtggacagtgttcgagtgagacactgatccacggagttcgcgaacagtgggtactcttggtgaccgggacactggtggctgttaacccagaggatggtcgtaacatgtgctaagctgacactgtcggtcctacatattgcactgtgaaggcaagtgggtagtgcgcacaactggtgcgtttagagatctctgagctt

SEQ ID NO: 658745 - DNA, 1094 bp, Homo sapiens
taaggggtcaataatagtctttatataattcagtggtccggctcagaaggcagggaaggaggtggaagcggcaggggagggcgtggcgggaggcccggcaggggggctcaggggcaaggtggcaggagggcggagtggggggcaggcggggggcaccggggcagggcgcgcgtgaccgtggtccgggggcccgggatggggggcagaaagtgagccgtgcccacgcgtgtcccgccagggtaggcgccaggcatcctcgaaacaggcgccagggcaggccttcgggctccgactcggggacaaggcgggtgcagggcaaatgggtatgcagggtccggcccggggggcccgggaaagcctggcccgtagggaccagagcccaaggacggggctcaacattcagtcacagggggggtatgacgacggccagacaacgggggagggcatggagggacaagggggtccccacttccagggacgcccaatagcagagccatttaacacgcggggagagggtgccggatgagagggagtccatccatcacggcccgggatccaaaatcagggggctgggggccagccgagacgggtgaaatgccgcaacgaggacagggacaggggcggaaaaaagggcaccgagggggggggccaccggccatggcaaggaaggcgaccttggggagggggtccaaagggggaaggaggtgggactctcccaaatcacatcaccactatacccgggatggtgggcccagcggaggaaccttgacgcagcctgacacccgggggacccacagaggagcccttgaaacacgagggaagggcgtatataggggggcgcctgccccataaaaacaaggggataacaactagccgacgcctgagccgccatataggtgagtacaagaagatgggtagaggttgcagaagtggcgaaagcgcagcaccgggacgacaacaaaacaccgcgaggacaacgagagacacgcagtgcgcagaagctctggacgccgagaggagcggtcgcaaacgacgcatgtaagcgaaaaggaggacggggagtatacgagaacctagaaagaacgatagtgaaa

SEQ ID NO: 658746 - DNA, 224 bp, Homo sapiens
caagcaggtacagtgtatcactcccttcttcctacatgggaccatcttatactactacttcttgtaatattactggagaaaggcagaactaaaaaagtgtgtcattttcatataaaaataattgcttagctatatagcctacactttctgtataactaagccaatacaatactgtctatagtgttagaaggaaaatgtgattataatatttaaccagtcattga

SEQ ID NO: 658747 - DNA, 644 bp, Homo sapiens
ctgtatgctgatctagagatatcccgactgtctcgctggctatcccatctacgggtatataccctaaggattagaactcatgctgctataaagacacatgcacacatatatttattgtggcactattcaccatagcaaagacattggaaacaacccaaatgtccatcaatgatagactggattcagaaaatgtggcacatatacagcatggaatactatgcagccatgaaaaatgatgagttcatgtcctttatagggacatggatcaagttggaaaccatcattctcagcaaactatcacaaggaaaaaaaaccaaacaccacatgtactcactcataggtgggaattgaacaatgagaacacttggacacagggtggggaacatcacacactgggtccttttgtggggtggaggtatgggggagggatagcattaggagatatacctaatgtaaatgacgagttaatgggtgcagcacaccaacatggcacatgtatacacatgtaacaaacgtgcacgttgtgcacatgtaccccagaacttaaagtgtaatacaaaatatatatcttaaaaaaataacaaaaagtgctaattgtaaagacaacaaaaaagattcgattcagtgaacctcatgtaaactaa

SEQ ID NO: 658748 - DNA, 115 bp, Homo sapiens
attgcggcctatgcgacgagtcagtatgaacaatagaaaatcttaagaagccgtaagctaaaaacatcaaatgattatagcgcaccaactgctcgactggaagcagcgaaattac

SEQ ID NO: 658749 - DNA, 202 bp, Homo sapiens
atattatacagactgaaaatgtcctggacagcagagagatgtatacctatattttcagacttgataaaaaatggacttaaccctaaagattttccattttccttccttctgtcttcttctctgtgtctatcctgacacaagaattaccaagatgagacatacaaggaggaaagtaacataaggatagtcttaatagggcaat

SEQ ID NO: 658750 - DNA, 185 bp, Homo sapiens
agactctagaagtatccgataaacagccaatatctacgatcaaccaacaagtcattattaccctcactgtcaacccaacataggcatgctcataagtgaaaggttaaaaaaaagtaaaatggaactcggcaaatcttaccccgcctgtttaccatataacatcacctctgtgcatcaccagtatt

SEQ ID NO: 658751 - DNA, 211 bp, Homo sapiens
tactcagcgtgttagacggcacttaatagccatgagattgcacgtgagtgtagatggagaagagcagcagtttgaagaccaagacctgagacagtccagcatttataggcttaggagtgattaagaagaaccagtagaataaagttaagaagcagtcattggggcagatagcgaatgaaggagtctaatggacgcttaataaagagagtgt

SEQ ID NO: 658752 - DNA, 249 bp, Homo sapiens
  misc_feature (247)..(247): n is a, c, g, or t
atatggctaggttggttacgaacacgactaaaagtatgtgcaaggcaaacatacttacaacggaacggcacgcctaaaaagggttaagagggcaaaaaagggactaaaaagacattaaaaaatcaatcagttaaataaacaaatccatggtcggacgggatatggtatatacaaatcatatgccacacacagaaaaacatcatggggaaacaaacatatcagaataaacatgaggtagagagccggnca

SEQ ID NO: 658753 - DNA, 143 bp, Homo sapiens
agccagttttgcaggtatcctagtcataaaaacaatataggcagagcaaagggacttaggccagccatcaaccacttctttgagcaggcagatggggaaatccaatctgccctctgccgataccaagctccaacacagggagc

SEQ ID NO: 658754 - DNA, 842 bp, Homo sapiens
aatatataccacggttcatgtacatcccacattatacatccttgtaccaaatgaggctttcatgtagtagaataagaatcgtgtaaatttctaagagattttagcaggttgttctttgcctattcattgatttctcactcagttctaaaaggattcctttaagcatgtcagagtgaccaagcaattaggacttaaaagttgtccatatgaatttccctttaacccttgaggcttcattagactcttttcacttactaaacgtgttgtatcttctttgttttgacacactcccctttgcttttatctcttacctgccagaatgttctcaaatggatttagttcaaatactgaaatacttaatgagcaattacttgatttttaatgatgacttcgaaggagtcatcactaggtgctttgtccttgtttgtattctagttgcacccacctcttggattggatatagcaataacatcttacttggccgttgtgagctcttgatcccagtcattaccccatgagaactaaaaaatagataggttcttaacttcaacattacttgagaaaatttccgcgcaaacaagtagcaaatctgacttgttccctcttcacgttgccgtggctcacttaaaggtgtaggataaactgaagcactgcagcagctacagggctttgctacttaacttctgggttggactaattacagaatcctatgtactctcatacccttctccattagtccttcatatttcctctgcctctattcttctatactgcagatttttctcaccattattgtacaaagaaattgcgatgtatatattactccagtgattttggatctt

SEQ ID NO: 658755 - DNA, 739 bp, Homo sapiens
tggaaagggagtctaactctgtcccccaggcgggagtgcagtagtgcgatctcagctacactgcaacctccgccccccgaggttcaagcaattcctccgtgccttggccctcctcaagttagcgtgggatttacaggcattctgtgccaccatgtgcccgggcaaattttgtgggtgtttttagatagagacagggttttggccagtgttggcgccaggcgtggctcctcgaacctccgtgaactcctcagggtgatcacacccgccttcagccttctccaagaggtggcgtgggaattaatataggtgtgtgtgaggcccacgcgtgtgccccgtgccgtggaactcgtagttttcactatagccagcgccaggtggaggaacactctttggggtaacatgtaaaggcccgaggggccacacaaagccgtctcaagagaggttcagagggtgttagggcccagtgaggccgggcacctatgctggcaggcaagggttcccaatccccgttgccctaaggcaactctctctcccagagcgccagtgtgggggcacctggggggaagcgctcagtctcagaaatttctgagcagaagacctcttaaacccccatcccaagcaaccccaatccggtttgtcccccagagcgtggtcttcccatgagttgtgctaaagccaaatagccggggcccccaaccaattttatcacaaaccggcttcatacccccaaaaaattcca

SEQ ID NO: 658756 - DNA, 231 bp, Homo sapiens
  misc_feature (101)..(101): n is a, c, g, or t
  misc_feature (155)..(155): n is a, c, g, or t
  misc_feature (181)..(181): n is a, c, g, or t
taggggatgaagaatttgccctactttgcccagttcctaagacagtgaggtggcaaaaccccagacaggaagctcgccaaggagcaaaaggcgcattttcnccgtgtcatgtaaaatttctaaggtgtttggcagcactctgtaccctgtggagnactcaggacctttgtttgatgggcgnacaagacctgaaaaaaaatcccttaaaaaaaaaacccattaaaggggagc

SEQ ID NO: 658757 - DNA, 137 bp, Homo sapiens
acaagaaccgaaccttccctgctcgtctcggtccctttccctatcccgatctcggtcccccctgtcccgctccctttctctttccctcttctgtctcctctaaggacaattgtcattggctcagtcttatcccggat

SEQ ID NO: 658758 - DNA, 818 bp, Homo sapiens
cactagtggtgtgtgtggacgacagtgagttatagtgctggaattggtaggacttcgttagcccgaccatggtggtgcatggcaccagtcatgcgattgcgtgtcttatcatacgatttgtcgattcaaagacccgacagcagaccctgagaacaacgtgtgccttatcacactggtctaatgactgtgaagctgctgaccacagctcagcccagacactgggccggtatccctgtcacaagctagagtactgtgcaacccaagtggcaagatcagcttctgcgacgggcgatccgcagtggcccatctggctctgaagcaccgacaaggcaagaatcacaagatgcgcatcatatgcctttgtgggaagcccagttggatggacaatgagaatggatctggtgaaactggctaaagcgcctcaagaaggatgagaagtaaatgttgacattatcaattttggggaacgaggaggtgaacacagaaaagctgacagccttatgtaaacacgttgaatgtgcaaaagatggaaccggttctcatctggtgacagtgcctccctgggcccagtatggctgatgctctcatcagttctccgattttggcgttggtagatcaggtgtgtgccaatggatgggatcttggatgcaggtgactttagaatatggagtaaatcacagtgctgattcatgagctgggctggcccatcgggaatcaatgaaggagacgggagggacgaggagatgccggggagatgagatctatgtagaagcaggatgacaaacggaggaagccgaaacctgtaatactcagcattt

SEQ ID NO: 658759 - DNA, 1097 bp, Homo sapiens
  misc_feature (438)..(438): n is a, c, g, or t
caccatcctttttcggggatcttttttcggggttacacacccctctggagagtgttgaaagtaggttcctgatgatgtccttacacacaaggggctttccccggacaattaatgtctgtgcccccccgtgagttggggaaagcccgtttaggtcttaattctcccccgggggatataaaaatggagaccccccgtttggggggagaaaacacattacgggttaatagggttcttgagccctaattggaaatagctccccaggtttggggcctttccccttaaggaggttttttaattctgttggtggagcgccacccccagcaaaagaggtgtgtaccccggtatggggaaaatataagccgtatggaacacacccccggggccacatagtgttcgaccccccttccccgtcttaccccacgtaatttctacttccgncatatatctccccacccgcggcggttccaaccagggtatatttaagccgtgagactcggcccaccacacttccaccggagaggcccacatattgaaaactcgaattctcgctgcacacggtgggcttctgaggccccctatgggaattccaatgctcttgcgtgtttgttcaccccgctaaggtggccccgtgaactggggcactgtggtaattatgccacaactctcactacactctatgaccactcgctattctaccaccgacacaccggtattctaccgcgttgataggctcaaccgttccacctaatgtttcctcattcacaaatggaagcctgtatatttgcacactccaataaggagggcttacacattcacctagaatttccccctcaatttctcacggctacacacccctatgagccacaaacctataccccacaaaatccacatttcacctatcatattcatcggcgtaaatttaactttcttcccacaacacacttttctcggcctatccggaatgccccacactataatactacccgtatggcccacccactaattaacccccataactccttacactattcctcatcaccccaactaaaaatattaaaccaccaactaccccctacctccctcacccaagcccccta

SEQ ID NO: 658760 - DNA, 192 bp, Homo sapiens
gcactctaaggatctgctgatcgcttaggaaaagaaaaaaatcacaggctagtacgatatcagatcactcttgtagtccagctactggaggctgaggtgggagtattgcttgacgcccagagtcatgatgagctggacacatagcagacctatctcttaaaaaaacaaaaataaaattaatttaaaaaaata

SEQ ID NO: 658761 - DNA, 382 bp, Homo sapiens
tcaattatctccctccctcttcagaggcaaccacattaccagctatttacctttcccatgatagtcactgcctatacaagcatgccaagtatctctctgtgtttttaatacacactgtggtgtattatacacactgtcctgtaccttccttcttacttaccaatgtcatttcagtgcttctagatgtactgcattcttttttaacaggcattatattcactgtatggctacgatgaacatttagcttgtttctagtcatatgctaatataaacaatactgcaatgaaaattcttatacctaagtctttgtatcaagccagtatatctctacaggataaagtcctaaaaatggaattgctggctcaaggggtatgtgaattta

SEQ ID NO: 658762 - DNA, 318 bp, Homo sapiens
tggcatatgtgaatgatggtgatagtagtggtagcttacccttcttttcttctatatgtgtgtcccactaggtaaaattaaaagttatggtactatgttagcccccataattttttttttctttttaaacaacttccctaattctggactcctctgtccaggcactgctggccagcctccaagctccatctccactccagattttttacagctgcctgcagtactttacctcctatcagaagtttctccgctcccaaggctctgagcaaatgtggctcctgggggttctttcttcctctgctgaaggaataaattgct

SEQ ID NO: 658763 - DNA, 407 bp, Homo sapiens
ccatgcccaatgtttgcctgttccataacactaactcccttcccccttgctaatcagaagccatctcctctcagtggctgatctctgctcttcatacatgattacagtcatggggtagagagcgcttgctaaattatgcagttaatcctatggagctttaattttcaggccttcaaaacacacttgtacagtgatgtgcagatttttaaacacatgaacttccttggactacagcatttgtattgacagccaaattcgcctttcattcttcaaattgcgaatacagtgatttttacagggctctcagccaagttttgcctttcatgtaaggcttgtaaaaccctagcaaatatatctgcttacatgaaagacgcaaattctgttttcaccctgacttttttaacaaa

SEQ ID NO: 658764 - DNA, 279 bp, Homo sapiens
ctgtaatctcagcacttttggaggccagggcgggaaggattgcttgaggacaggagttcgagaccagtgtgagcaaaatgtggagaccttgtctctgcagaaaataagatagttgtgggtgtggtggtaccagatgtggtggtacacacctgtgtagttccagctacccgacaggctgaggcgggaagagctcttgagcccaggagttcaaggctgcagtgagctatgattgcgccactgcactttagcctgggtaacagagcaagtccttgcctccca

SEQ ID NO: 658765 - DNA, 290 bp, Homo sapiens
tggagaaggaccacactggataggagtgtatgggatggtgtgggggaaaggaaaacaattgacataatgtacaaggcacattcaataacaacacaagactcaaccaaaatagaatacaagaaacataataataccccaccaatcgttttcacaatgtactacaatgggatagttataatgatcatattgtgaacacatgaatactgatctggttgaaattgctctttatttctgggaggattggggtgggcagtgtggtgtgtgtggtaaggtaggattggtacctcaga

SEQ ID NO: 658766 - DNA, 180 bp, Homo sapiens
  misc_feature (10)..(10): n is a, c, g, or t
  misc_feature (55)..(55): n is a, c, g, or t
  misc_feature (116)..(116): n is a, c, g, or t
  misc_feature (118)..(118): n is a, c, g, or t
  misc_feature (144)..(144): n is a, c, g, or t
ggcctgccanactcaagagctacctgaggcagaagctccaggccctgggctgcgnctgggggcctgaagggggctgaggggatgatgtggggttcaggatggcccccccatggtgngnattgatttgcactttggttccctgtnttttgatttctcattaaagttcctttccttccccgt

SEQ ID NO: 658767 - DNA, 398 bp, Homo sapiens
agagatctcccacctcagcctcccacagtgctgggattacaggcgtgagccgccacacccagcctattcaaaatttttttttcttagagacagggtctttgttgcccaggctggagtgcagtggtgtgatctcggctcactgcaagctccacctcccggcttcacgccattctcctgcctcagcctcccgagtagctgggactacaggtgcccgccaccacacccggctaattttttgtatttttagtagagacggggtttcaccgtgttagccaggatggtcttgatctcctgacctcatgatccgcctgctttggcctcccaaagtgctgggattacaggcgtgagtcaccgcgcccggctcattttaaaatttttgtagatcagtgtactgttgt

SEQ ID NO: 658768 - DNA, 899 bp, Homo sapiens
  misc_feature (11)..(11): n is a, c, g, or t
  misc_feature (822)..(822): n is a, c, g, or t
  misc_feature (887)..(887): n is a, c, g, or t
gaacagagacntccgcaccgtaaaggggaagaaaaacacccctcctgttttgtttttctgcaaaaggtggagcttgtggaattcattcccacagacgacagatgagaagtggatcacagtgcccataacaaaactggtaacgaagtcaaaggacccgagtgaatgtgacatgtgaaataaaagcagattcgatgcttccttgtcctactctcacatctgcattcctctatcaacaatggactgatctcattcatattgaaaactaagaagatgatactgtaaatcacatgctccctgacttagttctgtttagaacgccaacatctatagggaacatgggccagagagcatctctgaatctttcatttccaaaatactgtttttcaaatggctgcttaaaattgcctgcaaatgaatatgctatatgatttgggcaaaaacacagcagaatcaatgagtaaatttctaccaagagtcgggtttgccacagagatgtgaatattaaactaaactattattttttaaagaatcctcacatgcctagagcattctgacctcttcttgtttagagtgataacattttttcccagacagatgacagcaacaagatagctctacttttttatatggaaataacattatgttactgacaaggtcattttctaccagagacaattagaggactggtacttttcctaagttgtgtattactgagtcttggagtcatctctgagagcaaatgtatgttcctgaaaagctaattttacacctcatttactgtaggtaacaggaacaacctcaatttttccaaatttttgaagntttatttatgggggctagaattcccctgcataggagatttgtgtaggggggccagaattctttcnctggaaatgcta

SEQ ID NO: 658769 - DNA, 284 bp, Homo sapiens
  misc_feature (15)..(15): n is a, c, g, or t
  misc_feature (44)..(44): n is a, c, g, or t
  misc_feature (114)..(114): n is a, c, g, or t
tagaggatcccccgnatggcgtacatgtgacttggcagaatttnaaaagtagcaggagcagaagatgaaaggcatcttgaagcctaggcttggaactgacacagtgtcactttnatcacagtctcttggtcagagcaaatgacacagccagccagattcaggtggaaagagccaccaaagtggacctgagaccacccaactctgaactttttgctaagtaatgaaagggatcctgaagtttaggccactgtcagtcagttttctgttacttacgcgatgacggg

SEQ ID NO: 658770 - DNA, 139 bp, Homo sapiens
  misc_feature (130)..(130): n is a, c, g, or t
gtggggactacaggcgcgcacccaaaatgcccagctaattttcgtatttttagtagagacagggtttcaccagtgttggccatggatggtctcaagtcacttgatcttggtgaccatgccctgtctcggntctcccaaa

SEQ ID NO: 658771 - DNA, 404 bp, Homo sapiens
  misc_feature (52)..(52): n is a, c, g, or t
  misc_feature (71)..(72): n is a, c, g, or t
  misc_feature (82)..(82): n is a, c, g, or t
  misc_feature (91)..(91): n is a, c, g, or t
  misc_feature (93)..(93): n is a, c, g, or t
  misc_feature (95)..(95): n is a, c, g, or t
  misc_feature (99)..(99): n is a, c, g, or t
  misc_feature (108)..(108): n is a, c, g, or t
  misc_feature (120)..(120): n is a, c, g, or t
  misc_feature (134)..(134): n is a, c, g, or t
  misc_feature (136)..(136): n is a, c, g, or t
  misc_feature (139)..(139): n is a, c, g, or t
  misc_feature (144)..(144): n is a, c, g, or t
  misc_feature (149)..(149): n is a, c, g, or t
  misc_feature (152)..(152): n is a, c, g, or t
  misc_feature (160)..(160): n is a, c, g, or t
  misc_feature (167)..(167): n is a, c, g, or t
  misc_feature (172)..(172): n is a, c, g, or t
  misc_feature (191)..(191): n is a, c, g, or t
  misc_feature (194)..(194): n is a, c, g, or t
  misc_feature (196)..(196): n is a, c, g, or t
  misc_feature (227)..(227): n is a, c, g, or t
  misc_feature (231)..(231): n is a, c, g, or t
  misc_feature (233)..(233): n is a, c, g, or t
  misc_feature (255)..(255): n is a, c, g, or t
  misc_feature (259)..(259): n is a, c, g, or t
  misc_feature (261)..(261): n is a, c, g, or t
  misc_feature (275)..(275): n is a, c, g, or t
  misc_feature (291)..(291): n is a, c, g, or t
  misc_feature (293)..(293): n is a, c, g, or t
  misc_feature (306)..(306): n is a, c, g, or t
  misc_feature (324)..(324): n is a, c, g, or t
  misc_feature (331)..(331): n is a, c, g, or t
  misc_feature (333)..(333): n is a, c, g, or t
  misc_feature (352)..(352): n is a, c, g, or t
aacagcaaaaaaaggaaaccgggccccacggccgggaccccccaaccccganaaacccccaaaacaaaacnnccgggccccnccacccccnananaaancccaaaacncccacccccganacgaaaaaaccccncncanaacanaggcngcnggccacanaaacccnccaanccacaaacccgccccccanaancncggcccaacccaagccacgaaggacaccaanccanangaacaaaagggggaacccaaanaaangnacaggggaaaaaanaaaaaccaaggggaananaaaaccccaaaanaagggcaaaaacagcaanaaggccnanaaaccaggcccgaaaacanaaacaagccccaaggacaaaaccctttcgaaggctaacccagtttcgtgagg

SEQ ID NO: 658772 - DNA, 194 bp, Homo sapiens
cctacccccaccgccaccaaaagtcatccattgtgtagaaccactcttcagcatgcttatcacaatttttacaacttctcttccacggggtggtggtggtgcacgcctttaatcccagcacttgggaggcagaggcaggtggatttctgagttcgagaccaacctggtctacaaagtcagttccaggtcgacgc

SEQ ID NO: 658773 - DNA, 181 bp, Homo sapiens
tacacaggtaagaatttgtatcttgagaccaagtcttaaaatgactgcatggtggaaataaggccactttcgtctcttgaaccagagataatatgtgtcagtccattggacaaagcatagtactaattctaagtacagataatgagtaatcagaaagttagtggtgtggaaggttaacatc

SEQ ID NO: 658774 - DNA, 201 bp, Homo sapiens
gtccattggacggggccgtggtggacgaggtgcccctactatggcgtcaatggcccctatccggcggctggggctgggcctgtgctcttctggctgtttctgtcatcactatgcttctccttatgccttccccaaggcctgttaggcatctgagccgttcaggcctgatctagagtgggatcctactcagagtcagacctt

SEQ ID NO: 658775 - DNA, 133 bp, Homo sapiens
gggaacatgcccgacgtgcccagccacccccaggaacctcaggggcccagcctggagtggatgaagaaactgagagcacctccactgatagaggcggcccctcccacggttcccaataaaaatgtgaaaacca

SEQ ID NO: 658776 - DNA, 431 bp, Homo sapiens
gggcgtgtcagtcatgttacatgagacaatggcgttagatagggcaacaattgtcgctgttctgtgaaccacgactgcagtgactcagagttggtcttacctaggtatacacttggcacacgttacaccgaagtagggtcagcaagtttctccatggctcaatgtgattgacatgcgaggacggatgtcaggtgtctcatggagcttaggattgctatgccctaaaccctttgccctaggatccatgagttcatgacgcagcccattaaaggtcactcatgctcggggattcaagtgcacatcttgtacagtcatcccagtgataagtctgttaagaaagtggtcgtgattccagatcatgctgcattctgtaggtatcaaggcagtgagccacgacttgccacgcagtgtgcaccagtaacggcttgtgc

SEQ ID NO: 658777 - DNA, 242 bp, Homo sapiens
  misc_feature (29)..(29): n is a, c, g, or t
  misc_feature (71)..(71): n is a, c, g, or t
  misc_feature (91)..(91): n is a, c, g, or t
  misc_feature (96)..(96): n is a, c, g, or t
  misc_feature (110)..(110): n is a, c, g, or t
  misc_feature (140)..(140): n is a, c, g, or t
  misc_feature (144)..(144): n is a, c, g, or t
  misc_feature (155)..(156): n is a, c, g, or t
  misc_feature (175)..(176): n is a, c, g, or t
  misc_feature (201)..(201): n is a, c, g, or t
  misc_feature (203)..(204): n is a, c, g, or t
  misc_feature (223)..(223): n is a, c, g, or t
  misc_feature (232)..(232): n is a, c, g, or t
  misc_feature (236)..(236): n is a, c, g, or t
cggaaactggcagaggcggaggagacacntaagcgacctcagagccagaagggaggtcagggaatcaacgncgtgaacacagaaggcaatnccatnaagagcaccattgncaaccccaccaccacccagtattccagccntaancacagccttanncctaaggcacggagcaccnngtcggtacaatgacccccagaacgngnntacccttctttgaaattgngctcaaganaaantaaaat

SEQ ID NO: 658778 - DNA, 131 bp, Homo sapiens
gcatcatcacgagaacatggcctttggtttttaagtcatgaaagcctttatgaaaaccttcagctagctaggctgattaagggtggactagtcttctcactgtttaacgtcccctagccagacgaagtata

SEQ ID NO: 658779 - DNA, 310 bp, Homo sapiens
  misc_feature (190)..(190): n is a, c, g, or t
  misc_feature (202)..(202): n is a, c, g, or t
gcaaggtcgacaactagtgggatccaaaagaatgcgggacacgagggaagagggtaaagtaaaacgcctcgatgctcaaaactagcaggcggtggtggcctgatctcggcgtaccaggaaaggattttgtgaggaaattgtgctttagtcaaaagaagttgttcgtgaggcagaggatggggtgatgggngtctcgctgcanaggggcaacaccctgtgaatgttctgtgggaggtgcttaaaactcatgaattctaatcagcttctaagatatctcccacctaatctttatcattacatttaagaactg

SEQ ID NO: 658780 - DNA, 438 bp, Homo sapiens
  misc_feature (1)..(1): n is a, c, g, or t
  misc_feature (84)..(84): n is a, c, g, or t
ngctgaagtcttgctttcagacagggcttcagcctagccttgcgtagttctcagctatggtcttctgaacacagtcgtggatgnaagtcaccttcacatacacaccatactcagcctcagcacagctcttatcagtgcttaagatagcagtcgcataccaggtgtcctcattcaggtcgtgttcgtcataggcactgccagcatcgccatagcaggtgtcttcttggtacttagacatgccagcacagaaggtgtgttcattcagtatggactgcacccctacagggctcttcggtgtcttcgtatcggggactgtgctgccttcataatgccttatgcattggtcttggtcagccacagtcagcatggcacacttcatatggtcagtaaatttagaattggcatttcgcccacagccagaaacataacccacacgcc

SEQ ID NO: 658781 - DNA, 304 bp, Homo sapiens
gctcgacctttgggagtccaaggagggggatcgggtgagtccaggagtttgagaccagcctggacaacatggtgaaacccgtctctacaaaaaatacaaaaattagccatgcatggtggctcatgcctgtagtcccagctacttgggaggctgaggcaggaggatcacttaagcccagaaggcagaggttgtagtgagctgagatcgcaccactgcactccagcctgggcaacatagcaaactcctgtctcaaaaaaaaagttaaaaaatattgcccggctcctagaatttatttatttcctga

SEQ ID NO: 658782 - DNA, 236 bp, Homo sapiens
ttcatcacagtcacacggcagcatggtgtccttgctcgaaagatgagtgacatggactaaagtgtcatctgacaggatgcctgcattggctaacagcaaatactttctctccttcagccatctcaggtccgaggctgatgacctgttcttccttctattccttcccctttcgaggttgccatttctgccctttcgtctgcagactccatagcgaacagcaggagagtaggagcgtc

SEQ ID NO: 658783 - DNA, 435 bp, Homo sapiens
caaactttggttatttcgacttaagaggttatcaagaattaggcttaaaaatataaaataaagagggccaggcgcctgtaatcccagctcttgggaaggccgaggtgggtggatcacttgaggtcaggagttggagaccagccgggccaacatggtgaaaccccggttctctactaattaagtacaaaaattagctggggtgtggtggtgtggatgccggctaatcccagtctactcaggtggaggctgaggcaggagaaatcgcgttgaacccggggaggcagacggttgcaggtgagccagggatcataccacttgaactccagcctggggtgacagagtgagactctgtctccaaaaaaaaagaaccgagccgagtaaaaaaacctgattgcgataaatagtcctcttggtagtgttagcaaaagtgtggcc

SEQ ID NO: 658784 - DNA, 159 bp, Homo sapiens
tcaagcttctaacgatgtacggggacatggtaaaaccccatctctacaaaattaggaggttgaggtgggaggatgatttgagtctaggaggcggaggttgcattgagccaggatcacaccaatgcagtccagcctgggcgataaatcttgtctcaaaaa

SEQ ID NO: 658785 - DNA, 227 bp, Homo sapiens
cgagtaggtactctccttcgtagacatcttcatgtaactttctagtcattgcatttgttagtacttacccgttgcatcataagaacaaattggaaacgaaaggctgcagtaactggatcaggtacagaaattattgctactatacttcactacaaagcctgtctatacagtatcatatgacctttgattatgaaaaaatcagaataaaaatctttagtgacataagc

SEQ ID NO: 658786 - DNA, 381 bp, Homo sapiens
ggcctctgtgcctattagtcacctatgagactgcatcaccgcacctatccattcctacctcactcatgcagcgcgtctgtcgtgactagcaaggagtctgggaaacctgcgccgtgaatcatctgcatgccggtaatcaggcatcatctgtcatcactgcgctcaggaacagcagggtgactcgccgaagagaggaaactcatagattacgacatcttacatacctgaatgcgggaacctcgggagaaccaagtacagcttacagtgtctactctcattctgtgtcatatctttatctcatttatggtatttacgcctaggacaaggatgaaagcaaacaaaagcaggcctgagtaaccctggcctgtctcctctggactg

SEQ ID NO: 658787 - DNA, 127 bp, Homo sapiens
gccttcagctgctttcttgcgagcactgctccacggtcggctgtcttggcggcggcgtcgctgtcggcggtgctgtcgtcactcttctcctgcccttcctgccatgcggccgcacgtactcttccag

SEQ ID NO: 658788 - DNA, 905 bp, Homo sapiens
ccgctcggttccatggcaccccgcagccctgcccagtgtgccatggcctgcatatgtaccgccctggcctgcggcttaactggcatggtctgagccccttgggctggcatcatgcccgtagcatccagaccctgcgagtgcttatgtggagatcttgtggccagcttcccactggcattcgcgattttagtagatgcacagtgcccgcctgtgccaaccagaggtgcatccacatctagtgatggaactgattgctgagaatacttgccacactgaccctgctggagcagcagggcctcatcctgaaagctccccaagtacaataacttgctggctggccctgcacagaccccaaggatgtggcactgagtaagagagcaatgacggtgatttgtaacatccttctcagcggtgacacagggtaccactcccgcctggtgggggcccgtgggcagctgggcaactgtatgtccccaagactgatttccagcggagctgtggatgagaggttatccaggctgccatgccagggccgcacatgtatgtgcttccatttcaggcatgggtcgtgttggtgctccccgctgtcccgcaattcggtgggtgcatgctcactgcactcagcctattgtggttggcaaagcatgctgtattattgaccccgagctggggacacctgtgcttcaggccctgtgagattggttaactattgtccagtgttatgcactcgagtgccccgtcccttaccgtgacatgtgttgcctgttgagcctgttggctttcatccatagaaaacctgattggacactcttcctacagtggagacaacatctcggacgggtaggtgcactctgtggaagagtattgccagcatctttcgatgcggatgtgtttagcaaaaattt

SEQ ID NO: 658789 - DNA, 582 bp, Homo sapiens
aagttttgtaaggtacataaaatccaatttatatgtaaacaagcaataatttaagttgagaacttatgtgttttaattgtataatttttgtgaggtatacatattggggaattgactcaaaaatgaggtacttcagtattaaattagatatcttcatagcaatgtctcctaaaggtgttttgtaaaggatatcaatgccttgattagacctaatttgtagacttaagactttttattttctaaaccttgtgattctgcttataagtcatttatctaatctatatgatatgcagccgctgtaggaaccaattcttgattttaatattgttaatattctttctttaaagaacctttagaaagactacatgttactaagcaggccaaattttatggttgttttgtcttgcccactctgggagggggaaaaaatcttttaattaataggtggtaagttttaaaacaaacttcaaatacccaaaaaaacggatggaccctttttttgagcctattttcttacttaaaccccctaaataccctttcctttaccctaaaatttccagaaaggaaattctttttttggat

SEQ ID NO: 658790 - DNA, 883 bp, Homo sapiens
gagaggacgaggagaaatggaaaaggaggaggagagaagaaggaggggaaaataagaaaaaggggcaggcaggcagaggcagcaaggtgccaggcaggaaacacaggcagtcaaacagtggaggagcaggcagcaagcacaggcagtcaggaggcagcagctagcagcaaaggtgacggagcacgcacaaagcaggcaatgctagaattactgaacaaagcagcaaggcacagcaacaaaaggcagtggacgcacagcgaggagcaggctagcaactaaggcagctaccacagcgcaaggagcgcagcacagccagcaagcgccacgcagcgcagcaagccgcagcgcaacacaagcagggcgcagcgacagaaggcagggcaccagcgaggcagcgcagcacaattcgggccacaaggcgcagcgaagggaggaggcacaggcacaacgggcagggggggcaccacacactcacacgcaaacacaaagggcgggcacgggcacgcggcaggcacgcggcacgcaacaggggttgcccacgcgcaaggggcaacacaaacacacgcgccagttcacacacaaggttggggccacgcggaaggcaagcgccacccacacccacaggggcaggctaagcggcaaggggcaagcacgcgacgccaaggcacaccacggggtctgcacggggcacgtaaacggaacacccacacgcaaggagcacctttgttcaggacactttgaccttaaacacaagcaagcaagcacaacgggacggacaccacaccggggaagtttggggacgcaacaggggaagggaacgaacgttcacggaaacttacaggggaggttacgcaacgggcaccgcagggaacgaccggcacac

SEQ ID NO: 658791 - DNA, 376 bp, Homo sapiens
cacaacagaccaactattatagtcatgcatcgcttactgacggggatgcattctgagaagtgcattgttgggcggcttcattattgtgtgaatatcacggggtgtacttgcacaggcctggatggtgtaccctatcccacgcctgggttgcaaacctgtacagcacgttactatgctgagtatcttaagacaactgtaacgcaatgttcagtgtttgtatatctaaacatacatagaaaaggtagagtaaaaatacagtattgcaatattatgggaccattgtcatatatgcagcctgtctttgaccaaaacatcattatgcggcacatgattgcatatgatcacattcttgtgaaatgtccagaaaaggttaaaa

SEQ ID NO: 658792 - DNA, 148 bp, Homo sapiens
gccggatgcctggccctgctttagcttacggcgctgccgcgcaaaggggagctgcctgcctatcaggggcgtgcctgcgctggagctccatggagcccaggcgtggcgtgtgcaggcacagcagcaccgcaggttaccgagctcgcaa

SEQ ID NO: 658793 - DNA, 151 bp, Homo sapiens
cactgttctgagtcgctggacactacaggcctggcccaccaggatgtggctcatttttaaaaaatttcttgtagagacaggctcttgctacattgcccaggcttgagtgccgtggtgcattcacagctcaccgcaggctcacactcttggc

SEQ ID NO: 658794 - DNA, 87 bp, Homo sapiens
  misc_feature (21)..(21): n is a, c, g, or t
gggcagggcccccccccaaanttaaccgaatggaaacaacttaactgaggcctgactttttcaataaaacattgggtagttttggga

SEQ ID NO: 658795 - DNA, 219 bp, Homo sapiens
  misc_feature (88)..(88): n is a, c, g, or t
  misc_feature (101)..(101): n is a, c, g, or t
  misc_feature (113)..(113): n is a, c, g, or t
  misc_feature (166)..(166): n is a, c, g, or t
tctagatacaggtactttatttacaaatattgagattaatagcattttgttacatcaaaggaggggtacagcagtctgaataaatccntcagtcacaaaancaataaaacccnctggaactaactttgggtgtcagggtatttcacctcaacaagccgcagtcttnagtttgggatttctacctgatttcccaaatggggggtcttgttagttttgtgt

SEQ ID NO: 658796 - DNA, 406 bp, Homo sapiens
ttttttttgggggggggggcctttttttggggggcggggcttggtttcgggaaaagaccctccccccaaaaatttcagtttttttccaggggggagaacccggttttttggtcaagggggaattgcccctcaaaaaaattgcccctttttttgccccggggggccccccagggcccaaaaaaagtggggttttttagggcccttcccctttaaaaaattagggggaagacccccccccccttttccgtttttcccccaaaaaaatgaatttttaaacctttaaaagcccccccactaaatgccaaaaaggggttgggggaatccaaagttaatttaaagccaaaattttttccccccggtttttaaaaattggggggggccaaaaccggaaaaaatttttttttta

SEQ ID NO: 658797 - DNA, 183 bp, Homo sapiens
tctaggggatcccccgatgtacttaaaacgggggcttcttcctgcgcatccaccccgacggccgagtagcacggggtccgggggaagagcgaccctcacatcaagctacaacttcaagcagacaagagagaggagttgtgtctatcaaaggagtgtgtgctacccgtaacctggctataaagg

SEQ ID NO: 658798 - DNA, 996 bp, Homo sapiens
ggactcaagcgtgccgtgacgtgcactgtgtggtgaagctacgttgggtcccgggacgcgctgtcggcgtgctgggcggtgggctgccgcaacttgcaatagactaaagcagattgcagagataccaatggacgaatttgttgagctataccgttaattgatgaatcgaaagcgcaagatgtgggtcccagaagggagatttggtagggaggtagatgaagtataatgctgttgtggagacatgacaaggatacgcgcgcaagtggtcgggcctgagattcaatgcaaaggtattacttggaagaatcgttctcgaaggaactagtatgttgatgcatgtaaggagagtctcgatgcgtttgcacggcctgggtgaaatagatggtgtcaagggaagttagatgaacgaattggtcgggtgatggggtagagagtgttgggtgaggactgggtcgaagtggcattggcttcagggtgagaccatagtgatgaagaatcctaggcacgaggagaagctatcagtggagaattttgcttacatggttggggggagcatatttcgttgggagaagattctgttgaagatgtgcaggaggagggagatcggtgtatgtgcgttaaagcgtgaggaatgggtagattgagtgagctgtgttgagaaagtggtgtctatgaagtggataggcgggtgagtcacattgtctgttacatggattttccttctgtcaatgggatagaggatcatgtgaatggaaatctagttcttcaggggactttcatcattatttgggggaaggttggaagttgtgttttcccgtggagtggtacatggcgacatgtggttaaaggttcttccagcatagaataaataaagaaggtgggggggggcagagaattacaaagtgggggggggcagagaagagaagatgtgtaaaagaagaaggggacaaaaaggggggggaaaaagatgtgtgttagagaacaccggaggagaga

SEQ ID NO: 658799 - DNA, 100 bp, Homo sapiens
tagaggatccccaacgctggtcttagctagtcagactgatcctccagatgacagacaagtcccccaaatgagtacacatctccagctattcagacagatg

SEQ ID NO: 658800 - DNA, 163 bp, Homo sapiens
  misc_feature (21)..(22): n is a, c, g, or t
aggagttcataagtatatttnntgaattggtggtttaggaagtcaactttagttttgctttgtttgcatgtccactaattttttattttgatattagtctttttaaaaaaattttacagtagtcattgaaagttatgtttcttgttacctcaattttccccta

SEQ ID NO: 658801 - DNA, 198 bp, Homo sapiens
ctagcacttgggaggcgagggggggcagaatcactatgaccacagggggtttgatgaccagcctggggaacacgggggagcgccaactccacaaaatatacaaaaaatagccaggcgtggtagcggtgtgctataatcccagctacctgaggggctgaggcaggaggattgctatgaggctgggaggtcaaggctgca

SEQ ID NO: 658802 - DNA, 706 bp, Homo sapiens
  misc_feature (529)..(529): n is a, c, g, or t
actggtctttgcctagacgtcgtattacgacttgactactcgactcatgcactcattggatcgccatctagtctatccgctaaatgaatacgtcctatgggggtagatatatagcgcacaggaatgattacaaggtcgataggaccttcatagcgataccaacatgagcgactatgatccggaagcattcaacgaccgttattctgaggtttactatcatgctttgagagagaaatgaaccacagcagcgggacaactcgaacaagctaaggcagaaacagacccagttgtgagagatgtttgacgatccagtcactacaaggctaatgctgacaatcagtgatggaagcatgctctgtgactacctggagtacaagcgtggctttagcatagaagatctcgctacactttacagctatgctgagtttcagtacgaaagtatgcttaactctagagcagaacagtatcttcatcattttagagcgctcgatcactgcgcagcatagattgctataagttgactctggcngaacgtgtactccgaaagagtatgcagaactgagatcgatacatcgaagacctctcacgacctatagagtccgtcgatataccgtcatgtgagtcatacacttgagactgcttcgcagtaaacatgagtcactcacctgacgactgtaaggtaacgtgaatcccacgaggggtcacg

SEQ ID NO: 658803 - DNA, 453 bp, Homo sapiens
  misc_feature (298)..(298): n is a, c, g, or t
ggagacgggggtctcacgggggacagggaagcccaggtttctaatccctcggcagtatcacggcaactaggacaagcccccaaggaaagcatgagatcagagacactcgggaggaaaggcatacacagaaaaggaagaacaaaggtcagtaacatctactggcattctttaatgggacagtattctggggtgactgcattctcacgcaagtctcttcaattggaaaacttacataatttggttagtggttaaaagtcaaaattgagctgggacatggtgggcatgcgtctggcaatcnccagccacttgggagaggctggaggcacggagaaatggcctggaacctaaggaggtggaaggctggcagtggagtcaaggatcggggccactggaactcccagcctggggctaacaggagcaaggattccattctcgaaaaagaacaagaaaatt

SEQ ID NO: 658804 - DNA, 971 bp, Homo sapiens
aacgcatcctcattcctgggctcctcctcgacctctcagcccgtgtccagggcacatcatgaacacagagatggattaagagtctgagaggtacaggcaaagcagagaaccaagaaactggccatgattctctccctgccacctcttcaggccactgccacagttcccggtgcaggttaccacctgaaaggagttgacttaccaacgggtagtaaccaaagaaggccagagtcacatttgggaaatttggtatcaggagccttggaccaggagatcttattctgacctcattctgatatttcatagcctgacgtcaacggtgaagcctctcaacctctctaagcccagtttctccacgtataaagtaaggaccgttttatccaccagattttcactgggttttattactcaaagataaattgcaagctacaaagacgtgtgtgtataagggattgttattatccaggttaaaacataacctgtattcaaaagaattcgatcaatgcacatgtgacaaaagctgatgaattattaaaaggagcaattcctggattcctctcctaagtcttagctcagaacctctctacctagctaggcctggtgctaagggctggagatctagaaacaaggcacgggtcctgctctggaggaactcctggcctcatagaagtgtgttgttgacctactgtgtgcctagcactgtgaagcatgccagaatagacatggtcacacttttcttaaggagcccaaataaaacttttcagggagatgaacacaagacatacacctatgaaacagagaaggaagattgtaacttatctgggaagaaggctctaatgcatgtctccagtaggtacaggaagattcctgtactatagcatggaaagaggagattgagtcaaaggggcaaacactagtctacattataaaagtctctggttggctagagaagaaaaaatttttgcaaaaaa

SEQ ID NO: 658805 - DNA, 747 bp, Homo sapiens
gatatgtcgaccagcgtcgccacgcgtcggacccacgcgtcgactagttctagatcgcgagcggtcgcccttttttgtttttttggtaaaaatggggtctcccactggtccgagacagcagttgtaaacgaccgccagtgcctagtatatacgactcactatagggacacgtagtacaacgaaagctgagatacgcgtacacaatgcgggcccctcgaacgggcatactctaagagcgagcgcccataacagaacacaccaccacaccagggtcccgcagaaaaaaccgcgccacaaaccacaccggagacgacacaatcaaaacacaacaccgcgacaacacccaacagacgacccccaacacaacaacacaacgcccaacaacactcgggcgctcacaacaacacacttacacgcgtgaaacaccccaacagacgggaccacaccccacacatcacccaatcagaagaaaccacaccacgagcgcagaacaacaaaagcaacactacacacaaacacaggcaacaccaacacctaaccagtgcgacacagactgaaagagaacaccaaccagccgacggaccaaaaacaagacggaaaaccaaacaccagcacagaagacagaacacgaaacacgccacagcaacaacacaacgaaaacacactaaagacccaacagacactcacagccaacgcccctaacacaaccacagaggaagcacagaaacaacgaaagaacacagaagc

SEQ ID NO: 658806 - DNA, 368 bp, Homo sapiens
gtcaggaatctgggaggggtgctaggttttgagtaactagaggatgtgttcccctcaggtgctgtcagggtggggagggggccggagtgcaaggtgctttcacctagagcttgttacttgtgccctggggtgaagcttggtccacgtgtgcctgggagcctgtgcctctctccccagcctccagcagctgtgctcatgagggctggtggcatgatggtggacaggtcctggggagagactgggccctttgccctgtgcctcatgcgttcatggagatagggctgggcattcagcaggcatttgctaaatgcttattgagctcgtttatcaagcttcttgaacaggcagatggcagatgaggagttaag

SEQ ID NO: 658807 - DNA, 400 bp, Homo sapiens
  misc_feature (2)..(2): n is a, c, g, or t
  misc_feature (5)..(5): n is a, c, g, or t
  misc_feature (350)..(350): n is a, c, g, or t
anccngtcatctagaggatcccttcaacgtttgcaacacctttcgcctctctcctgctgcaacctgagcagacgcttctgcttcttcgtcttcttctgccgcctcccttcaagcaggcgctgcaggccttctctgggatctcatcttcagggaaaatgcctcctgccaggtcctgcagcttccggatcactttgtagagacgctttctgttctgagaaggggtgctctggcggctggccatttcaaacagcctgttagcaactgcctcgtagtcaaactggagaacggggccgccactgtccctgtcgtcacctgcctgctcctcaccagcctcaggttcagccctgcangatggagcctgcgggcggcttctcagacctcttctgggaacctgcgcgtc

SEQ ID NO: 658808 - DNA, 254 bp, Homo sapiens
cctttttttgggagctccttcttgccactgcctgggcacctttttgccatagaaaaagacattcacgcttacaccagcctccgggggagccagcctgcctatgaaggacagcctcttactcatcaccggggctccccgcatgcagcgagcccgagactcatctcgccacctggcttctgcccacggggtgagtcatgccaaggttctttgcgaaacctgaactcacttactttggttgacttaagagagatgtt

SEQ ID NO: 658809 - DNA, 159 bp, Homo sapiens
ggatgtgtatgggctggccactgctgggatatgtatcgatatggtggcctgggatcgctatgatgaccgaggcagcagagactatgatagatgtgctatgattcccggataggcatgtggcagcaagagcattattggcatgtgggtatctgcagggat

SEQ ID NO: 658810 - DNA, 796 bp, Homo sapiens
ggatagataagattcattaaaaaaggcaagttattctttgggtcagggctgtttatctgtagaagaagggttaaagtttctagagggtaagaaggttggttataataacgaagtctggacaagagagtctagtatacaatttttctacttggtctcaatgatggttaagtagagggatcatacgaagctaagattttattaaagaagagaagtttttttgtagattggctgatttatttatgaaaaatttgtgacatatttataaatgttttcatgatatttatatgaaaatatattgtagggttttcttggtagaagagagggggagaataaaggatgatgagggtggaagaataaggtgaatttagtattattttttttagtagtaaggaaagggatattgtagggtataggaatatgttattagggggtgttttaagaataaggttggttctaacctgatcagtataggtgaccatatttgtttggatttcttaaatagaagcaatggcaatgacaagtgatttgtttaattttcttgacagaactggggcagatacagagggtgttgagggatttataaattctttcagtttaagaggtatttattaattgaaataatagttatgctaccccttgcgtcagacttactttcatctgtttagcaactgctttatatgaaacacaaaagagctcagcaatgacactcgtgtcttaattaaccattgaataccttatagagcagctgtcacaactcttgtcacttgaaaggaagcacagtggtccctgtttaaaa

SEQ ID NO: 658811 - DNA, 308 bp, Homo sapiens
tagttttttcatacagtggtattaggttttctgcaaagacaatcatgccatatgtgaaggcagtgttatctgttttgtttctaattgatttgcctgactctgcaacataaagagtccttatttgggctgggcatggtggctcacatctataatcccagcactttgagaggctgaggcaggcgggtcacctgaggtcaggagttcgagaccagcctgaccaacatggcaaaaccccatctctgctaagacggggtaatttatgaagaaagggtttccttgactcacagttctgcaggatatacataagc

SEQ ID NO: 658812 - DNA, 1045 bp, Homo sapiens
aggaatggcctgcgcatggtgcaccatgttctgccgccgccggcctagcgccccagtgtccctggagaaggggcaccagtgcggccagtgtgcccaatgcttcctggtggcacgctcacccgcgcagtgactgagtgccgcggtcctgctcccgctccctgctctgggcctgtctcccccttccatgtgctccatgtgccaagggcttcctgcccagacaatgccctgaccctgctctgtcagtgactgctgtgccctggggttggtggtgctggggcggagcggaggcggagcggagctggagcctggagctgtaggaattccactttccccggggttttgtggggaggtggagtgcctgcaaggccctggcttttttcgcggtgtagcggtcgcggggtggatgtgccgagtgtgcccaccctgatgtgggggcggtgaagccttcgggtttgtgtgaagccccgcgcgaggtagaccttttggagaagtgggagggtgaggtggacgaacggggacagtaggtgggtcggggaaaggtgcttccttcgcatgttttaccactgccccccctgcccagcttcttgggctgcgtgggtaacaatcctcggacaacctggtgtccagggcttgggccgaagatccgttggcaccgggacgcgggggccacggttgtggggaattcccttctttggaaacgaaactattacggtacaatccgaaagtttggggactggggaccttggggctggggacagacggatggttttggtacccggtcccgggtaaaacgacgccctgtagtggctgtgccgcaggctgggccattgggcacctcctttttagcaacgtttttggcacgttttgttacgttgtacagcagagggagggtgaccacactacttcccccggtttgtcctgcaaaagacccttctatcggtgtataagtaaattatggacccccttcacatatataacaggagtatcgctggtgaacttggcatctattataggcgggggatgatatttctagtccgcggcgcca

SEQ ID NO: 658813 - DNA, 113 bp, Homo sapiens
gacggctcggtgctgcgggtctgagtgggtcagggcccaggcaggcaggaggacagctggtgtcagctcaggagcaggccaggccatctcggctggtgggtcggccctccagg

SEQ ID NO: 658814 - DNA, 183 bp, Homo sapiens
caggtacgagctgcgacagatcacgagtgataattgaatagacagttctagagtaggaaatgttttgcgagatctgctgtagggtgactgtgaaacggggtctacattcgaggtaagtgcagcaggtagaggcttacacatgaatcgattctgcactgaaataaccggggagtgatgctttga

SEQ ID NO: 658815 - DNA, 261 bp, Homo sapiens
gtacttacaggatccttagtggagccttaccctgtgtggggccatgctggagaggggcggggcaggtggtcttccaggccccttcctggcattctgttaccagacctcaactggcttggagtggccagtgttccttgttagtgccctgccccgcaccagtgcaacgctaacacaggatgggaggcttaggctaaggcacatttacagtagagggtgcaggaaatccgaggctcacgttccaactgctggagtgcccaccat

SEQ ID NO: 658816 - DNA, 378 bp, Homo sapiens
  misc_feature (7)..(7): n is a, c, g, or t
cccgtgntgcagcgctgaggcaggtagatcaaaaggtcaggagtggctgggcgcggtggctcacgcttgtaatcccagcactttgggaggccgaggtgggcagatcaccaggtcaagagatggagaccatcctggctaacacggtgaagccccgtctctactaaaaatacaaaaaaattagccgggcgtggtggcaggcatctgtaatcccagccacctgggaggctgaggcagaagaatcgcttgaacccgggcggcagaggttgcagtgagccaagattgcgccactgcactccaccctgggcaaaaagagcaaaactgtctcagaaaaaaaaaaacgaaaaagtcaggagttggacaccagcctggccattttgg

SEQ ID NO: 658817 - DNA, 198 bp, Homo sapiens
tgagttacgcacgagacgctgaaaaggcagctttctgatcagcagctcgtgtggacttctggtagcggcgaagcgcgcggagagccactgtaccaggccgatagcgatggggctatcttgacaccgccggtggccggagcgctcatatccgagccgccttggatggccagctgcatgcgcggagccttgccgccggtg

SEQ ID NO: 658818 - DNA, 522 bp, Homo sapiens
  misc_feature (237)..(237): n is a, c, g, or t
tgtcagaggatccctatgccgaagagtatcatctatagaaatattggtttttccaaggaataatgctttaagaagagacttgtagaaacagtgggactacatcaggaccagaatgacagtgacacagaggacggcaaatgttaagactaggattagcttttcacttggagcttgttatgtagaggacgtctccttctgttgattcctacagccgagacaagatgtgatcacaggagnactccaaaattctcaaacggggcttgagtcacaccctatagtaacttcaggaaccccactgtaggttgaagttactgcatactgtggccccgtgaaaaagaggtgcaagtgcacaaagattcatgcagagcctgctggaacagagggtggtggcggcgggttagtccacacttacacaccagcaggtatgctggggaagggccccccaggtggagtgcctgacatagggctcgctccagaggcgtctgactcagaagctcctgagagaggtgtctactcttcggg

SEQ ID NO: 658819 - DNA, 1386 bp, Homo sapiens
  misc_feature (250)..(250): n is a, c, g, or t
tggtaaaaatggggctttgctcttttaccccacccgggtctgaaacccctgtgggcctcccgcagatttctctcccacctttgtgcctccccaaattgtgcgtgggggatctacacgggcgttgagttcaccattgcccagcctatagcagtgagttttaggataaagatttgggtatactgcgtgggagacaagtggagaacaagcgcaggattaggggcgccaccgacagggcgtgagagagagacantcgaggagtctctgtgtgtggggcgtgtgcgatcgtggaatataccgccatgtgagaaggcgcacagacacagggagagcgctctctctgtgagagagagaagagatgtctttgtgagacacaaaccgacacgagcaggaagagacaccctcgcgtagtgacgcgcacgtggagagcccaccatgtgtgaggagaaattagtagcgcctctgtagagggatgaccccaaggggagtggtgggggcgccccaccatggtaggatgttagtcccaccaggtgagctagcagaaaccacccagagcagtgccgagagcgcctcctaccagcgaggattcgttgagagcagagtagcagagaggcgccacgtcgttgcgacaacgctatattagacctaccacaggacagcagcgtccacaaagaccggcggaaagaccagaagacctcacctagtgataagccgcccccgagtgggaaaacacccccctctatcacagctgtgcgggaaacactctctcttccccgcgcataaaactcactttatctttttactccaccagaaaagaacgtactcacaccaaacgagttatgcgtcttcttctatctaacacctcccctcttttcttcagaagcggtcgctgctataacagatgtgggcctcctcaaaatatatcaaccagttgtgtctacccccacaacaacatgtatttttaccgccacaaagaacgacgattcttgttctccacaaaagacttctctttaccacattcagtcctcaccaaaatggagtgtcctctcccccaagatggaggaggacccccctgtatataccggatgaaacttctccgacgtggtcgtcgcgacaaaaaaagccccccccccctcctccgtctgtggctgctcaaacgcacgatagctgtgagtaatcaatcctgctggcgaaacaccaccgctgttcactaacaggcgcggtggtctcagcttacattgacaacacaaattgggcgtgtccaatacatattcacagcaatatgtcgaatatcgatacgtctcctgtggcgccacggacgaagaaacatatattcttgggcgacaaccctccacccctcagtgtacaccaattctcgattgatgggaa

SEQ ID NO: 658820 - DNA, 1259 bp, Homo sapiens
atgagctggagtaggcgtgcgctaacgcggcgtgccggggcgggacgcggtggccgtggcgcggagaagtcggggcgggcggcagagaggccgggacgcggaccgggcctgtgtttcgcccacaggcgacctgacggcgcacagagagcgctgcgccccgaaaggcccgcggcacttagcccgggcggtgcatgggggctgcagcgagaggcacagcctgaaagccccaggtgcgtgagaccgggacggaacacgtgcacgggaaggcgggaagggggcaagaaaacggcagcgccacataggtataggccaccagagggccaagccctaaaatccgatggaggaggcggggcagtggaggggggaaggggccaccaagaaggcacggggcgcttgggagagacttgtaccatagggaccaggagaccagggacataccagtggcttcaaagaattacacaatgatgccccagggggaccccttcacatggcgatatcacagtgggactatggagaaggaagggtgatatcattggcacgcataccaatttccagtcgacagggaaccaaggcgaagaggttccattcagttccagtaaaggggatcaccgtttaagcaaggacacacgacgtgttgggccttgtggaggggggcgtattttaaagggggcaaggtatcaccaaaaggttgcgcccagttcacgacagattgtcgttcagaaaagagcgcacgttcgatatcgcaaagccgaaaggttgcggcattggcagaaggcgcaatttcgacaacaaagaatgcaaaaagagtaggcgcgagaccgccagtaaccgaaagtaacggacaggaggcacccaaactaggggagtatcagtacacagaccaagaaggcaataggtggaaacgagagaaagaagggggatccaaggggagcccacgaagggaagagtacgcagagtacagacaaagagggggatacccacgctaacgcaaagaggcgttatacagaaaagcacacaggcagaaaagtaaaagcaagaccgcagtattacagagaaggagggccacagattaacaccgaaagagatagtgatagcaggtcggcatcgaggacgacagaagaagacgccccggagggagtggcaccacgagagagcaatacgcccggacgtagcagagatagaccgtacctcgcagagtaagcagtacagccggtcgaggagcaccaagcgaacagagcgcccgcgagctgatccagggg

SEQ ID NO: 658821 - DNA, 108 bp, Homo sapiens
aggatcccccgctgcaacttcctttgagatttaatcttgcgaccgtactccccagtggataacttaatgcgttagctgcgcgagccaagcaccaggaaggcggcggcc

SEQ ID NO: 658822 - DNA, 300 bp, Homo sapiens
aacatctctgcctttgcctgtgtgtgttttgggggaggggggacatggaaaaatattgtttggaccttacttgggtgagtgcccatgaaaacatcagtgaacttgtaactattgttttgttttggatttaaggaaatgttttagatccggaaccgctaataggaatatgcgagttaattcagaattgaaaccatttttccctgttctacccatcccccccttttttccaattgaactctttgttatatgtccctttctattcatggaacttctttttcctttaacatgggtccaaactta

SEQ ID NO: 658823 - DNA, 580 bp, Homo sapiens
tttagaggatccccttcgacggtgttctgaatatacaatattagctctcattccaattttttctaacatgaattttcctggttgacatgatttcaaagggttttatgtattaaagtgacagaatcttattaaatgtgaaacatggcaaggagaaaaaaaaaaaaagaaactcaggctaaatttggatccccaaggggggggtgcggtgtggggagggggggcctagtggggaggtgtcggggtaatgggggccagatctctccggaatgggctggaaagtagctctgggaaggcaatggagtggcttggctgctcaaggagcccgggatatagttctccaagaacttacaggtatgtgggccagggtggcaggggctcacacctggtaattcccaggcacttgggggagggccaatggcagaagggatcggctggagggccgggagagtttggagaccaggtctggggcaacattagcaaggacccggattctctacaagaattaacaatttaaataaattggagcagggacatgggtggacacttggcctggtatgtcccaagctactcaagttgggct

SEQ ID NO: 658824 - DNA, 315 bp, Homo sapiens
  misc_feature (302)..(302): n is a, c, g, or t
tttcggcacagtcgtgtgtttattgagacggaccaagcctgggcaacagtgagactgtctcaaaaaaaaaaaaaaaaaaaaatttctagcagacactgaagggagagggagaggaacaagccccagggaccctttatccgacttccttccacctgggggactccctccacgggcccttgctttaagggcaaatggcgagggcaccagaacacagggaggccatgcgaacgtccctgctgcaaccatgcggccccccagctcactcccagcagccaagacgaaggggggcctgggctcccctnagggaaggcgcct

SEQ ID NO: 658825 - DNA, 153 bp, Homo sapiens
cctccacgtggccttgaaactgcagatggacgccagtgacgggctgctctcaggacaccacacggtcccactcacagggtctccctggagtcgtggactggtggctgcagtgagcaggatttactcctcctgttatgtactactaggcggcag

SEQ ID NO: 658826 - DNA, 423 bp, Homo sapiens
cacactctatgtaatactatgcaggtggcgggcacgaggctcacaatcctagcaactggggaggccgagacgggtggattacctgaggtcaggagttcaagatcagcgtggccaacatgatgaaatcccatctctactaaaaatacaaaacttagccaggtgtggcagcaggcacctgtaattccagctactcaggtagctgaggcaggagaattgcttgaacctgggaggcggaggttgcagtgagtcaagattgcaccatcgcactccagcctggggaacaagagtgaaactcttgctaaaaaaaaaaaaaaaaaaatatccaagcaggcctggtgtttggccctgggggggggggaatggctgccaagtgtccagcatagggagggtaatgggtggggggggggctccaacttgagacag

SEQ ID NO: 658827 - DNA, 1025 bp, Homo sapiens
ggtgagtgagcggcgggttccgggctccgggctctgggtggctggcggctgtgagcggacggcactgcgtgcgcaggcggcggaggccagcggtgctgccgtctggcggctggccctgtctggccgctgggatgaggaagcggacctgagccctgtctgccttgtgagcatgagctgctgctgcctgcctgctgggctcgtcctcctccggctctggcctgccgccggcgctggacgccgactgccgcctgaagcagaacctacgcctgacgtggcccgtgcgtgctgtgctgaggccgctgctgcgcagccgacgcgggaatgaagcgggcggctgggcagtgcgaaatgtggcgtgtggttgcgcctgaagggaagatactttaacttggggtttgggggtgtggacacttggcctatgccatttctactatcaaacatatgtcctggcaatacgaaggccaaagtgattaacttgaatctcgtacagagatcccctattatcattgatttgaaaaaaccacaggatcaaggtttgaatcacacagtgtaaactacgtacctgcaggacagaggaacgacgttgacccattggagtctggcaacaccgtccctggaagtcctggtgggaagaaacgaccaaggcaaagacagatgtgggtatgagggaatgccttgagttcacaggccaaaccgtagtcatttctggtaacctgcattggggaacggcacaggtgtccaagagggaatagcgcacaacagagttgaagcttttaccaggtgctggagaaccgttggaataccaatgtgggacaccgatatgactacagacggatagggggtggaatacggtgggtcacgcccaatcctgagacgcgggcattaacctattacagacactcccaaggtaatagacttgaatccaaacaggacgttggggcaacaccccgtggacctttggggccagtcccatggccctagtgatgagcacaatacagatcgccggcactgtccacgagagaccc

SEQ ID NO: 658828 - DNA, 283 bp, Homo sapiens
ctgaggtcgatctagaaggatccctgtgggtctcttcttgacagtgtcacgagaactccatcgatgtgtttgacgtgaggagggcagaatgggagcagacctgtgccgctcaagaaggtgctggcccctcaatccagaggtgctcccttgttcctcatacggcacctgagaaggtccgccttgacctacctcatggaaccacgctgtgcagagacaggactgagttctgcacatccctggaccttcacctgacaaccagccgggctgccagcttgttcctgca

SEQ ID NO: 658829 - DNA, 924 bp, Homo sapiens
  misc_feature (153)..(153): n is a, c, g, or t
  misc_feature (165)..(165): n is a, c, g, or t
  misc_feature (168)..(168): n is a, c, g, or t
  misc_feature (171)..(171): n is a, c, g, or t
  misc_feature (185)..(185): n is a, c, g, or t
  misc_feature (187)..(187): n is a, c, g, or t
  misc_feature (189)..(189): n is a, c, g, or t
  misc_feature (198)..(198): n is a, c, g, or t
  misc_feature (201)..(201): n is a, c, g, or t
  misc_feature (207)..(207): n is a, c, g, or t
  misc_feature (212)..(212): n is a, c, g, or t
  misc_feature (248)..(248): n is a, c, g, or t
  misc_feature (255)..(255): n is a, c, g, or t
  misc_feature (262)..(263): n is a, c, g, or t
  misc_feature (271)..(271): n is a, c, g, or t
  misc_feature (301)..(301): n is a, c, g, or t
  misc_feature (308)..(308): n is a, c, g, or t
  misc_feature (322)..(323): n is a, c, g, or t
  misc_feature (325)..(325): n is a, c, g, or t
  misc_feature (327)..(327): n is a, c, g, or t
  misc_feature (335)..(335): n is a, c, g, or t
  misc_feature (337)..(337): n is a, c, g, or t
  misc_feature (339)..(339): n is a, c, g, or t
  misc_feature (351)..(353): n is a, c, g, or t
  misc_feature (368)..(368): n is a, c, g, or t
  misc_feature (381)..(381): n is a, c, g, or t
  misc_feature (386)..(386): n is a, c, g, or t
  misc_feature (389)..(389): n is a, c, g, or t
  misc_feature (393)..(393): n is a, c, g, or t
  misc_feature (397)..(397): n is a, c, g, or t
  misc_feature (401)..(401): n is a, c, g, or t
  misc_feature (403)..(403): n is a, c, g, or t
  misc_feature (408)..(408): n is a, c, g, or t
  misc_feature (414)..(414): n is a, c, g, or t
  misc_feature (418)..(418): n is a, c, g, or t
  misc_feature (420)..(420): n is a, c, g, or t
  misc_feature (425)..(425): n is a, c, g, or t
  misc_feature (453)..(453): n is a, c, g, or t
  misc_feature (468)..(468): n is a, c, g, or t
  misc_feature (470)..(470): n is a, c, g, or t
  misc_feature (475)..(476): n is a, c, g, or t
  misc_feature (486)..(486): n is a, c, g, or t
  misc_feature (524)..(524): n is a, c, g, or t
  misc_feature (528)..(528): n is a, c, g, or t
  misc_feature (540)..(540): n is a, c, g, or t
  misc_feature (559)..(560): n is a, c, g, or t
  misc_feature (593)..(593): n is a, c, g, or t
  misc_feature (713)..(713): n is a, c, g, or t
  misc_feature (918)..(918): n is a, c, g, or t
ctgcctcgccactgtcctgctgccctccagacatgctggggccctgcatgctgctgctgctgctgctgctgggcctgaggctacagctctccctgggcatcatcccagttgaggaggagaacccggacttctgagaaccgcgaggcagccgangccctgggtgcngcnaanaagctgcagcctgnananaaagccgcnaanaacctnatcancttcctgggcgatgggatgggggtgtctacggtganagctgcnaggatcnnaaaaaggnaaaaaaaggaaaaaatggggcctgagttanccctggncatggaccgcttcnnanangtggctcnananaaaaaataaaannnaaaaaaaaatgtgcnaaaaagtggagcnaaaanaanggcntaantgtncngggtnaagggnaacntnaaaancattggcttaaatgcaaccgcccgattnaaccaatgcaacacnanacgcnnaaacgaggtnatctccgtaatgaatcgggccaaaaaaacagggaagtnaatnggaatggtaacnaccacacaaataaaaacanntcgccagccggcacctacgcccacacggtgaancgcaactggtactcggacgccgacgtgcctgcctcggcccgccaggaggggtgccaggacatcgctacgcagctcatctccaacatggacattgacgtgatcctaggtggaggccgaaantacatgtttcgcatgggaaccccagaccctgagtacccagatgactacagccaaggtgggaccaggctggacgggaagaatctggtgcaggaataggctggcgaaggccaggggtacccggtacgtgtggaaccgcactgagctcatgcaggcttccctggacccgtctgtgaaccatctcatgggtctctttgagcctggaganatgaaa

SEQ ID NO: 658830 - DNA, 132 bp, Homo sapiens
gtgtttttttttgaccaaagttcccttttgccaaggggagcttccagcttttccccttccttccgttgttttttggaaggggtgctttgtgggcccttccggaaattaaaccccccccttttttttgcaaga

SEQ ID NO: 658831 - DNA, 947 bp, Homo sapiens
  misc_feature (160)..(160): n is a, c, g, or t
  misc_feature (163)..(166): n is a, c, g, or t
  misc_feature (168)..(168): n is a, c, g, or t
accggtacggcccggaattttgggatgggaaggagagccctgcaggcatggggcttccaggcttgggacacctgggcattcctgggccaggaaagcacccaagtaaacctgcaactcagaagccaaatgagacctatcccaggcaggtccgctctgcganggnnnntntcatcggcgtcaataggaggcatcggggacagccgctgcggcagcactcgagccagctcaagcccgcagctcgcagggagatccagctccgtcctgcctgcagcagcacaaccctgcacacccaccatggatgtcttcaagaagggcttctccatcgccaaggagggcgtggtgggtgcggtggaaaagaccaagcagggggtgacggaagcagctgagaagaccaaggagggggtcatgtatgtgggagccaagaccaaggagaatgttgtacagagcgtgacctcagtggccgagaagaccaaggagcaggccaacgccgtgagcgaggctgtggtgagcagcgtcaacactgtggccaccaagaccgtggaggaggcggagaacatcgcggtcacctccggggtggtgcgcaaggaggacttgaggccatctgccccccaacaggagggtgaggcatccaaagagaaagaggaagtggcagaggaggcccagagtgggggagactagagggctacaggccagcgtggatgacctgaagagcgctcctctgccttggacaccatcccctcctagcacaaggagtgcccgccttgagtgacatgcggctgcccacgctcctgccctcgtctccctggccacccttggcctgtccacctgtgctgctgcaccaacctcactgccctccctcggccccacccaccctctggtccttctgaccccacttatgctgctgtgaattttttttttaaatgattccaaataaaacttgagcccac

SEQ ID NO: 658832 - DNA, 156 bp, Homo sapiens
  misc_feature (82)..(82): n is a, c, g, or t
  misc_feature (114)..(114): n is a, c, g, or t
  misc_feature (135)..(135): n is a, c, g, or t
  misc_feature (143)..(143): n is a, c, g, or t
tcgtctccatggtgactaactgttttttccccggttgtaatacctctaccttgtgccctgattagcaaccgaatctgctttntgcctggatgggagctccctctccttttttgnctgggtgggactcctttctgnctttttgncctgagcccagag

SEQ ID NO: 658833 - DNA, 976 bp, Homo sapiens
  misc_feature (160)..(160): n is a, c, g, or t
  misc_feature (163)..(166): n is a, c, g, or t
  misc_feature (168)..(168): n is a, c, g, or t
accggtacggcccggaattttgggatgggaaggagagccctgcaggcatggggcttccaggcttgggacacctgggcattcctgggccaggaaagcacccaagtaaacctgcaactcagaagccaaatgagacctatcccaggcaggtccgctctgcganggnnnntntcatcggcgtcaataggaggcatcggggacagccgctgcggcagcactcgagccagctcaagcccgcagctcgcagggagatccagctccgtcctgcctgcagcagcacaaccctgcacacccaccatggatgtcttcaagaagggcttctccatcgccaaggagggcgtggtgggtgcggtggaaaagaccaagcagggggtgacggaagcagctgagaagaccaaggagggggtcatgtatgtgggagccaagaccaaggagaatgttgtacagagcgtgacctcagtggccgagaagaccaaggagcaggccaacgccgtgagcgaggctgtggtgagcagcgtcaacactgtggccaccaagaccgtggaggaggcggagaacatcgcggtcacctccggggtggtgcgcaaggaggacttgaggccatctgccccccaacaggagggtgaggcatccaaagagaaagaggaagtggcagaggaggcccagagtgggggagactagagggctacaggccagcgtggatgacctgaagagcgctcctctgccttggacaccatcccctcctagcacaaggagtgcccgccttgagtgacatgcggctgcccacgctcctgccctcgtctccctggccacccttggcctgtccacctgtgctgctgcaccaacctcactgccctccctcggccccacccaccctctggtccttctgaccccacttatgctgctgtgaattttttttttaaatgattccaaataaaacttgagcccacaaaagacgaaaaaaacttctccagcgcgg

SEQ ID NO: 658834 - DNA, 191 bp, Homo sapiens
ttgcctgctgtgccataaactttggtccctacttccgtatgaacgatggaaaccttgacaggagactggagcaaaattcagcttgaagtgaacagagcactttttactaaagtagtagcatgattttcagctatgccatatgaccaaacatgaggcattttggcgatttgtcattttttcattcggagtct

SEQ ID NO: 658835 - DNA, 240 bp, Homo sapiens
gcggtacctcagatggaaatggcagaaatcacccgtcttctgcgtcgctcacgctgggagctgtagaaccgagctgttctctattcaggcatctttggcttctctccaagagatgttgtactatatatatttggaaagggattatgataaaggcttactatgctatgggtaatagatataattgagatagtgtcatatatccacactcttttctatatagggcacgagatttggatacca

SEQ ID NO: 658836 - DNA, 1027 bp, Homo sapiens
  misc_feature (160)..(160): n is a, c, g, or t
  misc_feature (163)..(166): n is a, c, g, or t
  misc_feature (168)..(168): n is a, c, g, or t
accggtacggcccggaattttgggatgggaaggagagccctgcaggcatggggcttccaggcttgggacacctgggcattcctgggccaggaaagcacccaagtaaacctgcaactcagaagccaaatgagacctatcccaggcaggtccgctctgcganggnnnntntcatcggcgtcaataggaggcatcggggacagccgctgcggcagcactcgagccagctcaagcccgcagctcgcagggagatccagctccgtcctgcctgcagcagcacaaccctgcacacccaccatggatgtcttcaagaagggcttctccatcgccaaggagggcgtggtgggtgcggtggaaaagaccaagcagggggtgacggaagcagctgagaagaccaaggagggggtcatgtatgtgggagccaagaccaaggagaatgttgtacagagcgtgacctcaggcctgccttggggctggggctggggtggaggccagccagtgtcctcccatagtggccgagaagaccaaggagcaggccaacgccgtgagcgaggctgtggtgagcagcgtcaacactgtggccaccaagaccgtggaggaggcggagaacatcgcggtcacctccggggtggtgcgcaaggaggacttgaggccatctgccccccaacaggagggtgaggcatccaaagagaaagaggaagtggcagaggaggcccagagtgggggagactagagggctacaggccagcgtggatgacctgaagagcgctcctctgccttggacaccatcccctcctagcacaaggagtgcccgccttgagtgacatgcggctgcccacgctcctgccctcgtctccctggccacccttggcctgtccacctgtgctgctgcaccaacctcactgccctccctcggccccacccaccctctggtccttctgaccccacttatgctgctgtgaattttttttttaaatgattccaaataaaacttgagcccactcctaaaaaaaaaaaaataataaaaaaa

SEQ ID NO: 658837 - DNA, 405 bp, Homo sapiens
cccacggatgacccctcaggcatggggcacagaagacaacttttctcagcccactcagggtggcccattaaggctggggcctggagctgggtgtgcaggtcattctctctcccaggcccagagtgggggagactagagggctacaggccagcgtggatgacctgaagagcgctcctctgccttggacaccatcccctcctagcacaaggagtgcccgccttgagtgacatgcggctgcccacgctcctgccctcgtctccctggccacccttggcctgtccacctgtgctgctgcaccaacctcactgccctccctcggccccacccaccctctggtccttctgaccccacttatgctgctgtgaattttttttttaaatgattccaaataaaacttgagcccac

SEQ ID NO: 658838 - DNA, 711 bp, Homo sapiens
  misc_feature (160)..(160): n is a, c, g, or t
  misc_feature (163)..(166): n is a, c, g, or t
  misc_feature (168)..(168): n is a, c, g, or t
accggtacggcccggaattttgggatgggaaggagagccctgcaggcatggggcttccaggcttgggacacctgggcattcctgggccaggaaagcacccaagtaaacctgcaactcagaagccaaatgagacctatcccaggcaggtccgctctgcganggnnnntntcatcggcgtcaataggaggcatcggggacagccgctgcggcagcactcgagccagctcaagcccgcagctcgcagggagatccagctccgtcctgcctgcagcagcacaaccctgcacacccaccatggatgtcttcaagaagggcttctccatcgccaaggagggcgtggtgggtgcggtggaaaagaccaagcagggggtgacggaagcagctgagaagaccaaggagggggtcatgtatgtgggagccaagaccaaggagaatgttgtacagagcgtgacctcagcgtggatgacctgaagagcgctcctctgccttggacaccatcccctcctagcacaaggagtgcccgccttgagtgacatgcggctgcccacgctcctgccctcgtctccctggccacccttggcctgtccacctgtgctgctgcaccaacctcactgccctccctcggccccacccaccctctggtccttctgaccccacttatgctgctgtgaattttttttttaaatgattccaaataaaacttgagcccac

SEQ ID NO: 658839 - DNA, 131 bp, Homo sapiens
  misc_feature (10)..(10): n is a, c, g, or t
  misc_feature (49)..(49): n is a, c, g, or t
  misc_feature (111)..(111): n is a, c, g, or t
ccggcctggnagtgcctggagaaggaggtggagagcatgggggcccatntaaatgcctacagcacccggaagcacacagcttactacatcaaggcgctgtccaaggttctnccgaaagctgtggagctcct

SEQ ID NO: 658840 - DNA, 1068 bp, Homo sapiens
  misc_feature (160)..(160): n is a, c, g, or t
  misc_feature (163)..(166): n is a, c, g, or t
  misc_feature (168)..(168): n is a, c, g, or t
accggtacggcccggaattttgggatgggaaggagagccctgcaggcatggggcttccaggcttgggacacctgggcattcctgggccaggaaagcacccaagtaaacctgcaactcagaagccaaatgagacctatcccaggcaggtccgctctgcganggnnnntntcatcggcgtcaataggaggcatcggggacagccgctgcggcagcactcgagccagctcaagcccgcagctcgcagggagatccagctccgtcctgcctgcagcagcacaaccctgcacacccaccatggatgtcttcaagaagggcttctccatcgccaaggagggcgtggtgggtgcggtggaaaagaccaagcagggggtgacggaagcagctgagaagaccaaggagggggtcatgtatgtgggagccaagaccaaggagaatgttgtacagagcgtgacctcaggtgagaagccccagggccaggggacacatgggggataggacccctggggctcctgcatcctagtgctggggctcaaacctagagtcctgccttacccccaactggggtcccaagccctacagacccctgcagaccataaggctaaactagggtgggcgtctccttacccccaacagcatcagaggtgccctggagtcagagggagcaggggagggtcccagcagggccaggctctgagctcctgggaaggggctgcgagcctgactccagcaggcctgccttggggctggggctggggtggaggccagccagtgtcctcccatagtggccgagaagaccaaggagcaggccaacgccgtgagcgaggctgtggtgagcagcgtcaacactgtggccaccaagaccgtggaggaggcggagaacatcgcggtcacctccggggtggtgcgcaaggtgagccccggccctcatacctgcacagttcctctccttgggcccagaaaggcttgtgggcggaggcggcatcactccaatccaaaccccaggaaacaacacggggggctgcggctggcttcagattcagtaaccacttgagcgccggcatggggtgg

SEQ ID NO: 658841 - DNA, 439 bp, Homo sapiens
  misc_feature (40)..(40): n is a, c, g, or t
  misc_feature (43)..(43): n is a, c, g, or t
  misc_feature (51)..(51): n is a, c, g, or t
cttttttctcctaaaacccccaaacaaacgaagggttttnaanaaaccttntctgtgagttgtttcagggcagaatgtaccagccagtcagcgttgtttaacaaaataatcagatttttgcctagcactcggttttggtggagctgacgattttgagggctgaggctggttaggtagctggaatgtgcctatgtgaccagctcacttgcagacaccctgccggaagcagagcttaatcttcctaggactgaggtcttagcacatgtactggtggagtttccagaccaccagtatgaataaaagcttgttctgtgtgacccagcaagtggaaggacaaagaactgtgagcctcagatctttggacctttccaatgcgtctctttctcctgttattgctgcaatgtattttcttgcttatattaaagttgtttcatcagta

SEQ ID NO: 658842 - DNA, 180 bp, Homo sapiens
gactgtttctctcggatcatcatgtgtctgtgtgagctgacatcacgtcagactctcatgatcaggtgtctgttctcagcaggggcaaccaatagtaccagaagtcacaactcagctatggcactggagcctgctgcctttgggtaagattagcattcataactgcatactgctctcgtg

SEQ ID NO: 658843 - DNA, 465 bp, Homo sapiens
  misc_feature (160)..(160): n is a, c, g, or t
  misc_feature (163)..(166): n is a, c, g, or t
  misc_feature (168)..(168): n is a, c, g, or t
accggtacggcccggaattttgggatgggaaggagagccctgcaggcatggggcttccaggcttgggacacctgggcattcctgggccaggaaagcacccaagtaaacctgcaactcagaagccaaatgagacctatcccaggcaggtccgctctgcganggnnnntntcatcggcgtcaataggaggcatcggggacagccgctgcggcagcactcgagccagctcaagcccgcagctcgcagggagatccagctccgtcctgcctgcagcagcacaaccctgcacacccaccatggatgtcttcaagaagggcttctccatcgccaaggagggcgtggtgggtgcggtggaaaagaccaagcagggggtgacggaagcagctgagaagaccaaggagggggtcatgtatgtgggattacattttttttttaaagaaagaataaattaattgtgattaaagttg

SEQ ID NO: 658844 - DNA, 2185 bp, Homo sapiens
gtccagagccttgcctgcttgtgatcctggtggagaaggtggagtatggtgagctgcttgctaaggacagccaggcaacactgtgtttgtgaagatgtgctccaccttctcctctgtgcatcccagctcctcctgctgaaacagctgagcttgctttttggatttcttagactcctggcctctgagagacacctctaaggacaaactgaccttgcattgggaactttattatccagatcctcataggcttgtctactctggattgcttgttgcaacagttcttaggaagcaagattgtctcctgcaccagcatctgcctgtgtttgcttttacctactttgagcaagacccagtgaggccctagctctgttggtcctgaaaagcctgaaccctgaggctgtttctcctgcctccaaaatgcaattataggaaataagaagcacagaaacagtggaaacaaccaggaggagaaacaggaaaacctaaaattttcaatattcaaaaatacctgtcgtggtggttgatgcagaaaacactgagttcatcaaagagcttgtaattgttggaccagagaacccctttgctacaggaactgatatgttttgtctttctggcctagtcaagggaggataagtaagtatctggggcatggaaggaatgcactcttgggctgttttgcttgtatctgactcacccctgactctccagtgaagcagaaaggaagaaacctcacaccacccaggtgtggccagactttggccattattgtgaatccccaagagttaccacaggcccttcccaaatatatatttaatcttgtggttcaaataagcttttggctcacatctaagcacatcataaagaacgctgtagaagaggtgacatgatgaggcgggaagacgaggaagaggagggaacaatgatgaaggcaaaaggggacttagagatgaaggaggaggaagagattagtgagacaggagaactggttggcccttttgtgagtgctatgcccactccaatgccccacaacaagggcacccggttctctgaggcatgggaatatttccacctagctcctgctcgtgctgggcaccatcccaaccagtatgccacctgccgcctgtgtggcaggcaggtgagccgtggccctggggtcaacgtgggcaccactgcactgtggaagcatctgaaaagcatgcacagagaggagctggagaagagtggccatggtcaggctgggcagcgccaggatccaaggccccacgggccccagctccccacaggcattgagggtaactggggtaggctcctggagcaggtgggcaccatggctttgtgggccagccaaagggaaaaggaggtgcttaggagggaaagggcagtggaatggcgggagagggctgtggaaaaaagggagcgagccctggaggaggtggaaagggccatcctggagatgaagtggaaggtgagggctgagaaggaggcatgccagcgggagaaagagctgcctgcagcagtacatcccttccattttgtttaaattgggcttggagaatctattctgaaaacattgactctagacttgtagaaaagagccattttagtttcaactcaaatgtaaagcaaagtagtttggtgacattttgcttttatgtgaaatagtgcacagtatgagttaatctgagcaggtctgaattgaccaaatgcttatctacgaggttcctagagctctgctgacccttggccgaaactctaaaatgtacctattaaagataaatgcttctaccaaagtaaaactctgtgagttgtttcagggcagaatgtaccagccagtcagcgttgtttaacaaaataatcagatttttgcctagcactcggttttggtggagctgacgattttgagggctgaggctggttaggtagctggaatgtgcctatgtgaccagctcacttgcagacaccctgccggaagcagagcttaatcttcctaggactgaggtcttagcacatgtactggtggagtttccagaccaccagtatgaataaaagcttgttctgtgtgacccagcaagtggaaggacaaagaactgtgagcctcagatctttggacctttccaatgcgtctctttctcctgttattgctgcaatgtattttcttgcttatattaaagttgtttcatcagta

SEQ ID NO: 658845 - DNA, 288 bp, Homo sapiens
gtattcagagaagtcaggcaccttgatgtctgtgttgggtgataacatcacgtgatttatcgcccaaaaccgtggtgaagcaatgctttgagcctccctcctttgtgcgactggttccttggctgggatgatgatcacttggtctgtggaccccctggacagggccatggctgagctggctggctgaagaggggcagggcccaaccatgtcaccggtcagtgccttttggaactgtccttccctcgaagaggccttagagcgagcagagcagctctgctattagtgtg

SEQ ID NO: 658846 - DNA, 975 bp, Homo sapiens
  misc_feature (160)..(160): n is a, c, g, or t
  misc_feature (163)..(166): n is a, c, g, or t
  misc_feature (168)..(168): n is a, c, g, or t
accggtacggcccggaattttgggatgggaaggagagccctgcaggcatggggcttccaggcttgggacacctgggcattcctgggccaggaaagcacccaagtaaacctgcaactcagaagccaaatgagacctatcccaggcaggtccgctctgcganggnnnntntcatcggcgtcaataggaggcatcggggacagccgctgcggcagcactcgagccagctcaagcccgcagctcgcagggagatccagctccgtcctgcctgcagcagcacaaccctgcacacccaccatggatgtcttcaagaagggcttctccatcgccaaggagggcgtggtgggtgcggtggaaaagaccaagcagggggtgacggaagcagctgagaagaccaaggagggggtcatgtatgtgggagccaagaccaaggagaatgttgtacagagcgtgacctcagtggccgagaagaccaaggagcaggccaacgccgtgagcgaggctgtggtgagcagcgtcaacactgtggccaccaagaccgtggaggaggcggagaacatcgcggtcacctccggggtggtgcgcaaggaggacttgaggccatctgccccccaacaggagggtgaggcatccaaagagaaagaggaagtggcagaggaggcccagagtgggggagactagagggctacaggccagcgtggatgacctgaagagcgctcctctgccttggacaccatcccctcctagcacaaggagtgcccgccttgagtgacatgcggctgcccacgctcctgccctcgtctccctggccacccttggcctgtccacctgtgctgctgcaccaacctcactgccctccctcggccccacccaccctctggtccttctgaccccacttatgctgctgtgaattttttttttaaatgattccaaataaaacttgagcccactcctaaaaaaaaaaaaataataaaaaaa

SEQ ID NO: 658847 - DNA, 1732 bp, Homo sapiens
  misc_feature (28)..(28): n is a, c, g, or t
  misc_feature (39)..(39): n is a, c, g, or t
  misc_feature (71)..(72): n is a, c, g, or t
aatgtcgagcgtcggtacccccatagtntgggcatcacntggagagtacaggggtgagtcagatacaagcnnaaacagcccaacgagttcatcaaagagcttgtaattgttggaccagagaacccctttgctacaggaactgatatgttttgtctttctggcctagtcaagggaggataagtaagtatctggggcatggaaggaatgcactcttgggctgttttgcttgtatctgactcacccctgactctccagtgaagcagaaaggaagaaacctcacaccacccaggtgtggccagactttggccattattgtgaatccccaagagttaccacaggcccttcccaaatatatatttaatcttgtggttcaaataagcttttggctcacatctaagcacatcataaagaacgctgtagaagaggtgacatgatgaggcgggaagacgaggaagaggagggaacaatgatgaaggcaaaaggggacttagagatgaaggaggaggaagagattagtgagacaggagaactggttggcccttttgtgagtgctatgcccactccaatgccccacaacaagggcacccggttctctgaggcatgggaatatttccacctagctcctgctcgtgctgggcaccatcccaaccagtatgccacctgccgcctgtgtggcaggcaggtgagccgtggccctggggtcaacgtgggcaccactgcactgtggaagcatctgaaaagcatgcacagagaggagctggagaagagtggccatggtcaggctgggcagcgccaggatccaaggccccacgggccccagctccccacaggcattgagggtaactggggtaggctcctggagcaggtgggcaccatggctttgtgggccagccaaagggaaaaggaggtgcttaggagggaaagggcagtggaatggcgggagagggctgtggaaaaaagggagcgagccctggaggaggtggaaagggccatcctggagatgaagtggaaggtgagggctgagaaggaggcatgccagcgggagaaagagctgcctgcagcagtacatcccttccattttgtttaaattgggcttggagaatctattctgaaaacattgactctagacttgtagaaaagagccattttagtttcaactcaaatgtaaagcaaagtagtttggtgacattttgcttttatgtgaaatagtgcacagtatgagttaatctgagcaggtctgaattgaccaaatgcttatctacgaggttcctagagctctgctgacccttggccgaaactctaaaatgtacctattaaagataaatgcttctaccaaagtaaaactctgtgagttgtttcagggcagaatgtaccagccagtcagcgttgtttaacaaaataatcagatttttgcctagcactcggttttggtggagctgacgattttgagggctgaggctggttaggtagctggaatgtgcctatgtgaccagctcacttgcagacaccctgccggaagcagagcttaatcttcctaggactgaggtcttagcacatgtactggtggagtttccagaccaccagtatgaataaaagcttgttctgtgtgacccagcaagtggaaggacaaagaactgtgagcctcagatctttggacctttccaatgcgtctctttctcctgttattgctgcaatgtattttcttgcttatattaaagttgtttcatcagta

SEQ ID NO: 658848 - DNA, 893 bp, Homo sapiens
  misc_feature (160)..(160): n is a, c, g, or t
  misc_feature (163)..(166): n is a, c, g, or t
  misc_feature (168)..(168): n is a, c, g, or t
accggtacggcccggaattttgggatgggaaggagagccctgcaggcatggggcttccaggcttgggacacctgggcattcctgggccaggaaagcacccaagtaaacctgcaactcagaagccaaatgagacctatcccaggcaggtccgctctgcganggnnnntntcatcggcgtcaataggaggcatcggggacagccgctgcggcagcactcgagccagctcaagcccgcagctcgcagggagatccagctccgtcctgcctgcagcagcacaaccctgcacacccaccatggatgtcttcaagaagggcttctccatcgccaaggagggcgtggtgggtgcggtggtgtatgtgggagccaagaccaaggagaatgttgtacagagcgtgacctcagtggccgagaagaccaaggagcaggccaacgccgtgagcgaggctgtggtgagcagcgtcaacactgtggccaccaagaccgtggaggaggcggagaacatcgcggtcacctccggggtggtgcgcaaggaggacttgaggccatctgccccccaacaggagggtgaggcatccaaagagaaagaggaagtggcagaggaggcccagagtgggggagactagagggctacaggccagcgtggatgacctgaagagcgctcctctgccttggacaccatcccctcctagcacaaggagtgcccgccttgagtgacatgcggctgcccacgctcctgccctcgtctccctggccacccttggcctgtccacctgtgctgctgcaccaacctcactgccctccctcggccccacccaccctctggtccttctgaccccacttatgctgctgtgaattttttttttaaatgattccaaataaaacttgagcccac

SEQ ID NO: 658849 - DNA, 2233 bp, Homo sapiens
gtccagagccttgcctgcttgtgatcctggtggagaaggtggagtatggtgagctgcttgctaaggacagccaggcaacactgtgtttgtgaagatgtgctccaccttctcctctgtgcatcccagctcctcctgctgaaacagctgagcttgctttttggatttcttagactcctggcctctgagagacacctctaaggacaaactgaccttgcattgggaactttattatccagatcctcataggcttgtctactctggattgcttgttgcaacagttcttaggaagcaagattgtctcctgcaccagcatctgcctgtgtttgcttttacctactttgagcaagacccagtgaggccctagctctgttggtcctgaaaagcctgaaccctgaggctgtttctcctgcctccaaaatgcaattataggaaataagaagcacagaaacagtggaaacaaccaggaggagaaacaggaaaacctaaaattttcaatattcaaaaatacctgtcgtggtggttgatgcagaaaacactgagttcatcaaagagcttgtaattgttggaccagagaacccctttgctacaggaactgatatgttttgtctttctggcctagtcaagggaggataagtaagtatctggggcatggaaggaatgcactcttgggctgttttgcttgtatctgactcacccctgactctccagtgaagcagaaaggaagaaacctcacaccacccaggtgtggccagactttggccattattgtgaatccccaagagttaccacaggcccttcccaaatatatatttaatcttgtggttcaaataagcttttggctcacatctaagcacatcataaagaacgctgtagaagaggtgacatgatgaggcgggaagacgaggaagaggagggaacaatgatgaaggcaaaaggggacttagagatgaaggaggaggaagagattagtgagacaggagaactggttggcccttttgtgagtgctatgcccactccaatgccccacaacaagggcacccggttctctgaggcatgggaatatttccacctagctcctgctcgtgctgggcaccatcccaaccagtatgccacctgccgcctgtgtggcaggcaggtgagccgtggccctggggtcaacgtgggcaccactgcactgtggaagcatctgaaaagcatgcacagagaggagctggagaagagtggccatggtcaggctgggcagcgccaggatccaaggccccacgggccccagctccccacaggcattgagggtaactggggtaggctcctggagcaggtgggcaccatggctttgtgggccagccaaagggaaaaggaggtgcttaggagggaaagggcagtggaatggcgggagagggctgtggaaaaaagggagcgagccctggaggaggtggaaagggccatcctggagatgaagtggaaggtgagggctgagaaggaggcatgccagcgggagaaagagctgcctgcagcagtacatcccttccattttgtttaaattgggcttggagaatctattctgaaaacattgactctagacttgtagaaaagagccattttagtttcaactcaaatgtaaagcaaagtagtttggtgacattttgcttttatgtgaaatagtgcacagtatgagttaatctgagcaggtctgaattgaccaaatgcttatctacgaggttcctagagctctgctgacccttggccgaaactctaaaatgtacctattaaagataaatgcttctaccaaagtaaaactctgtgagttgtttcagggcagaatgtaccagccagtcagcgttgtttaacaaaataatcagatttttgcctagcactcggttttggtggagctgacgattttgagggctgaggctggttaggtagctggaatgtgcctatgtgaccagctcacttgcagacaccctgccggaagcagagcttaatcttcctaggactgaggtcttagcacatgtactggtggagtttccagaccaccagtatgaataaaagcttgttctgtgtgacccagcaagtggaaggacaaagaactgtgagcctcagatctttggacctttccaatgcgtctctttctcctgttattgctgcaatgtattttcttgcttatattaaagttgtttcatcagtaaaaaaaaaagtcgacgcggccgcgaatttagtagtagtaggcggccga

SEQ ID NO: 658850 - DNA, 927 bp, Homo sapiens
  misc_feature (160)..(160): n is a, c, g, or t
  misc_feature (163)..(166): n is a, c, g, or t
  misc_feature (168)..(168): n is a, c, g, or t
accggtacggcccggaattttgggatgggaaggagagccctgcaggcatggggcttccaggcttgggacacctgggcattcctgggccaggaaagcacccaagtaaacctgcaactcagaagccaaatgagacctatcccaggcaggtccgctctgcganggnnnntntcatcggcgtcaataggaggcatcggggacagccgctgcggcagcactcgagccagctcaagcccgcagctcgcagggagatccagctccgtcctgcctgcagcagcacaaccctgcacacccaccatggatgtcttcaagaagggcttctccatcgccaaggagggcgtggtgggtgcggtggaaaagaccaagcagggggtgacggaagcagctgagaagaccaaggagggggtcatgtatgtgggagccaagaccaaggagaatgttgtacagagcgtgacctcagtggccgagaagaccaaggagcaggccaacgccgtgagcgaggctgtggtgagcagcgtcaacactgtggccaccaagaccgtggaggaggcggagaacatcgcggtcacctccggggtggtgcgcaaggaggacttgaggccatctgccccccaacaggagggtgaggcatccaaagagaaagaggaagtggcagaggaggcccagagtgggggagactagagggctacaggccagcgtggatgacctgaagagcgctcctctgccttggacaccatcccctcctagcacaaggagtgcccgccttgagtgacatgcggctgcccacgctcctgccctcgtctccctggccacccttggcctgtccacctgtgctgctgcaccaacctcactgccctccctcggccccacccaccctcgtcatctgacgcactaggctgcgggattatatgaatcaataatgacagtacg

SEQ ID NO: 658851 - DNA, 259 bp, Homo sapiens
ttcgactcgttatagatggtcagacccagatgactcatgcctgtgccacgatcctacctcctcaggggtggcaaaacccagatcctcatacctgtcatgagatcctacctcctcagatactgacagagccagatcctcataccagggccagatcctacataaacagaccctcgaagccacagaccctacactaccaagggccagatcctaccacctcaaatgggggacaaacccagaatacctcataacagggaacaga

SEQ ID NO: 658852 - DNA, 772 bp, Homo sapiens
ctcgagtactttgtttttcttttttaaaggttggagggggaatgctggaaattgtaatggggtatggaaacttttcatataagtaatgctagggtgagtggtaggaagttttttcataggaggtgtatgattgggccgtagcggaatcgggggtatgctgtccgatttcataagaccagggaggttagaagtagggtctgggtgacaaaatatgttggtgtagagttcaggggagagtgcgtcatattgttgtccctaggaagatggtagtgggtagagggtgtttataataataatgttaggtgtatccggctatgaagaatagggcgaatgggcgcctgcggccgatatccgagtgttgaacccgtgagaactagtttcggactctcccctttcggcaaggtcgaagggggttcggggtgggtcctcgttgcataggtggtggaggatacacgtcattttatgtggccagggggtccattgagtggcgcggagttacatcagagggtgatccgtggctgtccggtgcacacggggtggcgcagtgtcccagggagccctcctttttcagcccatcgtcgatcgtacgaatgctggccagggcgtgacttcatatgagattcgttggggctacctgctcgcagttgcgccgatcagggcgctcacttgggagttggatcgctcccccctgatccagaggcttggggtcacccgggctaggcccacacggttggcctccgcatacactgggggggccctacgtctgagcgtc

SEQ ID NO: 658853 - DNA, 123 bp, Homo sapiens
  misc_feature (104)..(104): n is a, c, g, or t
tccaggagttacaggtagacctaacactgtagttacactatatagcagtgaccaaaaagggctaatatatactacgaatagtttaaattacagacataatgtanatatatacctatatgtaga

SEQ ID NO: 658854 - DNA, 469 bp, Homo sapiens
  misc_feature (6)..(6): n is a, c, g, or t
  misc_feature (240)..(240): n is a, c, g, or t
agtttntgtcactctttagtttttaagttaaagcatactgatagactttttcctctaaaaagccattccactccagattttaccctgggggaatattctacaatactgcttacttttctctataaaaactcatcaataaaatcatgaaagggcactgagttttgtaaaatcaggacccctaaatgtttaattggtaaataagtttccagataattattataagctttgccgtggaaagtntgttggttttttttctcactaagttaagtcacctgcttctgaaatacctctgaatgtaagattatgcagttctttccaaggcataaatatttaacctgtaatatgctacctgaagaagattccaataaagctgctccacctacccctgtttaggtttaaatactagggtttgttctatatttaaaacatgcattttggatgattaaagaatgccgggttttcgttgcca

SEQ ID NO: 658855 - DNA, 293 bp, Homo sapiens
tgtgagtgagccgagattgtgccactgcactttagcctgggtgatagagagagaatcagtctcaaaaaaataaagaaacaagcaagtcagtccaggctcttagacaattcaccatgagttttgccaaattcagtccatatgcagaatggtggtacacatgtggatttggtgtttcagggcccttgtgcaagccatcaaacagggcaaacctgccacccttgcaaaatgtggtaactaaagagcttcttatcaataaggggcatctatacaggtcaagatttcacatgtgacta

SEQ ID NO: 658856 - DNA, 377 bp, Homo sapiens
  misc_feature (44)..(44): n is a, c, g, or t
  misc_feature (61)..(61): n is a, c, g, or t
  misc_feature (72)..(72): n is a, c, g, or t
  misc_feature (74)..(75): n is a, c, g, or t
  misc_feature (167)..(167): n is a, c, g, or t
  misc_feature (203)..(203): n is a, c, g, or t
  misc_feature (214)..(214): n is a, c, g, or t
  misc_feature (220)..(220): n is a, c, g, or t
  misc_feature (283)..(283): n is a, c, g, or t
  misc_feature (338)..(338): n is a, c, g, or t
  misc_feature (353)..(353): n is a, c, g, or t
  misc_feature (373)..(373): n is a, c, g, or t
atctccccggggccgctctccggccctcgccctgtccgccgccnacgccgccgccgccaanatcgccaagcnanncccgcgcgccgctcttctcccgctgctgctgctgctgctggcggcgcccgcctcggcgccatgtcccgggccggccgctcggcgcctttggncgccgaggtgcccaaacacgctgcgaaccggcgcgntgcccgccgcnaccggnaccatgcgaaggcggccgggcccgggcagcgtgcggctgctgcgaagtgtgcggcgcgcccgnaggcgccgcgtgcggcctgccagcaggcccgtgcggcgcagggctgccatgcgtngtgcccttcgttttncaaaccatcataaacatttncttc

SEQ ID NO: 658857 - DNA, 418 bp, Homo sapiens
  misc_feature (284)..(284): n is a, c, g, or t
  misc_feature (286)..(286): n is a, c, g, or t
  misc_feature (290)..(290): n is a, c, g, or t
  misc_feature (353)..(353): n is a, c, g, or t
  misc_feature (362)..(362): n is a, c, g, or t
  misc_feature (411)..(411): n is a, c, g, or t
  misc_feature (418)..(418): n is a, c, g, or t
gcaacggcctgcagagcaacatgcccaagttttattgtgactactgcgatacatacctcacccatgactctccatctgtgagaaagacacactgcagtggaaggaaacacaaagagaatgtgaaagactattatcagaaatggatggaagagcaggctcagagcctgattgacaaaacaacggctgcatttcaacaagggatcctctacttcattctctgctcctctctgcaggggccgatgatccactcccccagctttccggtctctcgcctgtatgatgcngnaccnatatgggggcctccatgatgccatgatggcctctctctggatatgcagtggactgtctgatangcgccatgnaggcaatgcatatgctggcccatgtctctgccgccatatgtccatcgcngtgctcn

SEQ ID NO: 658858 - DNA, 104 bp, Homo sapiens
atgcttactaatgctgtacctaatgcaactcgtgatcgccaaatccagcagccatttaggtaacagccattaaggtaacagccatttaggtacagccatttagg

SEQ ID NO: 658859 - DNA, 988 bp, Homo sapiens
gcaaacctgtaccatcttgtgcttacccatttgttagaccacacatctcgttaccatgcttctaagaagagggaatgtgaatttcgtagtctgaacctcatacatcagaacatgtggtctttatacatgtagcgtgaattatgtccactagagtgagtaacatggtgtgtctataagtataataactgcatgttacatcatattgtggtaacttgaggtttagtagctgactttattatcacaacattagttggtaagactttcatcgataagtgtacataattatccgagtgatcacgaaggaccattactcttagcgcaccaacactatgtactcttctgctagtagacattaaacacgcatacggatgccacgagaccagagtggtgcaagttgcgcatgccacagctcatgtaaagttcaaccaagcacgtgttagaaatcggccattatggatgggtcggcatacacatttgacaaatcagagagaggattcggaaagagcacagcccatggactgacatggatggatgacaagccaccatcatactacataaaaatagtaacgagaggaatattacgccaggagcagttaactggcttagctcacgtcttggttacatctccaagccttactcgcggcaggtctagaacgacgaggaaggaagtctgggtttgaatcgcgcgtggcagagtagtaatgtgtccagatgaggactagagatcgattgccatctgactctgccaaaactggagtcgagtagcagccagaaatctcatctgtcacattattccaactacacataaaagatactaatagagctcagtaaagggtgccccctcgtaaggtgagatgatgttacgaagagaggctcggatgttcacgctcagccccaggtcctggcctggaatctcattctctgacttggccctcccttgacaggttcccacagattttcttcccccttttaagtatgctatcacaga

SEQ ID NO: 658860 - DNA, 359 bp, Homo sapiens
caggtggcgcccgaaaatgcgccgctctctgtaggaaaagatgtcgccacacgttgtgggtaagaagagaaattcgttgggccaccagcagcgggggcggtcaaacacagacgtggagagcacccacaccacctcgtggggggatgcgctcagcggtggggcgacagacataccaacgtgggagcgcgcacacggggatcacacacaaccgctctgccggcgcggcacacacaggctgggggaagaccccgtgttgcctagccgagaagaaacgacaagagagcaccgccgggggacacagggggagcagtgtcccgccggccgtcgggcaactggagatccccgcccaacattgtgcg

SEQ ID NO: 658861 - DNA, 123 bp, Homo sapiens
gatctgcgagggcatggcctatctgcacgcgcagcacgacatccccctcttggtttcatcctggagcagggagcctcctgctccctgctcagtgaacagaagggagtaggctcacaaaacggg

SEQ ID NO: 658862 - DNA, 204 bp, Homo sapiens
gaggcagtgataggtgagcaggttgcatacagggtcagggcagtggagatcggaaacacgagtttcagatttgatgtcattgctatgacaggtcaactctgtggaatcgatacctcgttgctgtgctgcggggagctgactgggggggagcccctcagtaggatcgaatggacgtatatgccagggtacgagctgaatcgtatc

SEQ ID NO: 658863 - DNA, 957 bp, Homo sapiens
  misc_feature (279)..(279): n is a, c, g, or t
ctatcatacagtaaaggccacacccgatgacggcctaacagggagccctctcacccctcctaatgacctcgcggtctagccatgtgagtgcactgccaatcctataccgctccctctgtacgtaggcctactaatctcaaccacaatcatagagcgcaagtaataccaattgatggcggcgtaggtgatcagcagagacatgcgcataaccaaggtcccacccacgacgctcaactggtccgaatcaaggtctacgtatacggagagaatccatatgtnattacgctcaaggaagatgtgttgctgccgtcgaggtctgctgcatgagtccgtgatacacaactcctagattagcctctcttagcgcacgcacaaatttgagtggcggccgctggcacctcatatcggggaatacactcactggtggaaaatgggcctgagatgttgtgctacctaaagcaaatcggggataactgcgctgtctgctgtctccatacaagtgtgaactacaccatagtttactagatgaagagcgacagcgggttgatgtgagtgagctgctgattaccatgacactggggtcgctcatttttgcctcctgtcactgctttgaaatagcccgaggacgacccttcaccattatcggacggatctccggtccacggtacaggtgtcacagggttccacggaatgtcggccacgtctgtgttaaatctggctgctgttggtaagccgcagaaatctgcaagcaggaccgcacatccggcgaagtgaaccgggggattctgccaatgggaaggggcgccaacgggggtccccgggaggggtcccaggagtggaaaacccgtgggcgcttcacacacgaagccggggcgccagaaagagccccgcctaacgaaaccgccaccaagcgcgggacacacaccgggcgcacacgcaacaagtgtgatacgaaaa

SEQ ID NO: 658864 - DNA, 147 bp, Homo sapiens
ctcgagctctgtacctgcagctctctctgatgacatgagccctccaggtgacctcagccctcccaggtgactgtcttccctggtctagtgagacgacggctgcacactcacgacgacgacggctgccggggactcctctacgacgtc

SEQ ID NO: 658865 - DNA, 108 bp, Homo sapiens
  misc_feature (1)..(1): n is a, c, g, or t
nggtttcaaggcttcacagaatgagttaggaagaattcccttctcttttatttttggaatagttgaggagaatggtattcttggtaagttggtagacaaagggaaaca

SEQ ID NO: 658866 - DNA, 136 bp, Homo sapiens
ggttaggatacgtgggagaagaaagagaggacgtaagttaatttatgccttttggggttgaggtgatgatggaggtggagatttggtgctgtgacaattgttttaggtaatagcttttctagccggtgcaggtgtg

SEQ ID NO: 658867 - DNA, 103 bp, Homo sapiens
gcggccgcctactactactactactgctcgaattcaagcttctaacgatgtacggggacatggaaaaatggttgatggaaaataaacatcagtttccaaaaaa

SEQ ID NO: 658868 - DNA, 408 bp, Homo sapiens
  misc_feature (295)..(295): n is a, c, g, or t
  misc_feature (383)..(383): n is a, c, g, or t
tgttgggacagacctgtgagaactgacaagaccaggagtccctggccttagctaataatcgaatcctcagtgtccccagtccacaggccttgtggcaaacatggtggaagccctcctgtgtgcaacagtaactggggtcctgctgtatagggtgccagggtgcgaggagcaggcagtaaggacacagacggggatcccagtgggcagagatgcctaggtcctgccggttggggtaggatcttgcagtagcttagggggctttaatcctccaagccccatacacctgccttctttntattttattttagtttttagcaatagggtcaccctctgtcacccaggctggagtgcagtggcgtgatcgtagttcactgcagcctcanactcctagactcaagtcttttgagt

SEQ ID NO: 658869 - DNA, 123 bp, Homo sapiens
tatctgcaatgggaaaggcgggcagagaaaggggaatgacaaggcatacgggagagttacaagcatgccaactccaccattacccctcctaagagaggctggagagaaagccacatagacatt

SEQ ID NO: 658870 - DNA, 245 bp, Homo sapiens
tcttcagcttaccgatctgcaatgcagctgaaaagcaaccaaattatattttgctgaaactagatgttttacatgagaaatactgtatgtgtgtctaagatgtcagttatataaatctgtattcagatttcattctttgttagctcactttatgatttgtatttatttactgtatagactaaatatattctattgacatgtatgtcaactcattacttaatacctgtgaacagtattgagaaaac

SEQ ID NO: 658871 - DNA, 414 bp, Homo sapiens
aagtttcagtaaatcatcaacacagggactggagcgctggagagtgcaccgcagttctcagccacacccacgaggggcagggggctcagaagccacacacagtgacctggagctgcagccaggcactgggtacggggtttactaggctacaatctctactcctgaactggaaaatgttcacaataaataggtcaggaaaaaaaggaatgatttcactggttaatgtgtactcataggcactgcccacacaacggtgtgttttccactttcagtacagtcccacctttcttttcctctgctattttcttcagccagccacagggttaagagcattagctctggctttgaatcccagctgacctcaggaaaatttcttatctgtgactcagttctcccatctgagtgagctccctg

SEQ ID NO: 658872 - DNA, 87 bp, Homo sapiens
aaaaccccgggttttttggttttttttttggggggtttgggggggttgggtttaaaaccatttattaaggcccggaggttttttgga

SEQ ID NO: 658873 - DNA, 940 bp, Homo sapiens
agctgccatgtgaactacctcatgctgtacttcccccaatgtaccacagaggcctgctcttgacacagaaagccaatggtgcctcacgctatctttaaccatctggttgtttcccaataccaaaaatggagtctcttgcacaacaatgcaagtaatattcaaccaagcattacagatatattcatctcccaacataggactctacataattcgttgcctagtgtaaaacccctggactacaaaagtgtttggttgccccgatggcttgcatcggtgcataacgtcagtgatccattgttgtccctgcttaggcttatcgcaacactactagcacaccatagcgtgttgccaccttctccttggcttgtcccaaaactaaggaattcataaaagagaccaaaacccagagaaattcaaacgcccatatttaatttaatttctctttgggccccttgtgaaaagccacattttctgtggagaaccctttaagccccccaacttataatttataattgccgttggaccccccaaggaagttggttcccgccaaagtgggcgttctccaatttctccacacgctattatatataaaacagaaaaatatttcccagttttgcccctttagatgacacgcgataagtaggcacgaaccaccggggaactcaccggttttggattgccctctgtatgagggccgcgttagaagcaacagggctttatataacaggcaggcacccgccatgtgtgggttcttacacttacaaaagtacccccattataaagctcttgggctacaacattaatctttcaggattcaggaggttcccaaaattgtggaaagagaccgccattcaaaacattttcgctacgatatttacaacagggttttcccccacttcaatagcgcccccatctgtagagtggcaacatagatttccct

SEQ ID NO: 658874 - DNA, 266 bp, Homo sapiens
atatgtgttcccgaaaccagccgtcaggaggctgaggcaagagaattgcttgaacccgggaggtggaggttgcagtgagccgagatggcttcattgcactcaagcttgggtgacaagagtgaaattccatctcaaaaaaaaaaaaaaaaaaaaagacacttgcaaagtggcaccagatattagaccttgaagatattttctcaaaaaaaatctcattccgggttggccgttatctcgaaggggggagctcctcttaaaattcaccc

SEQ ID NO: 658875 - DNA, 182 bp, Homo sapiens
aaaagcaacgcgtgcgtcacactgagtgaagtcttcctgggacataatctttcttgatggcaggcactaccagacaacgtcaggaagtgctcagccattgtggtgtacaccaaggtcgaccacagcagctgcaacctcagacaatgaaggtatggtcattcggacgtgtgcagagggatcct

SEQ ID NO: 658876 - DNA, 148 bp, Homo sapiens
tacgggtgttttccggtatccttaattagcatgggtgttgcgctgcgggcttcctgaccgatttgttcctcggcgagagcgcacagcggtgagtcaggcgcaggacgcgtgcggaccacttatcctcattcccttacgaccgggcctt

SEQ ID NO: 658877 - DNA, 831 bp, Homo sapiens
aatgttgaatgaatgatgtgttttcttgtgtaaaatggattaccacctttcctgctttcttgagccaactatcacttttcgtcaggttcatcattatatccagcagttaatgtcctatgtggcagttcagtgatgcccttaggggcttggaggtgctgtactctgaattcctttttcagcttttcatgtgtcctgttcttttccctgcctgctggccaagtgcttgatgtgtaatcaatctgctgtggttctgtagcatcctccctgccttcttatttccttctcctaatctgcagtgggctgaaataagatcacctagcatgattgggataagactggtaactaagggctagaaatctctgatggaggtcctaaacggctctctaatgggaacaccgtgtagatgcatgtgcacatggacctggtattggtagaggcctttaaacttcctgtcttcctgctcaaggaaaggtcagataaccatctcctgggcaggagcagggggtccatcagtcctgcagaggccatgtcaggagtagaaggttcatgacattggattctataaacaaaagaaataagaaactgtgtctgttctccagtggaactccaccaattatttgggcaaacatgtgaatgctccatccaataggtattgagtgtagtaaaacttagcatttttgtagggcatttgaaaaggggtggcttacccaaaaggaaaggtggtaacacgtggcacaactggcaattttggggacccattgaagggataaatgaagggacatatttgagggggcctaagagaacagaaaatggggaacaaattggcaagga

SEQ ID NO: 658878 - DNA, 188 bp, Homo sapiens
caggcccggccggtaagcagacatggccggtgcaagccgaagcgggccgctagccccggtggccgaggagaaggaagaggcgcgggagaagataatggccgccaagcgcgcggacggcggcgccggcagcgagggactagggcgtgaccctgcaggggaacatcacgctactcaagaggcgtggcgtc

SEQ ID NO: 658879 - DNA, 283 bp, Homo sapiens
gcatttcaagtatcccgtgatgatccagcgggctgtctacctgcctcccaaggatcccggctactgaacagaactgaaggaggaatgtgatggggaacaccagtatccagatgatgaagtttggaagaaactccttcctgctcaagaaaattaagtgctcagccccaacaactgttttctttctgaagtgaaagggcttaaaatttcttggaaatagctgtacgaaaatggattaaaaagatcctaccgatcaagatgagttcagctagaagtcataccaccc

SEQ ID NO: 658880 - DNA, 272 bp, Homo sapiens
  misc_feature (272)..(272): n is a, c, g, or t
gttactttatcgcctgcgatcactctaccccacgtctctattctcctgtgctcactctacatttggttttctcacatagcattctaatgtactagctatacatcgccaccatctactcttgtcacttctgtctcacagctgttactgtctctcatcccacgacatatatgtactgctatcctagacgctgagcattaatcgaatctatactgaattgtctttctttgacatgtttacgatcgagcttgatgttgagtatctgtgtccgtccn

SEQ ID NO: 658881 - DNA, 104 bp, Homo sapiens
ttctgagcataacatctatgaaatcacaggactgatgtgtcatgggtctgtgcaccacctaaaaactgcaatagcaaactgggatggatctatgagtctgccac

SEQ ID NO: 658882 - DNA, 637 bp, Homo sapiens
tcacgtggacactatcagtccctcattctgaaggttcccttctcgccacaggacagaggtcgacattcacacctcaaggtctacaatatcaggaccaccctgtcttgtggacacggaggatgattgaggatgcaagttcgaagtcacagcgaatcagcatcaccttcgcccctgtccagtacccccaagctaatctgagactccaacaggcaggtcacagcggatcaacccccgtgccagcacaaaaagagcgggcaccagtatctgggacccaggagaaaaacaaaattaggcctcgtggaccgagagattcaagctattatagtgaaaatagaagccagttgaagtgatgcttctccactcggatagggtcaggctctttagcaactggccgtccggttacatggcacggagatgttgcagtaaagatcctaaaggttgtcgacccaaccccagagcaattccaggccttcaggaatgaggtggctgttctgcgcaaaacacggcatgtgaacattctgcttttcatggggtacatgacaaaggacaacctggcaattgtgacccagtggtgcgagggcagcagcctctacaaacacctgcatgtccaggagaccaagttcagatgtccagctaa

SEQ ID NO: 658883 - DNA, 430 bp, Homo sapiens
tatatagcagtgctctccgagcaagtattgaatgagttcatacgtaatggactatgatcattttctgtccatgtaatctattactatatgcaggtttaattggagcaataagattacttctttactgtactatttagagcgaatcctttacagtttttgataagaactgtgacatttgttctttgtggataaaactcctgaaaataactcacaaggtcagtgctgcactctggcacatgtaggttgtaaagagggtcagttggttggttggttggctggttgattggttggttggtttagaacactaatgtacttgtaatgaaccaaactctggtcttacagtcttaaataccacctcatggggctgtttactctgttagcaatgaaacctgtgccaggtgtagtggctcacgcctgtagtcctggcact

SEQ ID NO: 658884 - DNA, 1418 bp, Homo sapiens
  misc_feature (278)..(278): n is a, c, g, or t
  misc_feature (349)..(349): n is a, c, g, or t
  misc_feature (353)..(354): n is a, c, g, or t
  misc_feature (358)..(358): n is a, c, g, or t
  misc_feature (362)..(362): n is a, c, g, or t
  misc_feature (366)..(366): n is a, c, g, or t
  misc_feature (375)..(375): n is a, c, g, or t
  misc_feature (378)..(378): n is a, c, g, or t
  misc_feature (380)..(380): n is a, c, g, or t
  misc_feature (387)..(387): n is a, c, g, or t
  misc_feature (396)..(396): n is a, c, g, or t
  misc_feature (407)..(407): n is a, c, g, or t
  misc_feature (414)..(415): n is a, c, g, or t
  misc_feature (419)..(419): n is a, c, g, or t
  misc_feature (441)..(441): n is a, c, g, or t
  misc_feature (487)..(487): n is a, c, g, or t
  misc_feature (1417)..(1418): n is a, c, g, or t
ccaagcagagagagagacaattacgccgcagagctctccacccagaacgagccatggacaagcacagtgacagcgaagaggagcttgctgccttctgtcctcagctggacgattctactgttgccagggcaactggccatcacagactctgagcactcagacgctgaagtctcctgtacagacaatggcacattcaatctttcaaggggccaaacacctctaacggaaggctctgaagacctagatggtcacagtgatccagaggaatcctttgccanagaccttccagacttcccttccattaatatggatcctgctggcctggatgatgaggacgacactagcattnggcnntgcnccanggcnttgatgtanccngngtctccngaccagggngctgaggagcncccaggnncccnacctgccagccgggacgaggcntgcgctgccggagctcctgcttggtgctcttcctgtaggatccaanctctaccagtcaaaccttgtcctagcctaggtctcccatgggtgatgattcaggcttggccttgtcatggggcctccgcgaaccaggccgctttctggagcacgctgcccagagagcaacgagaggcttcctccggtcccccagttcagacctggacactgatgctgagggggatgactttgaacttctggaccgagtcggagctgagtcaggctggaccctaggcagtgctaggagccactgaggcagagactccttttgggagtcactgtggtttaggtttttttctccccatcccacttaaggtgatggggcaagggaagaactcagctcccctcccctgaattatatttgtatgctgggtggcctggctgatgctcagaggcctccttagagaggacactcactcccctcccaccagctggatgcccatttctgagctcaagtcactgaagtgagagtgtgctccccaagggagggcttctctccatcaggatgggtactgttgggggaacaaaatagtcagggctattggttcccttttgagaggtgctgctgaagcactaaaagatgagtgccagggggcctcacttgaaagagcattgctggcttctacttattcgctctctagaggccccaaggtcggcagcagctggacaggtacctggccccaccttcttcagagcaaggtcgccttgttggctagatggcgggtagcgaggagataggatctacaaaggttgcccacggcggaaaggggtacgacgaagcactaaggaagcgagcggccgagaaacacgcagcatatccgcgcgtgcaacacgagcaacacacagggcgcaaccaacacagacggccacgaggagttacaacactagcgcaggtagtgagcgcggctatgatcggtagcgttctgaggttttcatggcnn

SEQ ID NO: 658885 - DNA, 134 bp, Homo sapiens
cctgagcgacgtgttgcatgacccgctcagaactgatgagatcaatgggaatgttcaagcgaaaagcgagcaggacggaccttccaagatgtgccagcttcctgggatctcactgcagcagagcgtgaggccca

SEQ ID NO: 658886 - DNA, 881 bp, Homo sapiens
agcccagaagtttagggaagagctgcgagaaatacagacatctcaaccagaaggaggatgtggcctatgcagtcaactcctgggaccactagttattctcagggtactgcgtgctgaaagctgggaaatccatgctacaattgagtgtggcgagcatggttgatccagatggggctgtaagcagtgggaaccttgtcacatttgttctctaccagatgcggtacaaccaggctgtggaggtacgtgctctccatctaacccagagtacagaaggctgtgggctcctcagagaaaatatttgagtacctggaccggacccctcgctggccaccctaggggtctgtcgactcccttacagctggagggccgtggtccagttccaagatgtctccttggcctagccaaaacgcccagatgtctaagtgctacaggggctgacattcaccctacgccctggcgaggtgacggcgctggtgggacccaatgggtctgggaagagcacagtggctgccctgctgcagaatctgtaccagcccaccgggggacagctgctgtgggatgggaagccccttccccaatatgagcaccggtatctgcacagagcaggtggctgcagtgggacaagagccacaggtatacggacagaaggtctttcacgaacactcatggctatggtctgagccagaaggccaactatggaggacatcctggctgctgccgtaaaggctgcgggaccataggtccaatctctgggactccctcaggggctatgacacagacggtagaccaaaggctgggaagcaagtagcaaggagaccagagaaaaggaaaaggcctatggcccaagacatggaacacgcgaacccgggcgaacatacacg

SEQ ID NO: 658887 - DNA, 124 bp, Homo sapiens
  misc_feature (13)..(13): n is a, c, g, or t
aattccattccangcgtacaatgccgttcgcagctatattcaattccattccagcgtagaccggagtaatccaggtcggtttctatctacttcaaattcctcccggtacgctggaatggaatgg

SEQ ID NO: 658888 - DNA, 114 bp, Homo sapiens
gagtcaacttactttctaagggtccaagtcccagagatccatagtcgtcaaacgcttgagagtatctttcttcccagccagtcagtggcttgagccctatcttccactacaaat

SEQ ID NO: 658889 - DNA, 445 bp, Homo sapiens
ctccgggaaaagtttcaccccgggtggaaccttaacttttttcaatttttcaatgcggtaagctagataaagcactcttgcactactcggcctttggcaagtacctgacaagaatcttaagggtttattaagaactctttattttcttcataccctgttctctgcagtgctttctaacagcttctgggtgcagattttcttcggcatcctttgcactcagcttattaccaggtaggtagtgcttaagaaaagtcatggaggactaaagcctaagtccttttcacttttcctccatctgaaggtaggtgagttcatcctcttcatagtaatgctgttttacccaagactttatagcagatggacccagaaagaatttctgctattgtgttcactacaacaggatagggacatcagacagccccagaaacccccttccagatctgat

SEQ ID NO: 658890 - DNA, 195 bp, Homo sapiens
tctcatgctctcagcccacctgtggtgggccacagtgactggttgagtcatgaatcgagggtctgtgtggagtcggagatgcaaaagtctaagaaaacatctcagaaatgctaaggttaggtttacaatagtgatgttatctaggggaatcattgggggaaattgcaagtctgtgttacctccagcacaagaaca

SEQ ID NO: 658891 - DNA, 507 bp, Homo sapiens
cagtctcaacgttgatttcgacgcacagtctattgtagtccgactcgcatcagtccgaaatgggtacatggcccctccagcatgttccaacctcctgccaccttaattcttcagctagggcagcgaaagaggtacttgatcacatggttgccacgttcgactacgatgcacgcatcagtagtccagtatgtcacaggtccagtggcagagtaccaacatggacacttcgtgtatgatctaggtaggtatcagaggtgatcggcgatcatagagcgatgtagttctagatccattgaaacgagctgtagacagtagcatgcagtcccgctacgtgtaccagcatccccagcgtatggcattccatgcatttgctcgtgaggcatccacggtgcttcaagctatcggtttacttgtacctatgcctcatctttcttcttgtgcgcttcagcgtgcgcattagcttcttcatccacatggctctcatcgctcataggtttccacaggcat

SEQ ID NO: 658892 - DNA, 406 bp, Homo sapiens
  misc_feature (2)..(2): n is a, c, g, or t
anagcttcttaacttctatactgaccattctgttcactcatgctctataccttcatcactatatagcgttcaatatctgtcatcttggcactcctctctctggcttcaatcttattggcccatcgtgtggctgcccatggtgtagtgatgtatgccctctgccatgctggtcggacatacttctggtgggcactgtgcgttaacataagcatgtaatcagtaagctgcatgcacttgataggcatggcctgtctcctcacttgagcgcatggtccatagcccagagccctgttctgatcatataccatccactatcgcgacctatcgtacggcatgaggtacaaaggagacataggtcacgcgcacgctctacacggagcgtgtgcacaacatggtggtctcgtgc

SEQ ID NO: 658893 - DNA, 125 bp, Homo sapiens
gggtggtcctacttcgagggacgcatcattgtaataatagccattttatgcacagatgaggtgattcccacacttcttttcgcagatgtttcattatctgaatggtgtctgaatggtcgtgaagt

SEQ ID NO: 658894 - DNA, 119 bp, Homo sapiens
tactctctggcactgggtcctgcaaactctggaccccttggatctcctttatggaccctcaagcaatgtctcctcaactacagggagttgccaggttggtaccatgggttagctgcccc

SEQ ID NO: 658895 - DNA, 153 bp, Homo sapiens
cagatgagcgccggtcgtaccataaccagttgggctggtgttaaaatagtcgagactacgactcctcagagaactatccgggctacgtgcatatacatgactaactggactggtaataggtactatagcaggaatcagtaaacaagtcagtaa

SEQ ID NO: 658896 - DNA, 610 bp, Homo sapiens
agcggcttctgccaactgcactccaggctgggtgacagaatgagactgtctcaaaaaaaaaaaatcagactgggtgcaagtggctcacccgtgtaatcccaggactttgggaggccgaggccaggcggctcacgaggtcagcacagtgtgcggcttgacagtcactggggccgagtaaagatggccacccatcatgaggcatgttgaaccaggcaccggccatctgctgcagccagagtcctctggattgcctgtgcttgatcaagggggctgacccggcggaaccgcgttcgagggccttgatggccacctcgaatgccagcgccagtatttctgggcccacgcgacatttccaacacccttcaacctggcaatcacaagctggcaacagtgcgcatgtttgcagcacacctccgttccgtcactttcttaagggcgcacgcgaccttcttgcacacccgatactagccctccaagctgactggtgtgcctgcgcgccgcagtgtcttttcgcgccctaggcgctcatgtccttctgggccgctggcctttgcacaatgtgcccctcggtggccccatccgggcccttcccccgtcccgcgggctccta

SEQ ID NO: 658897 - DNA, 178 bp, Homo sapiens
tcagtcactttcaaagaaaaacttagatgatttcaggcttgcacttagtgcagacttaactgcagtcagaggatccctcgccttgcttctgtgtgcctggctcagtggcccatctttgctctgtgaggagctgggttaatggcagtgaggctgggttagtcagggcctccgtgtcttc

SEQ ID NO: 658898 - DNA, 710 bp, Homo sapiens
tattcccgagtttaaggcaaaacaggggtaacttccccttaatgcttaaagagcggacccttgggcatcacctgaccaggccccgaagggcttgaaaaaattcctcttcataacaaaatattaacctggcaagtcagtaacaataccgagtattgtttggggcctcctcgggtagcttggataaagaagaccagtggctttttttcaaagaaaggtggaatgatgcttggcatacaaggataatcttgctcactctcaaacaaggccctggttggaggtcgggaactcataggtggagcctcacctgccctaactgaaaacgacagtttccctagatgcttttggtgtgtcaggatggtagcaactgctctgtgaacactaatggacagtctgcccttatgtggaggtcataagaagccacccggggtgttgaaagaagagaccttttgaccctgcagtcgtggaggttaaatgcatgaatggtctgtagagcaccgagaacggcatatgctttctggcattgggaatgaccaattacgctatgaaaatggtaatggttgtatttgaggacatagatcaccgtctatatgccgaaatgaacgttaagttctgatttacaacccaaacgtcagttttaaagggcgggtcgagactaccttgtaaaaagtcattccttcccccaaagttatgcaacacatttatgctcataa

SEQ ID NO: 658899 - DNA, 414 bp, Homo sapiens
agagtcgctgagcctggggggcggaggtgcaggagccgagatcgcgccacgcacttcagcctggcaacagagcgagactgcgtctcaaaaaaaaaaaaaaaaggaaaatccaaccctatacctcaaacaaggggtaaatatctaaaggataaactccgtttaaaagatgccacaggagtgaaatcatggagggtatgggtctttcgggtgtcttattgggcttacttgatatcctcaggttaatccggggtgggggcaaatgataggggttccatctcttttataaagagcggaatagtactccatgggtgtatatataccacatttttcttttttctggaggggaaactcggggggcccaaaaattactaaactaggggaaaagacaagctcggaagggctcaggacaaaccg

SEQ ID NO: 658900 - DNA, 132 bp, Homo sapiens
cctcgctgaccctataaaggcacgtgtggttctcacgtataggccttctgatgggaacttgtgtgttaagagtaacagatgatttcgttagaccgtgtcttgctctattgctcaggctggagtgcagtggcc

SEQ ID NO: 658901 - DNA, 107 bp, Homo sapiens
ctgccctatattacttggggctttcaaaggagaagttctgaaactctgcccatcggggggtgatcgctggaggtgcgtggagctgcggcttctctggcctgggcagg

SEQ ID NO: 658902 - DNA, 128 bp, Homo sapiens
aggtgtcgtgaaactaccctaaagccaaatgggaaggaaagactcatatcaacattgtcgtcattggacacggagattcgggccaagcccaccattactggccatctgatctataaatgcgggtccat

SEQ ID NO: 658903 - DNA, 646 bp, Homo sapiens
  misc_feature (333)..(333): n is a, c, g, or t
  misc_feature (355)..(355): n is a, c, g, or t
  misc_feature (478)..(478): n is a, c, g, or t
cgggtgtagtggctcacgcttgtaatcccagcactttgggaggctgaggcggtgtggatcgcctgaggtcagcagttcgagaccagcctggccaacacagtgaaaccctgtctctactaaaaatacaaaaaattagctgagcgtggtggcgggcgtaatctcagctacttggaaggctgaggcatgagaatcacttgagcctgggaggcggaggttgcagtgagcaacctgcaccactgcactatagcctgggtgacagagtgaaactccgtcttgaaaaaaaaacattataaaacaaaaacgtgttatgaaactattgaaaccaaaagacangaatgaatatttaaagcagcangagaaaactgatgcctcaagtacaaaagatcctaaacgagattagcagcagatttctcctcagaaacctccaaaagcagtaggataacatatataagtcctaaagggaaatacttgcacccangaattctacatctgaaaatactatccaagaaaatgaagagaattacgacatttccagaataagactaagggagttgctaactactaggaccagatctaccaggaaatggctaagggaggcctttcaggctaaaatgaagggaccaccagacagtagctaaggggcttt

SEQ ID NO: 658904 - DNA, 459 bp, Homo sapiens
gtccctgactttcatttgctgtgaaagttaggttgatgggtttaagaaacattaatggtgctgaatactctggcctgatggtttctactaaagtgcttgattcttgttgttcctctgacaggagagatgatttcttttcagaattaaaattcctccatgagacatacagaggttctcttggttcctgatgaaggttgatattatcccataacagctgaatatacacaagtttgctatcctggggacagagatgacagaggaagctgtacaccttcattacaatgttcagatgtgaggataagtcctggcaagttactaggaaggtccaaacgtctgaaataccaaacgaggttccagaaaatgattggatgttgattgatgaaagaagatgtatgaatcacctgatcaccttcattttctagcaaagattcaagttctttacggagtactagaggactc

SEQ ID NO: 658905 - DNA, 633 bp, Homo sapiens
tggcattgtccagactccttaaaaaccccatcctcaaacctctgaggaggctaatttgaggtttcctcccatcttctcattcagctaccctgagatgattaaactctttctctgctgcaactcctgctgtttcagtgtgttggtctgttactgcacgatgggtttaagagcatcctaagagctccctactcctcacacactgcctggcacatagcaggggctccatgatctgtcatccatcatccatcacgatgtggggaatgacagaagacagcaaagtacgccccactcttcatggggtttatgaagaagaaaagaacttggggctgggcatggtggctcatgcctgtaatcccaacactttgggaggttgaggcagatggatcgcttgagcctaggagtctgagaccagcctgggcaacatggtgaaaccctgtctctactcccccacaaaaaaaacctgttgggcatgatggtgcatgcctgtggtcacagctacttgggagactgatgtgtgaggataacttgagctctgggaggcagaggttgcaatgagctgagatctctcaactgcactccagacctgtctcaaaaaaaggaaaagaaaagaaaagaacttggtattgcagagag

SEQ ID NO: 658906 - DNA, 346 bp, Homo sapiens
gctagatagagttcaggtccacggaagtgagatgcgaacctgggactgctttagtaggagcctatgaaatggaatgcgatcagaactgtctgcttaagaacaccatggtgttgatcgccaggggaattatcccgaggagtgctcactttgggagcatatgcataactggaaggactgagagagatactcatgcagtaagtgaagaatagcgcattaacagtgacagatagcttatacgcactgatgcaccagcatgtacacactggcagcttgtttgaactacctactggaacaggctaactagtgagcactgcaagctcctgagatagaagtgcttctagcgact

SEQ ID NO: 658907 - DNA, 319 bp, Homo sapiens
gatgggagttaattgatttaatttagattagttgaaaattattacaaaatattctaaaagggttttttgttggtacttcaaggaacccgattagttttgatctattgaaatcacaaaggtagaacagggcattttatttttggtataatttaggattaggtatgcttcctgtgttctaacaaggacatgttttctaacccttctcacactaggcacccagcacagtatttgcacctgctatgggatatatagagtgtggagatcagctcagatgacattaaagctgccgtagtgttattcttgtatgccaaatcttttt

SEQ ID NO: 658908 - DNA, 1211 bp, Homo sapiens
ggtggatccttgttcccctcgtatcgccttgttttcccacatgcccgttctgtacctctccaagggccagaccacgcactcgtgtagcccctgcagactcgccaggtggaccggccggggacaacgttacaaggctacatgtacctaggtttgattcttccctttatcgtacttgggcacctatatccctcacaagatagttgggtttgcccattaatcccccgttgccgtcattggcccgcccatgttgcctctcaggaagggctagacaccatcagagctgtgtgcgaaagttccaacatggtcttcaaacgcatgggtcctctaccctaagttaattaccacactaatttcttgtcttagaactatgtccttacggctacccgctgtacaaacttgtttcgactccattgggcttgtattcttaggtctaagcccctcgcgaggcccacggtaagtcgcgccggttttcggcttacgaagttcccgtaagggaatcacactgtaggaggctcccctcgcacctttgtttgtctacttacccatcaccaccgaccatggctcatgggctatccgagctagtacttcctagctggacttgggtatacctatctgacatttctaggatgataaggctactgggactacgctacacttggactactatgcagtgtgcgtgtggaacaagtatcatggtgtctactcgcgcagtgttcacgtgtggggcactgtgccgtccgtgtgtaccctgaacggagcagtgagatacggttgtcagcatgttccatgtgagcaccatggagctctactcaccccgcatccagagaacaacaaggatgaaagtgactcctgcggcgacggatacgggaatccacgggcgtcctaactgagcattgatgaggattagaggatggcattgttctcgtatggaccttgatgatgcatgtctacaagatcctctaacctccgccttcacaattgggtgaagctaccggtggaagctctcgatagtcagaggcagggaccggtggacttagtcggatgaagagtgatcctccttccgtccgtggccaacggtctgtgacagcaagatcctcgtgcatggggtaggcggattgattctgccgatatccttttgtgtttcatccctagttgtaccatcttattccctaccgggtgctcattggaatctgagtagagtctgggggagg

SEQ ID NO: 658909 - DNA, 146 bp, Homo sapiens
gtgcacagccatgcatcactgtaaccagaagatgtggatggcctccggaaactgtggcgtgataggcgcgtgctctcagaacatcattcctgctctactggcgctgccaggtgtgggcaggtcatcctgagctgaacgggaagctc

SEQ ID NO: 658910 - DNA, 310 bp, Homo sapiens
ttttcaaaaacactttccattttattgatcttttgtatttttatttatttcaatttcatttatttacactctagtctttattattccttttcttttactaattttaagtttggtttactcttgcttttctagttctttatgatgtattgttaggttgtttatttgaagatttcatgcttttctgatgtaggcattgctgggcaaggtgccacagccctggcatcaggaagtggttgacttgtgtgttggtaagaagaatttaccgatgacagtataggtttgaaaaaggaaagatttattggagtcgacc

SEQ ID NO: 658911 - DNA, 1120 bp, Homo sapiens
  misc_feature (482)..(482): n is a, c, g, or t
  misc_feature (1032)..(1032): n is a, c, g, or t
  misc_feature (1120)..(1120): n is a, c, g, or t
tatgcctctttataccccattaaattattttatatttaatcattctaggcccctgcatgaggtgtagaagaatggaagaagaccagtcacaaacgggtcctgagcagtgaggcagatgtataataatacggccctctatggaacaagatcttgattttcccaacatgtgtataatatgccttcgtttagagtctagcaagagtgcgaatctatccaccattcgtttgaacatgctctaaatactagcctgcctgaataattcttcgcacatataaagctcttccgacaattcaaacatcgtccaaatcgtgtcttactaatatttattaaaaaaataacactccttcaacctctatctatagcgtataacacaaaataactaataaataggcatctccttctcggacactttaaaatgtgttagagaaacatcctagcattgcatcacatttatcacttaatattacgagcgactatcaatnactacataactaccctcataatataactcagaactcgtccatgcctcatacagctacgacaactgagtattgcaatactgaatcgtggctatatcacgctataactccgataagtgctccgtcgactcctctgcatatacccccagtcttcctcgcggacataaaacatctaagtaatcgtaattactgttaccccacattatctcgccacccctctactccgctccacttaaccactgccaaccatccgcgctcgctaatgtgcttaaggtcgctacccaatccattctgagatcctaccatcatcttattataataacaatccacacctaatgtcctaatcgtctgccatcgtacatgcatggccgacacaaccactccacacccatcatatcgtcttcagtcaccaccattatcagtatacaccgaaccggtaaagcaacaacactcgaagtcacctgacacatctggtttagcacacgcatatcaccgaataactcctgacttgcatctttcactgtgcttccatagccgcttatcatcgcactanagtacgcgactttctctacgataactcataccggcatagagacgggttgaatttgcatacacctactactcatagtctcttcctcttn

SEQ ID NO: 658912 - DNA, 368 bp, Homo sapiens
gtgcctgtgactaatttgtttgtctcaggccacacagcttgggatgttgtgcaaactagctattccaattcagaggtctacggatccaaagtttgcatgcattgcacaccgtctgtcgcctcccctacttttatacgagcgtggaaactgaggcccaaacaacagcagggatgacttgaatctctaccaaacttcccgttcatgtatcttcctgttttgcacgatgcttcgtacgcggtgggctctggctggtaacagtagtgaacagcttcccagtgggatgtggctctagcttcctctgcatctcccacctccccaggagggtctcagggcttaccagactggaggagctcagctttagtcacatc

SEQ ID NO: 658913 - DNA, 221 bp, Homo sapiens
  misc_feature (8)..(8): n is a, c, g, or t
  misc_feature (25)..(25): n is a, c, g, or t
  misc_feature (29)..(29): n is a, c, g, or t
  misc_feature (41)..(41): n is a, c, g, or t
  misc_feature (208)..(208): n is a, c, g, or t
  misc_feature (210)..(210): n is a, c, g, or t
tcctctanaacggccgccccactgnacanagtccactgganttctcagtgagaacatttggtcgaaaactatcgctcaaaccaggagctgattcccattacccgcatccagtcctgaccccagcctacccgtctgtatggcgatgatttcatcaactgaccatcgatctggcaggtcccctgaacccctgggatttttctagctctancncactgtttatc

SEQ ID NO: 658914 - DNA, 727 bp, Homo sapiens
ggacgtcagcggaccgggcgctcggggccgggctgtatggggctcccgcgcgggtcgtcttctggctgctgctcctgctcacgtgtgcctgctcggggctcctcttgtgccctgtacttctcggcggtgcagcggtacccgggccagcggcgaagcaagggacaccacatcatttgaagcattctttcaatccaaggcatcgaattctgtggacaggaaagggccaggcctgcgaaaactgcttcacctggccattcaggggcacccccaacttcgcgtggcctgtcaattctctccattccagtgctgctgtggggggacctcttcaccccagcgctctgggaccgctgaggccaaaaaaaaagccctgtatggctgggggggctctctcaccaagtcatcgcctcaaccctgagccttctgaagcggtacagagaggtgcaagctgttgtgcccgcccaggggacaccccctccaaaaggtgtatccgtgtgtgccgtgttggggacaacgggagggcaattcttgaaatggggtccggccagggttccccaacaatcgatgcccaatgactatgtattcagactcaatggacgctgtgatcaagaggcttcggagcgcgatgtggggcaccaagacttccttctatggttcactgtgaacccggatgaagaacttccctcgttttcctagtggaatgtgggttcacctccgggcaagggcacgc

SEQ ID NO: 658915 - DNA, 357 bp, Homo sapiens
  misc_feature (330)..(330): n is a, c, g, or t
  misc_feature (340)..(340): n is a, c, g, or t
tgagtggttggaagattatatggataacttttaataaatgacactagattctcactcttggtagatattatcactaggctaagttttaaaatgattatagagccatatttggtacctatcattatagtcattttggaaacagggacactgagactcagagcattaacctatccaagttcaagcaactaataagggacagagtcaggaatttgaacccagacatctatctgacacacaaagttgactttcccctttaggatcacctggcctggcttaggccattgttcaaaggacggaggggtgggccaagtttttccaggaaaatgtggnttttattccntccaaacattttaggcc

SEQ ID NO: 658916 - DNA, 776 bp, Homo sapiens
  misc_feature (39)..(39): n is a, c, g, or t
  misc_feature (96)..(96): n is a, c, g, or t
  misc_feature (99)..(99): n is a, c, g, or t
  misc_feature (103)..(103): n is a, c, g, or t
  misc_feature (123)..(123): n is a, c, g, or t
  misc_feature (172)..(172): n is a, c, g, or t
  misc_feature (223)..(223): n is a, c, g, or t
  misc_feature (287)..(287): n is a, c, g, or t
  misc_feature (367)..(367): n is a, c, g, or t
  misc_feature (550)..(550): n is a, c, g, or t
  misc_feature (602)..(602): n is a, c, g, or t
  misc_feature (626)..(626): n is a, c, g, or t
  misc_feature (698)..(699): n is a, c, g, or t
  misc_feature (772)..(772): n is a, c, g, or t
caggctgccaacgtaaacataaggggcagggggctaccnggccctgtccccaacccctgagacagggaggtcactgtcaggggcccttagccatcnccncccnctaatctcagccctgcgggngggagggggggaatgtcagaggtggggaagaactcaacgggaatgaggnagagactttgtaaactcagaaccagggtaaagggccgggggcaagggggcnctgggggcccttgccctggcctaggggtggggcccgccccccccccaggacctcggggaatacnggtggcttagtccccgccctgcccgcccccttcccagcttcttcccccatccctcctccgccgaccccagacaggccgcnctgcccggcctcttcccccccgtctggggggcctcccagggggggccccgccccgggagccggggtcccctctgggggcgttgggtctctggggtgttagagggaacagagctggcccggtgctacttgacgggttcccccccccggaccttgccctcgcgcttggcaatcttgtccagaganaacacagccttgtccgggggcaggtagagggggcggccaacaggagaggccncagggggcgtgatggctctgcgcnccatcacactgcccgacctcatgaggtggcttcgggaaggctgctggtgggagaaggactgggagcggcccnngctagcctgatgcctctccaccaagtcccggacagcagggctgctgggggctgctcttgcgggagaggggccnggcc

SEQ ID NO: 658917 - DNA, 191 bp, Homo sapiens
aagaaagaaacacaaagacacgacaagaccaaaaacaacagaaaacaaaacgactcaacacaccaacacaaatgacacagcacaaagaaaaaaaaaacaacaacgaaaacaacacgaaaaaaacaagaaaaaaccaacaaaaaacacgaccaaaaaagactattgacctcttatggcgctgctgttttcat

SEQ ID NO: 658918 - DNA, 179 bp, Homo sapiens
tacaatgtgcaaaatactttattacaaaatacaccacggggctcacaaacccttttccaatattctctaacactgacactgaagcgctgcaaaatcccttgcagtgcccgcaatctaacgtgtacaataacctgaacccccttagttacacaaaaactctgcaacaggcattggaatgg

SEQ ID NO: 658919 - DNA, 442 bp, Homo sapiens
cggctgtctagaggatcccacaacgcgactcttcccaaaaaaaaaaaaaaaaaaaaagactacatagcttatatggcagataaccaatataaaaaaatacataaaacattaaggataatatttggtacatacctttaataaaaatatttatttaaggcacaattcagattcagaagcgtcaacagttagtcagaaagatacatgaagatgaatggaatgatatgaaggattatcttccccagggtcaacaggaacaagaatctttcatagataataagtcatggaaagaaaatctggcagggggtgggacacttacggaagcagagaagatgtccttggaaactcagaaaaggaacctggctacagaaaatcagtattaaagagtatcctgggagaaggaagaaaaagcctaatcctcataacgggaagaggtcagcgtggg

SEQ ID NO: 658920 - DNA, 219 bp, Homo sapiens
ggtcgactgccgcttgtgtggttcgtgaggaactcaggtgggctggatggtatggggcggcccttggcaagaggcgggcgtttggagtatcgcggggaggcgtcgacgcgacgaggattgtcaggggcgcaggtgccggatttcagttccagcgcgccgttgcaggtggtgctcggggcgcagatcggtgagttcagcgggcaaagtctgttgtcgacg

SEQ ID NO: 658921 - DNA, 314 bp, Homo sapiens
  misc_feature (132)..(132): n is a, c, g, or t
  misc_feature (166)..(166): n is a, c, g, or t
acttgaatttacaaccaaaagcctgctcagttgattacagctgggccaatacagtacaaggcaataacaaattagtgtgggttgattctggaattgaaaaagcttttgcttgtatggatacagcaaatccanatgtctgtgaacaaagcaacaatttaaaacaacnacattttctgtcctttaagcacttcacatcaaaaaaaagtgttttcaaaggcaaaaatctgcattttaagcaaaaggtggcttcccagctctaacaaggtaactggttagcatgacattaaagcttgggcaaggcttcaaacttaaaa

SEQ ID NO: 658922 - DNA, 188 bp, Homo sapiens
aatgtgtggtgttatgctcgttgaggtggaaagagttttagtttgtccttctgccccatatgcactctcttcgatttaaaaagaaaaagttatgttaattcttaaaggacattaggatgtccgatggattttattcaaacattggtcattgtgtaaatattgataaaaaaagatacgcggattaaata

SEQ ID NO: 658923 - DNA, 353 bp, Homo sapiens
  misc_feature (241)..(241): n is a, c, g, or t
tgccttgcaagaagcagcgcttagcaggctccgagaaggataacactggctgaacaccgggaaggaactggcacttgaagtccagacatctgaagcttgtcaagactagtttttggaacttggcccactccatgtgagtggaagcatggcctgatcacccacggtgtgcctgtattgacatctttgttctggttttgacttggtttgacttggtaagactagtctttggaacttgccccanctccacgtgagtggaagcgtggcctgatcacccacggttgtgccctgtatcggcactttagatactggttttgacttggcttgacttggtaagactaagtcttgggaacttg

SEQ ID NO: 658924 - DNA, 118 bp, Homo sapiens
tagattacttacaataattactatagtgtaagtggtgtataaatagttgctatactgcattgtttagagaataacaataagggggaaaagtctgtacatacttagtacagacacaatt

SEQ ID NO: 658925 - DNA, 348 bp, Homo sapiens
  misc_feature (43)..(43): n is a, c, g, or t
aacaaagaaccggtaaaaagggcgcacacacagttttgcagtntgcaccaaaccaaaatcagagtatccagaaatccaagccaggtcaaaaccaaaaccaaagtatcaagcaatccaagtcaagtcaaaaataaaaaccaaagtgccaggagaggcacaccatgggtgatcaggccacacttccactcaaatggagtaggcaagttcccaagaccaatcctgtcaagcaattcaaaccaaaaccaaagtgccaataaaggcacgccatgggtgatcaggccatgcttccactcaaatggagtgcgcagttcaaagactaccttacaagtttagatgtcagactccagg

SEQ ID NO: 658926 - DNA, 366 bp, Homo sapiens
ccaattggacttttattatatcaggctgattcactgtttctaatgcaatgaacttgacacatattttaaattttttctcaatctgccccattgtgtagacaaattaattcaaagttcttgttcttccttctttttttcatctaagcctgtgcttatgagtagaaaaagagaagaagctaccttgaaatgcctagggcccaaacttagaaggctctgcacataactgagcctcccttcctactaataatggaatagggattgcttataggggtggtggtccaaacataagttgtggatgaattatttccaggttgctatcacctaaggtaacttcaattaatcttttgtttttggaaaggaggatta

SEQ ID NO: 658927 - DNA, 411 bp, Homo sapiens
gctgatgactgtctgttatagtgtccattgcaaccttctggtcttgaggacatttgctaaaggacagctaagtagggcggttgtccctgtcctgttctggtgacattactgcctctcctgggtgttctggcatgctctccccttgagcaccatgccctgttatctttcctccatttccacctggcaactggcaccttgctctgtacagagctcccatctctaatcattgtcaattgggcttaaaagtcaattgatgtggatgctaaccagatctagctggaaagagacctcagcagagtcttctttgtggtggggaggggttttcagtcttctctctcctccccatccttccatggggtgtattggagatcagcgtcctccacccggttaagccgggcggtagctgtaggc

SEQ ID NO: 658928 - DNA, 337 bp, Homo sapiens
tctgtgtgatacgtgtgtttcgtgtgtgtaccttgcgggttggctgtgctgtgttgtgggaagttcgtgcctcacgttgctctcctggtgagagtccggagcaggatgagggggttcctggctttcacaaaatcccggtacccagaacaagcccacccagagtccacttgcccctcaagccttcagaggccaagctggctcctgctggacggcgatccctgaccactgtgctctgtgggccttctggaagccactgtccctcccccagtccctgtgctgaagccagacacctgcagccgtcctgcccccaaccccagctacccaggcctgaggctgg

SEQ ID NO: 658929 - DNA, 180 bp, Homo sapiens
gtgctatacttagtgcctgtagtttttttgtttgtttgtttttgttttgttgttgttgttcttttaagacagtcttgctctgtcgccaggctggcatacagtggcgcgatttcagctcactgcaacctctgactccctggttcaagcaattctcctgtctcagcctcctgagtagctgga

SEQ ID NO: 658930 - DNA, 1629 bp, Homo sapiens
  misc_feature (292)..(292): n is a, c, g, or t
  misc_feature (396)..(396): n is a, c, g, or t
  misc_feature (424)..(424): n is a, c, g, or t
  misc_feature (979)..(979): n is a, c, g, or t
gcacagatacttgagcactctgtacattacctggacagaccttctaatctgcatggttaactcaatggtaggaacggagtagtacaattgcatgagattgacttgacccgaaagagcactgacattgcgtacgggcatgaatactgaccaatcattatcagtcatagatggctcctctacgcgtcagcaagagaccacgctcatgcgagttagtcaccaagcaactttcgatggaacgcccaatacatgatgtatgtagaccagaggagcagtctccgcattgacaacctcngttctacactcattactctgttctgacacacatcaatacctccatacgatctctggtagccaagagacatacatcaacacaatacagacatcatacatacatantggaaaacacaacacatcacacacaaanaacagagcgagagcgcgcgcgcggtgcgtcaacgctgtctatcactccctaaaggggggggtgccgtactattgaatttcgtagggcgcaacccgtcgttatgtctcttaggagacagaagagagcggcgagagctcctatctatggaatgagcgcggggtaggatgtacaatacgaacaaaaggtgcgagagagggtgagcgggcgcgcgtgaaattccagagcgcagacgaacgttggccgggaagagccggggataaagacacagcgagagagcaaaattccgtgcgaggttcaattgtatagggtgcgaagaagcgcgtgaaggcccctattccatttccgtgaggggggagtgccgagagccattataaactggaggggtgacacagatatgagggcttccccccattatatagagaagagcgtctctttacaccaaagcgcgcttcttaaagtaccgagggaagaacaataccaaataaggaaagatctattccatcatagggagtgctgcacatacaccgggggcgccgagttacaaattaggacacncgccgtgtagagggactcaacttagaattgactcgggaattcttgaaaataccatacactatcaagcgttaacgccaagggaaggaaacatcatataaaccctgtacaaaggcagccccccttttctgatataccatcgcgcgaggaggggggcagagaaatgaaaacattaacaaaacaacagcgagcttctctcaacagggacatttccaacccattacggacaatttacagcccgggtaaagggacaccccatttatcggcacccgtaaattccgtccattaaggcccgaaaaattacaccgcaacaaccagttatattaattaagttaaacgccggcggtcagaccacacgttaacagactcgctttcgcctaaggggaaaacgaacccctaaggacacggcccaatcctaccccgtgtgaactctacgacagaaaacgaatcatgatggaggcacaccagaaggaaacccacaacgcaccataaccacgcccgggggtcctagaggaacaagcgcggagacagggcaatgtccccgctcgacgaagcctatacacacagacaacacgactagagcaccgactacaaccaacaggacgacgagaacgacgaataacaagacgagaacagaggacgaggacgtacac

SEQ ID NO: 658931 - DNA, 334 bp, Homo sapiens
  misc_feature (121)..(121): n is a, c, g, or t
gatgacatcacgcctattatgtcttaagtcctggtgttgtgtggatgacaagcagaagcagttatgatgacaggtgatagatcaaaataattgcccatttgttacattttccaatttctanaacataccttaagaaaatcatatatggggtcacaccatcctcacggtagtccaatagagcaagcatgccatctggattcatgttttcaccaaataaagaaactggtagtatttgaaattagcaaggatgtgctttgatttgttctgcagccccctgtcataaaaaggtttactctttctgggtctctgttcttcaagtagctctgccaaaggg

SEQ ID NO: 658932 - DNA, 262 bp, Homo sapiens
taagcagacatttagaggatcccgcacgggtatacagagttactgattcagtctgaggtggatgatgtgtgtagtcaccagcattttggcgaggctgagagacattaggatcatagagcgccaggagatcacgagcagactggcctagatggtgaaagcccatctctactaaaaattcaaaaattagcccagcatggtggtgggcacctgtaatcccagctacttgggaggctgaggaaggagaatggcgtgaacccgggag

SEQ ID NO: 658933 - DNA, 476 bp, Homo sapiens
  misc_feature (67)..(67): n is a, c, g, or t
  misc_feature (100)..(100): n is a, c, g, or t
  misc_feature (167)..(167): n is a, c, g, or t
  misc_feature (175)..(175): n is a, c, g, or t
  misc_feature (324)..(325): n is a, c, g, or t
  misc_feature (328)..(328): n is a, c, g, or t
  misc_feature (331)..(333): n is a, c, g, or t
  misc_feature (337)..(339): n is a, c, g, or t
  misc_feature (395)..(395): n is a, c, g, or t
ggccaggaggttctgggctgcctctggctccgtgggcactgctgcttggctggtggtctccgccgcnggaaaccaactccaaacgtcttctccttcgcgnagaaggctgatttggcctgaagaagccctgtgtgcactggccctagcaacccccccagagccagctngggagggncccacctagggcctagctccgaaacggcacaaaacgcgctgctaggagctgcattctgcaaagggaaactgggctcggggaacaaacctcagccccgatgcggcttggctcaggagcgcagcgcctgcctggttctcacctagccctcnntcnccnnnggcnnnggagggtctgggctgcctctggctccgtgggcactgctgcttggctggtggtctcncgcattgggaaaccaactccaaacgtcttctcctttacgcagaaagctgatttggcctgaagaagccctgtgtgcactggc

SEQ ID NO: 658934 - DNA, 287 bp, Homo sapiens
aatcttacgagttgtctgatgctagttgtgatctcggtcactgactccgctcccgtcagcgattctcctgctcagctccaggtgctggggtacaggcacccaccaccatgcccagtaatttttgtacttttagtagagacaggtttcatcatgttggccaggctggtcttgaactcctcacctcaggtgatccacccacctcggcctcccaaagtgctgggattacaggcgtgagccaccgcacctggcctacatgtgcatcttgatctaaaagcctagaagcacag

SEQ ID NO: 658935 - DNA, 479 bp, Homo sapiens
  misc_feature (70)..(70): n is a, c, g, or t
  misc_feature (103)..(103): n is a, c, g, or t
  misc_feature (170)..(170): n is a, c, g, or t
  misc_feature (178)..(178): n is a, c, g, or t
  misc_feature (327)..(328): n is a, c, g, or t
  misc_feature (331)..(331): n is a, c, g, or t
  misc_feature (334)..(336): n is a, c, g, or t
  misc_feature (340)..(342): n is a, c, g, or t
  misc_feature (398)..(398): n is a, c, g, or t
gcagttgctgctgcagtcgatctaaggatccccgcgctagcggcatagtgaacgggtggtctccgccgcnggaaaccaactccaaacgtcttctccttcgcgnagaaggctgatttggcctgaagaagccctgtgtgcactggccctagcaacccccccagagccagctngggagggncccacctagggcctagctccgaaacggcacaaaacgcgctgctaggagctgcattctgcaaagggaaactgggctcggggaacaaacctcagccccgatgcggcttggctcaggagcgcagcgcctgcctggttctcacctagccctcnntcnccnnnggcnnnggagggtctgggctgcctctggctccgtgggcactgctgcttggctggtggtctcncgcattgggaaaccaactccaaacgtcttctcctttacgcagaaagctgatttggcctgaagaagccctgtgtgcactggc

SEQ ID NO: 658936 - DNA, 149 bp, Homo sapiens
tactacttcaccaaaattgcttggactgcttttatattactgggttaaagtttggcatgtgtcagcatatgttagggaaaaaacatcaattcccagttaattccaaattcagcttcttatgtaatttatacaacacaaaaatttaaatg

SEQ ID NO: 658937 - DNA, 199 bp, Homo sapiens
  misc_feature (32)..(32): n is a, c, g, or t
  misc_feature (85)..(85): n is a, c, g, or t
tgatgggatgaaaatagtcgcatacattttgncagatgtaagtttctccaaagaatggggccacaagagaaatggggaggggggnctacatgcaagcagatgaggggcatttgcttgcccatattcttatattttttactaatggtgtctcattaagaatactaataacagctcaagttcaaaggcaaacttgctaggg

SEQ ID NO: 658938 - DNA, 138 bp, Homo sapiens
tgtcaatgaatgacttgaggaagctagatcatagctagaaatacagataatccacagcacatctctagcaattatgctattcctattctctagcctattccttaccactgtaatcttgacatataccttggagttgaa

SEQ ID NO: 658939 - DNA, 374 bp, Homo sapiens
  misc_feature (1)..(1): n is a, c, g, or t
  misc_feature (6)..(7): n is a, c, g, or t
  misc_feature (55)..(55): n is a, c, g, or t
  misc_feature (167)..(167): n is a, c, g, or t
  misc_feature (249)..(249): n is a, c, g, or t
  misc_feature (253)..(253): n is a, c, g, or t
  misc_feature (269)..(269): n is a, c, g, or t
  misc_feature (300)..(300): n is a, c, g, or t
  misc_feature (349)..(349): n is a, c, g, or t
  misc_feature (360)..(360): n is a, c, g, or t
nttttnnttttttgaagactccagcctgagcaactgagcaagacttttcacagtngtgaagagagcaagagttgtgcagtggtgccatcacagctcatgcagctttgaactcctgggctcaagcaatcctcctgcctcagcctcctgagtaactaggactacaggtncatgccaccatgcccagttaattttaaaaatattttttggccgggcaagctggctcatgcctgtaatcccaggagttcaagnacancccggacaaaatagtnagacccagggtctacaaaaagagttttaaanatttgccaaacatggtggtatgcacctgtggtcctagctactttggggntaaagtagggnggttgcttttagac

SEQ ID NO: 658940 - DNA, 181 bp, Homo sapiens
cgcttctgtactgcccctcacagacctgccagcccatggatgatcagagtttatcgatgcttcccgtgctggtatatgatggcaacgggacatcaggaaagcagtgctgatgataatggacccctgatggagttggatgactctgactttgagacagaagattttgatggcagaagcagga

SEQ ID NO: 658941 - DNA, 154 bp, Homo sapiens
tgatggctgttggagactgttgagtctaaaatttaggaagaggattggcttttagtggggaaaatactgaaaaagcctagagaaggcaggattacgggaagagcagagcagagctcagtaagtttaagtcaaacatttctttcccagtcgctct

SEQ ID NO: 658942 - DNA, 986 bp, Homo sapiens
gttctagatcgcgagcggccgtcctttattttttcttttatcaagaaagcaaatcccattaatggggaatttcagctgacaacaaatgtgagaggaaggtctatccccctcccctggaaatcatgccagtcttctgttgcccatcagtggcttcatctacagggcataagaacccccatgtcctgacatgtcccctagtagtggcgaagctacatcctagtggtgcgtgtgtggcggaagaggcgtgagtgaggttgcctactaacgcgcagagtcgtggggatgctggagaacaggacgtggcaagacgtgtggcacccatcaccttcgtgtggctcaattcccttcttccccgggaaccgtgggtgcgtgccccacagtcccgtggggtgtgggctggcaagacagggcctcagtgcaaccaatgagttagacaggagggtggcacggaaacggtggccttgtgtgccccttgtggcggggcgcgaggaggactaagagggggccatgctgtgtgccacagcggtttccaatgttggaagtatctgcagtgtacatacgaggagggtttggaaagaggcatccttttcccaaaggctgtcgcctgggcgacaagaagaagagggcgaagtacacgctggcacatgccggtgccaagggcgcagggctccagggcacagccgtgccaccttgacgcgggccacacggagagcttaggagctacgggaaaactccgttgggcgcgggcccaagtgcagggcgcaggactgtacccggaagtatgtgcgacaggaatgtccgtgtggtacagggtttcacacgcaagaacacacagaacgcctatatggggctcaggggaacgagcggctgtgatcccccgagaacgacagctggggatgaccaactggccaaggacacgcagtgaaacgcgcaaagcggccaaaagaggcgaacacgaatcccaggaagtcgggaccgagatgaag

SEQ ID NO: 658943 - DNA, 369 bp, Homo sapiens
ggcgcccgtcgctgacggatacgtggcctctgcgctcagcggggcagccaagctccatggactcatagctctcgaagactggcccaggcagctagccaccaatgcccacacccgcgaggggccaaaatgccaaaggtaacggagataaatgcacagcggcgcaaggcaagtaaaaggcggtggcgaaagggcgcgcgttgaggcctctctgccgcgtgcgctcgcgtttcccagcctcctcgtccgagccggtctctccgccgccgccggggcacgcctgcagacagaggggccgcgagcggacccgggcggcggcggcgcgggcccgggactcggggctctacaggaaagcggtccgcgtcggcccgg

SEQ ID NO: 658944 - DNA, 103 bp, Homo sapiens
cttccttcatagccagggtaacggttagcacacacttcctttgatagacacaactcctctcttcttctgcttggaagtagtagctgtgatgtgagggtcgctc

SEQ ID NO: 658945 - DNA, 1025 bp, Homo sapiens
  misc_feature (101)..(101): n is a, c, g, or t
  misc_feature (106)..(106): n is a, c, g, or t
  misc_feature (108)..(108): n is a, c, g, or t
  misc_feature (964)..(964): n is a, c, g, or t
  misc_feature (1025)..(1025): n is a, c, g, or t
cgccacagagctccaccgctgaggccaacgaggccaggtatttattacaagaaaaagaaaacatattctaaatagcaagggggggtaaatttaactaacanaaatntnagcaacattgcctcactggtaggccaatatgatgaaatgattggagtttcaaaactacctccttcgatctccaagtatgtaacacgagttatatgttaaaacatcctattttgggggggggtataaaagttctaaaagaaatagtacatgcatcacaccaggtttttgaagtccatagagtactggttacttctttatatttcatattacgaggctctagagtaaactcacctttacttagtatctttctttcacttttttttctcggtctcaatctttcttttataaaaatattttaaaaagcatgcaccacaaatacttcagaagccaatgagcgcatagaatctgctgcttttgttcccttctttggagagctaagcttttgtaatacttccgggatacttatgatcgcggtacgcgaaaagagaacacagcgcccaagagagagagagtttaaggtttaaacgctgctgaaaatagaaaaccatgggaggggtcgttaggggtgaagcgattagggatctccacggggaggtcatcttaaagggtcctgctgggggttttgtgaaatctactgtggcgtgagtggggggacaaatttgaggtgaaaccttatgtggggctgtgccaacaataatagagctgggggcagtttggtgtaagagagattttcaatggccaccgagagtcctgggtgggtcggtgagggggtggccttgtctttcgaggctgttgaagaggaacaaagaagcgagagccctgggcttatgaggtgggatctgagcagaagaggcggtacttatggtgtgggactcatgttcgcccatggaggcggaatgatgaggccgtggtgtgntgcggcggcgctttacaataagtgagcgagaatagggcggatggtggagacgacgcgccan

SEQ ID NO: 658946 - DNA, 435 bp, Homo sapiens
tgcgtacgggacagctctagggcgcgtaggaatatatcactggagagcgagtataagatggaacagcgcatatgtagggctgaaagcagtcaccaagttaggagagctgttcgaggcgcaacaggcattacctggaaaatcccaagacatcgtgcgtagaactccatcataccgcgagtataggaccatatctatcaccctaactagaagaatctaatgttagtataagtcacatgaaaacattactcctccgcataagcctgagtcagattaaaacattgaactgacaattaacagcccactatctacgatcaagcaacaagtcattattaccctcactgtcaacccaacacaggcatgctcatcaggcaccggttcaaaaccgtgcacaggacagctcggcgcatcttaccccgcgtgtggttcagacgggtc

SEQ ID NO: 658947 - DNA, 1601 bp, Homo sapiens
tggtggaacgaatggatgaagaatttaccagagttaggatgcagactgacacatcactcaccgaagagtacgtggagcacttgagaggatagaggcccaggatgtgtgccagtcatcgagcgatgtgcaagcgagcaactggaggagaagggcactaccagaggaggtcatgccgcatagtaccataggctgccgcatccatgaacaaccgtacgtaccaagtaagatatacaacggaccacaatgagcgacaagactgaacaccgaacctgagggcatcatcaacagtcatgagcaagaaccagagcagacaaatgacggcgcgaagcgactcggacagtcgttagacaggacgaagactgagacaaagatacactatacgccccaaggacccgcaaagacacaggatacccgcaacccatgcatcgcccatgcacctctgcccagcaatacctaagcagacaaaagacacatgcaacaccggcaagcatgagataaccaaaggcccagcagaaaccacgacaattgcaccaaatgacgcccaactatgccaagagaagaaacaaatagcaaagacaatgaccacaggaaccggacacaagccatggaagaaataccaattcacaaacgaacgacaaccaaacggaagccaagacgtgggagacaaccacaagctgacccatacccagcacagacagaaccatagaaacaccaaaggaggcaaaacgcgacaaaacacaaacggccacacaatggccaggggaaacaagttccccaaagatacgcaacgactgaggacacaaaagaaccaaaaggggaggcacaaccacagtgagacgaaccaacaggcacatgagcatcgacgtgggaaaggacaagcccacgaaaaaggagaaaacccgaaaaccacgaacgggcacgccaggcagcaaaagagggacgagaaaaacagcgacgacaacaaccaaaaaagaaccaccacaaactcaccaaaacgacgatgcgaagaaattcagaaaaaccactaggcagaaagccacagagcacacacgaccaggacggacgcacacaaacccgcggcacagaacacagtagagccacaacggagacacaacacaggcaaaagaactcgcccgcgatacagaacgagagcacaaggacacacaaaccaagaagaaaagcagaaaaagcacacagcacggacaagcaaccacctgacacccaagcaacgccaacgtcagcaacagcaaccacacagcaaagagaaccgaacaggacccacctaaaacgaacaacgaccacacctataccgcacagaagccacacgactgaaaaaacacaacagagccgacaccacaacgacatgacagccaacacagtggacagacaccacaaaggacacgagccgaaaaacaaagcgagcagactacccagaagacacagacacacgacgcacaacacagcagcacacccaagactcaacccacagcgacaagaacacgcacacccacagcagcgccacacacaacgcacacacacagaaccaagaacacgacaataccaagagacaccacgacccaacaaacagagcaagacacaca

SEQ ID NO: 658948 - DNA, 122 bp, Homo sapiens
tatctgcatatctaaacatagaaaagcacaataaaaacacatatcataacctcacgggaccaccatcatacagcaatttgtcatgatcaaaagaaacatcattagtcgtgccataactgtat

SEQ ID NO: 658949 - DNA, 140 bp, Homo sapiens
gagagagagaactatgttctttcctgactttagggaaggtgaatgtgtttccgtctccggagtcagaaagagactcttcccttccttctctctctactctagtgttctaatatctcaccccggtgtgccccttttacaca

SEQ ID NO: 658950 - DNA, 633 bp, Homo sapiens
  misc_feature (633)..(633): n is a, c, g, or t
tgagacggagactcgcccgtgtcacccaggctggagtgcagtggcgcaatctcggctcactgcaacctctgcctctggggttcaagccattctcctgcctcagcctcctgagtggctgggattacaagtgcccgccaccaggcctggctaatttttggtatttttagtagagacggggtttcaccgtgttaaccaggatggtctcgatctcctgacttcgtgatctgcctgcctgtggcctcccaaagtgctgggattacaggcatgagccaccatgcacagccactaattttggtattttttggtagagatggggtttcaccatgtggcccaggtggttttgaactccttagctcaagtgattcacccaccttggcctcccaaagtgctggaattacaggcatgagccactgtgccgggccagtttataggtttcggtcgttggtgtctctcagagacgggggtctgtgctgtgctaaggctggaggagtagtggtgtgatcatatctgtgtgcagcttgaactcctggttcaccttgtttctttcaccttagccttccgggtagtggactgtacgtatgtgccacttcgccagggtaggtttataattaaacgtcctttcattccattgan

SEQ ID NO: 658951 - DNA, 210 bp, Homo sapiens
catttcaaatgtgggtatccaccattctcgaaggcccagtggctgaccatcatcttccccatgtcatctgaccaggcccgatacggtgtcacttggtcccaactgggtcctttacttccaccaccaaaattccatcatagacagaggctgcagacaattctttgtttcccgggccatctggtagtttgtactgtcggggatgcttcttgg

SEQ ID NO: 658952 - DNA, 119 bp, Homo sapiens
tcccataaactttgctttcttatttacagggttatattggaaataactttccgttatacacaaattaaggactgcgcattactgtatgttctctttacatattctttcataatataggg

SEQ ID NO: 658953 - DNA, 788 bp, Homo sapiens
  misc_feature (6)..(6): n is a, c, g, or t
  misc_feature (77)..(77): n is a, c, g, or t
  misc_feature (91)..(91): n is a, c, g, or t
  misc_feature (93)..(95): n is a, c, g, or t
  misc_feature (144)..(144): n is a, c, g, or t
  misc_feature (153)..(153): n is a, c, g, or t
  misc_feature (176)..(176): n is a, c, g, or t
  misc_feature (202)..(202): n is a, c, g, or t
  misc_feature (232)..(232): n is a, c, g, or t
  misc_feature (262)..(262): n is a, c, g, or t
  misc_feature (264)..(264): n is a, c, g, or t
  misc_feature (266)..(266): n is a, c, g, or t
  misc_feature (276)..(276): n is a, c, g, or t
  misc_feature (279)..(279): n is a, c, g, or t
  misc_feature (282)..(282): n is a, c, g, or t
  misc_feature (294)..(294): n is a, c, g, or t
  misc_feature (333)..(333): n is a, c, g, or t
  misc_feature (350)..(350): n is a, c, g, or t
  misc_feature (363)..(363): n is a, c, g, or t
  misc_feature (377)..(377): n is a, c, g, or t
  misc_feature (381)..(381): n is a, c, g, or t
  misc_feature (402)..(402): n is a, c, g, or t
  misc_feature (433)..(433): n is a, c, g, or t
  misc_feature (522)..(522): n is a, c, g, or t
  misc_feature (531)..(531): n is a, c, g, or t
  misc_feature (579)..(579): n is a, c, g, or t
  misc_feature (591)..(591): n is a, c, g, or t
  misc_feature (609)..(609): n is a, c, g, or t
  misc_feature (637)..(637): n is a, c, g, or t
  misc_feature (639)..(639): n is a, c, g, or t
  misc_feature (643)..(643): n is a, c, g, or t
  misc_feature (654)..(654): n is a, c, g, or t
  misc_feature (656)..(657): n is a, c, g, or t
  misc_feature (687)..(687): n is a, c, g, or t
  misc_feature (696)..(696): n is a, c, g, or t
  misc_feature (765)..(765): n is a, c, g, or t
aaagcncatctgcatctgaacctcccgccacaactgggatgaggacagatacagtagtaagccatctgtccaagtgnttaggaggagcatncnnngaccaaaatagggaggcgcacgcaggagcagtgcgtttcaggctgcagntgccgtctncccgtctcacttccggcctctcnactgtgctaggacaccctcatctaancagctttgctggaaagagaggagagcctantgcaaaccaggcaccttgtaggaaggcaangngnaagagtcctnacnagnccttccagaacnaagccagttaaagagggcggccctgcagagtcctatgtncaaacgcagaaaggcgnagaagcagagcanggggaggagccggncagngcctctgccaggttagaagtnaccatcgcgctcccccaggggatgtaccgcntgctgcctggcagcctccaggaaggccagcatccttggctatccttcttctggtttcgcgcctcatactccaacctgttggtgatgatncgctggacnatgaggtctgtggtgaggttgctgccactgtcaatctgacggaagatnccccttctcttnggctcctggtatgggtcngagccatccctgtcagggataatttctntnttgncgtgacacacnanntccaccttgaagtgactaaggagctctgcngtgaacgcntaaggggctccaatcacacttctgacacgtaccggcagccagcacgctcagaatccgttcatacagatncatgatggggtagttcttccctt

SEQ ID NO: 658954 - DNA, 151 bp, Homo sapiens
  misc_feature (17)..(17): n is a, c, g, or t
  misc_feature (69)..(69): n is a, c, g, or t
  misc_feature (80)..(80): n is a, c, g, or t
  misc_feature (106)..(106): n is a, c, g, or t
  misc_feature (113)..(113): n is a, c, g, or t
  misc_feature (133)..(133): n is a, c, g, or t
tttatattcttatcctngcaggcttcgggaataattcatattgtaacttactactccggaaaaaaaganggtttggatanataggtatggtaagagctatgatatnaattggntttagggtttatgtgtgagnaaatatatttaaggggta

SEQ ID NO: 658955 - DNA, 1025 bp, Homo sapiens
ggcagatgcccagtgaccaagaccattggtggaaggggacgactccttcaccaccttcttctgtgaaactggtgctggaaaacacgtaccccgggcagtttttgtggatctggagcctacggtcattgatgagatcctgaaatggcccataccagacgagctcttccacccagagcatgctcatcactgtggaaagaggatgcctgctcaacaactatgcccgtggtcaacctataatccatttggtcatatggagatctattgacccagttgctggaatcggtatcctgtcaagcatgtctgacgcgagtgtcacagtgacattcgagcggctatccatgggttgtttccacagactttgagtgagtgggcacttggctcttggcttcaccctcacgtcctgatggagcggctctctgtctgactatggcaagaaatccaagcctggagagttctccatcttacccatgctcccccaggtgatctacagacccgctggtcagatggcccgtagcaagcgtctagtcctgaccacgcacacaaccaacccctgtgcagtcacgtcagaacgtgtgccgttcattgggttgggacagacgaagcatagtctatgacatcgtgcgcgcccgcgataggcttatgacatcgagcgcccaaggctacaaacgaatgctcaaatctggctctattagccaaaatttgtcgtcctccgatccacgagacttctcttgcgcgtttgacggggccctcaatgtggacctgactaggaagttccagacaaactggtgcccctatccgtcgcatcacgttccctcctgggccaactatgcacccagtcgatctctggcaggaaaaggcatacacgtagcagctgtcggtggcagagatcaccaatggcctgttttgaagccttgcaaccagaggttaaatgtgatccccggcacgggaagtcttgggctgctgctgtgtccggggaattggggccacgttgaagctgcatggcgcataaaaagggactcattgga

SEQ ID NO: 658956 - DNA, 115 bp, Homo sapiens
cgtcaagtcatcgagctgctgttggtcccacttgaggtcaggaatgaggacaaaaccatcagagggatctagggttctcgaaaacaatccggaccgcttcagacctatcttgtcg

SEQ ID NO: 658957 - DNA, 132 bp, Homo sapiens
gcagcagaaacgggggtagttacttgactggacacatcttctctgtatactccacactgacctaagaaaagaacagtaggcattcttaacacatgcttacaatgagctagaagacacatgacacgttccaca

SEQ ID NO: 658958 - DNA, 306 bp, Homo sapiens
atctttagtacaagtatctcaaatcatactagactcctaactggtctttcttcaagtcctgctccctcaaaaatttaatcttccaaaaagcagctgaaatgatttttttttttttggaaacagattttggctctgtcgcccaggcgctcagctcattgcaaccttccgcctccgtgggttacaagttgattctcggtgcctcagccatgtgaagttagctgggatttacaggcgtgcaccaccaggccccttctatttaatttttttaagtaaagacggggtttcaccattacgcccaggttggca

SEQ ID NO: 658959 - DNA, 403 bp, Homo sapiens
aaattgcagtcagggactaaagctctctctaaagcatcggataatactgcacaatgttgacactttgaacagcatagggatcaggaaaggaatactgaggcaagagaagcaggtgaactcccaggttcacctgaagcatcccccatgcgattctaaaagcatatgtaaaggaggcacttaatgtgggtcacaaagcacaagatatgatatacgaactgggtgaggggttatgtgataaaataatcaggagagcaatcaattcatagcccaagtttgatacaagctaaatactaaacagaacacaaaagccataaataatgtagtatggagagcaaaatgtaaggagagatagaatacggtgattgatgtgtggataaagtgtaagttcaggcatactacttgg

SEQ ID NO: 658960 - DNA, 350 bp, Homo sapiens
catgaagaatgtgagaactgtaaataccaatccttgaaagggaccatggtgcggcctgtgagacataagaaaccagtcaattactcacagttggggcatctgacagtgaatgatgatggttctgaactgtacctttaaacacagaaaatccagacacagcaccaaaggagttaaacacaagataaaccaaaacctacacttgaacaatctccggcacaggaagaaatcccagatacaagagaaaacccctaaaaaaagatcactgaaggtactaaagctatccagctagtgcagttgcctgtgtacaaagatggcttaagatgacccagctctaccagagagactcagaa

SEQ ID NO: 658961 - DNA, 819 bp, Homo sapiens
caggcgtgcatctggccgagcatgctgctgtagacagggcatcgtagctctctgacgtcctgagaacggctgcggacactggctccttctcagccgtctcaaccaggcagaccagtctgcctagtgcacccatgtgccgcaggcctggatcataccccaggatcaggaccttgcgggtcttgcctggcccagagactgtgtcagctaagcccgccccagtggactcgttcgtccagagcggatgctccatagcctcgacgaaccccgcggatcgaaacccctacggtggtgccaggctccaagcgcttctcctgcccctcctgtggaatctgtcattcgtgggtgcttcagagtccaccatccaatgagtttctgcagccaaagagataaccagagaacaaattacggcaaaactataagtacaaaatgggggcgagtcgccggtcccaaggaagttgcgcgaaagaaggcacgcgtcaccatcctggccacgccccctttccccgagaggagagcgtccgcccgcaggagctgcagaatctgagcgatgacgatcgacgcagttgtggaaggagatccgcctgcagcctgatggccatagagccctcatgaaggaggaagctgatgagaagcgtagtgacgtaccgtctaagcggcaacgaatgagcaacaagccattatggggtccctgtcccagacaaatacgttggagcttcggtctaaccggtgccacacactgcagtacctgaataccgggagaagaactgtggcgcggattcgtaggctgtgaagattatcaatgcggaaggggttaaaaga

SEQ ID NO: 658962 - DNA, 224 bp, Homo sapiens
gatggcgctgtgacctcccgtttcagcgattaccagggcgaactgctggatgccgcagccgaggcctgcaaaggccgccgcgcacgtagccatatcgtcagctatgccgaggatggtgcgctgctgaccgagctgttcacccgtggtggtggcggtacgctggtgtcgcaggagcagttcgaagtggtgcgcgaggcgagcatcgaggacgttggcggcttgct

SEQ ID NO: 658963 - DNA, 393 bp, Homo sapiens
ggggggctactggagaggagagacagcaagtcccccctaacttgttacccagcacaaaccacaggttttggaattttcattttcgaccctaaagaaataggtgctataaacagggaattaagcaaaatgctggaggctaaagatcttttaattgtcttaattttttttctattattaaaccacaggcgggagattttttagttctcccagaacttctatcattttaaactggcttggatatttaaaaaaaaaattttcaggaggatgttttggactattgctaaccccttttttgtaatgggtaaggggtttgattgtttgaaattttctgtttttaaaaatggagcccttgcctttttgccaaggaaaaaaataaaaattattccagggcca

SEQ ID NO: 658964 - DNA, 349 bp, Homo sapiens
caagcaggctttattcactacttctggtttgctgttatcagagtctgctcgtttgcaggatttttcgaagttcagtgattgaagattttatcatgtaatgaagcttctgcctaatggggtattagatattatctgaagaccctgctgtgtcaaaaactttctgcctactggttggtagtggtaaacgcggctataaatttcatctttgttttgaaggcttgttagcagtgatccctagaaattgagataggacttgctgaaaatttgttttattccggtttcatgtactctttaaagtgattgtactatttgattttaatgtgcacccttcattgtccattttttgcca

SEQ ID NO: 658965 - DNA, 328 bp, Homo sapiens
tttgggacttgattaaagacggaaaagtcatcgaatccttagaaatctcctctgatgagaaattcactagaaatttgtcagtcagaaattatgctattgatgcactttggttatggaaacaaggcggtggggacttccgaaccaagaaatagatagagaaaaaaataatagtacatacaggtgcgccgaccagcgcctattcataaaaacaagaataatgtgtctctttgagtcatgttccttagcttcttttttaaaaaaactgtctcaggtattttcgcttctttgatctcccaatctccatatcccaaccacgttcatatacctc

SEQ ID NO: 658966 - DNA, 143 bp, Homo sapiens
acgagaaaatcagtacatagtgaaaaaaggaacattgataatctatcccatgatacataacgctcagcgaagaatagctagctctttcaagggtacagagctcctatatggctaggacaaaatatctagaagtaggtagggca

SEQ ID NO: 658967 - DNA, 917 bp, Homo sapiens
  misc_feature (123)..(123): n is a, c, g, or t
  misc_feature (143)..(143): n is a, c, g, or t
  misc_feature (154)..(154): n is a, c, g, or t
  misc_feature (157)..(157): n is a, c, g, or t
  misc_feature (159)..(159): n is a, c, g, or t
  misc_feature (170)..(170): n is a, c, g, or t
  misc_feature (176)..(176): n is a, c, g, or t
  misc_feature (179)..(179): n is a, c, g, or t
  misc_feature (183)..(183): n is a, c, g, or t
  misc_feature (185)..(185): n is a, c, g, or t
  misc_feature (188)..(188): n is a, c, g, or t
  misc_feature (192)..(192): n is a, c, g, or t
  misc_feature (203)..(203): n is a, c, g, or t
  misc_feature (207)..(207): n is a, c, g, or t
  misc_feature (215)..(215): n is a, c, g, or t
  misc_feature (222)..(222): n is a, c, g, or t
  misc_feature (224)..(224): n is a, c, g, or t
  misc_feature (228)..(228): n is a, c, g, or t
  misc_feature (231)..(231): n is a, c, g, or t
  misc_feature (237)..(237): n is a, c, g, or t
  misc_feature (245)..(245): n is a, c, g, or t
  misc_feature (247)..(247): n is a, c, g, or t
  misc_feature (254)..(254): n is a, c, g, or t
  misc_feature (256)..(257): n is a, c, g, or t
  misc_feature (261)..(261): n is a, c, g, or t
  misc_feature (267)..(267): n is a, c, g, or t
  misc_feature (271)..(273): n is a, c, g, or t
  misc_feature (275)..(275): n is a, c, g, or t
  misc_feature (281)..(281): n is a, c, g, or t
  misc_feature (285)..(287): n is a, c, g, or t
  misc_feature (304)..(304): n is a, c, g, or t
  misc_feature (314)..(314): n is a, c, g, or t
  misc_feature (319)..(319): n is a, c, g, or t
  misc_feature (340)..(340): n is a, c, g, or t
  misc_feature (344)..(344): n is a, c, g, or t
  misc_feature (379)..(379): n is a, c, g, or t
  misc_feature (381)..(381): n is a, c, g, or t
  misc_feature (385)..(385): n is a, c, g, or t
  misc_feature (637)..(637): n is a, c, g, or t
  misc_feature (704)..(704): n is a, c, g, or t
  misc_feature (710)..(710): n is a, c, g, or t
  misc_feature (794)..(794): n is a, c, g, or t
  misc_feature (815)..(815): n is a, c, g, or t
  misc_feature (828)..(828): n is a, c, g, or t
  misc_feature (836)..(836): n is a, c, g, or t
  misc_feature (848)..(848): n is a, c, g, or t
  misc_feature (869)..(869): n is a, c, g, or t
cttttaaaatgaagatgctttttaaaactaatgaactaagatgtataaatcttagtttttttgtattttaaagataggcatatggcatattgattaacgagtcaaatttcctaactttgctgngcaaaggttgaaagctattnctgattagttnccncngtttgaagatngtcccntcncagngntgntaangtttgccgganttantaaatttnctaaaangnaatnttnaaaaanaaatttgngngtcctgngnncccnaggggnaatnnntnaatganaaannnaaaaaaagcgcccaagnaacacaaacngccantcaacaggaatttcccttacnaccnaaggaattgtaaccattgctcaaacattgtaggantnaacnaagaagaaaactacaggagaggccgggcgcagtggctcacgcctgtaatcccagcactttgggaggccaaggcgggcagatcacgaggtcaggagattgagaccatcctggctaacgtggtgaaacccgcctctactaaaaatacaaaaaattagccaagcgtggtgctgggcgcctgtagtcccagtaactcaggaggctgaggcaggagaatggcgtgaacccgggaggcggaggttgcagtgagccganattgtgccactgcactccagcctgggtgacagagcaagactccatctcaaaaaaaaaaaaaaaaaanacaggngagacaactggtttttgaatgaaatacatgggtactgccttgcttgacatcacatagtccttgatgaaagttcacatttaggtntgcttggtacaatacgcctcntaaaaaggtcctngaagaaantcacatttaggnctgcttggtacacacgcctcngaaagagtctgatagctttcagtagcagtagacacttgcatgtgatgt

SEQ ID NO: 658968 - DNA, 550 bp, Homo sapiens
  misc_feature (493)..(493): n is a, c, g, or t
  misc_feature (508)..(508): n is a, c, g, or t
  misc_feature (513)..(513): n is a, c, g, or t
  misc_feature (520)..(520): n is a, c, g, or t
  misc_feature (522)..(522): n is a, c, g, or t
tgatgttgttgaaagatctaaacagctttgcagctgatgttctaaagaaataaaatataccactgaacccagatcaagcctttgcactaaattaatgtgagtttgaatttctgagtttcagtagtaatattttctatctttggcaatcatttttggactgacgctcattacgttttattctctttgggctttattccatggatttgtaaaggacaccagttcgctttatttctggaagatgtaacacaaattaagtaatgtgcctttgattccaatgtaactgttacaccttaactaaaactgtcatgagcaacatcatttttaaaagcatttctttgacgtgcaaatatatgacagaaaccattgtaaataggactttttgaaaacaatactttgctaaaaggggtgttttatgaaggatattatgttctgaagacctaaaggtagggtctggttatgtaatgtgtatgaacctatataattcatggcttantggcttatagggccntttantcatgancngatttaaattttgggctgcttttctggg

SEQ ID NO: 658969 - DNA, 360 bp, Homo sapiens
  misc_feature (7)..(7): n is a, c, g, or t
  misc_feature (77)..(78): n is a, c, g, or t
  misc_feature (131)..(133): n is a, c, g, or t
  misc_feature (137)..(137): n is a, c, g, or t
  misc_feature (149)..(149): n is a, c, g, or t
  misc_feature (166)..(166): n is a, c, g, or t
  misc_feature (174)..(174): n is a, c, g, or t
  misc_feature (185)..(186): n is a, c, g, or t
  misc_feature (194)..(194): n is a, c, g, or t
  misc_feature (196)..(196): n is a, c, g, or t
  misc_feature (216)..(216): n is a, c, g, or t
  misc_feature (229)..(229): n is a, c, g, or t
  misc_feature (252)..(252): n is a, c, g, or t
  misc_feature (292)..(292): n is a, c, g, or t
  misc_feature (295)..(295): n is a, c, g, or t
  misc_feature (317)..(317): n is a, c, g, or t
gcagcanaactaatacaaaaaaaagcactctcaaacgtatacttgaagactatattttactaccaatttaatttttnnttcttcagcagaatatgtcaatgaaccaagttctcatagaacttaaaaatttnnntgcnctcttcccaggnccagaaattccaaactncccgggcnaccccctggcnnaccacttncnttgcatgacaatggacactnggttcataaagancttctttttaaaatgggatattntggaaggaagaataccatgaaaagaataatcctatgaganttntttttaagggcagttattttgnggccttgggtcttcatgaaggatactacagtttatatagggaa

SEQ ID NO: 658970 - DNA, 135 bp, Homo sapiens
cactccaacctgggcggcagagtgagaatctgtctcaaaagaaaaaacaaaaaaaagtattagttaaattaaaattgaccgtttcgaaatagatactggtttaagaatttcatgtagaacagacaaagggaaaca

SEQ ID NO: 658971 - DNA, 378 bp, Homo sapiens
aggaccccaggcccttgggggacaaacccatgggatggaaaccccgcctttacaaaaaataacaaaaaattagccggctgtggtgttgcacgcctgtagtcccagctactagggaggctgaggtgggtggatcacttgggctcaggaggtcaaggttgcagtgagccgtgatcacacccctgcactccagcctgggcaacagagcaagaccctgcctccaaaaaaaataaaaattaaaaaaaatagcaaggcatggtggcccctacctgtggtcgtcgttttagctattcaggagttttagctattcagtgggaggatcacttgagtccaggagtttgagagcagcctggacaacataacaagaccttttttttgtta

SEQ ID NO: 658972 - DNA, 527 bp, Homo sapiens
aatggcggggaattttaaagacactctcatttgatgcgatagctaatattaagaaatcatctatgcaacaggacatgtaaaaagtactgaggtgtttatcactttaaaagggttccaggctgggtgcagtggctcacgcctgtagtcccagcactttgggaggccaaggtgggcagatcacgaggtcaagagatccagaccatcctggctagcgcggtgaaaccccgtctctactaaaaatacaaaaaaattagccggacgtggtggcgggcgcctgcagtcccagctactagggaggctgaggcaggagaaccacatgaacccaggaggcagaagttgcagtgagccatgatcacaccactacactccagtctgggcaacagagtgagactccctctcttaaaaaaaaaaaaaaaggggtaaaaaaatttaaaagtagagaataccttatttaatatgacggtacctgcttgcacagaaccgtcggtattttgggcgtacagtatagatgggggaccctctagagt

SEQ ID NO: 658973 - DNA, 324 bp, Homo sapiens
  misc_feature (76)..(76): n is a, c, g, or t
  misc_feature (119)..(119): n is a, c, g, or t
  misc_feature (266)..(266): n is a, c, g, or t
  misc_feature (287)..(287): n is a, c, g, or t
  misc_feature (302)..(302): n is a, c, g, or t
  misc_feature (319)..(319): n is a, c, g, or t
ttaatactcccatcacaatcaatttcaagcttaccaatttcaggcagcagcatctggcatctggctcccaggagcncagagagtctctgactcatctccaacctcaaactcttccaccnttcttgctcctgccgttgagccacactggggttgctgtgccgtgaagcatcccaagcaaacccccatcctagagccattccttccacaggaatgctcttccccagctatttattccttcattccattcagatctctgttcaactgtnaccctggcagagagggtttcnctgaccacccgggantaaaatggtccctaagncctca

SEQ ID NO: 658974 - DNA, 335 bp, Homo sapiens
agatggggggtcagcccccccacccggccagccgccccgtccgggagggaggtaggggggtcagacctccgcccggccagccgccccgtctgggaggtgaggggcgcctctgcccagtcggccctactgggaagtgaggagcccctctgcccggccagccgccccgtccgggagggaggtgggggggtcattcccacgccttttcattggacttcgccacattgttcatgctggcgcccggctcggcacatagttgcattttcgtttccctaacaactttgctttggcaccgaaccctgatagtacccctttttccctggccccccccccccccc

SEQ ID NO: 658975 - DNA, 441 bp, Homo sapiens
ggcgacaccgaaccaacccaatctggcgatagatcagccttgacgcgtgagggacgcccagactgtcatttctcttttccgccagttcttaagcgagcaggacaaattacagcgaaccatggcgcttgaaatcattttactgctgatcgaatggcaaatttcccgtccttccggatatgaagacagcgccaatgaagccggtgcggccatggcgtggaaggcgaaacagcttattcgcacacagtttcatttaccgctttcaacgtcgctactggcaaaagaactgcactgcaatgcggattatcttgggcgagtatttcgccggacatttcatttaaccctgacggaggccattcatcgccagggtgtccgggcggcagaaaaattactgctcaacgaggccgcatcattaaccgaagtagcgacacgctgcggttttaa

SEQ ID NO: 658976 - DNA, 265 bp, Homo sapiens
  misc_feature (50)..(50): n is a, c, g, or t
ggatccagcagctatacaatgtttagggtatcagaacttgtattacacantataccatctcagacagccgtaatgtccgaagatcccgggagaacaggcagaatcttacaccggtggtctctgaatgctgagaacaccagtccaattacctttaactttaaaaacaacggctgagaggatccctgggcaaaacatctcccaaggagagaaggtcccccaaaacagggacctggtaacgggggaagggtccacggttgttggagga

SEQ ID NO: 658977 - DNA, 1290 bp, Homo sapiens
ccctcctgaacagcagaggctgatctttgctggcaaaacagcgtggaagatgggcgcacccatgtcatgactacaacatccagaaagagtccaccctgcgacctggtgctgcgtctcagaggtgtggagtgcaaactctctcgtgtacacgaccccgtctacatggctaagactcatcagccctctgacgcgtcggagccccaagtgagcagcgcatcgaccaactgtcaaaaggcaaacagatccaagggcactcgacaagggccacgggcgcaattcgccttcccatggtcagacgaggctccaagcgcagtgcttcggccatccgtgttagaggccacagaggcagcacagactcaagcatagggggaacaggcactcggggcgacagcacaacccgcaataggtatacatggccacgtttcaacgagaactcagttcccccagacaggcaaccaccagcaagcgtcccctgcgacgcccccgtggcacgagacccataggcggctcgcccatgcgccgagcccccatcgccgaaaggtagacgcgcctcgcagcaccacgtcggcgagccagaccattcctacctcgccggggctaggacccacagcgaaccgcagccgtgtccaagcacatgggcggcaaacacagcgcaaaacccaactagcgagccgacacccagtcacaccaaccagacctcgagaccaaaggcgcgcacgacaaaggctgtaagccaaacgcgccaacattcagccacacgcaccaaaagggaaccccaaacgagggccaccaaaaacacgcaaacatcacgccaacgaaggggacccctcaaaaagccaggacaacaaacaaagggaccagaaaatatcaaccccagtggcagaccataggacacacagaccccagagcgacgaacaccaaacacacagacatacacgggcacacacaccccagtcacacacggtacacacagggccacaaagacgcacccacacccaaggaaccacacgctggccacaccacgagcctaacaacatgtgcgggcgacaacacggcaccaacacacaccgcgaaaaaggtgacaacgccgtggggaaacgcaatcaacaccccgacaatcacgaagacactaccaccaacaggcacaaagaacaaggacaacacgcaaccgccaaagccagacaccgacacactggacaacaacagacacgacactggaacacacacaacaagcagaggcgcacgcgagaagacaggaatacgacaccgcgagcgcgcggcaatcacggc

SEQ ID NO: 658978 - DNA, 118 bp, Homo sapiens
tatttgacttagaggatccctgtctagcctgtgcagtggtctagcctcccagtgttcaatgaaaaccaactcactaaacaaaactacaaatgagtccacttcactcccatgctacctc

SEQ ID NO: 658979 - DNA, 272 bp, Homo sapiens
aactagctaataaatatagcactaaagtagagacaaaggaactcagctctctggtgggccagaaacaacgcatagccatagctcgcgccttgtcagacagcctcatatattgcttatggatgaagccacgtcagctctggatacagaaagtgaaaaggttgtccaaagaagccctggacaaagccaaagaaggccccacctgcgttgtgattgctcacctgctgtccatcatccatacttgctacttaatagtgtgtgtttcataatggcag

SEQ ID NO: 658980 - DNA, 975 bp, Homo sapiens
tcaaagggaaaaattttattaacaacgggtttcaacgaaaaagcaaatgaaattaaccccctaataaaattaattaaccactcattcatggacctccccaccccatcacaaaatctcgcgattgatgaactttgggttcactcttgggggcgtggcctgtgaatccttcaaaattcaccacgggattattccttagccagtgcacttattctcaccagaaggctctcaacgcgccttttcatcaatcgcccacattaacttcgagaagttaaattatgtggcgtgaaactcactccgtatacctttcatcgccaagtgggcgcctcaatattctttatcggccttttctatacacatggggccgaggcctaatttagggactcatttctttctactcagaaaaccgtgaaacactggggataattcctccgttggtttggcaattataggcaacgaggcctttcattgagggaagtggtccctccgggggagggcaaatatcatctcgggaggggccaccagtaatttacaactttattatcggccatcccaatatgggggacagaccttagtttcagtgaaatctgaggaggctacctcagtaaaagagttcccaccctcacaggaattttttacctttcagttcatctgggccttcattaagtgagccttagaagaatcccaccctcctatttgttgccgaaggggttcaaaaacccctgtaggaaatacttcccattcgattaaattacctttcatccttattaaaataaagagccccgggatattctctccttccttcttagggtttaacatattgtcccagacctctagggcagaaagttatctaatgacgttataactcccaataagacgaggattttattgccacaattgcacgcgccacaggggggtggtatatatcactcgaagctctctttagacaaaaattgccgcatatgtttgcgccttcta

SEQ ID NO: 658981 - DNA, 642 bp, Homo sapiens
tttataaaaaaaaagtggttctccttcaccagggtaaaggagcgtgacaacttcgtgcccatggctaaactgtatttttaggagggctctgaaaagaataccaattttctctgttcatggaaacagacaaaatcgtatgttgtggggtactgtccaggacatcaatccgttgggtgtatgggtagaagcgaactcagaagggtatagtgtttgagacagcggagttcctgactttctccttggcatcattaaactttcatgccacgtaatacaggggctggaacaccgatctagtgtaattctgaaaggctgtcttctaaggctaagtgaggagaagctttgtcttctctgataatcagaggtgtaatacaccataggatgacatatgcacagctccatatgcctttatggagtgtcagtgtctgcagagagctcactagacagtgaatcagtacagtgtgtcgagcttatcaatgtattcacaaggtgagtgcacaaaggcaagtggaatgtcctggcagaaatgggcacagcttagatatgaaagcatgggtagatgtgctaactgttcatggcaccccccaggttgggggtatgtgtggacctgtatccaggctcgtgccgaattcctgcagaccgggg

SEQ ID NO: 658982 - DNA, 337 bp, Homo sapiens
aagagtaagatataagtacgaggtaattttacccattgaattgcctttccatggcacttgctctgttgaccaattatgtgtaaaagccatgaactcagtgttccacgcagatataaccatgaagaagccacagcctctctccttgaaagtttatagtgtgttggacacaattctcagtggttgtgtacccattaacacacttaataagcatgagaaatagtccaggtctagaaatagctaacttcagagcacacagaaaggctccacaagaaaggggcatccacagtgtctgtgtagagagatatgagatgtgatatgagcacagaggaggcacttc

SEQ ID NO: 658983 - DNA, 244 bp, Homo sapiens
cccccccccgggggggggcccccctttttttttttccccccttttttgccccccccccccccctttaggggggggtttggggggggccccctttttttgaaaaaattttgtggggggccccccaatttcccaaaaggggcccctttttttgggggttccccccaagggggggggcccccaaaaagggtttttttttttaatgggccctttttttttttaaaaaaaggggggttttcccccttta

SEQ ID NO: 658984 - DNA, 409 bp, Homo sapiens
aaggatcgtctcggagagagatttgggaggaggatgaccccacaagacagaagaggtatgcgacggagagactggttgcacccaattcatggtggcgaacaatggacccaaacctgcctcaaaaagagaaaggtcagagaagcaggaaactgggagagaactgtggcttagccaagaggagagggtttagaggaggaggggcccattgcttgacattccagagagcttgaggaagacgggtgctgaggacccaggacttgaaagagggcagtcctggttcaacgacctggaacctgtgggtcctctggtcgttgaaggccaggaccgaggcttgtccaggttttgaggttcccagagggtccagccagggacagggctattgcaggtctctctccctgcagggtaccgg

SEQ ID NO: 658985 - DNA, 338 bp, Homo sapiens
  misc_feature (59)..(59): n is a, c, g, or t
  misc_feature (63)..(63): n is a, c, g, or t
  misc_feature (65)..(65): n is a, c, g, or t
  misc_feature (79)..(79): n is a, c, g, or t
  misc_feature (81)..(81): n is a, c, g, or t
  misc_feature (87)..(87): n is a, c, g, or t
  misc_feature (135)..(135): n is a, c, g, or t
ggatctcttgacctcgtgttccgcccgcctcagcttcccaagtgctgagattgcaggcntgcncncacgcccagctggncncttganattttttaaaaaaaaatgtatttatttggtttgtttcagatgggggtntccctatgttgcccaggctggtctcaagcttgtgggctcaaacgatcctcctgcctcagcctcccaaagtgttgggattacacgtgagagcacctgggccctttttcatttttttagagacaaggtcttgctctgtcacccacactgggagtgcagtgggtgcgttcactacagcctcaatcttctcggggctcaagtgatcc

SEQ ID NO: 658986 - DNA, 782 bp, Homo sapiens
accccactccccccccccaccttacagctaggtacgaggcctgggctgttactcggccgagggtcatccttcatcgatagcgacacaccgacaaccagcgcatctcgagttctttggcctgaacgaaggaagagtgccctgtgccgtgcgcctcatacaccctgtgaggaggagatgaccaacgtacaacgccctgaatctggatgtgatgctgactgtgcagatgatggatcacatgaagttcttgccacctgcttccctggcatgtgtgcaacaatcaatgccccaccatgatgagccagtgagctgcctgcgagtgacttggtgacaatgcatgcctgtcaatggtgcttgtttggtgaacgaacttctgacatgactgtaggctttctcgatatgacgcaaaacaaaacagctctatttgtgtgacgttctacttgccccatgtgtagtcggtacactagcaacacacgtttgtgctccctattttgcggataaacttggcgcagatgactgtacaaaggcaccatgacgaacatctgtcatctgccaacgatgtgactctgactgccaaacgaggtgcgagcgcctgacaacagtgccacagcttacccacacactcaagtatctttccttgccagtgcccgaccgtgcacggtcactcgattacaactgtgggaccgcccgccttgactggctccaccaacatcctggagagcggtggccccggatggcgccggcgctcctgacgatctcgaggacctgcctacgcgacgcccaca

SEQ ID NO: 658987 - DNA, 241 bp, Homo sapiens
atgaccaaagaggctgagatatagacagagatacagaaagagaagcagagagaagagagagacacacacagggacacgaagagacagacagagagacagaggcaaagaaagggacacagcaaagggacaggcacagagggagggatagacgggaagagagacggagggatagagacagacacgggggagagatggatggagaaaggaggcaccgacggagacacacaggggtgtgctttca

SEQ ID NO: 658988 - DNA, 617 bp, Homo sapiens
tggtttcctctttaaaagtccttaatagggttagggtgtgggaaaatgctatattaataaatctctagtgtttggtgttaatatgtccaaaaccaaagtaaactggattgaaaaatggactgggtctaattatcatgactgattagactcgtggtttaagtggtgtagtaaagcatttaggagggtcatcccgtgttcacaaaagtgccactaaaacagcctcaggagaataaatgactggctttctctaaactctcaggtttactctgggcctctatcatatagacaggcttctgatagttggcaactgtaagcagaaacctacttatagttaaaactccgttggtcttctctgggtaaccagatttttaattgtctgatttattaaacatttgccaacaggagaactccggggattggagttcctctgaatagcatatatttgatgctttgggataggtcattatgatttttacccatttggacttacattagtgaaacccatttctttttaaattatcagattatatttggtacagtggtggaaaaagctaatggtagtttccattatgaagtttccccaataacccagggttttctaacaacaaaaaaaaagg

SEQ ID NO: 658989 - DNA, 624 bp, Homo sapiens
actctgttaaaaaaccaaaaaccaaaccaaaacacatatatccacaggaacacaaaatagtacatcaactcttaaggatgtcagttcactgacatccttgctttcaagctcatccacagacttgaaaatagcccataaaatccaaattgacacttcataaattactatataaactgatactatgttaggaagaatgcaggagaaagagaaaagaaggaaaagaataaggagattcttttaaacttgaagatactaaagacagaatacaataaaatgctgtgtgtgaactttggaccctagtgttttaaggaaagctataaaagacattaaggggacaaatgagagaaatctggatatgaataatatatgataatgtctgaaaattactgtttattttcttagatgctacaatggtattgtaccaactttgaggaatatgctgtgatattgaaaataaattgccatgtttacaattgactttattatggatcaatgggaaaaaagaagtagaaaaaacaaacactgcaaatgtcacaactgttaaatcgctgtatttttcattcatactatactttcaacaattaaaaaaatatatatatattttaatagagatggagtcttgct

SEQ ID NO: 658990 - DNA, 859 bp, Homo sapiens
ataggaccccgtctcataaaggcgggatccacgggggtgaaagacaagggccccccgcgtttaagaacaataccgggggcatggcgggggaaaacaacccggcagcgggaattggcaaagggccagacacaacagcgacggcgggtgattactacgcgggagcaccattgcgtctggcgagagctcacaagaagagagaatctccccccccgcgtctactatcggggcctgaaagagttattgaacccccccgccgagatagttccgcgccggcgtgcgccgaaaacagaagaagataattccctagcgcccttttcaagacaggtaaagggcaaaatgtgggggccccgtgcagatcacgccggccatggcgaccgccgaaactaggtcgggagttgcgcctctcccctatcagcgcccagcgcccgggtgttaaggggagcagaagcaaccaagggtagccctccccgcgcaaggtgagtggaagacacacacacagcggagacatagggccacactgcagtacgccccagcccacgcctcaaacaacacccgacgaggcacacacaggtatgcagtgtcctcggcaaccggcgtcgcgcacgataatgaggttctaccgcgcccacctaaggggtgcaaaaacccaaatttccacgcgcacgcattggtgtgtaaagcccgcctacttgtgaggcgagatcataaatataacgggggccaattgggagagattcttcaatgagtctagttttcaaaccgcggttcaagatcccttgaatggcggcctccggcttcatgttatcgcaacccggcccgcatttaacatttcaaagcgacccccttccccgcaaacaag

SEQ ID NO: 658991 - DNA, 257 bp, Homo sapiens
tgggtttatttgagacggaatttcacgcttgtcacccagaatggagtgcagtggttgcaaatcttggatcactccaacctctgcctcccgggttcaagtgagttcttctgcctcagtctcccaaatagttgggattacaggcgcccaccaccagacccagctaatttttttttttttatttggagatggagtcacactttgtggcccaggcgggggtgcaagggtgtgatttgggctcacggtaacctcggccctcc

SEQ ID NO: 658992 - DNA, 414 bp, Homo sapiens
  misc_feature (76)..(76): n is a, c, g, or t
  misc_feature (159)..(159): n is a, c, g, or t
cccattcttcttaaaaacaaaattaacccagcgcggtggtgcatgctgtaatccaactcttgggagggtgaggccnagattccttgaaccaaaggggttgaggctatgttgagctgagatccccccctggttctccacgcctggatgacagagtggagnctctgtttcaaaaaaacagaaaagaaaaaatagtttggttcttcctttttttaaatttgcaaatctcaggataaagtttgctaagtaaattagtaatggcctatagaaataactggccaaaaattgttccccctaaaacaatcgggaattgcttattggtttatgggaaactctttgtctttttaagacccctaaaagccttttggaacttgaggggttaaaaaaacttaataaatttgccctttccaatttcca

SEQ ID NO: 658993 - DNA, 303 bp, Homo sapiens
ttttttttttgagatggagtcacgctctgtcgcccaggctggagtgcagtggcacatctcagctcactgcaagctccgcctcccaggttcacgtcattctcctgcctcagcctcccgagcagctgggactacaggcgccggccaacacgcccggctaatttttcatatttttagtagagacgggtttcaccgtgttagccaggatggtcttgatctcctgacctcatgatccagctgccttggcctcccaaagtgctggtcacctattcttttaatgttcaactatttcttactgcagtcgac

SEQ ID NO: 658994 - DNA, 405 bp, Homo sapiens
  misc_feature (37)..(37): n is a, c, g, or t
  misc_feature (42)..(42): n is a, c, g, or t
  misc_feature (44)..(44): n is a, c, g, or t
  misc_feature (46)..(46): n is a, c, g, or t
  misc_feature (113)..(113): n is a, c, g, or t
  misc_feature (284)..(284): n is a, c, g, or t
  misc_feature (289)..(289): n is a, c, g, or t
  misc_feature (291)..(291): n is a, c, g, or t
  misc_feature (293)..(293): n is a, c, g, or t
  misc_feature (305)..(305): n is a, c, g, or t
  misc_feature (376)..(376): n is a, c, g, or t
  misc_feature (387)..(387): n is a, c, g, or t
cacaatgctctacagagaaagctccggatgccggtgnggctncncnatggccttctctcgacctacggacaaacttgagcgctcaggacttcaagtctcgcggacgtgccggngaggagcgtaactgtacgaggtgagaatccgtgcatttgacccaggttaaccctctgccagaggctcgacacccacaccttcagtccccggcctcgctttggagtccttggaaatacgacacaggaagtcccgcccgaccgggcaaaggccaggggcggggcgacggcgancagananangaactttcccgngtttggggggcgggttgggccactgctgtgctgagtgcaacccccggaagtgagttggctgccaagtagtnaaagctcagcntgggtcccgggaagcctt

SEQ ID NO: 658995 - DNA, 199 bp, Homo sapiens
actttgcagtcctcacatcacaaatagagtaaaagattcccaaaaggaaggggatccttttgactgccagacgcgggaaggaaagaatgaaattaaagaatatccttttaaacacacacctcgacacaattttccactctgctaagggatcacaaagactaagacgcgggcagactccccataagccacgcttataacc

SEQ ID NO: 658996 - DNA, 238 bp, Homo sapiens
tgggggccccgggggcccccttttaccttgaacccctttttttcccccccgggggggggttggggccccccctttttttttttgcccccggggggccctagggggtttggggcttattaaagggggggggggttggggggccgggcccccccccctgacccccccccccgggggttttttttttttattccctttttttttttggggcccctttttaattaaaccttttggggtttta

SEQ ID NO: 658997 - DNA, 227 bp, Homo sapiens
aatgcatgtgaatagctagcaaaaagatgtcaaggatgtcactgggagccctatctgaggggggtcatccatgggggcgagaagggatttgactgtacatgtgctatgtacggtaaatggtctttatgtactatgtactgttaagggtggataggtctgtcggtatcctactgagtgaggggtggctttggagttgcagttaatgtgtggtacttgaaggttgattg

SEQ ID NO: 658998 - DNA, 304 bp, Homo sapiens
gcttagattagcttcatagtccccgggagtaatcacaatgctgtattctattgtaaagtggacataagagtagtatttattttttttaatatagcgcaagtggtcaaaagtggtcaaaatggtcctcattcctcgatggtctctttataaccagtctcttgcccttcaaacagaggaaacctggcctccacataagcccatgtgatgtagccataggctaggtcttggactatgctgggcagctcagagatctctgctctaatctgccgcattgagtcacggtccctcagagtagcagtgtgtg

SEQ ID NO: 658999 - DNA, 343 bp, Homo sapiens
  misc_feature (22)..(22): n is a, c, g, or t
  misc_feature (221)..(221): n is a, c, g, or t
  misc_feature (232)..(232): n is a, c, g, or t
  misc_feature (249)..(250): n is a, c, g, or t
  misc_feature (281)..(281): n is a, c, g, or t
  misc_feature (287)..(287): n is a, c, g, or t
  misc_feature (289)..(289): n is a, c, g, or t
gagacggagtctcgctgcactncagcctgggtgacaagagcaaaacttcgtctcaaaaaaaaaaagaagtttaaatatcagacaggaagacacatacgaacaatggcctttctagaaaagagaaaacttaatgttagtattaggcctaatgagactattgagtagcttgttgagtacatgaaacatacactcacatcaaatatttagaagctaataaacancaattggaaanaaatggttacaaaattnnattgtataacaatgaaaataaaaattctaancatagnangtatgaagaaaactacaaaatttcttgagagaaatataacttcattaaatgagg

SEQ ID NO: 659000 - DNA, 1148 bp, Homo sapiens
gggaacctgtgctcagatgacacccccatggtgcggcgggccgcagcctccaagctgggggagtttgccaatgtgcttggagctggacaacgtcaagagtgagatcatccccatgttctccaacctggactctgacgagcaggactcggatgcggcatgctgtgcgagtggcaggcgtgcagtgaacatcagcccagacattctgcacccaggtaggatcctggaggccctggctgatgccctactcatgcgccaggacgatagaagacaagtcctggcgcgtccgctacgatggtggctgacaagttcacgcgagctccagaaagcagtggggcctagagatcagccaagacagacactggtccactgccattccagaaccattgatgaaagactgtgagtgccgaggatgagggacggcaggactcgccacaaggtcaaagagtactgtgacaacctctacagctgactgtacggagagaatagtgatcatgtaccacatcttgccctgcaatcaaaggagctggtgtccgatgccaaccaacatgtcaagtctgcccatggctcagtcatcatggggtctctctcccatctcagaggcaaagaccaaccccatcgagacacctaattgacacatctaactggatcagcatgaggatgagaagacataaggtacggacgcaccatcatctctaacctggactgagtgaacgacggtgaaatggcaatacaggaaaatggaaacaagaacgcagacaacacgtaacactaagtgaagaatgcatgaagaacagcaaagaatacagatgagagagaccaacacatgaagataaagcaacataccgtgcagtaaacaactaacaaacgaaaacacaatgaaaacgcaacgcatagtgaagtgacgagctggagggaacaagaaaaataacaaacagcaaggcacacacaaaaacaagacaagaaggagaggcaacactagtaacagacgcggaacgagacaacgaacaccagagcaggtacacacaagcaggaccccagaccagaaagcaggaacagcaaaaacacaaacatcgcacaccacgcactaccacacaacctaagctcgaagaagacaacgatctacggatgcgaaaggccagagatcgagc

SEQ ID NO: 659001 - DNA, 1258 bp, Homo sapiens
  misc_feature (12)..(12): n is a, c, g, or t
  misc_feature (72)..(72): n is a, c, g, or t
  misc_feature (235)..(235): n is a, c, g, or t
  misc_feature (381)..(381): n is a, c, g, or t
  misc_feature (396)..(396): n is a, c, g, or t
  misc_feature (423)..(423): n is a, c, g, or t
  misc_feature (653)..(653): n is a, c, g, or t
  misc_feature (741)..(741): n is a, c, g, or t
  misc_feature (1048)..(1048): n is a, c, g, or t
  misc_feature (1085)..(1085): n is a, c, g, or t
  misc_feature (1096)..(1096): n is a, c, g, or t
  misc_feature (1156)..(1156): n is a, c, g, or t
  misc_feature (1172)..(1172): n is a, c, g, or t
  misc_feature (1240)..(1240): n is a, c, g, or t
  misc_feature (1258)..(1258): n is a, c, g, or t
gtcggtgtttgngtggtgaatatgtgagctcgtattggggagtgtgtgtcgttggtaatgtttttttgttgngcgagcatcgaggtcgtgatgaagtggtgtgtcttgtgtgtgtgggagggttatgtgtagaatatggcgtgtatggtggagtactgccctgcgctgcatcctgttggacgtgtgtgctgttgtatagtacgtggatgtctgtatagagtgtgcgtgacgtatngagtcgagtatcgtcggtgaatgctatgttgacgcaagcgtggttgtggagtgtgtatgtgaggtatggatgtgtagatatatgaatggtgagctggggttgtgatgtgttgcgatagaggattgtgcagtgttcgtgttgtggtntgttgttgcgaacgntagtggtgcgcacagattgcggtgtgntacgaggtgtagtgtggtgtggagcgatggtgaagagtatctgagagtgttgagtactagtgtgtgggtcgttgtgtatacatatctgtcagtgagggtgtctgcgtttgtagatcagtatgtagaggtgtcgtcagtatcgaggtagtatcatagtgtctgaatcggtatagttgatgcattggtgtgtgtgagtagggatagtcagctgtgactagattgatacgtgntatatgatgtagtatggattggtgcgttgatatctaggagacgctgtgtgatgcaggatgtgtgagatgtggggatgagcgtgtggtngagtggtctgatgtagtgagttgtatggtgatggtgtgtgactgatgtgtgatgggagttgtgatgatgttgtagtgagtatattgttggatgtttagtgtcgtgtgcgtatgtgtagcgatggatatgtatgttgtatgatggtgatgtgtgtgttgatcggagcgatatagatagtagtgtctggagtgattagggttctggatgattctgttatgatcgcgctcggcgtggcggtgtcgttgtgttgatgtgtgatatgatgtgctggatgatatgatgtagagtagcgtgagatgtgtgacgncggggcgctgtaggtgcgtgcatgatgtgtatgaganagtggatcggntggtcagacgtagtattgcgatgagtgcgggatgatgatgctgagatgctgatgatgagnagtaggtgtgtgtgangtagtgtgatagttattgcgagtaggatgactgtgagcgatgatgtgtgatgtcggtcatgtatgcgngtgcgtattgtgtgggtn

SEQ ID NO: 659002 - DNA, 445 bp, Homo sapiens
ctacaacgccaaggcgttttcttttttaccgaatccgaatcggtcgttagccccggattctaccaacgggacggcttgaaacggtttcatggatgaacgggcgaacgtttgccgatgcggtctcctaattcgtaaagcagccggccggcggtatctacaacggcgacgtgaatctcatgcgtactttctacatattgaccgcgatagacgcgaatcggtttttctttcatcgtcatcatgtccttccctcctgtttgtattgtaccatgaagtttgtcttgctttcctacgattttccggtaaagacgttgtttaacggttttttcttcttcggggttatatttagatgaaaaatatacttgaaggaggttttcctcaattttttcgctagtcatctcatcaaatatatatataaagtttaattgggtgcacgtctatagtttcc

SEQ ID NO: 659003 - DNA, 108 bp, Homo sapiens
ggtccatgatgttgtggcagtgagaattgcttgacacctgggagtgctgtgagtgttgcatgtgagcctgatattgctgccactgacactccatgcctgtgtgtgaca

SEQ ID NO: 659004 - DNA, 552 bp, Homo sapiens
  misc_feature (5)..(5): n is a, c, g, or t
  misc_feature (95)..(95): n is a, c, g, or t
  misc_feature (99)..(99): n is a, c, g, or t
  misc_feature (115)..(115): n is a, c, g, or t
  misc_feature (213)..(213): n is a, c, g, or t
  misc_feature (292)..(292): n is a, c, g, or t
  misc_feature (338)..(338): n is a, c, g, or t
  misc_feature (379)..(379): n is a, c, g, or t
  misc_feature (385)..(385): n is a, c, g, or t
  misc_feature (427)..(427): n is a, c, g, or t
  misc_feature (444)..(444): n is a, c, g, or t
  misc_feature (447)..(448): n is a, c, g, or t
  misc_feature (455)..(455): n is a, c, g, or t
  misc_feature (510)..(510): n is a, c, g, or t
taganaaaaatgggttaaataacaaggtaaccatttgtaatgagtctgtttagaataaaatagttcttcacaaaagttagaaaaggccatgagtnagtntatgactgtataaaanatatcagtgaggtcaaaatatacctgtaccaaaaagtagaacagcaatggtagtggatctaaatgtgtcctaaattaaattaaagcacataaagtttnagtgttccacaataaaaccattgctctgaaggaggaatctgtgggggttggttgggtaggttactgagaggggaaaggnccagggctagttaattttgttattttttattggggtttgttggggngggtttggggtgtggtgtgagggggggcattggtttgtggngggggnggggggggggggggattgtggggtggtgtttggggttggggntggggggaggggttttnttnntaatttntgattcgttttgggtgggggttgttttgggttggttttagggggggtgggtgggngagggggtgtgggtgttcgttgatgagttgtggttgtgttta

SEQ ID NO: 659005 - DNA, 362 bp, Homo sapiens
aaacaccatctctactaaaaatgcaaaaattagctgggcatggtggagggcacctgtaatctcagctactcaggaggctgaggtaggagaattgcttgaacccaggagatggaggttgcagtgagctgagatcacgtcactgcactccagccagggcgacagagcgagactccatctcaaaagagacaaacaaaaaaaacagtttgggccgggtgtggtggctcacgcttgtaatcccagcacttcggaaggcaagcgggcggatcacgaggtcaagagatggagactgtcctcgccacatggtgaaatccttctttactaaaatcaaaattatctggcgtgtggtcatcctctagtccagc

SEQ ID NO: 659006 - DNA, 560 bp, Homo sapiens
  misc_feature (337)..(337): n is a, c, g, or t
cgaactgcccccccccccccccaagtgggaaaaccgcaaaattttttcacaattttgtgagggggtttccccttgttccctgccaggatttaaaacccatgtgaatttctttgtgtgccaaaaaaaaaaaaaaaaaaaaaaaaaaaaaaaaaaaaaaaaaaaaaaaaaaaaaaaaagaaaaaaaaaaataagagggagcgcgcgcgcgccgccacaaatatctccctcccgagagaggccgccaaccccgcgcgacccacccccaccgtatagcatcagacaagacggggcggcccctattgagaggagagagtgcgtctattatatatatagacanagagagagacgaggcgcgcgctcgcgtactttttataatcaacacgcacgtctgctagcgcaggtgcgtgagagcaaaaagcgctgtgcgcacagatggcggaggagaacgaccaatcttgtgagtgcgaaacagcggacccacctacttatctgtgttgtggggtgggagagtgagagaaaaatagaggtgtgggagagaacatacccatcactcgaggaga

SEQ ID NO: 659007 - DNA, 852 bp, Homo sapiens
  misc_feature (339)..(339): n is a, c, g, or t
  misc_feature (644)..(644): n is a, c, g, or t
  misc_feature (845)..(845): n is a, c, g, or t
accagcgcaagagggaagcagagtaaaagcaaccccggccgcggagcggctcacggcacaacccccgcccccttctttcccccagacgccgaagtcgcgggcgcgcatggcgggcctggagggacggtacgcatcggcagcgccggccaacacctgcaggcaggacgcgcccgtctgcttctagcattgggaaggggggacacacggttacatcggcatggggggcggggaccagccggggcccaaagaaaagaagacagaacagcggccagcgggggggaacaacaaaaaagaccagaaaggccaccgggaagagaaaaaggagggggccagaaagcnccctgtgaaagccaacaccggggagagcagcaagaaccccaaagggcaggaaaaaggcacacagcaagaggcagacttgaccctgaacaaggaagaaaaaaacgaagcagaacacctgggggacatccacaggaccaacaagaacagtgaggagcatcgggcacgaaaagggtctggaaacatcacaccaaaccaagagcagtgggaaaaggcgaaagaaagcagtccccaccgggagtacccccctgctaccgccagagaggtggacccactccggattcctccacgccacccacacaccagtnggcagcctccctggtgtgatcccctgggcccgtttgttgtcgggggagaagacttagacccttttgggcctcggagaggtggcatgattgtggatcccctgagatctggcttcccaagagcacttattgacccttcctcaggcctcccgaaccgacttcctccaggcgctgtgcccccaggagctcgctttgacccctttngacccaa

SEQ ID NO: 659008 - DNA, 203 bp, Homo sapiens
ccatagaatgactacataccttccgggggttgatatgatatctatctcattttagttttggtttgcatttctctgatggtcaatgatgttgagcaccttttcaccttttcatatgtgtgtttgacatttgtatatcttcttttgagaaatgcatattcaaatctttcacccattgtttgatcagattgttagattcttttttt

SEQ ID NO: 659009 - DNA, 1237 bp, Homo sapiens
  misc_feature (1237)..(1237): n is a, c, g, or t
taaaacttccattttcagtttattttataaaccagaggggcacgtacccccagaaaagcaggatctgaaaaccatcaggggggcttgcttgaagtgatctgccccagccttctgacttcagaagtgtctcatgatccaagtggccatgtggggacggagctgccccttgataggatgcacttaagcatggtcaattcccctttcccccaaaggaatgtggagaaaaggagccaagaagtcaatgaatcccgggaatattggtcccaaaatccttccagggatgggtatacagattgggccaccatgtccacaattggtgactgggtcacggcggatctagtaacagagggatcggactgttggcggcaagaataataatcctgggatgatatcgcactccacggcggacatagcaaatcaccagcgctgtcacatttaccagtctgcaagacagaccacagcatatagagcgctatagagcaacagagatatcaccaagcggcccgacaaacattctactttagacaaccactatatcctccaataacagaagcgttggggcacattttaaccccaccacaactacattgggttaaaccacacacacctgcggtcacacagcacaacgcaagcaaacgcagcaataacgcggggctatcctacacacacgtcggtaagtttcaagccaaacaaagagctaacgggagaccaccactctgggggacaaacaccaacggggagacagagagcgaacaactaggaacccccaagcacaggagcaaaaacacggcgtgcgaacaacaaacaagtgggcggcccacagtgccatagacaaccagaggcgtcaccctataacattaccacagggaccatacagtgggtaaggaacaacaagacgaggagacggcccagttagagccaccaaacagaaactgtgcaaccaggacaaacaagatacaggccgcacaacacacaaacaacagtcgtcgggaggggaatcggaagcccccaaacgatcgacaacacgcccgccacgaggcttcattggacaagcccaacaacagacaccagctggacgcacgaaggcaacatctagtaggcaacgcgggggaccaccaaccccaaaacatgcagcaaggaaactatacagtcccaaacaccgcactaataaactccccaccacacagagcacaggatagcacagaagacaccacagaaaaacgttagagcggacgan

SEQ ID NO: 659010 - DNA, 288 bp, Homo sapiens
gggcctccttgttttccgccttgttgtccttttccgggtcggggcccgcccccccgcgccccgttaagggccagtttagcggggggaaccgcaacaacagcgccgagcgccttttggaggccgtggccccccccccccccaaggagcccccggaggccgggcccggccgggcgggggccgtggaaaaccagttctcctttttaaaattcccggggccgcccgggtgggcctcccctatctcttccgccaataagccctgttaattgtagcctgttttaggggctgcca

SEQ ID NO: 659011 - DNA, 779 bp, Homo sapiens
ttccctggcccctctggtcattgtcctgggtctcccccggttatgagtgtgcccaccggctaccctacatgcacatttctcgttgctgaaagaaagttgttttcgcgcgctttcttgttaaaactctgacgaccgcgtcccaatttttacaacgcttttgtgtaagcccccaatcgggcatgtaatagtcgtctccggacaacacacaccgcggttgtaggagcaagctttctcagttgcagtcaaccccccagcgagccacctatcaggcccggtcacaatcagcccgaacatgctcccgtggtggtcatacacacaaccacccgaggaccacccaaagtccttgcggcatccgctcgagagtccaccaatagttgcccccagattgttctcaaaggcccacaacggcagaattattctccccgctgaatcccgccccgcccccttcgatacatacacaggtggtagtaaccaagccgtcttgacaaaccttgtttggatcaccattgtgccctttcaatcttcatccttactacaaatgggggttcaatgatacacacaggggtcgatgtacaccgccccacgatagatacatgatatattctttaggtggcccaccttgggttgtatttatctgtgctgccgaggcaccgactatgttgatatgagtcttaaaccacgcccttttgggactgggaccacgtagtgcccccacgagcagctctcgtgcataactgttcgggcagcccccttagacgaaataaaacagcccacataac

SEQ ID NO: 659012 - DNA, 536 bp, Homo sapiens
cacagagtccacctagcctcagccccctaaactagggggataacaggcgtagagccgcatagcctaggccgcctattctaggtcataagtttttttctagagaaattttttttcatagtatagctatgaggcatagtctagtcttataagtccagctatggttagtagagcaagtaggattgtatactagtaatagtattttatagtatagtcgggcttttagtctagccagtttctttggttattttacaaaattgaataatgatttctggatcatcactttgtattatctgtaatttggtctctcccattaacaccattaaatagatgataactgattttatttccttctctttcaaaggaaaaccagtgttctctggacatgaaaagcaaactgaatacaagtaaacaagcagaaaatggacaaccagaaccacaaaacaaggttccggctgaggaccttacattgacattcaggtaaagaaaaggagattgtcgtagccatattaaattacacacaaaagagaaactattat

SEQ ID NO: 659013 - DNA, 149 bp, Homo sapiens
  misc_feature (6)..(6): n is a, c, g, or t
gcttgnatgcctgttgtccctctagaggatccccgacaagcccatcgactggctcctggaccatattctgtgggtgaaagtctgcaaccccgagaaggatgcgaagcactgtgaccggcaggaagccaacctgcagatccgctatccgt

SEQ ID NO: 659014 - DNA, 574 bp, Homo sapiens
acggttaactagcgtagaactaaatctccacagtaaaggaaagtcaagcatatgcttattatacactcctcagattattattaaaaggagttacattttccttatggaaactcaggattctacaagcaatgctctcctcagtttcaccagtactgtgtccagtactatattgctatattcacagtaaaacggacttcaatttctgagtgatcagtctatgttttaagtttctgatgaaactaacatacaccttagtcaaaaaccacaacaattccctcaatctgtttgctgtgttattgttcttgtgtgtttttctgaggcttgggtaatgtaagtacttccccactccattgtaatctgcgattggcatctaaagtaattcattaatgtacaggagtagatgaggcctggcacacatagcagaaggtaatggttctataggtgtatcttctgtaatgcacattgggctagagaaatagaaaaatcacacgtaacaaaaacaaatagctttttggagcacacgggtgtcgcgtgactaggaccggcctacatgtagctatcatccttccccatt

SEQ ID NO: 659015 - DNA, 338 bp, Homo sapiens
  misc_feature (66)..(66): n is a, c, g, or t
caagcagttaatacagactcagtgtcctgagtagctgggacacaggtgtgcgtacatgcctcgtanatttttttggtatttggtagtagagacggggttttaccatgttggccaggctgttctcgaactcctgaccttgttggaccacccgcctcgagctcccaaagtgttgggactacaggcgtgaaccaccgcacttggccttgtattttttagtagaacccgggttttgctgtgttaggcttgtccaaaactcctggcctcaagtgatccacctgccttggtttcccaaagtgctgggattacaggcgtgagtctgtattaaactgcttggggta

SEQ ID NO: 659016 - DNA, 718 bp, Homo sapiens
  misc_feature (718)..(718): n is a, c, g, or t
gtcagcaaagagttcacttaaaattagtgcaggttgccaggcgtggtggctcacgcctgtaatcccagcacattgggaggccgaggcgggcggatcacgaggtcgggagttcgggactagcctggcaatatggtgaaaccccgtctctactaaaaatacaaaaattaggcaggcatggtggtgcatgcctgtactcccagctactcggtaggctgagacaggagaatcgcttgaacctgggaggtggaggttgtggtgagccgagattgcgccactgcactccagcttgggcaacagagtgagactttatatccaaaaaaaacaaaaaggagaaattcgagggcccggtggacgggtgctgtgctgtgctgtgtgctgtgccaattgccggaaattcccatttaccagcgctttgcgatttttccccagaggcttgctctgaacacaaaggggccaacaacaatggggcgggcggaaccgaacacccaggatttggaacgcgtgcccatacaggggcgggcggccgaatacaaggaggtcccgccaggaactagtcctaaagatcaacgcgcagttcgcgtcgaagacaactcggtaatcgggaaactgggcctaagtttaaataaacggtgtggctgtcacccaagattctcatccctggtggggacgttattgtcgcaaaaatctcctttccttctaaaggggcggacataacttn

SEQ ID NO: 659017 - DNA, 151 bp, Homo sapiens
tagaatagaatacaacagaatagaacagaaaagaagagaacagaacagaatataatagaatagaagagaacagaacaaaatgtaacggaatagaatgcaatagaatagaatagaatacaaaacaacagaatagaatagaattgaatagaac

SEQ ID NO: 659018 - DNA, 169 bp, Homo sapiens
cttacggtactctatagatagtgtacgtgtttgatttgttataataacagaatttgtctaggtccacagtcccaggctcctgagatctactaagtccttggaattcctcaagtgacagggatgcctttgttattcattatagagctcctggtgaccgtgcctgacattt

SEQ ID NO: 659019 - DNA, 895 bp, Homo sapiens
gggactcgcgtcgtgtgggatcccggacgtaggtagttgtgggccggttctgaggccttgttctcttaactttcccacctctaggccacgatgccgcagtaaccagacctggaggaatacagccgcgctttgccgagaagctttacctcgttgaccctatgaaggcacgtgtggttctcacatataggcattctgatgggaactggtgtgttaacgtaccagagtgatcacgtagttcggtgtataaaacagaccagctcaagatgtacagcaaccattgggaaattccacagtcaatctatggcgacttatggtaagccaagggaaggcccgcaattgtttacctattggaacctgatgtgagtggtttcgaccatggaaagactttgtgtccgggtacccttagggaaaggtacaatatctttcggaccttacgagaacttgtttgggacacgcacacagtacttttatgtacacctaaaggtgggctggtcccaaaggcctaaagagggctcattttcgtaaataccctcttataactaaccttttaggagacgctagggatgccaacatgtgtttcaggctaagaagagcccttaattctacctttgtggcaattggcccacgaaatggcatcttgtcttagacaccgtggcgaatacttcgctgttacggtcaacacctgtcattgttgtctcttgccacaattggtatcaggcaacttggacactgagattttaggaaaaccatttcttcttaattacgccacttcctttacacgaacataactgtgcccttcgcgcatcctgttttgggccaaacggttcggtgtgcccaaacttaatcggggtggggaccaccatctggcggcatcaccgggcccacgttaccgcgg

SEQ ID NO: 659020 - DNA, 233 bp, Homo sapiens
tagatgacagagttcactgttggacagtctggtctcaaattcctgaggatcaggtgatccatcctccttggtctcccaaagtgctgagattacaggcatgacgcaccacgcccgatctacgtatatcttattagtctttagttgtcgtcgtaagctatacgtcttctgggaacaaaaaaaattcacaagggcttaagaaataacattctggccatttttgcaagcacacttgt

SEQ ID NO: 659021 - DNA, 360 bp, Homo sapiens
  misc_feature (11)..(11): n is a, c, g, or t
  misc_feature (24)..(24): n is a, c, g, or t
  misc_feature (27)..(27): n is a, c, g, or t
  misc_feature (51)..(51): n is a, c, g, or t
  misc_feature (72)..(73): n is a, c, g, or t
  misc_feature (88)..(89): n is a, c, g, or t
  misc_feature (92)..(92): n is a, c, g, or t
  misc_feature (102)..(102): n is a, c, g, or t
  misc_feature (119)..(119): n is a, c, g, or t
  misc_feature (142)..(142): n is a, c, g, or t
  misc_feature (147)..(147): n is a, c, g, or t
  misc_feature (183)..(183): n is a, c, g, or t
  misc_feature (227)..(227): n is a, c, g, or t
  misc_feature (231)..(231): n is a, c, g, or t
  misc_feature (239)..(239): n is a, c, g, or t
  misc_feature (245)..(245): n is a, c, g, or t
  misc_feature (252)..(252): n is a, c, g, or t
  misc_feature (320)..(320): n is a, c, g, or t
tctcatttaanttttttaatgggnctnaaaattctgtgaaaaatttttggncaagttgtttccattaaaaannactgattttaaaaannaanaacttaaaantgccacacgcaaaaaanaaaaccaaagggggccacaaaanattcncctttccttctgaaggttttacgatgcattgttatnattaaccagttttttactactaaacttaaatggccaattgaaanaaanagttctgngaccgntcttccnccactgattaagagggggggggcagggattaggggtaatattcatttagccttctgagctttctgggnagacttggggaccttgccagccccagcagccttcttgtcc

SEQ ID NO: 659022 - DNA, 101 bp, Homo sapiens
tggtgattagaggatcctggtcagtgatctctggctagtgattctctgctcagctgagtcattttctattaaataagtcagcagtcataagtagatgtaaa

SEQ ID NO: 659023 - DNA, 164 bp, Homo sapiens
tgcaggttgaggcttactagaatgtgaaaacgtaggcttgggtgtaagcgacagcgatttctacgatagtcagtagaattagaattgtgaagatgataagcgtagagggaaggttaatggttgatattgctagggtggtgcttccaattaggtgcatgagtagg

SEQ ID NO: 659024 - DNA, 172 bp, Homo sapiens
tagcagccggtgatcatgcgtgccgatcaccaagtgttgggtgtggcagacctgcatgcttaattatgttcgcccgtatccccctgttgttaaatttgttttccctaaaactcttatgcgatggatggacccgtcctctatgcacagtgcgatgacaccacggcactccccg

SEQ ID NO: 659025 - DNA, 409 bp, Homo sapiens
  misc_feature (1)..(1): n is a, c, g, or t
nttgtgcgtgttgccccagcctgtcgcggtacagctcttgccatcccacaggccctgcccgacatctggaaggcacacagcctgaatgtatcctgtaagggccaggggcctgaaaaggtgccacaggccaatatcgttcctgttctcctcgctgttggggtcccgaaaggaaagatagcccccgtggtagaccacagcttgcacccccattcgcagcccgtgggaagaggcttgggccgcggcaccggcaacacactcgccttcggcacagaacgcggttccgctccggaacacagtgggcgcctgtcagcaccgagtccgcgagagaacaggtatcccccacagagtgtgtgctccctcatagcagagtctcacttgccgcggacagcggcccaatctcgctcgtgcc

SEQ ID NO: 659026 - DNA, 513 bp, Homo sapiens
  misc_feature (80)..(80): n is a, c, g, or t
  misc_feature (461)..(461): n is a, c, g, or t
  misc_feature (491)..(491): n is a, c, g, or t
tggaatagttgaagaagtctatatcgtgacccttagtcatttgtctgcagcccatactctcttctgaactgtagaccatntagtctccgtctagtccgagtacagtatttcagcttcgatatagacagatatctcactacacgtgtccaaagtggaactcctgtttaccctccccaatatgttcttccagcattctccccatcccatttatgggactgctgtgcttccagttgcttattgaatacacctctggtcatgtttttttcccgtgtaaaaaaatctggtccttcatccagttcatcagtaagttctgttgactctacctgtaaaatatattccaaatttcatctatcagaactacttccggtggcaacagcttggtccaagccaccatcctctctcatctggttctttattgacccttagaggctgtagtcctccccgcagcgaaaacaatccgngaaagtgttagtcacatcatgctctgctgngctcaaaccgcgcgggggctct

SEQ ID NO: 659027 - DNA, 171 bp, Homo sapiens
attcccgtcccaagttttttttgcccagtttttttagaatgaattttaccagtttatgaatttttgtaaacagaatgtgtcatggaaaaactgaaaaatttttccctaaagtggccttattggctgctggtgtgatgcccctgtaatgtaataaattttttaattgtttca

SEQ ID NO: 659028 - DNA, 911 bp, Homo sapiens
gcccactgctgctctgaaaagccatctttgcattgttcctcatccgcctccttgctcgccgagccgcctccgcggggcgctcctccgccgcggactccggagctttatcgccagagtcctgaatctcgcttttctttttaattcccgtgcatcggatcaccgggtgcccacaccaatgtcagacggcagcggtagaaacacagttcggaatatccaccaccagggactttacgggagaagacggaagtggttgaaacgaggcagacaatggaaagagaaggcccttgtaaaagggaagtggctaattggggaaaaattgggggagcagggaggttgaccatgtggagggtaaggacggaagaaaaggaggaaccgcagggtgggggagaaggaaggagggggggaagaaacgacgggggtgatggggtcgagggacacgcagacatgtgggacgattggaggcattgagcgaaacgctgaggtcaagactcaggggggcaaggccggcaagttgaacgaattgattgagggattgccgattgttggatacccaagaaagcagaagaaccggggaggcattggattaagaacgggcaaaaaggcaaacgtttaaccctacaaaaaaaaaagggggggcggtgacattattcaacccttacaattttccggttctacagattctacaggtgtggtcccccttacgagttaagaggaggccgggccggcacacgtggtgttatgtggcacaccggggaaatatgacaaggtgtttttcaacaagccaaacaaactagtgataaatttggacagtgtgggggaaaaaggacacacattccagggccgtgtattttttaaaggttcttaaaaggacattgtgtgatattcagtaaacattatattttggacagatg

SEQ ID NO: 659029 - DNA, 187 bp, Homo sapiens
  misc_feature (63)..(64): n is a, c, g, or t
  misc_feature (89)..(89): n is a, c, g, or t
  misc_feature (118)..(118): n is a, c, g, or t
atttcggcacagccagggctttttctgggcaccgagttttgttttaaaactggacctgtatanntgtaaagctatttatgggcccctgnactcttgttccacaccccaacacttccancattaagctgccacatgcggagagtttaatttttaacttattgacaaccgagagggttatcccgccgat

SEQ ID NO: 659030 - DNA, 448 bp, Homo sapiens
cccccccgcgctagcgatctctgattcgcgcctggctatttcagtacacaggcgttcattatttcttattgatatgcactgagtacgcttaaaatggaagcctcatgagggaaaaatcagaatggatgcttcttgatgtacgttcgacttgtcttagacagagtgggctgccatgagtcatagtgccctatggtgctggcataggtatcagcgatccaggacatcccccgttcgcacgtgccatgtctgcagcaggcacatcaatgccaggaccaataaagcccttctactgctagctccatggatgaacctccttgctgatcatacccaatgcctatcagtatagtcctcgggatgatcttaacaccagctaagcacccccaaaagaacatccccctacgaaacacaacccaaccaaccaaacaaaccaaccaccacacccacacag

SEQ ID NO: 659031 - DNA, 1414 bp, Homo sapiens
cagccgagccatatcggctcagtatcgccaggggggaatggtgaaggtcggtgtctacaggattgggtcgtatagggcgccgtggatcaccatgggactgcatatatatgagaactctaggtaaagtggtatatttgttgcgcgatcaatgacacccattctatatgaccatcaactacaatggattagacatagttcacaattatgtattccacccagtgtgtccaagagtatccgtgggcgaccgttcgaaggtgctgagaatcggggaagacttgtcgatcaatggtaaatcgcgcatcaccattcttccatggagcgtagaatcctctccaatagagtcaacgatggagcgcgattagcatggtgccgcataggatgatgaagcagtacggatggagaaaggtctcaccgtagggcggttcgttcacgcgacccaattgcggaagaaatggctttgggagcattcgagttttggccacggtggagagcgaatgtccaataaaaagcgggatacaatcatttcctcatagacacacaccatcatagcatagaaatgccacacacaatagtatccagatcatcggggtggtgaaacccaaatggagaaagtcatgaacaagcaagcccctcaaagaatccattcacgcaagttgccctcccttggcaaccaacccagagctggccttaagacagcccccgtgggccacaaggttcaatcccatggacgagacgttttggggtattccgtggggaaagggactcatggacgcaacaagttcccattgcccatcgactggcccaggcgcaagaaaaggatcttggtgtgcagtggggcccccgtccgggggaaacacttggtggggcgttgcacttgagcccgcggggagcctcctcccaaggaaccaatttctattcccctggcctcataactggagcggcctggccaaagggctgtggggcccaggggtcacttaccccttataaggatgacacacggggaacaccttcgccggggcgaacgcgaggcaaataccggggggtcccccacagggcccacacgaggtcagggggggacgacccagccgaacacatacgaccgcgcgcgatggaaaaaaaaaacccggccgccacaacatctagctgggccactcaccaaaaagggacgggggaagacaagaggcgaggcgcagaggggggggccccccacaaggcgggacgcttgggcgctgaaccagcaaagacacacagggagcgggtcgcccccgaaagagtaactacagagaaagcagaccacctatccacctacaagcgacaagaagaccgaggacggccgaccacgacagacacagagagataagcagccatacagcggagcctagcaccacaacagccaacaacggaacaaatctgc

SEQ ID NO: 659032 - DNA, 337 bp, Homo sapiens
ggtgtgtggtgactagaggatccgtgtggtcttgagagtctcaggactctgggctggcacatatgctggtggagtgatgtcgctcagagaaaggcaccaggaagtggattttttagtcttggtgcacagatgcagtgcagtgagatgttctgagctgtttgatcctctcgctgaagtcggacacccactggatgacggtcatgccggcagccaccgtgtagtggtgacagctccgaggcaagatccctttcactagctcgttgatcagcgtgcgcaagtagttggtctgcttcttctttccttcgcacacctggacgacatctgcaaggaacccacg

SEQ ID NO: 659033 - DNA, 694 bp, Homo sapiens
gctctcccggcggctcgctcgcctggtgtctctcccgaccatggagggggtcgcggtggtgacggcgggcagcgtaggcgctgcaaaaccgagggagctgcagccttgccgctccgcctccgctcctgtctaccccgaccgcctcaccctgcaccgcaggggtgagcgggaccgcgcctctgtctgagacgggggcagcccggctgccacacggcatcccgaagaacccctgagctggagaccgagagagcagacagggccggcatcagagagacaggctaccgcaggacggaaggacagaggaagccgcaccgcagaagacgagccgaggaggaggagggaacgaggagcacggaggaggaccagagacgtacacaattcgcggcagagcgcgaggacgggagagcacgaaagagaccacggaggccagaagagcgagcggcatggcatcaaccacctcagggcgcatggacccccagaacacaatgcggataccagtgcggcgcaaggagacacaacaagactgccaactcacaaatcaccacaaactgaactacaaagcgcaaagacgaaaggggccatcggcaggagcgagaacaactaacaggacaccagaccgccccaaagagacacatcgagacccacaccgacgaccacccgcgcacaaacactcacgcaggaccgaccgccccac

SEQ ID NO: 659034 - DNA, 359 bp, Homo sapiens
ccctatagattccatgcctacaccccaatccaaacctcctaaccaagcctttttggtgattattaacaaacctgattataaattataaattaaatatgcccaggtgcagtggctcatgccctgtaatcctcaacactttgggaggtcaaagcaggtagatcacctgaggtcaggagtaagagactagtctggccaacatggcaaaaccccatctctactgaaaatacaaaatttagctgggcgtggtgatgggcgcctgtaatcctagctgctcggaggctgaggaagaagaatagcttgaacatgggaggcagaagttgcagtgaggtgagattggccactgcactcagcttaggcaa

SEQ ID NO: 659035 - DNA, 584 bp, Homo sapiens
  misc_feature (514)..(514): n is a, c, g, or t
  misc_feature (540)..(540): n is a, c, g, or t
  misc_feature (551)..(552): n is a, c, g, or t
  misc_feature (556)..(557): n is a, c, g, or t
aaaaacccccccccgggggggaagaaaaaaaaaaaaaaaacccgccggggtttttttttctttctcccaaaaaaaaaaaaataaaatctccccccccccccggggggggggaggaaaaaaaaaaaaatgagacaaccccctttttttattttaaaagccccccctttttttttttttttttttaaaaaaaaattttttgtgtccaaaaaaaaaacccccccctttttttttttaaaaaaaaaaaaattttttttttttcccccccccggagaaaaaaaaagggggccccaaaaaaggggggcccctttttttttttccgcgcatttataagaaggagttttttttttcacacaaactttttttttcaaaaaaaaaagtgtttttttttctctaaaaaaaagtcacaagaggggggggcccccctttaaaaaaatgggccttttttcccaaaagggggaaaaaaatttaaaaaataaaattcccaaaggttacccagggcccccccaaagtctcngaaaataaaaaaatatggcaaaattnttggccagccnngccnnggcagaaaagtatctcgttgcgaattc

SEQ ID NO: 659036 - DNA, 166 bp, Homo sapiens
tcagctcgtaccgggataaggaaggcacaggaattacatccaaatgagttaataggaagtgaatataggggcaggcacagtggctcacacttgcaatcccagcattttgggaagccaaggtgagtagaacacttgagttcgtaagttcgaggccaggctgggcaac

SEQ ID NO: 659037 - DNA, 83 bp, Homo sapiens
  misc_feature (10)..(10): n is a, c, g, or t
  misc_feature (13)..(13): n is a, c, g, or t
  misc_feature (16)..(16): n is a, c, g, or t
  misc_feature (19)..(20): n is a, c, g, or t
  misc_feature (22)..(23): n is a, c, g, or t
  misc_feature (27)..(27): n is a, c, g, or t
  misc_feature (31)..(32): n is a, c, g, or t
  misc_feature (34)..(34): n is a, c, g, or t
  misc_feature (36)..(36): n is a, c, g, or t
acatctgtgnacntcngtnncnncagngggnngncnggacctacgagcagtacttcgggccgggcaccaggctcacggtcaca

SEQ ID NO: 659038 - DNA, 154 bp, Homo sapiens
  misc_feature (93)..(93): n is a, c, g, or t
cgtcggtttgccggccggacttcagggacagttgcaaatgacaacgagtagtgagcaacctgatctattaccagacgcgtactcgtgatgctncatgatgattcgatgctgggcttcgagtcctcacatgatctggcagaatcgcgtggcatgc

SEQ ID NO: 659039 - DNA, 172 bp, Homo sapiens
cacccagccagcatcatcagcactgcaagcagccagcactggcaaggagggtgacaaataagcggggacagaggtggaacggctcactgtccttgaacagaccttgaaaacacctggtgtaccgcccactgggagacatacacgtggcccctccacttctttctcctgactg

SEQ ID NO: 659040 - DNA, 164 bp, Homo sapiens
gctcctccttcgaccagcttccggtggtatttcgtcttttagccttagtactccagttatactttctcttgcgcttggcagggtatccacatttgccacaggtcgacttctgaaggtggtatgccttagagccatcagcgtgcggcacaacgtgtgcgtcttat

SEQ ID NO: 659041 - DNA, 1172 bp, Homo sapiens
atgtttctgcatacctaggacgatgttagtacgcccaaactgacgctcgtgtctcttgtggtatcgagatccggatttgagagtagaatcgacaatgaacatggctattagtgcactgtgacaatccactcttgcgaggtactacctccttaggatagtcctaggatcgtactgcgcatgctggttggagattcgtccgcataaggatgtcagaaagtatatagaatggacgaatagtgatggacgaattgaggatatgcgcaccgagtggttccatatcccctgtatgctatatgtctggggtatttttggagcttcagctcgatccgatttaaacgaactctcattgatcgtacgtcttatcgtacacataatttgagtcaaatattatgagatacacgggtcatttgtccatcatgtgtttacattattcagataacgtatggtacccttctgagtacatcaattggtatgttatctacccttttcaaatatagcataaaactatggaggcacaggatgcatccattgggcatcaaaccatagtttgcattgatattagaactttgtatgtgcgctagctcgagatatgataatagcgatggaaatagagagttcgccgtacttgtataagttacaattcacagaaggaaaatgtggggaccacgtaacggcgcgggacggcagtgccaggatagatccttcgctatcctgttgtgtctctgtgaccaggcaaagggatgtggggcgtggattggaattatccccaagtcagtataccatatacggacgcaatttgactttttttaccaccacacaacgtgtttggagtctccccccaattatgatgtcagaaagcccgcaataaaaagaataaagggagacggaaaggtaactatgtatgaaggaggagtaccattgtgtgtttataagcaagatggcgctacgagggtaataatcgtgggaggccaaatgataccgtgtaaaaatgagtttggagggcacttagatatacttgctatgctggaaacaacgagaggtatacgcaaatttgtatgtttggacgctgaagtatgacggatggcgatattgatgtctagtgtgttagagtgaacctttgcgtcgagaaatgctcaagtaaagcataaacaagatggccaatgttgataaca

SEQ ID NO: 659042 - DNA, 194 bp, Homo sapiens
gtagaatggtttggaacaatataaaacctgctttctgactgattgtggggtgaaggaaaaaagaacctatttttcgtgcatcatttaccaatcatgccacacaagcatttatttttatgacattttattttttcataaaattgctattgccaaagctttgtattaaaagaaataaataataaaataaaagaaga

SEQ ID NO: 659043 - DNA, 391 bp, Homo sapiens
  misc_feature (86)..(86): n is a, c, g, or t
  misc_feature (96)..(96): n is a, c, g, or t
  misc_feature (281)..(281): n is a, c, g, or t
  misc_feature (297)..(299): n is a, c, g, or t
  misc_feature (311)..(312): n is a, c, g, or t
taaagctttgccgcagaagattctggtctgtggtgttcttcctggccggtcgtgagaacgcgtctaataacaattggtgccgaatnccgggacganaaaatccgggacgagaaaaaactccggactggcgcaggagggatacctcattccagaaccagaactgcgaatcaaggttataaggttcccgtaacacagactgttgagaaggattcaactgccgaattcagaactcatcagctggggaacgacggtgataaaggttcccgtaaagcagactgttnagaaggattcaactgnnnaattcagaactnntcagctggggaacgagaatgaagacaacccattttgggtaccggaaagactcacccgaaaaatccagactggaccaagg

SEQ ID NO: 659044 - DNA, 161 bp, Homo sapiens
  misc_feature (124)..(124): n is a, c, g, or t
acgtaattggttgcaggaaggggtaggttggaggattgaatgtgctggtcaagaaccatgatacgggtaattaagggtcaccttgtaccactgtcttggcaaatacatgctttgacgacaccanagataagcatgtcagacagccatcaagtgtcgttggc

SEQ ID NO: 659045 - DNA, 761 bp, Homo sapiens
  misc_feature (173)..(173): n is a, c, g, or t
  misc_feature (175)..(175): n is a, c, g, or t
  misc_feature (259)..(259): n is a, c, g, or t
  misc_feature (275)..(275): n is a, c, g, or t
  misc_feature (277)..(277): n is a, c, g, or t
  misc_feature (279)..(279): n is a, c, g, or t
  misc_feature (288)..(288): n is a, c, g, or t
  misc_feature (290)..(290): n is a, c, g, or t
  misc_feature (313)..(314): n is a, c, g, or t
  misc_feature (318)..(318): n is a, c, g, or t
  misc_feature (321)..(321): n is a, c, g, or t
  misc_feature (330)..(330): n is a, c, g, or t
  misc_feature (334)..(334): n is a, c, g, or t
  misc_feature (339)..(339): n is a, c, g, or t
  misc_feature (347)..(347): n is a, c, g, or t
  misc_feature (349)..(349): n is a, c, g, or t
  misc_feature (352)..(352): n is a, c, g, or t
  misc_feature (354)..(354): n is a, c, g, or t
  misc_feature (362)..(362): n is a, c, g, or t
  misc_feature (367)..(367): n is a, c, g, or t
  misc_feature (369)..(369): n is a, c, g, or t
  misc_feature (380)..(380): n is a, c, g, or t
  misc_feature (391)..(391): n is a, c, g, or t
  misc_feature (397)..(397): n is a, c, g, or t
  misc_feature (399)..(399): n is a, c, g, or t
  misc_feature (406)..(406): n is a, c, g, or t
  misc_feature (411)..(411): n is a, c, g, or t
  misc_feature (621)..(621): n is a, c, g, or t
  misc_feature (629)..(629): n is a, c, g, or t
  misc_feature (632)..(633): n is a, c, g, or t
  misc_feature (638)..(638): n is a, c, g, or t
  misc_feature (675)..(676): n is a, c, g, or t
  misc_feature (680)..(680): n is a, c, g, or t
  misc_feature (683)..(683): n is a, c, g, or t
  misc_feature (686)..(686): n is a, c, g, or t
  misc_feature (692)..(692): n is a, c, g, or t
  misc_feature (698)..(698): n is a, c, g, or t
  misc_feature (700)..(700): n is a, c, g, or t
  misc_feature (743)..(743): n is a, c, g, or t
ggattttcatttctcgcgtctgccgtacttggtttcgcttcgctagtcccagaggcccagagtggctcgcctggagtctctgtggcgcggtttcctgtacctgccttgggatccggagggaggaagctgggacacccgggagtcaggaaatggactcggtggcttttgaggangnagatgtgaacttcacccaggaggagtgggctttgctagatccttcccagaagaatctctacagagatgtgatgtgggaaaccangaggaatctcgcgccncnanagggcaaananggaaggaccagcaacattaaagnncacnacnaacaccgcngggngaaanccacagangncanangcccaganagacncnaccaaaccaancgaccggccantcagcncngaggcancttcncgccagtttcgcaaatcagaatcgtgagcaagaaaatccctgcgagtgaaactcttgtgaaagcattgtatatggagaagtcagcatgggtcagtcatcccttaatagacacatcaaagatcacagtggacatgaaccaaaggaatatcaggaatatggagagaagccagatacacgtaaccagtgttggaaacccttcagttctcaccnctcctctncgnncacangagataattcacactggagagaaactctatgattgtnnggantgnggnaaaccntctttncnctcaaaagaattagaagacacatcatcacacacagtggatatncaccatataaatgtaagg

SEQ ID NO: 659046 - DNA, 105 bp, Homo sapiens
tacaagtctcctttgtctccaagaaaaattactgtaacactacaggttaccaaacgtgacccaggtagatggaaacagccgcgtgcaggttctccactagagacc

SEQ ID NO: 659047 - DNA, 131 bp, Homo sapiens
tatccatttgaatgtttgagaataggttgatcatcgtgtcggccccacgcacctctaatcattcgctttcaggcggaataaaactgcgtggggggtggtgcgtcgtcgtctgacgacagcaccagcttatc

SEQ ID NO: 659048 - DNA, 755 bp, Homo sapiens
gatgcccacgagggcccctgccagagagtcaccagctggagcgctgtatcgtaagaccagccagctgctaggagacatcgaatcaactggagcacacacacgcacgtagtagacatcactcgcaccagccctgcggccaagagcccgtcggcccaacttgatggagcaagtcggctcagcttaagttcctgagtgacaccgtcgagaagctcaaggacgaggtcctcaaggagacagtatactcagcgtccactggagtccacagtacccactgactttgccacattcccgtcatcagccttcctgagggaccaaggaggagcagcaggatgacacagtctacatgggcaaagagaccttctcatgcgcggctggtgtgtggacagcgacaccggctggtgctgacccaggagcagctgcacaagcttcacagtcgcctcatctcctaagcactcctgttcccctgctgtccccgttcgaccctgcagccctctaggtgccgcgtctgcccgatgcacagccacctcagccagcccccaggtagaaacgtgggttaagcatcttcgctgccccagttcagcttcactcgcaccctgtacagcagtcctgccccttcaccttgacccgggttcccccactcaccattcctggcatctgccataatttgttgttcaactgctccctccttcctgaggggcgtacagggcttgtggggggtaggctgagaccccataccaaaggggaagtgagtcccc

SEQ ID NO: 659049 - DNA, 477 bp, Homo sapiens
ggctcctgagtagctgagacataggtatagcctcgcgccacacacccagctaattttttaaaaacatttgtacacttgggaggctaaggcgggaggatcacgaggtcaggagctcgagaccatccgggctaacacggtgaaaccctgtctctactaaaaaatacaaaaaaattagctgggcgtggtggcgggcgcctgtagtcccagctacttgggaggctgaggtgggaagatggcttgatcctggcaggttgaggctgccgtgagccctgatcatgccactgtactccagcctgggtgacagagtcagagcctgtctcaaaaaacaaagaaataggcaaatacaagagatggaaaaaggaatcgaaagaatggccatgggattgcgcattagacaattggctttttaaaatggcatgtggttttgaaggacaggttgaattgggatgtttaaaatgcttagtgaaactaagactg

SEQ ID NO: 659050 - DNA, 113 bp, Homo sapiens
cagtgcattgagagcatgttagccgtgccaaccaacacaaggagcagcagctgggcctgaagcagcagattgagagtgaggttgccaacctttaaaaaaccattaaagttacc

SEQ ID NO: 659051 - DNA, 137 bp, Homo sapiens
tccctcccgacttcctcataacaaacaagagatggcaatagcagcagttctaccatgcccattggaattatcctttaattttacgagatccacttgtctgtaggcttacggaccaagatgtccaaaattattcgggc

SEQ ID NO: 659052 - DNA, 1182 bp, Homo sapiens
  misc_feature (564)..(564): n is a, c, g, or t
  misc_feature (787)..(787): n is a, c, g, or t
cgccctcgatgagaagaagaaaaagaagataggaaaagaaaggaaacaaaagaagtactcaccatctctgttgtgactcccgtcttttgtctgtgagattcatatggtaatgcacatccgtggtgttgtgctatcactgcgttggaaaggactgcgtcctcctgctagattacaaggtggtgttggtctttttgtggcgatgaaacgtggtgttcccacccgcgtatggggcacccctgtccacgacgagttcaccggagtaaatcggcgaagcgccccggactttgggagaagcttctccggcggcaaaatgggcatacaaagacagagaagggtcttccaaaggaatttctcggggccaacatttgctggggacacaccagaatggtcccccccctggaagcccgcttggcttcactgctcaggtggattatcctggaccatccacggccacattagcccccggttatgcccccgtattggattgccaccccggctcacatgcaagcaagatttgctgagcttgaaggaaaggattgagtccccctttctggtaacaaacgnctggaaagactggccctaaatttcttgagaagttctggtgaatgctgccccattgttgaataatggttcctggcaagcccacatgtgtgcttgaggagctttctccaggacttatacccacctcttgggtccctttgcctgtttcgtgatatataggagcaccagcaccagattgcgcgtgggctgtccataccaaagaccagtggcaccagaaagagctcgnctggggagactggccaagagtcacacccagttctgccccgagaaggctcacgaagggctataatgagatatttatccctctatacctgccacccccaccttcttaatcacgctggtggaagaaccggttctcacgaaactgtttgtttcacaattggccacatttaaagtttagtagctaaaaaagactggttaaatgataacacaatgcactcgtaaaacccttcacgaaggagaaaggagaaatgttttgtggagccacctttggttttcttttttgcgctgtggcacgttttaagttattagtttttataaatcagtactttttaatgggaaccacttgacccaaaatcttgtcacagaattttgagaccccctttaaaaagtttaatgaga

SEQ ID NO: 659053 - DNA, 149 bp, Homo sapiens
gatctctattcatggcaacctcggcctcccgggttcaagcaattctcagtatagcatccctggcagcttctgtgttcttttcgtacccggtgatggtaattgggtccgggggctggttcccatcgtccttatcaggaaactggatgttc

SEQ ID NO: 659054 - DNA, 518 bp, Homo sapiens
ataacctagaaaaatacattacctactttccatatatctacatccgtacatatcacactgtgacaacaagccttcattttcatgtcagtacacaactgcactctatcataaatgccacagatgcataatcactgttttcttgctctatatacacagctgatatacctattctaacgaatgagggagaggagtaatgcacaagaaactcaggccaatgggggagcaagaagaaaacgaagaagtgcagtgcatgcgtcatcggtgtttaacagtcagaagcgaaacagttcagaacaaggcctgccctgtcaaaagaagagctaaagacagttatataaaaattaaggtgggctttcagactggctaacacaacaacattccatgagtagatggtaatttatttttgtttatccatatcgttgggagcaaggacaaaaatgtaaatctacaccttgcttatcaaaattgccgaaaaaagaatgctctgccttttaaaaaagtatcatgatttagtagac

SEQ ID NO: 659055 - DNA, 398 bp, Homo sapiens
  misc_feature (147)..(147): n is a, c, g, or t
tgagacggagtcttgctctgtcacccaggctggagtgcagtggcgtgatcttagctcactgcaacctccacctcctgggttcacgccattctcctggctcagcctcccaagtagctgggactacaggcgcccgccaccacgcccggntaatttttaatatttttagtagagacggggtttcactgggttagccaggatggtctcgatctcctgacctcgtgatccgcccgccttggcctcccaaagtgctgggattacaggcttgagccactgggcccggccttcagttttcatatctggtaaagggaaggatcttaaggggatgaatttatggttatttattttattttatacattttcgtgagggcctaccatgggatggaccctttgctcaattt

SEQ ID NO: 659056 - DNA, 156 bp, Homo sapiens
gacatatacgaatcgagcctgtaccagtaccctagggatacagcgcaatcctatctagagtccatatcaacaatagggtttacgacctctatgttggatcaggacatcccgatggtgcagccgctattaataggttcgtttgttcaacgatttaaa

SEQ ID NO: 659057 - DNA, 108 bp, Homo sapiens
tctcttgttcttaaaaatgctgcagtgctccctatttcttaagagacaggctctctgtcacccaggtttgaagtgcagtggtgtgaccatatgctcactgcaaccttg

SEQ ID NO: 659058 - DNA, 940 bp, Homo sapiens
  misc_feature (37)..(37): n is a, c, g, or t
  misc_feature (91)..(91): n is a, c, g, or t
  misc_feature (107)..(107): n is a, c, g, or t
  misc_feature (111)..(111): n is a, c, g, or t
  misc_feature (115)..(115): n is a, c, g, or t
  misc_feature (119)..(122): n is a, c, g, or t
  misc_feature (150)..(150): n is a, c, g, or t
  misc_feature (185)..(185): n is a, c, g, or t
  misc_feature (188)..(188): n is a, c, g, or t
  misc_feature (194)..(194): n is a, c, g, or t
  misc_feature (201)..(201): n is a, c, g, or t
  misc_feature (223)..(224): n is a, c, g, or t
  misc_feature (227)..(228): n is a, c, g, or t
  misc_feature (238)..(239): n is a, c, g, or t
  misc_feature (247)..(247): n is a, c, g, or t
  misc_feature (270)..(270): n is a, c, g, or t
  misc_feature (293)..(293): n is a, c, g, or t
  misc_feature (297)..(297): n is a, c, g, or t
  misc_feature (307)..(307): n is a, c, g, or t
  misc_feature (319)..(320): n is a, c, g, or t
  misc_feature (323)..(323): n is a, c, g, or t
  misc_feature (328)..(328): n is a, c, g, or t
  misc_feature (331)..(331): n is a, c, g, or t
  misc_feature (391)..(391): n is a, c, g, or t
  misc_feature (402)..(402): n is a, c, g, or t
  misc_feature (445)..(445): n is a, c, g, or t
  misc_feature (456)..(456): n is a, c, g, or t
  misc_feature (465)..(465): n is a, c, g, or t
  misc_feature (487)..(487): n is a, c, g, or t
  misc_feature (516)..(516): n is a, c, g, or t
  misc_feature (566)..(566): n is a, c, g, or t
  misc_feature (618)..(618): n is a, c, g, or t
  misc_feature (621)..(621): n is a, c, g, or t
  misc_feature (639)..(639): n is a, c, g, or t
  misc_feature (643)..(643): n is a, c, g, or t
  misc_feature (665)..(665): n is a, c, g, or t
  misc_feature (693)..(693): n is a, c, g, or t
  misc_feature (766)..(766): n is a, c, g, or t
  misc_feature (771)..(771): n is a, c, g, or t
  misc_feature (784)..(784): n is a, c, g, or t
  misc_feature (811)..(811): n is a, c, g, or t
  misc_feature (813)..(813): n is a, c, g, or t
  misc_feature (815)..(815): n is a, c, g, or t
  misc_feature (819)..(819): n is a, c, g, or t
  misc_feature (832)..(832): n is a, c, g, or t
  misc_feature (905)..(905): n is a, c, g, or t
gcctatgacagaatcttatccttgtattcctaaactngacttagaggacaggccaggccccaataaacctggtctcaggctcctcgccgcntccgggtcctctgtcngtcnctgnggtnnnngaggggactgatgtggcacccttctgangtcacccacaccatgtccactgaggaccctgagtnttnccagcngttgganactgagcctcctagtccctgtnnggnnggtggctggnnaggaaggnctgctgctgtgtcagccaaacanacaatcctccctgtgcggatgtnagtncttgctcgtnccacccacaggnngcnggggngcngacatggttggcgcttttgatatgcaaagccgcaccttgttttactgagggtagacaatnggccgtccgcnccctgcctcacccctcttaagcatcaaagctcagacgtcagcngggcttggagngtcttggcntgggcggtgccagtgacaacanctgggtttccagccgccggggttccttgnccacaagatcaatgttaataattgggttagggtgcagggcccagtggaanggacggttgcggacggactggggggtggggggccagggcatggccacggagngcncctgcgttggtactttcnaganatggctccacatcctctgtggnacggtcttcagttcacttctcgaccagnttctccaaaaggagaataattccagaactgagagttacatagcattgatgatgagaaaccgtgatgtccagtnatggncctccaaccagtnccaagcaaactcagcaatcagctggtntngnaggnaggagtatttgancaggaactctctccactgcttccacgtaggctccttaagatccagaagcttggtgacgatgtcctccccaganctgtcttcttgcagagggcagatggtgtggatgat

SEQ ID NO: 659059 - DNA, 159 bp, Homo sapiens
  misc_feature (35)..(35): n is a, c, g, or t
  misc_feature (63)..(63): n is a, c, g, or t
  misc_feature (67)..(67): n is a, c, g, or t
  misc_feature (69)..(69): n is a, c, g, or t
ggatccggttgcagtgagccgagatcacactattncactccagcctgggcggcagggcaagantctntntcaaaaaaaataaaaaactgaccatctagtccttgtaatctgggcaccctcacacatctccttaaccacgcttaatctccaaataagtac

SEQ ID NO: 659060 - DNA, 354 bp, Homo sapiens
taagagtaatcaaagacattgtatttttttttcagtaagatcaagtaagtcattccaaactgtctggcgtcctgtcccaaaacatctctgaacttctcagttcaagaagtaagttccagaatttatttggcaaaggtagcttatgttcacagtactgtctctggttttccagtctgtctcctagtcataggcccctaaagtccaccagcccttacacttccggctgcatgcttgcaaaatctactatgtagttctgattttgtaattttcatttcaatgagcatgaaaacttttaatactgaacgtccagaaaagatcttgttttcttttattccctttcctttaggtcgacgc

SEQ ID NO: 659061 - DNA, 1131 bp, Homo sapiens
ggtcaaccggccctcagtcccagctctcacccaatgccaaggagttcgtgtacaacggtggtggctcacccagcctcttctttgatgcggccgatggccagggcagcggcaccccaggcccgttatggaggcagtgggtgctggcacctgcaaccagccagccagctttgcaccatggcccaggtattttggcaggttggttgccaaacagcactcttccatggcagaagacgacccttatgtggcaggcctcaagctcacaacctgcaacaccatgcagtcatcccagccagccagttccagcaccgtgagtgcatggccaacatgacccatcatacctgcccagtggggccatggagcacaccaagcaacacagcaacacagcagcaaaggcacacaggccaaacaaaacagcaggcacaccagcaaacaatgtacaaacaagattttcgcatctatctcactcttacttctagaacaacaagatccagcccaggcacaggaatgggagggccctgcaaaccgcacccaagtgctgttccactcaccacacttaccgcatcgcccaccggggccatgatgaaatatccatcacccgggatacgggaaccaggggcaacacaactactcacacatctcaacacatcacaccccacacactagacctacaaacgggacccgctacccccatactatacacacacatacgcaaaaactagcagctggcacccccccatgagcgcccaccgacacagtgggcaccacaaatattgacaaacaccttgaactgacccccgccagggactccacacacacaaaaccacacacacacgaccaacgacacgccaaccaacccagacaccaagaaactaacggcccaccacacacgcatccaatataggcgcacagacccacgaccccccgcccccactcagaaacgcacatcaaccacccatcacccccgcgacacaacaagagggaacaacaggacgcggcccacaggggtcacacatcgccccccctgagtcaaccaccaagcagtataactcagcacgaacctacagaacagacaatccacagaccatcgcgccacgagcgccacaacaacaccactcgagcccacccttgaag

SEQ ID NO: 659062 - DNA, 429 bp, Homo sapiens
aagccttccccttatcctccctgtaacttgatccatttctaattatgtagctctttgtcagggagtgttccctatccaatcaatcttgcatgtaacgcaagttcccagttggagctccagcctgacatcaaaaaaggcagttaccattaaaccatctccctggtgcttatgcttttaattgccacctctaacagcaccaaattaaaatctctccactttcagctgtcttttggaggaacgtccgtataaggttttaatttagtaaaccaaacctatgcatggtttaaggactagtcaaaccttaccaacttcttatttttagaaaaaccagcacttggcagccttgtggatgtcaaacaaagaaagtcacagggccaaaccctggggtctttgaggttgcacactttttggaccaaataaacttttttt

SEQ ID NO: 659063 - DNA, 420 bp, Homo sapiens
  misc_feature (151)..(151): n is a, c, g, or t
  misc_feature (157)..(157): n is a, c, g, or t
tgggactgcaggtgcccgccaccacgctggctaattttttgtatttttggtagagacggggtttcgccgtgttggccaggatggtctcgatctcctgaccttgtaatccgccagcctcggcctcccaaagtgctgggattacaggtgtganccaccncacctggcaaaatgctgttctttaagtcagcgaactgaaaaagtaaaagactgctgggtgtggtggctcacacctgtgatcccaacactttgagaggctgagggggaaggatcacccgaggtcaggagtttgagaccatccttggtcggatggcgaaaccctgtctttactaaaaatacaataatttatctggggcgtgttggtggtcacccctgctggtcttcagttgcttaggggaggcctgatgtcaattaaaaaataat

SEQ ID NO: 659064 - DNA, 242 bp, Homo sapiens
gacgatgcttatactgtggtgtaccgtactccaatagcataagccaagtgaataatggaactttggcgtttaaccagaacctgcggggttgtgttcttttgtcttctatcaccaaccactcgtttctgctaccaaacgttctgctactgagcatggctcagtgttccaaaggagtgctgagttcaagatgtgccatgccagtataatgctacaacaccttagtaacctacaagaaggaacac

SEQ ID NO: 659065 - DNA, 543 bp, Homo sapiens
ccactaaaagggatagacgatggtatgtggggtggaggttatacatacatacataatgccatgaaacaaaaggagaccacctctaacttcttcatgataaaggaaaaccaagcccacactcctgaaactcactgtcatctcaacgtgatagggagcactacaggagagaagggagctcttcaaagggtgagtcagcatatgccaggctggtggggatgcacagcaatgcctatgaaccccctaggatatagttagtgccctacactctcaggaatttcctagatctcctctatggctagatgcctccttttactcagaatgtgttacctacatccaactccccttggataatgccagtcccagataccctgtgtcattgaatacacacttattgattatcttctgttccaagaaactccaactgctaagaacttaaagatgaatcacactttccctcttgctagactattcatttgctaggacagccgtaacaacacactgtagactgtgtgacttagacaaagggacaacccggtgtaccct

SEQ ID NO: 659066 - DNA, 114 bp, Homo sapiens
atgatgaatcatgctaacaggataggatcaccaagaagcagcaatactaaaagtaggagtctccagtggggagtgcaggctcttgttggttagaagaggctatatcgtgccggg

SEQ ID NO: 659067 - DNA, 329 bp, Homo sapiens
cagtgcgggaagccttcaaaccacttcctttccaaagcaaacactgggtgtttacagtttaagcaggaaccatatccttttcaatggttccttttgctttgctttgtgttgtgagtccagtccctacatgcaaaatgattaagttaggccagttttaagagggcaaaaaactggggtaggttgaaaaatggtaacttaatgttcagatggtatcaaaccacatagaaacccaggctgccaaggcacaggactttttagcgcaacatcaacgcagagtttactagagtcttccctttctcctgacacagagaacagttgattgtcaggtc

SEQ ID NO: 659068 - DNA, 191 bp, Homo sapiens
tgaaatgtaagctcatattaattattttagaatgtgacataaatgcgcagcccactcgggaccaggggaaggttggtaggtcagctgtaacagattgctccagttgccttaaactatgcacatagctaagatacccaatcttcttgtacagctttgaacaaacgtgcacttgttttcttgatccccaccct

SEQ ID NO: 659069 - DNA, 324 bp, Homo sapiens
tgcccttagctgattagtttacaacagacggccagatgcaatgccgtacgttctcctacaccgaccccgcccgagggctcggtcgtaggctgctgttatttcatggctgccgaacgcgtgactgtgacctagtcatcatagccgaagaggcacgtagcgattaggcccagtacccctgcgacgatctaggagtggtttcctctctcaacaaggacaccaatggaggtgatcaggtagagcattgccgctatgagggttcggaagaaatcactccagggccagttgatgaatggtatcttggtgtgcaggtcacacatgttgacc

SEQ ID NO: 659070 - DNA, 821 bp, Homo sapiens
ccgggtgtgatccgtcctgcgcggttgtctctggagcagcgtcttttatctccgtccgccttctctcctacctaagtgcgtgcgcacccgatggaagatcgatggacatggacatgagcccccatgaggcccctaggaactatctttacggttgtgaaccgtaaaggccgacaaagattatcactttaaggtggataatgatgaaaatgagcaccgagttatctttaagaacggtcagtttaggggctggtgcaaaggatgagttgcacatgttgaagcagaggcaattgatttacgagggcagtccagattaaatgtaacactggcaatctcttgaaaatgtctgtacagccaacggttttccctttgggggctttgatataacgccagccagtggtcttagaggttgaagtgtggttcagggccagtgcctattagtgacagcacttagtagctgtggaggaagatgctgagtcagacagatgacgaggaggaggcttgtgaaaagtcttaagttatatccttggaaaggcggttctgcccctggagcgtgggtagcaaggttccacagaaatgaggtaaaactttgtctgctgatgaagaatgatgacgactgatgattgacgaggattgatgtttgcagatgcttgatgtgaatgagtttgatgacttggggacgctggtgaaaaagctcctgtgaaaaatctataggaggggtttcggcccaaagggcaatagtaagtctttgtggggagattaggcttttatgccgaagtaagggagaattttttaaaggggatgttaagcaaggcggctttggc

SEQ ID NO: 659071 - DNA, 677 bp, Homo sapiens
ataactacgaaatgcctaatccgaaggattcccaatatcagcccgcacatcctaacggctaaagggtgcctaagacgtacgcgtatgtaggggtcgcagatgtagttcttttttcgggaaggctgataagggaggtggggaaaaggtttgggcgccgttatctggcttttagtgccggtggttaggatctggagggcgtttttaaaccttacttgcctcctttaattcttcgtgataagggtgggccgctgcccgcgccgcgctacgtacctatatacctttacgatacttatctaccgtccctctattcatttcgttcctctttagattatgtataggttggccttatcgaggaataaggactgcttgggattttcttagggggattaaagactttctcgtcgcgggttactgaacgtactcggataagcgtcgtgattctccttaaggctaccgtccgtgggccgggcgatgctttactaatcggctagagaatgtttgtgaaacgttatccggaatagcggttgggtacgaggaattctcctgcgattccgggatcgatccggaaagggggagaactccctgtgtatagaggtctcttccttacgtcctctaatggcggagtccgatgtgggccgtttctttttcggtgaaagtctcttttaaacgctatcctc

SEQ ID NO: 659072 - DNA, 344 bp, Homo sapiens
agcggtctccagaatgagggtcagggacatctttttagaggtgcaacaggagcgattatgattcaggatgcacagcactgctaactgcagcgctcaagtagcgccacatggcgattcatacagcacgaatggtagtagtggtgttcagatatccagctggtccagctccttcaaggtgcattgcttgtggaccacatttacttcttgcttggtcttctcgctgggcctgtttgctggcagtgacctgttgaatgggcatgggcctcaggctccattgtgcgcttgccttgggctcttggtaatcttgatgcttggctagaggcctcaatgccacttatgagcgc

SEQ ID NO: 659073 - DNA, 170 bp, Homo sapiens
ggggggtttttttttttcgggggggggggggggcccgggatttttttttttccccccccccccccccagggtttaaaattttttgggccccgtttttttttggggggggggcccggggaaacccccggggggttgttggctcaaataaaaaccccccggggcccccggga

SEQ ID NO: 659074 - DNA, 116 bp, Homo sapiens
gtgtcgttatatggtcgcgacaacagctgcattatgtcaacaagatacgcacgaaggtggacgaactgacccagattatccgcgacgcttccaaggcacgggcccctctctcgggg

SEQ ID NO: 659075 - DNA, 204 bp, Homo sapiens
gggtgaggcggccgatgcacacgtcgaggctgcgcaggccgagtgcgtggccgactttcttggtgtatttgtattcttcggtattgatggagtggccgccccagcacaccacgatcttcggctcgatgcccgggcgcagggtgcgggcgttgcgcagcaggtggaacacgtagtcggtgatgccctgggaactgctcaggtcga

SEQ ID NO: 659076 - DNA, 104 bp, Homo sapiens
tttcaggcatgatcctttgttgtgtatttatccagagtgaaagatgtttttgtcgtaaccatcttgcatcgtcttagactccccattaaataaagtttccgaca

SEQ ID NO: 659077 - DNA, 904 bp, Homo sapiens
  misc_feature (904)..(904): n is a, c, g, or t
aagtattgatggtcatcttggtctgctattaggtgccagacacctggctgctgaattgttttttccctcaccaaagtgtcattggaacgccagctgggaggacttgagggaaaagaaaatatatgacaataggcagtattgacacatgtttaaaatctttttcacaataaaacaagaacacccaagtgtcatattgttaaagttggaaatctataggtttttcttttttttttttttttcttttttggatctctagatttcagggccagaacacaaattcacgtttctggtcctaggacagggaatgggtgacaaaagggattatactattttaataacggggaacacttctcaaactacttgtgtttaccccaaattctgggcttctcaaagcacacatgaattaaagcacagtatcaagggtgatgccctatgacaatgtttcaacacacactgtgaaatttaacgagaaatttcagttcttcactcaggaaatgtgcggtattctctaatgtactttcatgcggcagagatggagcctctttaaacagcttggggataattatagcagcccaagaagtttatctgcaaaatatatcatcattgggtccaatagatgacttttacatcaggtatattagaccttatgtgatataagctggtttaccttagaaaatattcttaaggaattatttctattaaaaaaagaagacatatacaaattagaaggaatagaaaaatataacaaaaaaaaaagggggggtacaatacaaccggagggagaaaaaccatttttgaaaagggccaagagaaataaaaacgggagaaaatagggaaaagcaggtttgtgaaacttggtggtggaaccaataatagaaatggtgacatgggcgtgatagaaagn

SEQ ID NO: 659078 - DNA, 612 bp, Homo sapiens
actgcgtgctgcagtgtgtgctggagtgccatgctggtgctgccgtcggtggctggccctgtcggcctgtgggatgatggaagctggacctgagccctgtcgccttgtgagcatgagctgctgctgcctgcctgcggtgctcgtcctcctccgtgctctgtgcctgcctgctgtgtgcttggactgcctgactgcctgcctgaagcatgaacctactgcctgactgtgccctgtgctggctggcttgagcctgcgctgctgcagcctgactgcgggaatgaagcgggcgctgggcaggcgaatggtgtgtgtggttgcgcctgaggaagatactttatcttgtgtttatggggttgtacattgccattccatttctcatcaaactatgtcctggaatacagtgccaaactgattttcttgaatttcgtaagagttccctatttcattgatttgaaaaaaccacaggatcaaggtttgaatcacacgtgtaactactacctgcagccagaggaagacgtgaccatttggagtctggcacacctgtccctgcagtctggtggaagaacgcccaaggcaaagaccagatgtggtatgaggatgccttggcttcag

SEQ ID NO: 659079 - DNA, 1287 bp, Homo sapiens
  misc_feature (422)..(422): n is a, c, g, or t
  misc_feature (621)..(621): n is a, c, g, or t
ggtctgcctcttggtcgggacccgatgggcacagtcagaagacatgagtccctgaaacgtgactggacgatggattcgttaattgcaaaaagctgttcaacgacggtactggccaggggcccgacgttggcgtggggctcggtgtaacagatgaagcccagaggtggctgaaggagtacccggcggatcgctaaggggccgcagaggcattggtcgccatcgaggcggcgccgggcatgcgacgccaggagcccacgaaggcttggtcgctccacgaatgcgcaggcacgcagtgccgtcgcctgcgtagacacgcgaacggttgtaccagagatagcgaaacagcgaaaggagataggcagcgacgcaggggccacgcggtctgccaggggcaatggcaaaggcccttgaatgggctgagncggccgttcatgaacgagacgctggcgcgcgggaccgatcgtggacctctgtgatcgtgaaattcgtgagcgagagagtgcggggacaccaaaagattgccaacgagaggagataacctggcgtgaagcagattgtttcccaagaacatgagtggaccgagagcgtgccattggacaggattggggagttcacctcgancattgtccaaagattgttccaatgcaatcccgttttgccaacccaaggggtaataacgccccggattcggagggcaacctctacttaacacaaggcggcggacttagacattggtgtcccttagactctgagagaaaacaaggtcgttgcgataagacactgggggcccccagggcgccacggcagtaagaaacggcctggggaacccgggtgttgccattagaccgcggtgttgcgacaggggacacccctgtgacttaagtctggaggagaaagagcggaagggaaaattacaaccgttgcacggagggggtcactacctttcggaactttcgccacgcggcacacttaagcgcaacagggcaaggagtatgttgcgaggcacaccagaaccccttgtcccaggtcctccaggattccattgccgctgggtcatttgggagacgcccctgggtggccccattacaccattaactttcggaaggggatttcctaatgccaggggccgagttaccccggggggggcgacaccaggctattggacccccccaaaactgggacaaaggcggcctcgttggacacaaatccaagggaggacttagcttacgaacatacgcatttgaacaacgggaccatcttccatttaccccggcccctgcgccttgg

SEQ ID NO: 659080 - DNA, 456 bp, Homo sapiens
ttatgtctgacccaccagcaagaccttacttcccgtcacttcgacctgtagacacggtctctgcccaggttaagggccactggcaataaggtggcctgagcgcgctgatcaacgccgtggcgcacgtggacgacatgctcaacgcgctgtccgccctggagcgagctgcacgcgcacaagcttcgggtggacccggtcaacttcaagctcctaagccactgcctgctggttgaccctggccgcccagctccccgccgagttcacccctgcggtgcatcgcctccctggacatgttcctggcttctgtgagcgctcgtgctgacctccaaataccgttaagctggagcctcggtagccgttcctcctgcccgctgggcctcccaacgggccctcctcccctccttgcaccggcccttcctggtctttgaataaagtctgggtgggtcagaacataag

SEQ ID NO: 659081 - DNA, 298 bp, Homo sapiens
  misc_feature (68)..(68): n is a, c, g, or t
  misc_feature (97)..(97): n is a, c, g, or t
cgactctaagatcccacattgcggacttacaacagaagcatgttctagcagcactaatgcggcctcancctcccaaagtacctttatatacagcatntttggcaaacgtgtagctagtcatatctcagactttctgtgaacaccctgaacactggggaggttagataagcatctttatgaggggttatcttgtactaccggcactgtttaaagacattgctgcagaatatcttggtatgcaggagtcaaacagcagtcatcatgccagctgctcttcaagatgacatcactcttacaa

SEQ ID NO: 659082 - DNA, 220 bp, Homo sapiens
cacggtgcatggatggtatgacagtaagccactcaattaccttaatttcaaaatcaattcactattactctaaagggctgctaggcctaggactgtccctaggtgtaaggtgacttctcttctagccctgtggcttctaaagatttctttttttttttctttttttggagacggagtctcgctctgtggcccaggcgggagtgcagtggcgcaatctcgg

SEQ ID NO: 659083 - DNA, 165 bp, Homo sapiens
tgtggaggcgacataaatggctgcgcaggctgctggatgagctgaccctgggcagagccgatctggagatgcagattgagaacctcaaggatgagctggcctacctgaatgaagaaccacgaggaggtagatgaatcgcctctgcgcaggcctaggtggggtggt

SEQ ID NO: 659084 - DNA, 937 bp, Homo sapiens
tttttttctattactttcccccccccctaactaagggactatgatggtggtggtttaaatttagctcttagggctatagctattggggtttactgtgcggggtccggctcccgtctcccgtggctccccgcggcccgcccgtggcggccccaggaccccctacgctactcataccagacccggcgagaaagatgggggctggccggagcgcagtgcttgtaaacgcggaggcacagggaagcgaggaaggtgagccggccgaaatcgcggcgcactgcgacgctgcctcccatcgggggcggactagggaactccgcgagacccttcatctatcctacacggtggcgggggcgagaaagaaaggacagacacaagtgcgagattagcgataccagcgagaagtgcgcggcacgtcgctttacgtcgcggatacgcatcgagcgacgaccacacataccacgcgaaagccaggacacacagccacaaagcccacagagtacgcggaccgtgaggacacgttggaaggaactgcgaacgggaacgcaagtgagaatacaaccacgcgggaccaggagaaatgatacgaggaagaagaacgggagcatggagcaatcacgcatatagataagcaggcccttaaacaaaagataatactcaaagaccaatcagggaagatcaagggccacgggagtataccatggatctcactatcgggagaccgtgcgcacccaaaagagacggagaagaagcacacacgataagccccgctgtgagtgtagcccccgggacagacaggagcagaaaagacaagccccgatacaataacaggagcaaatcagcaagaaacgaattgcagtgcaagccccagagctgaagaggggaaacaaggagagggcagggacccaaggaggggggccagggacaggggaggcactag

SEQ ID NO: 659085 - DNA, 113 bp, Homo sapiens
gggacgagctacctaagaacagctaaaagagcacaaccgtctatgtagcaaaatagttgggaagattttataggtaggaggcgacaaaacctacccgagccttgtgtatagct

SEQ ID NO: 659086 - DNA, 328 bp, Homo sapiens
  misc_feature (328)..(328): n is a, c, g, or t
ggcctgtggtggagtgaccagaacgcgaagtgtttatgtagcacattacactctcagatgaagagagagagatttatcagtctgtgacacattatgcacatgtgccggggcttttgctttgaccgcggcaaatttggtgccatacttaccttcttacaaatgcagggtgctccaatgggccctcacgaaatgatacacctggagaaccgtgaaagaaggttataagggagaagaagtcaaatctgtgctcaaggtcagatgaggaatgtgcgacttggccggattctttaacaggtcctgtgataacactgtgcacatgtttttgtgn

SEQ ID NO: 659087 - DNA, 1088 bp, Homo sapiens
tggcagccgacgggaaatcctatcaagtgccaatgcgtggcccagctctccgtgttccggtgtgagtcgacaagtgcccccaagtgatttatggtacaacttcattgaactgccctaccacggggaagagcatcagcgatgctgatggcactgccgactgagagctccagctccggctgtctggccatcatcgccaacaacatcagcaccaagaccatagacagctggatgagcgatcatggtgcccaagagggtgcaggtgatcctgcccaagtacacagctgtagcacaaacagattggaaggagccgctgacacgttctatggcattcacggacatgtgagattcatcaagaggcaaatttggcaagaaataacaaggtcagacaaacctccatgtttctcatatctgtgcaaaagaggaaaaatggaagtcagtgaagatggaaccaaagcttcagcagcaaccaactgcaattctcatgtgcaagatcatcgccgtccctggtagatagtagacaggaccttaactgttgttcatccgagcataatcctacaaggtgcagtgtattcatggggcacaataaaccaacaccctgacacgagtaatccacaagaaaccatgcaaaggacacgacgtactttggcaacgcagaaagactacctttcccggacatatttcacaacacctggttaagatactcgtgggtccgttggctcattataaaaactcgttcttgggcgaccagcacatgatgcgcaccggtacctcgcatgcaaggaccatcgcggggcgcacacacagccgcatcgcgtgaacacacgggcactcgcgacatgtaaacacaagggttccaagaggcccagaagcctctacacaccagagcggggccaacgtaaacaaccggggagaacctcagggcgacccaccacacaaaagctcacggagccaaaatgtggcgtgcccaaaaaccatacagacggagacatacaccgatagtagcccctttcaacaacagacgatgcacacccaccacagcgcacacaggagcaagccaaaccagtcgatggtagctagcacccaatcta

SEQ ID NO: 659088 - DNA, 1081 bp, Homo sapiens
  misc_feature (310)..(310): n is a, c, g, or t
  misc_feature (1043)..(1043): n is a, c, g, or t
  misc_feature (1046)..(1046): n is a, c, g, or t
gatttggcgggatctgtgtctctcgctgggctggcacaggagcttgggatctgtctcctctttcgcctcctgcaccttgggagccctgggctactctgtcacagcccctgttgccctgtgatctgtaggtccttggggacgcatagttaaggtgccaggacatcctggaagctgggaaatgatatgtattcatttcctaccaccgtagtggaagagatactatccctatctttacaactgatagcatttccaacagtaagctgtgagattctgcttgaaatcacctctcaaacaaataaaaaacagaccngggagacatgctacgctcattctgctcaagaaatagggcaagaaagctttctaagaccccgaactccagatatgcgatggggcaaatcctgaagcgtacatggctatctctcacagctaaagcatccctcacccctatccagcgcttcttacccctggcgcaagagaatcacctgcggggaggaaaactttcaaaatcccttaaacccaagttgtaaccgcacaactaaatcagaatccttggagctggatctgaaaaaaatacggttgaaagtcgtgcaggtgattacaatgtgtaggcaaaccagaaaaccatggctttaaccagcagcttttgttagaaatgatttctccaatgaatgtagaaacgtttgctgctgaattgtgacctttccattttacctgcttttcctgcaaagtatattttgcagacccaggcagtgctgctcgctctgttcctggttcacccagtgccgtgtgtgctcagtgcatcctgtgcacgggtcactgtgtgccctggcctgggtgagcatcattcttcggggagaaccttgatgaaaacaaagctgcattccaaaaagttaaaaccgtgctacttactgtactgaggtaaaaattaaaagacctaggggaactcttccaaaagttaaaacgtaaatacaatatcttgtaacattaatatacacctgacgatgtcctgagtgaacccgccccactttagaaccaaacaaacnttnctattattctacaatatcagttacggatggaatgc

SEQ ID NO: 659089 - DNA, 350 bp, Homo sapiens
  misc_feature (341)..(341): n is a, c, g, or t
gatcctaccacctcagcctccggagtcactgggactacaagcgtgcaccaccaccatgcctggctgattttcgtgttttttgtagagatgggggggtctcgccatgttgcctaggctggtctcgaaatcctgagctcaagtgatccacctgtcttggcctcccaaagtcctggggttactggcgtgcacggcaccctcataatttttaatgtgtattttgagggactgttgtgatcttccctttgaattctcatctccttagacgggatggaggatcaggaggatagtggttctcccacactctgtggaagggtagaggaccatctaacccttcctgttantcttgttta

SEQ ID NO: 659090 - DNA, 1050 bp, Homo sapiens
  misc_feature (310)..(310): n is a, c, g, or t
  misc_feature (792)..(792): n is a, c, g, or t
  misc_feature (801)..(801): n is a, c, g, or t
  misc_feature (804)..(804): n is a, c, g, or t
  misc_feature (880)..(880): n is a, c, g, or t
  misc_feature (888)..(888): n is a, c, g, or t
  misc_feature (899)..(899): n is a, c, g, or t
gatttggcgggatctgtgtctctcgctgggctggcacaggagcttgggatctgtctcctctttcgcctcctgcaccttgggagccctgggctactctgtcacagcccctgttgccctgtgatctgtaggtccttggggacgcatagttaaggtgccaggacatcctggaagctgggaaatgatatgtattcatttcctaccaccgtagtggaagagatactatccctatctttacaactgatagcatttccaacagtaagctgtgagattctgcttgaaatcacctctcaaacaaataaaaaacagaccngggagacatgctacgctcattctgctgaagaaataggcatcatagctgggaaacggattcacaagacccaggctgttccctacatatgtttcctcctccgacatcagttcatcagtcaatcaagccatgtgagagtggaggccttgtattccctattattcttgggcactctactccaagtaggaaaaggccaggaggtcctgttaaaggatgcactcagagcccgggctccctaacatatgagagtgctaaccagcaggtgtagacttttcaggagtgaagaatgaggcaggcattccaaacctggaccttcatcaccttttgtttcatctcaagacaattctgagggactgttttggagcgtgtctggaaggtgaaccttgaagaagagtgtgggctttgatgtgactcagttgagatctttcatggggaggcaggaattcaatgcccagaatctgggctggtgtctttgaggtcagtangttgcgtcnttngtatccaagtccattgttactaggttggaggctggagattctaaatggttccagaacatctctctgattcttttgngagatggngtctgaagacnatgttcgtctttgggaatcttagaaagtttccttggaactggaaaagctggctaagccaaaggtccattgggcttaccacgtgatattgggagataaccgttggggatttaaccctttcgtggaatgaacttgccggcggaataaaacttc

SEQ ID NO: 659091 - DNA, 1291 bp, Homo sapiens
tgatactaatctccctacaaatctccttaattataacattcacagtcattagaactaatcatatatcagtcatcattcttcgaaaccacacttaatcatgcatcatatggcgtaatcaatcaatcatgatgaggcaatcaagtgcagaaacgccatgaaacgctagagcaacatacttccctattcatgaccacccataggtagggctctcgttcaccactaagtacattctgcaccgcaatgtctaacagatcgacgaatcgagccttaaggcttctacattaaagtattcctactactacaaatttctataatggctccaagtaacttatcaaaagctcctagagccaaatacactttgactatgaacttagctcggaacgacgaaagtaagcgttatacattaccgttacacacgcattgacccatcggatacatcgggcaccttcacgagcattagttgtaacttgcgcggctaatacaggcgccacaattgtgtccagaacacgaccacgcgcaattcacgcatggcgggatccaaagttcagctacacccttaggccacgccaaaggtaacgtcattggacaacacttaaggtgccgcgcatcactgcggagtacttaaaacgtatcgggccacgtcccaacaaagctccgattttcctatctaaaagcacaccccatggatccacagacacagcgacccgctacgagcacttaagactcacattataccgctttggtaacggaaattcccccttaattcgcacggggccaactacacatctaattagagccaaagggcatacccagtccgtgagctccataaaccggaacgcagcacgaacaaagggaagccgtaatagcagaaattgcaggcatccacatttgcactattaaccttcctttcccacatgttccattgcgacaaccacattaggacccgatacggtaatgattagaccaccgggccgcacattgcatcgtaattccccaaaaagcaccccactcgatgagcaacggacttaccaacacaccggggcagtgcccaaggagcgaaattcgtacaccgcacgtagacagtctaggcccccatgacgtgtgaccctttacaccaatttccgatccaactataacgcttaaattgcctgggggacgtaatggcgacagaaaagccatgcacaacagaggtacccgggaactggggcagttctcaggacggatccgggatagttaataacaatctcgtccatgctaccacggggaccttgtgcgaaaacatctttaacca

SEQ ID NO: 659092 - DNA, 1022 bp, Homo sapiens
  misc_feature (217)..(217): n is a, c, g, or t
  misc_feature (590)..(590): n is a, c, g, or t
gatttggcgggatctgtgtctctcgctgggctggcacaggagcttgggatctgtctcctctttcgcctcctgcaccttgggagccctgggctactctgtcacagcccctgttgccctgtgatctgtaggtccttggggacgcatagttaaggtgccaggacatcctggaagctgggaaatgatttcttccagaccatggctggagaaggaaagaagnttgttgcagtggcaggaccaaggtcaaatgagttatagccaagtctacagtaagatgtggcagtattctgttttgaagccgggaccatgattggcaagcttgccacttggtcaagtgctcaccctctgaaaatgtcttccttggtctttgcctccagctgggtgccacaaactctgaactggattccaaggctttcatgaatgcacttatgtttgctgtggcagctgcattatgtcgtgggggatgtggatgcagaacctcacattctgtcgtcttgcttatgttactctcctttatgtttcactttctcaaatgaatgtcaagcaggtgattttcagattcaaaagttctaaaataaattgctcaaatttanacattatgtaagctgttaataaaatttctggtaggtgctacatatttgttaaaattttggttgtaattttaagctcactgtaggcagaaaggaatcattaagattctattctttttagtctgtatctaaatgaccatattttttattccaaatatttactttatactcagtaatgctcatggtatttgcgaaaattatattgtgcttttattgaaaatataaggcttgttttagctctgaaagctatattatagtcatatagtttatgatagtaatgataagagaggcgcacttattgggaacggtaatttggtggctttaagatattaattaatttttcatagagcaatattaaggtggaggttccggaaattggcttttaagcgggttcaggggggtaggaggccagaaggggaaataaaggatagcggg

SEQ ID NO: 659093 - DNA, 996 bp, Homo sapiens
  misc_feature (310)..(310): n is a, c, g, or t
  misc_feature (738)..(738): n is a, c, g, or t
  misc_feature (747)..(747): n is a, c, g, or t
  misc_feature (750)..(750): n is a, c, g, or t
  misc_feature (826)..(826): n is a, c, g, or t
  misc_feature (834)..(834): n is a, c, g, or t
  misc_feature (845)..(845): n is a, c, g, or t
gatttggcgggatctgtgtctctcgctgggctggcacaggagcttgggatctgtctcctctttcgcctcctgcaccttgggagccctgggctactctgtcacagcccctgttgccctgtgatctgtaggtccttggggacgcatagttaaggtgccaggacatcctggaagctgggaaatgatatgtattcatttcctaccaccgtagtggaagagatactatccctatctttacaactgatagcatttccaacagtaagctgtgagattctgcttgaaatcacctctcaaacaaataaaaaacagaccngggagacatgctacgctcattctgctgaagaaataggcatcatagctgggaaacggattcacaagacccaggctgttccctacatatgtttcctcctccgacatcagttcatcagtcaatcaagccatgtgagagtggaggccttgtattccctattattcttgggcactctactccaagtaggtatgagagtgctaaccagcaggtgtagacttttcaggagtgaagaatgaggcaggcattccaaacctggaccttcatcaccttttgtttcatctcaagacaattctgagggactgttttggagcgtgtctggaaggtgaaccttgaagaagagtgtgggctttgatgtgactcagttgagatctttcatggggaggcaggaattcaatgcccagaatctgggctggtgtctttgaggtcagtangttgcgtcnttngtatccaagtccattgttactaggttggaggctggagattctaaatggttccagaacatctctctgattcttttgngagatggngtctgaagacnatgttcgtctttgggaatcttagaaagtttccttggaactggaaaagctggctaagccaaaggtccattgggcttaccacgtgatattgggagataaccgttggggatttaaccctttcgtggaatgaacttgccggcggaataaaacttc

SEQ ID NO: 659094 - DNA, 842 bp, Homo sapiens
gggctgtacggccggaattttgggatctttgtcatcggcaaaggcagcctttttctggcctgacttatggctcgcgtttatttctaggaaaaaaaaaaaaaaaatgaaggaaagaaaaaaagcaacgaaacataaaacacagcaagcgccccggtgccccgcagtgacgtctgggcctcgacagagcccccgacacggcaccgcatggggccccagcactgcgagacaggtaacagcgcgcgcgccaacgaagctgaaagactctgcgaggagaacggagcggtataaaacatacgaagggtgcatgaccctttaacaacacaggcacagaatacataacgctgcagatcagcaagaaaaaaagggcgtgtggagacaacgctcggaaaacaacgagcagcgctattggccccacgtatagtggcaaaaggtaaactgagagacgccacaagacaggcgaccaatcgggcacgtcactacacagaccccaaggtacaaaaccgtcgtggcggtgaaccaatgtggcacaccaaccgtgggaaccactcacgtaggaaagagcaagagagggcgctcggagagaggagcaatgccccgacatcacgaggaaagcggacccgcaagacccacctgtggggagccaacgaagggacacaataaacgcgcgttgatggtaagagagcagtaaaatacgcgaacagctgctgaatgcatcgcaaacgcgcacacccgaacggaacaccagccacaggggaagaggtccaacaacacggtatttggaagagacacaaaaacacacgcacacgtggggagcccactccgacctacgtcaacatttgggt

SEQ ID NO: 659095 - DNA, 140 bp, Homo sapiens
atatgaaagacggataacaactctccaggcgggccccttacctcgagaacagactctttttggagattcagggtaacgcgtgtgtgtgtgtgtgtgtgtgtgtgtgtgtgtgtgcagtagaggaatggcggcgcagtggc

SEQ ID NO: 659096 - DNA, 987 bp, Homo sapiens
  misc_feature (555)..(555): n is a, c, g, or t
gatttggcgggatctgtgtctctcgctgggctggcacaggagcttgggatctgtctcctctttcgcctcctgcaccttgggagccctgggctactctgtcacagcccctgttgccctgtgatctgtaggtccttggggacgcatagttaaggtgccaggacatcctggaagctgggaaatgattgttgcagtggcaggaccaaggtcaaatgagttatagccaagtctacagtaagatgtggcagtattctgttttgaagccgggaccatgattggcaagcttgccacttggtcaagtgctcaccctctgaaaatgtcttccttggtctttgcctccagctgggtgccacaaactctgaactggattccaaggctttcatgaatgcacttatgtttgctgtggcagctgcattatgtcgtgggggatgtggatgcagaacctcacattctgtcgtcttgcttatgttactctcctttatgtttcactttctcaaatgaatgtcaagcaggtgattttcagattcaaaagttctaaaataaattgctcaaatttanacattatgtaagctgttaataaaatttctggtaggtgctacatatttgttaaaattttggttgtaattttaagctcactgtaggcagaaaggaatcattaagattctattctttttagtctgtatctaaatgaccatattttttattccaaatatttactttatactcagtaatgctcatggtatttgcgaaaattatattgtgcttttattgaaaatataaggcttgttttagctctgaaagctatattatagtcatatagtttatgatagtaatgataagagaggcgcacttattgggaacggtaatttggtggctttaagatattaattaatttttcatagagcaatattaaggtggaggttccggaaattggcttttaagcgggttcaggggggtaggaggccagaaggggaaataaaggatagcggg

SEQ ID NO: 659097 - DNA, 1040 bp, Homo sapiens
caccatgttgttagaccaggctagtcttgaattcctgacctcaggtgatccacccgcctcggcgtccaaaggtgctgggattacaggcgtgagcaactgcgcccaggctcgaaatgccaattcttgaataatacatttatcttcgtccaagtttaagatagtatctgtatcatagagctaaagtagcccatagtatagttctggcgttttcttcgactgaggttttctatttcgcttcactgatcattctagttttattttgggaaccatactgttttaattatttagagtttatgatgtgtcttaacatctaatagaatattcatggtgggtgcggtggctcacacctgtaatcctagcactttgtgaggctgaggcgggcagatcgcctgaggtcaggagttcgagaccaggctggtcaacatcatggagacgcccgcgcgagtcgacagatctccagggcaatcaccggaccgggcccagcgcgcatcaatcgcacaaactcgcgcaccagcgccacacaaatcgcgcgaaccgcgggaaaggcgaggaccgcccgcgaacccaagaatccgaccaaagccaacccccaggcctgacacacaccaaggacaccaccacacacacaccccaacacaccacccaagcacacaacacacaaaatgcacacacaccccaaggaccggccaaagggcgaaaacacgcaacccaaccaaccaaacacgacacacgcaccacgaacaaaacacacaagccgagaacaacacaaacacacgcgggacacacagggacacacacccacgaacacacgcccaaaccagaagcacccgccagaacgcaaaaccaccagcccgacgccacgaccaaacaacagcacagccacaccggcgcaagcaagcaaaaacgaagcacaatagaaaacaaaccaacaaacaaaaaatcacaaaccggccgacgagaccaagaacaaaaaaagaacgacaccgacagcgaccacaaagcgacaaaacacacaacaaaaaacaaagagagacaccagc

SEQ ID NO: 659098 - DNA, 156 bp, Homo sapiens
  misc_feature (25)..(25): n is a, c, g, or t
  misc_feature (101)..(101): n is a, c, g, or t
tcagaatcgagctcggtaccagcgngcgccttttttgggccctacgtctggatgccggggcttcacacaagaaccacctctcccgcagttcccaaggactngtcatttcatgttcttattttagaccggtttggtaaataaagctgtttcccaagg

SEQ ID NO: 659099 - DNA, 1024 bp, Homo sapiens
  misc_feature (185)..(186): n is a, c, g, or t
  misc_feature (189)..(189): n is a, c, g, or t
  misc_feature (193)..(195): n is a, c, g, or t
  misc_feature (209)..(210): n is a, c, g, or t
  misc_feature (218)..(218): n is a, c, g, or t
  misc_feature (231)..(232): n is a, c, g, or t
  misc_feature (242)..(242): n is a, c, g, or t
  misc_feature (248)..(249): n is a, c, g, or t
  misc_feature (256)..(257): n is a, c, g, or t
  misc_feature (260)..(260): n is a, c, g, or t
  misc_feature (262)..(265): n is a, c, g, or t
  misc_feature (267)..(267): n is a, c, g, or t
  misc_feature (269)..(269): n is a, c, g, or t
  misc_feature (271)..(275): n is a, c, g, or t
  misc_feature (277)..(277): n is a, c, g, or t
  misc_feature (281)..(282): n is a, c, g, or t
  misc_feature (285)..(289): n is a, c, g, or t
  misc_feature (293)..(293): n is a, c, g, or t
  misc_feature (297)..(297): n is a, c, g, or t
  misc_feature (304)..(304): n is a, c, g, or t
  misc_feature (306)..(306): n is a, c, g, or t
  misc_feature (308)..(313): n is a, c, g, or t
  misc_feature (315)..(315): n is a, c, g, or t
  misc_feature (317)..(317): n is a, c, g, or t
  misc_feature (320)..(320): n is a, c, g, or t
  misc_feature (322)..(322): n is a, c, g, or t
  misc_feature (326)..(326): n is a, c, g, or t
  misc_feature (328)..(328): n is a, c, g, or t
  misc_feature (332)..(332): n is a, c, g, or t
  misc_feature (334)..(337): n is a, c, g, or t
  misc_feature (347)..(349): n is a, c, g, or t
  misc_feature (356)..(356): n is a, c, g, or t
  misc_feature (361)..(362): n is a, c, g, or t
  misc_feature (365)..(365): n is a, c, g, or t
  misc_feature (367)..(368): n is a, c, g, or t
  misc_feature (370)..(371): n is a, c, g, or t
  misc_feature (374)..(374): n is a, c, g, or t
  misc_feature (376)..(377): n is a, c, g, or t
  misc_feature (379)..(379): n is a, c, g, or t
  misc_feature (381)..(381): n is a, c, g, or t
  misc_feature (384)..(384): n is a, c, g, or t
  misc_feature (386)..(386): n is a, c, g, or t
  misc_feature (397)..(400): n is a, c, g, or t
  misc_feature (404)..(407): n is a, c, g, or t
  misc_feature (411)..(413): n is a, c, g, or t
  misc_feature (415)..(415): n is a, c, g, or t
  misc_feature (417)..(417): n is a, c, g, or t
  misc_feature (419)..(419): n is a, c, g, or t
  misc_feature (421)..(421): n is a, c, g, or t
  misc_feature (435)..(435): n is a, c, g, or t
  misc_feature (439)..(439): n is a, c, g, or t
  misc_feature (446)..(446): n is a, c, g, or t
  misc_feature (448)..(448): n is a, c, g, or t
  misc_feature (454)..(455): n is a, c, g, or t
  misc_feature (457)..(457): n is a, c, g, or t
  misc_feature (464)..(464): n is a, c, g, or t
  misc_feature (474)..(474): n is a, c, g, or t
  misc_feature (545)..(545): n is a, c, g, or t
  misc_feature (593)..(593): n is a, c, g, or t
  misc_feature (599)..(599): n is a, c, g, or t
  misc_feature (605)..(605): n is a, c, g, or t
  misc_feature (611)..(611): n is a, c, g, or t
  misc_feature (652)..(652): n is a, c, g, or t
  misc_feature (657)..(657): n is a, c, g, or t
  misc_feature (666)..(666): n is a, c, g, or t
  misc_feature (668)..(668): n is a, c, g, or t
  misc_feature (671)..(671): n is a, c, g, or t
  misc_feature (688)..(689): n is a, c, g, or t
  misc_feature (695)..(696): n is a, c, g, or t
  misc_feature (698)..(698): n is a, c, g, or t
  misc_feature (737)..(737): n is a, c, g, or t
  misc_feature (743)..(743): n is a, c, g, or t
  misc_feature (749)..(749): n is a, c, g, or t
  misc_feature (752)..(753): n is a, c, g, or t
  misc_feature (759)..(759): n is a, c, g, or t
  misc_feature (767)..(767): n is a, c, g, or t
  misc_feature (771)..(771): n is a, c, g, or t
  misc_feature (773)..(773): n is a, c, g, or t
  misc_feature (779)..(779): n is a, c, g, or t
  misc_feature (784)..(784): n is a, c, g, or t
  misc_feature (786)..(786): n is a, c, g, or t
  misc_feature (788)..(788): n is a, c, g, or t
  misc_feature (791)..(791): n is a, c, g, or t
  misc_feature (804)..(804): n is a, c, g, or t
  misc_feature (807)..(807): n is a, c, g, or t
  misc_feature (811)..(811): n is a, c, g, or t
  misc_feature (834)..(834): n is a, c, g, or t
  misc_feature (919)..(919): n is a, c, g, or t
  misc_feature (1018)..(1018): n is a, c, g, or t
gatttggcgggatctgtgtctctcgctgggctggcacaggagcttgggatctgtctcctctttcgcctcctgcaccttgggagccctgggctactctgtcacagcccctgttgccctgtgatctgtaggtccttggggacgcatagttaaggtgccaggacatcctggaagctgggaaatgatanngangaannnaagaaaaaacgacnncaacacanaatagaaatatanntaaaaatttntcaatnnaaaaaannaanannnnanantnnnnntnaaannaannnnnaaanaaanaaaaaananannnnnnananatnanaaantnattntnnnnaagaaatagnnnaagaaanatttnnaanannannaantnnananatnanatccccaaaannnncaannnnaaannnananananaaaacagaaacaanaaanaaaaaananaaacannangaaaaanccacaaacanaagaaaagcacccccccaaaaagggaaaatgaaaggaaaaaaaacggcggtaacataaaagaaagatcttnaaggccccagcccgagccaaaaaagtaccggccaacgacgcaaccgcnggaaangcgcgnccaatnaaaccatcaaagccaggggtaatcaacaggggcggtctttncaggnagaaatgcntncgnctatacgggcatcagcnnggcgcnnantgaatgggggaagcaggggaagcataacgtgttttttancaaaanccatcntannagacanagcgtaancctnanaaaacncaacncncncanaactcaataatcncantccntttttttcgcaaatccaagcccncacaagaaggaggaccccacaaaggcagcaaaaaaacagcaaggaaaaaacggaaaaacgcagaaggagcgaagcaccgaaaagnaaacaagaccccagaggaaaaacggaaaacgaagaagagagcgaaaggagagaaagcaacgcgagcacgcaaacaaaaagggaaaaaaaaaaaaggagnggggag

SEQ ID NO: 659100 - DNA, 1586 bp, Homo sapiens
  misc_feature (1376)..(1377): n is a, c, g, or t
  misc_feature (1470)..(1470): n is a, c, g, or t
  misc_feature (1494)..(1494): n is a, c, g, or t
  misc_feature (1586)..(1586): n is a, c, g, or t
ggcacgagcggcacgagggcagcggccccggcccgcgtctgcgcccctcgctgtcccgcgaccccggcgcgggtgcctcgggcccccctcgcgcgccgccatggtgggccggctgagcctacaggatgtgcccgagctcgtggacgcgaagaagaagggcgacggcgtcctggacagcccggactcggggctgccccccagccccagccccagccactgggggctcgcggcgggcggaggcggcggagagcgcgcggcggcaccggggacgctggagcccgacgcggcggcggcgacccccgcggctccgagtccagcgtctctccccctggctcccggctgtgcgctgaggctttgtcccctgtcctttggcgaaggagtggagtttgaccccttaccaccaaaggaagtaaggtacacctccttggtcaagtacgactccgagaggcacttcatcgacgacgtgcagctgcccctgggcctggcggtggcctcctgcagccagacggtcacctgtgtccccaatggcacgtggcgcaactacaaggccgaggtgcgcttcgagccacgccacaggcccacccgcttcctcagtaccaccatcgtgtaccccaagtaccccaaggccgtctacaccaccaccctggattacaactgccgcaagacgctgaggaggtttctgtccagcgtggagctcgaagccgcggagctcccgggcagcgacgacctctctgatgaatgctgacccagcaggctgggctggggtcggaccggctctcccgctgtcctgcccccgactgccctggccaagctgggcgaccttacccttcacgtcattccagccccagaggagtctaacctagagatacctccaagcgcggccgggggaagagaaaaaaaagaaaaaatcactgcatctcataattattgagatctttgtgttgtaattttcaagctgtttttagagggaatatatgtcctggtttgctgctgtgttgtttccccaaagtctcaatcagatgaggcaacaaaaagaccaccagaattgcaggaaagcagcagcagtctgggatagggaggggggaggagagctctccctccgtggtcagtttgtcagaagaaaagcatggaaaaagtgagatttaagaaatctcagccacgggtgtcttcactgcacaaaagtggtgctaattcagtaaacagtgacacctgtgtgggttcaatctgtggagagttgagttccattcctttgtttttaaatttccacctccatttgtgtttcctattaacctaaactcttgtaattctctaaatcttttttcatgatataaaaaaaaaagaaaatcccaaaccacaatttaagatgcctttttttnnaaaaaaaaggttctccgtgttgccacctgctccgggaaggccaggccgatgggcggccaggtttgggagcagcggcttcggctccgattgcgntccgtgacgggtcaggttccaagnacaaggccctgagaacggcgccgaccccttggaacctgggagccggcgccgcgcggctccgggagggtcccagaggggggtttggggttttn

SEQ ID NO: 659101 - DNA, 601 bp, Homo sapiens
  misc_feature (323)..(323): n is a, c, g, or t
  misc_feature (326)..(327): n is a, c, g, or t
  misc_feature (363)..(363): n is a, c, g, or t
taaaaaaattggttcaggatgaacttgcagagcactcttccacagaacatggttaggttagccctgcctgacttctagcaattgctaactatacaccttgcctgcctctaggacccctacctgagtggcaaccataccctccataggctgtgttccatggcagtccctgccatcccccaccagcggactctggctccctccctgtacccatttctagcaacagctccttgcctggctgctaagacggaggcgcctccttgtttgttcctgggctctgttctgctccctctctcactccatggagtcacttatagtcttccttnctnnacgcctgaattgagcctttgctccttctggatcacnccttcctgggcttcttctccgtccctcagtactgctaaaattgccctgctcctttagtccatttccatgacctcagccctctctctccacaccttgtcttttaactttctcctggacttcttcctctccgcagcatgaacccagagcctatcacacactgatgtttttgtcagcatcctgaactttctcatgcccttcaactttatttatttatttatttatttatttattatttttt

SEQ ID NO: 659102 - DNA, 958 bp, Homo sapiens
  misc_feature (244)..(244): n is a, c, g, or t
  misc_feature (526)..(526): n is a, c, g, or t
gatttggcgggatctgtgtctctcgctgggctggcacaggagcttgggatctgtctcctctttcgcctcctgcaccttgggagccctgggctactctgtcacagcccctgttgccctgtgatctgtaggtccttggggacgcatagttaaggtgccaggacatcctggaagctgggaaatgatagcatttcatcatatcaatgtgaagatttcttccagaccatggctggagaaggaaagaagntgtgtttgcctgactcagtgactatagagagaaccaagttctgcaggcctgtcacctaagtctcagctgggtgccacaaactctgaactggattccaaggctttcatgaatgcacttatgtttgctgtggcagctgcattatgtcgtgggggatgtggatgcagaacctcacattctgtcgtcttgcttatgttactctcctttatgtttcactttctcaaatgaatgtcaagcaggtgattttcagattcaaaagttctaaaataaattgctcaaatttanacattatgtaagctgttaataaaatttctggtaggtgctacatatttgttaaaattttggttgtaattttaagctcactgtaggcagaaaggaatcattaagattctattctttttagtctgtatctaaatgaccatattttttattccaaatatttactttatactcagtaatgctcatggtatttgcgaaaattatattgtgcttttattgaaaatataaggcttgttttagctctgaaagctatattatagtcatatagtttatgatagtaatgataagagaggcgcacttattgggaacggtaatttggtggctttaagatattaattaatttttcatagagcaatattaaggtggaggttccggaaattggcttttaagcgggttcaggggggtaggaggccagaaggggaaataaaggatagcggg

SEQ ID NO: 659103 - DNA, 1502 bp, Homo sapiens
  misc_feature (1292)..(1293): n is a, c, g, or t
  misc_feature (1386)..(1386): n is a, c, g, or t
  misc_feature (1410)..(1410): n is a, c, g, or t
  misc_feature (1502)..(1502): n is a, c, g, or t
ggcacgagcggcacgagggcagcggccccggcccgcgtctgcgcccctcgctgtcccgcgaccccggcgcgggtgcctcgggcccccctcgcgcgccgccatggtgggccggctgagcctacaggatgtgcccgagctcgtggacgcgaagaagaagggcgacggcgtcctggacagcccggactcggggctgccccccagccccagccccagccactgggggctcgcggcgggcggaggcggcggagagcgcgcggcggcaccggggacgctggagcccgacgcggcggcggcgacccccgcggctccgagtccagcgtctctccccctggctcccggctgtgcgctgaggctttgtcccctgtcctttggcgaaggagtggagtttgaccccttaccaccaaaggaagtaaggtacacctccttggtcaagtacgactccgagaggcacttcatcgacgacgtgcagctgcccctgggcctggcggtggcctcctgcagccagacggtcacctgtgtccccaatggcacgtggcgcaactacaaggccgaggtgcgcttcgagccacgccacaggcccacccgcttcctcagtaccaccatcgtgtaccccaagtaccccaaggccgtctacagcgacgacctctctgatgaatgctgacccagcaggctgggctggggtcggaccggctctcccgctgtcctgcccccgactgccctggccaagctgggcgaccttacccttcacgtcattccagccccagaggagtctaacctagagatacctccaagcgcggccgggggaagagaaaaaaaagaaaaaatcactgcatctcataattattgagatctttgtgttgtaattttcaagctgtttttagagggaatatatgtcctggtttgctgctgtgttgtttccccaaagtctcaatcagatgaggcaacaaaaagaccaccagaattgcaggaaagcagcagcagtctgggatagggaggggggaggagagctctccctccgtggtcagtttgtcagaagaaaagcatggaaaaagtgagatttaagaaatctcagccacgggtgtcttcactgcacaaaagtggtgctaattcagtaaacagtgacacctgtgtgggttcaatctgtggagagttgagttccattcctttgtttttaaatttccacctccatttgtgtttcctattaacctaaactcttgtaattctctaaatcttttttcatgatataaaaaaaaaagaaaatcccaaaccacaatttaagatgcctttttttnnaaaaaaaaggttctccgtgttgccacctgctccgggaaggccaggccgatgggcggccaggtttgggagcagcggcttcggctccgattgcgntccgtgacgggtcaggttccaagnacaaggccctgagaacggcgccgaccccttggaacctgggagccggcgccgcgcggctccgggagggtcccagaggggggtttggggttttn

SEQ ID NO: 659104 - DNA, 1120 bp, Homo sapiens
  misc_feature (217)..(217): n is a, c, g, or t
  misc_feature (688)..(688): n is a, c, g, or t
gatttggcgggatctgtgtctctcgctgggctggcacaggagcttgggatctgtctcctctttcgcctcctgcaccttgggagccctgggctactctgtcacagcccctgttgccctgtgatctgtaggtccttggggacgcatagttaaggtgccaggacatcctggaagctgggaaatgatttcttccagaccatggctggagaaggaaagaagntgtgtttgcctgactcagtgactatagagagaaccaagttctgcaggcctgtcacctaagtctcaggtgagtatgaattctcttgtgtttttcacagattgttgcagtggcaggaccaaggtcaaatgagttatagccaagtctacagtaagatgtggcagtattctgttttgaagccgggaccatgattggcaagcttgccacttggtcaagtgctcaccctctgaaaatgtcttccttggtctttgcctccagctgggtgccacaaactctgaactggattccaaggctttcatgaatgcacttatgtttgctgtggcagctgcattatgtcgtgggggatgtggatgcagaacctcacattctgtcgtcttgcttatgttactctcctttatgtttcactttctcaaatgaatgtcaagcaggtgattttcagattcaaaagttctaaaataaattgctcaaatttanacattatgtaagctgttaataaaatttctggtaggtgctacatatttgttaaaattttggttgtaattttaagctcactgtaggcagaaaggaatcattaagattctattctttttagtctgtatctaaatgaccatattttttattccaaatatttactttatactcagtaatgctcatggtatttgcgaaaattatattgtgcttttattgaaaatataaggcttgttttagctctgaaagctatattatagtcatatagtttatgatagtaatgataagagaggcgcacttattgggaacggtaatttggtggctttaagatattaattaatttttcatagagcaatattaaggtggaggttccggaaattggcttttaagcgggttcaggggggtaggaggccagaaggggaaataaaggatagcggg

SEQ ID NO: 659105 - DNA, 274 bp, Homo sapiens
cttagccgacggaactggacactggaccgcagcccatgagactcctcccccgcttgcttcttgcttttccttaactcgtgttccctgccactgtcttgttccaagggggcccaagaggcttgtaagcaggtggcacaaggtcttacagagggttaggacacagtagggggttccatacttaagggttgaaggtgagttacggccggggtagacgaggttaccccacaaattttggacagggtaaaagggaggaagttttctttggtagcctttc

SEQ ID NO: 659106 - DNA, 1144 bp, Homo sapiens
gggagagggcatataggataaagatgagcaaattctaccctaaaaatgttctcagtcagttcaccaggaagaagatgaggtttaataactttcaaggtaattctcagattgacattttgcaggggcacaacatgggctcttgttctagttgaagtgagcagagcaaggctatcaaattcaatatgtaacttacagcattcccagaggttcaaacaataactgatgcagatgtacttcttcagtgtgattcttcagatcaaacttttacttttggcatagttaatcttcagaaacatgtgctgtcatgctgtgtgtgtcactgagggcttggtcttgctgactccttcagcttcagctctacacttctggcaccctccttgctaattcccactgtctctcgcatacactgaacaactcatgcttgcaatgcactcttgctgatctgggcagacttcctcgatcttccagggcaacggcacggatgtgcagcccctgaacggccatgacactcccagctgctgtacggagccagtggcacatatggccatacccactaccttaccaggcgctggtcccttctgctcacaataacatctgcccaccagagggagctgggaagcaacgctctcaactctaacacctagccactgcgcatccgcacctccacgcagccacccataacaacccaacctgccccagcccaacccacccaccccgcagcagcacactagcccggcagcgcaccctaccacgacaccacaacactccatcatcccgcaagacccacacgcctcaactgcggagcacgccatactggccctaagcccactggccagcgaacaaccacgaaccaaccacgcacgaggccatcaaccagcacagcagcccacaatacgacagagccacaccacaccgaaaatacacagtagagaaactaccgcgaaaacagaaagacagaacacacaagaaacaccaactaagcgccccaactacacgaaaacaacaaaacaccccccaggcaacaacacacgcaagcaaacaggcagaacaaccatacaaccccgacaaccacacacataaagacagagcacctagaaaccacccacaaacacagacgcaacctcaccacccaaaacacacacat

SEQ ID NO: 659107 - DNA, 740 bp, Homo sapiens
ctgagccactggacatggtttaggctttccttatgctcttttgttgttgtcccgaggtttttttagtggagggtgttctgggtcccatatgtcctgtcctgtaggggattgttgcttccttgtaatcccctcgcaggtgcctttggctgaggtgccaggtgtccaagtctatcagattgccttgtcccttgatgtggatcttctgcggtccaggtccttggtgccctcgttggccctgctgcgtccagtgtagggctcctacggtgtggtgttcattgtgcctgtggtccctgtcaagcacacaccactttgcatctgaccgttaggcctctatagatgagtggcctgtcgccgtgtgcatgccctcagcctaggatcatggtcgctgccccagaggggactagactggagcagagttcgcaccacatgtggcgtaggaactgtaggccatcaccatgaatggcggccatgacgcgcgggagcatgacggaagacgccagcatccacacgtcttcgccctgccgcaacggacaccagcataggacggcagtaggagactggcagcatatcctcgctgctccatgctcagatgtcaaagcacaaatcctcaggacgggcttaagggccagggcagccgagggaagctccaggtgcgggaccacgtcttccagacggttggtgcccactggctgggaccctttgcagtggggtgcctcccctttaccgcctggggaggagca

SEQ ID NO: 659108 - DNA, 1795 bp, Homo sapiens
  misc_feature (1420)..(1420): n is a, c, g, or t
ctctctagctcttacctgttgatccgtctctacttcctgttcgtgtggtggcctatagttgtgtggttgccgcctctgctaggtggtgtggcgcccgattcgtggccccctcgttgtttgtgccactacttgttgtttgtgttggatgaccctctctcgtgtcgggatagtttcgtgggtcgcgcgctacgctacacctgtctacgccatgtgtctccctgttgtttcgctccggccttgtgtgtgttcgcccccagcgaagttgttggtgtgtgtctcctccgatcgaatacccacgagcgctgtgtttgcccgccctgtgtagaaggtttgtgttgttgtgcggtcccccgctgtggtgatgggtggttgtgtggcaccaccttggtcgctccggaggaagttttccgccctgggcatcgcaccacaacacctcttggtggttggcccccccttagagtctccgctcctgccgttagtgtcccgagatgtgttgcgcgccgttgtgggcctccccaatcaatgatagtggtcgcgcccccggtggctgattgacttgtgttgttgccgtgggtaggagagtaagccccctgtctcccctgtgtggcgccccgggccgttgtgtgctgtgtgttgatcgcctcacggagggtgttccccgccccctagtggcggctttgggccgttgttttttgaagtcccctcatgcttccctcactccccaaggattttgtcgttggaaaacaaattgtgtttgatccctccccttctcgccgccacattggtggtgttaaaaattatccaccttgggccgctttttcggtgcggcacccttgtgtgttgtgtggcgtccccccttggtgtgtgtgtgacacgcgttgggtgtttcttcccccctcattaggatgatgtgtgctctccaatgagcggtgcgccacaccaatgtgtgcgccccccccaggtctctgcatagccccacagctggtcggccctcaggctacttctccccactgtttttttttgtgtgggagtatgtggggtgtgtcgccccgccccacttgggggcgtctcttcaccagcagagttttggtggggcgactttccactacactgtgtgcccacacgctctcttctccccctcctcttgtgtgggtgtgccctctctgttgttgttgtgaaggaccctctctggggcccccccacagggtactcacagagagagagactctgtgtgtgtgtcacacttcctgtgagagcacacacacgcgcacacacagcgcacactttgtccgagagagctcctgtggctttctcccgctgtgagccacacacacagggtgtgtacgacctctgaatggtgatattgtccccacagcgtgccctcttgtttccacctgggtatacgctgtggtgagagggngaatgtgaaggagaagggcgagagttttttccagaaggccccgctgagaaaatatatggctcgcccctctgagagaaaggagattatatgagggagagggttgggtttggagattctgttgaaaggaagaagggtgagaggaaagaaaggaagaaggagaatatctaaattaatccacattccctttggccccgcacgcacatgtcacatgctcccaccgaaatttcacgcttcacgcgttaaactgaccacagagcctttaagactttctggttagaattgttttccccttggtgatcccagtcttttcccaagggtaccctgtaataatttttcccatccatatctcccaagtaaagtccatttaccactcca

SEQ ID NO: 659109 - DNA, 1073 bp, Homo sapiens
gcccggtccagcccggcacagccatgatcaatggcgatcctaatcttcaacaaaccacgggaaagccgcggctctccaagttctaccagccctacagtgaagatacacaacagcgaaatcatcagggagactttccaattgtggtcatctaagcagcagcatgaaacatgtcggtcaatttccctagacacaggcaggcatcattcaattgggaggcatctgacgaacaaactggatttatagcacattatgcaacgttcatcatttaagtactactagtgtggattcttcagaaagtgaacttggcattttagatctaattcaagtcatttgtggaaacatttagacaaatgtatggaaaatgtctgtgagctggatttgattttccatgtagcacaaggttcacaatattcttgcagaaaatggtgatggggggaatggtcattggagacaaatcatgcatgcagattgtaacacaaattgatgcacaaaataagctggaaaaatctgaggctggcttaagcaggagctccaagccctgtgcttgtatcagctagtaaagaatatgaatcttcctgagatcccaagacatattaccattgggtgacatcagtataaaagtgccaaaaccttgacctcatttacattaacaatgtaaacaagggccaatccccagggtaaaatccagtgggaagagtcatctaagttaaccaatgcagatgttaccaacaatagaggagaaagcttaccttgggcacatgggattcaagctcaaggctcgtgtctccaaagtttgtgtaaacacccgatatgaaagttccacggatggccgagaatgtgccaacagtaaattacaacgaaaattaaagaaaccccatagtagacaataatacgacaacaaaaggagactcctgtagcaccaataagagaccctaatatatggagcacaacaggtaataaaggtagtacaaatcaccagatgtttacccccagcattgttgtaaaaacacaaaagaaacacactcacattgcaagcattagcaccatataacacaataccttacaacgcagca

SEQ ID NO: 659110 - DNA, 949 bp, Homo sapiens
  misc_feature (496)..(496): n is a, c, g, or t
tttggccgagacgagactataacaaacaaggtgaagtagaaatacaaaaagaggagacaagacacgacatttaacaggcctgtgttagaagagtgtatggcacttgccgttttatcgtgcgacgagtatctctcctcgcgacctagtgttcaagggaccccatggtccgggctgtgaccacgctcgggaacaatgtgttggacgccagaacatttgtggcgaatattttcggctgccgccctgtcatttggtgcggaatattaacacgtctcttcaggtaaggcggacagtccttaatattgtcttcgtcataatgtcgttggcgcggtgcgcgacattgtttttgtttcgcagtcggggtttggtttacaaaagaacggtagcccgtgacaggtcctgagcgatcacagggttcccgggtcccccttggtaggttgggaagacagtacacagttttgttgataaccccgtagtctagggacactatatcagattnaagtagcgcgattctccacagaagaccgcgagtatttttcagagacgattcctcgataaataataccactagatgcgtcaataagtgcgcgcccaccgctctcgatatacttgagtagttttcaggctgtcgcctgttcacctaagttgcgtcgcgcatgttgggccgcgacccgcattactttccctctgtaattcaagaagggacgcacattatctacaggatccaagaaataagatactcatattttgagaggaaaggagttccccccgctatgtctttgaacaatctcgcttggcacgtattcggcgtagtaatacaaatatcttaatgagaacaatgtctagtgagagatgattaagaaacaaacactcttggttcagtcaagagatatttacaccacaatcttcgcccgggggaaaaaaaaacccccaagctttctaccacaaaaca

SEQ ID NO: 659111 - DNA, 401 bp, Homo sapiens
  misc_feature (4)..(4): n is a, c, g, or t
  misc_feature (66)..(66): n is a, c, g, or t
  misc_feature (70)..(70): n is a, c, g, or t
  misc_feature (91)..(91): n is a, c, g, or t
  misc_feature (122)..(122): n is a, c, g, or t
  misc_feature (132)..(132): n is a, c, g, or t
  misc_feature (202)..(202): n is a, c, g, or t
  misc_feature (227)..(227): n is a, c, g, or t
  misc_feature (237)..(237): n is a, c, g, or t
  misc_feature (245)..(245): n is a, c, g, or t
  misc_feature (279)..(279): n is a, c, g, or t
  misc_feature (301)..(301): n is a, c, g, or t
  misc_feature (306)..(306): n is a, c, g, or t
  misc_feature (330)..(330): n is a, c, g, or t
  misc_feature (337)..(337): n is a, c, g, or t
gcanccaccagagaaacgaggcgaaaacggagaggcacacaggggggagaagaagaagaagatgtnaganacatacagtgtggcatttagnatatacactcccttgcgcgcaagcgaaaaancctaatcgcntctgtataacatgcgggaggggaaagccgaaccgggaaaaacacgggggggagaggacgaacaacggcgngtagaaaaggaaggggacagggcgngagagagacngccgggcnggcagggaaaggggaacaaggcgaaacggaaaanagaacaagcggagaggaatgtnaaaanggcatatccagtcaaacatttgtntgtgganggggccgtgcaactgtgagaaatacgtggagggaaagaggtcagacactgaggacatccctggg

SEQ ID NO: 659112 - DNA, 123 bp, Homo sapiens
gcccagaatactgaacttgtgagcgggcaggtaggactattgttccgttgttacttggctgctgtgggatgctgttgattcctcactacggcctgaggttgtggagccgtcgtatgcagtaga

SEQ ID NO: 659113 - DNA, 526 bp, Homo sapiens
acggcaagaaaggctcatagagcaaaatgaagtattacataataaaaagttataaatccaaataagaggtgtgtgtgtgtgcctgtgtgtacaaaacacagcctcaaaaaaaggaacacacaaaaattaaaaaaaaaaaaaagggggggacaaaattctaaggagaacgggatgcaagccaccaccagagctctcacaaatccagttaaaagcaggcagtccaataactatgtgcagatggaccttgatgagacagcatttcctaactataaaatccaaccactcagggggccatgtaggtctcaaacacatgcttgaccacagagccaggcagttggcacaacatgcccaaaagataaccagacaaaacgtcacagcattgaacaattaaaagaaaaacattctaaatctgcatgccaaagaagccatgatattggatatattactacttaaaatacaatacagtatgatactgcaatacttggggatgtgacaggcattccaacataaaacactgtaaagaaac

SEQ ID NO: 659114 - DNA, 994 bp, Homo sapiens
gatacaggcagcagagttgataaaatgaccatagaaaatgcagaagaccctagacgaacaccaagttccgaggtgcacctgattataccgcgtggtgggccaagccggggtggaccagtaggcccccgtaagctgaagctccatcgaggggcattccgagagctcattgagcgtccatgagcgtcccaagatttccagtcccaagctgagagacccctcgggaccgttcctcatggttctgtggaccactgtttctccatcaaaggcctaagggcactgtgagtgacaggggaccagtcctttgcagggctccatcgagcctcggtgacagtgtggagatccctgccctcaaggtggtgaagacaggtgaagtccatgcatgatgttccacatgcccatcacgttcagccatgcataggagaccgggctgggcatcgtgcgatcaccgcagtttgacccgtaagcgtgctggagcgcgggttggtgtgtgcccccgagtccctgcgacactggtccgatgcgggcctctatctctgtggcagagatgccgtatttccgggggccccatgtagaaccaaggcctaagttccacattactagtgggccatgcaaacagtcatgggccggtggatgttcttcagtcctgctccagataactttgatgcaggagcctatactgggactctttcaatcttctctcaagaataccgttgaccaggagcagtaactgtcccaaggatttgaccaccagggagtgacagacactgatgaggccgagagaaagccggccaggcccagaggccatggcctcgggagcagttggcctggtgggtttgacaagccagtacatgaccccggttggccggggactcgcgccagctaaaatccggcattacacaacctgccagagctccagggccggccagggtaaggccgacacacgaaactgccagaggaaggtcaagagcaacagcctgacagaaaacacacacgc

SEQ ID NO: 659115 - DNA, 371 bp, Homo sapiens
ccccgggttttttgggggggggggccctttgggggtaaacccccccaaaacctttttggggtgggaaccctttgccccgggggtgtggggggggaaaaaaacctacccgggtggttttttttcccccgccccctttttatgggtcccaaaatgggggtttgttttttaggggtttaaaaccccctttttttttccccgggggggggccaccccttttcccgggtttggggggttttccccccccctttttttttttttggggggccaaaaaaaccccccctcttttttttcggtttttttttcccgggggggggtttttttttccaaatttttttttttaaaaattccccaaaaaatttttttttttttta

SEQ ID NO: 659116 - DNA, 236 bp, Homo sapiens
ttatctttgacgaggtgatagtactccccatgtctgctatagataatatatcagtatcttcaatatgaacatccctaaggcgcaaggtagcacttgccatcctgtcccagttactgtttgtgtaacaggttgacaggtttacggagagtcatgaacttatgtccggtcaccagggaactgtcaatgatttactggtagagatacgagatatgagttagacattagggagaacacca

SEQ ID NO: 659117 - DNA, 700 bp, Homo sapiens
cgtgtgggacgacgtgtactcagtgctcaggcagccacggacagttgagctagtgagtggtgatggggagccagtgacctgcccctgaccaatgatacccacacctcctcccagtgaatgactgcccagtgccatttgtatagtgaaaacccatgtgtgcctgccgccacactcaggatgccatgtgggaagctgggctgtctccacccaccatgactccaccaggctggtgtagaggtgcatgcagtgcatgcaactgatggacctgtgagctccaagtgcccctgttgtcaagatggcacatattcaaaaaccatcccatcacacacatattatacatcatgaggggaacacaagggagaggagcaccaatgcacaatgacatgacatcccacgttaattttcgtgatccattcttggttcacatattgcctagacaaatggataacattcgattgacattgcacaagaaacatatgggaggccccacgttggagacaccccaattcactgggattcattggcaatttcccaatgagagtgatgccaagagggtcatcccattggcactatttgggaaccaccacaatgatccttgctgcggataacctgtggctgggaacactacaagcgatggccttttgccagataagaaaggacccccacgcatcaatacccccacggcccaccaagagccaat

SEQ ID NO: 659118 - DNA, 843 bp, Homo sapiens
attatattaagtatttggtttgcttagggaagaaagagctaattttttaaataaatcaaggttattacatccatgtatcttgcctggtgtatgcttttacaagtccttgtaacattgagttacagtgactttaactcctgtgtctgaaaaatcacaaacactgatgacaatcaaagcctcatcttaaggccccgtagaagatgccaatcgaaaataaactgcattccttagaggcactatgcgcgaatagaaatgtaatagctcattcaactcctcaaggcccaggaaactatagcggaagatggtgggcgcgtaagatagtaagggccgattttgaaagatccagtaagttcagtatatctctagtgaactaatcattcaagtaaaaggcacaactgatgcaaaatcagtatatggaccactgtgtctgattagcaaggtgttcttgaagcattaaccaactccttcataaaggttataaaaggcttatggaagttatattttataatgcaagattaaatcttatagttctgtttacgaaattttgatgatcaaatgtgattggcttcaggcagtattaatgagggcttctatgtttagaaagttaagtcacgttctctcaaagaatgaaggtttttgctctgtttgaaatccttgaagttatccacttggatttaattatatgacttttacgatgacctgtaatttgtattttggtatgtcaagtggttttagaaccttttggtatttgacaaggttttcaaaatcaattttaaattatgttttttttctaacctaaataaactttaagaacttagtttccttaagacctaaaaggaatat

SEQ ID NO: 659119 - DNA, 568 bp, Homo sapiens
  misc_feature (36)..(36): n is a, c, g, or t
  misc_feature (61)..(61): n is a, c, g, or t
  misc_feature (74)..(75): n is a, c, g, or t
  misc_feature (84)..(85): n is a, c, g, or t
  misc_feature (88)..(88): n is a, c, g, or t
  misc_feature (93)..(93): n is a, c, g, or t
  misc_feature (212)..(212): n is a, c, g, or t
  misc_feature (233)..(233): n is a, c, g, or t
  misc_feature (253)..(253): n is a, c, g, or t
  misc_feature (260)..(260): n is a, c, g, or t
  misc_feature (265)..(265): n is a, c, g, or t
  misc_feature (267)..(267): n is a, c, g, or t
  misc_feature (271)..(271): n is a, c, g, or t
  misc_feature (276)..(276): n is a, c, g, or t
  misc_feature (287)..(287): n is a, c, g, or t
  misc_feature (289)..(290): n is a, c, g, or t
  misc_feature (299)..(300): n is a, c, g, or t
  misc_feature (302)..(302): n is a, c, g, or t
  misc_feature (316)..(316): n is a, c, g, or t
  misc_feature (328)..(328): n is a, c, g, or t
  misc_feature (344)..(344): n is a, c, g, or t
  misc_feature (350)..(350): n is a, c, g, or t
  misc_feature (354)..(354): n is a, c, g, or t
  misc_feature (360)..(360): n is a, c, g, or t
  misc_feature (396)..(396): n is a, c, g, or t
  misc_feature (401)..(401): n is a, c, g, or t
  misc_feature (407)..(407): n is a, c, g, or t
  misc_feature (409)..(409): n is a, c, g, or t
  misc_feature (418)..(418): n is a, c, g, or t
  misc_feature (423)..(423): n is a, c, g, or t
  misc_feature (439)..(439): n is a, c, g, or t
  misc_feature (445)..(445): n is a, c, g, or t
  misc_feature (452)..(452): n is a, c, g, or t
  misc_feature (472)..(472): n is a, c, g, or t
  misc_feature (480)..(480): n is a, c, g, or t
  misc_feature (490)..(490): n is a, c, g, or t
  misc_feature (498)..(498): n is a, c, g, or t
  misc_feature (502)..(502): n is a, c, g, or t
  misc_feature (506)..(506): n is a, c, g, or t
  misc_feature (521)..(521): n is a, c, g, or t
  misc_feature (528)..(528): n is a, c, g, or t
  misc_feature (532)..(532): n is a, c, g, or t
  misc_feature (550)..(550): n is a, c, g, or t
  misc_feature (561)..(561): n is a, c, g, or t
  misc_feature (563)..(564): n is a, c, g, or t
caagaaaaatacgaagcttcaaaagtactgtgcgtngtatctcttcattctctggcaggcngggagtccaaggnnagtctaggnnggngggcngcttggcctaagcagtcacacaattttcaccgtcttgagcatatctgacaagacatacgtgtcatcccaacccctcccaggcttcctcagggtccgctccaaagcctgggctgtttctnggggctctggtgtggcaggtntttgctcggggtgcggctgncagaacnggttntnattnacttnaccctcaattngnngggcatatnngngggggggcactgcnttgggcccagcnggcgctgggtcttttngccccnggtntcggcncacaaggttgggaataaaaacaccttcgggggtganggtgnttttgncnttctgtggnaaagnttgctccacaaatgcngggggngggcggntcattcccggtgttgggtcnttggtgtnaacgtcgggnattatggnttcnttgnggggcggtgcttctnctcctcntgcnaagctggcggtatggtgnggcgtctgcgngnngggt

SEQ ID NO: 659120 - DNA, 359 bp, Homo sapiens
ccgttttacaggttccccttacaccttatccgcatcatccatcaccacaattccacgtggcccccgcggactcgatcattgcgcctcatatccctgccgatcatcaccaccacctctggtttctcgctctctagcatctctgctttctttctcttccacatttaaacgtacttcccctcgaaacataatcggttttgccattaagattctctgaactggtttcagagtcatcaatataaccacacaaaccaaatattggaagctttcccccaacacccttggtattgatgcgaagttccactacgtttccataactcatgaagaattcctttaggtcgttttcatcaatatcttgtggc

SEQ ID NO: 659121 - DNA, 106 bp, Homo sapiens
ggcgagacgcaggacttagcccgctgctctgagcagtgatagagccttgacggccctccagttttcaggatacatgtacatgggtcccagccgccaatggtgattc

SEQ ID NO: 659122 - DNA, 307 bp, Homo sapiens
cccaacattgatagtccttttgaaaaacaaaaggttgccgagttttgggaaaaccccccccagcttttaagaagtaccggcaagaaacctactcaaagcaggtcaccagccaggagccttgacccaggttgcccagcctgtccttgggtggtttttttaatttttcctaaaagggtctgtcctttttgtgatttttgaaaaggactttttattttgagctggggaatttttgttttgtttttgttttttaaattaagcctgggttgagcccttgtaaattaaaaaaaggcatttttgtcctttttta

SEQ ID NO: 659123 - DNA, 512 bp, Homo sapiens
cttctgcggagagttaagttcatccatttcaccactgacaggtggctctgggtttcctcggcccagtgtccattccagaaacacagtgcccttgcgcatatgcggaagtaaccatggtggacagccacacagtgtcaccgccctcgtgtattggaacagtcatagctgctggcgggctgcgcagagccacattcattgatgtcttggcatcctccactgaactgttcatactggaagccggcgggacacatgcacttgtagctccccagggtgttgtgacaggaggctcctccgcagatgtgagcgctgaggcattcgttttcatcaacacactggttccactggtagtgctggaggtagccctgggggcagctgcacctgtagcccccaatgatgttctggcagtcatgctggcagcggtggttaacctcacactcgtccacgtcttcacagctggagccgggtctgatcaagtgagaatccccgttggcattcacaggtgaagcttccag

SEQ ID NO: 659124 - DNA, 350 bp, Homo sapiens
ggatttcaagcttacgaggacatgatgagctctgacagcagagcgcagaaactctggaagctgtttccagagggcctgcactgcattggaccacggccaccaccttctccttcaccgcatggccagatagctcccgtgccaccaggtctgcagccgctgcagcatggcctggaaccttctcatgcccttgtcacagaagctctccccaggctcctcgatagcgggatcctcaacatccgggacaggggatctgttgcctcggcaccgtaatccatctctttctttttcaagtagaggagtgagctctgggtgctgctcctcataataagccgccaccctcgttaagcttg

SEQ ID NO: 659125 - DNA, 295 bp, Homo sapiens
cgcggtccgggagatagcaggagctcattgaacctgggaggaggaggtgcaggagcaagatcaagccacgcacgtagccgtgtcatagagtgagattctgtctttaaaaaaaaaaaaaaagggagttcggcattatctccagtaatactctatatcttacagtctatctactcttggatattaaaatagtccctccgggcttcttatgcttaacggtgggcttccaacttatgggggtcctggtttccaatatttatctcttctaggcaacatataatgggggcttcctcttatg

SEQ ID NO: 659126 - DNA, 274 bp, Homo sapiens
tttttttttcccccttttgggtccccccccccgggtttccaaagggaaaaccaattttttgcccaattaaaaggccaaaatttttttttcccccaggccccgtttaaaaggggggcctccgggggtttaaaaattttttttttgttttttaccctcccttcccaaaggattaatggggggttacccctaaggttgattttttgggggtcccccaatttgtttccttttttttttttttaggtattaaataacccattttttttaagggccccta

SEQ ID NO: 659127 - DNA, 354 bp, Homo sapiens
  misc_feature (271)..(271): n is a, c, g, or t
  misc_feature (281)..(281): n is a, c, g, or t
  misc_feature (296)..(296): n is a, c, g, or t
  misc_feature (341)..(341): n is a, c, g, or t
cgcattgcgtcaactggaggtgcagccctgattgcggattacggtcacgatggcacaaagacagacaccttgagagggttttatggacaccagcttcacgatgtcttaatcgctccctggaacagcagaccctgacagcctgatgtggacttcagttaccctgcgcagaatggcacaaggaaaagtagcctctctggggtccagtggaacagcgaacatttttaaaaaacatgggcattgatgtccggctgaaggttctccttggataaangcaaggtgangccatcttgcggaanacaagcctactttgggaggggtatggatatggttaatggaatccnccagaaagattgg

SEQ ID NO: 659128 - DNA, 114 bp, Homo sapiens
tgaaaatttcttctcaaaggccttttgctcctgacactggggtaggtgtcgacatagtacttggaaaaaagtcgatctccatcattgtccagaatcaggcccggtacatgcaag

SEQ ID NO: 659129 - DNA, 214 bp, Homo sapiens
cgaaaagttattattagggttaacgtataagattatacatcatatttaagagtagctcagaattcattttctggcatagtgtacatgtagactttttaaaataaaactgttacattgttttttgaaatgtatcaagtggtatgtaaataccttaatgaattgataattaccacgcccaggtaattctttggatgttgtttttttttagattgat

SEQ ID NO: 659130 - DNA, 1071 bp, Homo sapiens
ggatcctctgtgacccagcgtgaccaacgccccgcagggggggctggcggaattcaatccccgttttcagagacaaatgcagcggaacagtactgtaagccaagctccctgggtcctcacagtccaggggttctccagccagtcagggaataaggagccgacgcgccaggccgtggtgttgcaggccaggaggctgctccggagaggaagaactggacaggaatagctgccgagctggtaacgcgaaggagcgggagctggagaacactgtagccaagttgcatgtgagacagaagcaactggacccctctgacctcgtggtgccctgtgtaaggccctgcctatcgtatcgaggatttctccacagagatccctgtcgcgactagccagcggatatgcaagatgctctactatctgtggatgtggcattcagtgactctgtgtctgaacctgcttgcctgcctggcctggtgctcgggcgaacagcctccaagggagtggacttagtgcctctccatcctgaggttatctgatctgcactccctgtgccttcctatggtcggtaccggatccatcgtataagggccttagggtccgagaactctgtacagcgtactaggggtccgacttggtatcgagaggcaaatcgggatctacgatcatccgagttgggatggcattccgtgggctggggggcaagcgcgctggcttggcgccgtgtgtaacagaggataattatttccgtggcatatcagcatcattgatggaggatggatggaactcaaccatttgtgcgagaaagtcagaattactacaggcacacggagggagcagacacaccaaaggcgacggggacaaaggggcacaacgttcacaatgcaaggcccacgcgaggaagttttcccacgggcaaccttacggtacgcaagagacattacagcaaacaggtggtacacatgcagagacacacgagaggaacacggaggaaaataagccgccccaccaagaagtacccagaccagaaacaatcggacgcagcagaagagcacaaccgagagagccacatcacgc

SEQ ID NO: 659131 - DNA, 179 bp, Homo sapiens
cacgagcatcctgtacacagaaaaaaacaaaactcctgatccctcctggtggcttggcaggttagggtttttccaaggcatagttgtggtgcaaccagggtgactcagggcaatcaggtgcttgcttgatgtggtttggggcatgcccatgctggggtggtcatcaacacaatggttct

SEQ ID NO: 659132 - DNA, 283 bp, Homo sapiens
ctcccgggctcaagcgattctcatgcctcagcctcccgagtagctgggattacaggcgcctgccaccacgcccagctaattttttggtattttttagtagagacggggtttcaccgtgttagccaggagggtctagatatgacctcgtgatccgaccgcctcggcctcccaaagggcggggattacatgcgtgagccaccgcacccggcgtttcctaggttattattgtagaacaaagattcttataatattagaataacgagtacggctacaaactaatgat

SEQ ID NO: 659133 - DNA, 132 bp, Homo sapiens
tacgccgggttaggagctggtctctcccaactcttaaccactttcttgacttggattgagaaaaaccgcacatttctctcattttttccttgtacatcagctcctcagtctccattattccttaaccccgag

SEQ ID NO: 659134 - DNA, 284 bp, Homo sapiens
  misc_feature (19)..(19): n is a, c, g, or t
tgtgcgtgtacttacatanttgctgcagcagcagagcggcagcagaatacttggcggagtaggcttgtctgtgcggggtggacagttgcagcaaagcagccccccgcaaggagcagcaggcggaggcgccagccgacgtagagcgaggcacccatctcccgcttctgcccggaggccaccagcgcattgtagaagttctgaatgatgtcgtgggccgaccaggacaccggcactattcacaatagggccggccaacaggaaacaccacccccgccaggatcatg

SEQ ID NO: 659135 - DNA, 998 bp, Homo sapiens
tttgcaggcacactcagtcacagcgctaagctcgcactgattttttacctgagcaggcctagaaataaacatgctagctttgtagttccaggttctaaccaaagaaaatagaacccatcgttccacagaagctgccatcaagtatttccatcacgcaagcaaccgcatccataatccttcataatagctatccgtcttcaagcaatatacgtctccgagacaagtgaagccataaccacatactacgcaatcaagtactcagtcattaagtaatcactaatggctatagcaagtaacaactaggaaatagcccccttatcacttcatgagatcccagaaggcttacccaaggcaaccccatcgtgacatcacggcactgcattcattctcaacagtgacaaaaatctagacccacgcagtctcaatcactataccaacatctcgtcccgtcacataacacgtaagccttcatacctcactctctcacgtcgttatccaatcagtagacacaggcagttgcaggtggataaaaccgaagacccagctacagcaaacatcttagcaataatcactcacattacccaacatcaggcatgcaataatagcaggatactacccgtacaacccatagccagtgaccacagtactactcaaacttgtcaactcattcgcatataaaataactaagcttactagccgacactgccgtactaactcaaagctgtaagactcccaagcaccaacgagccataactaggtagtatacgccaccatgaacaagcaaaggacttacacgaaatggccatcaaaaaaccaccgttaaaacttacccatttccaccgaaccttcccgtcataccattagggaagtgtcatatacacaccatggagtaaacaggagccattgtagaggcacaacaaactgggtacacaatacaaacacaaacaacaatatcccaaaaaaaaaacatagtcaaccccctaagcacacagcgcaaa

SEQ ID NO: 659136 - DNA, 1330 bp, Homo sapiens
cttctatcaatggaaaagaactgaataagagcatcaaccctgatagaacgctgttgcttataggtgcagactagtccaggacagccatacttgtactaggagacaagtactagagaatagttcaagatatatcgctagctactatggatagtacactacctactataaccctatgcgtaatacgacaactagctaggataggagtacatagactagtacctacatcaacgacgctaataccaccactaacctaccacaacagcacacagcacctctcacataccctacttcatcgacaaccgagaccatggctgctgctctacttcaggcttcaatagaagcgcagaaacgctaccactcgacaacaggaataacacaaacccatagactatgaacacaagacactgaaactacacacacagccataaacactaaccatgaaaacccaccgccacagctcgctacccatccacacatctccacacctcacctatattaaccactaacatagacccaacaacgtaactactacacacatggtccctactgccctgcacgcgaacacaaaaagctaaccggcggacccacgcagcaaccagcacgaataaacccacatcccacataccgtagaccacacccggacccgcacaccgaccaccaccaagcacacagcaccactcagccacaccgatcatcggccccacccgccacccctacaccaaacgactacacacacagcctcccaccccatcgcccacacacaccccaccgcaccctacgaacacgtgcactacaccacagccactctcccaccccccacctccctaccccacctaccaccaaaatcgaccaccaaacacctccaccacaccactcccccacacactacccaaccgccccccctctaccccccactaaaacacaccatccacacccccctacccccactccacccaaactactcaccaaaacaatcaaccccaccctccaaccctcctctccacctcctccccactcctcccccacaacaagacaccacacaacccacaaccacaactaccccatcctccccatctagaatacaacaatcacacaacacacacatatcaccaccaaactcagactaccacccctcccacacaaaaccaacaacatcaaccacaacaacacctccacaccccacacacccaatcccatcccaattcacctatcaccaccacaacaccaacaaaataatcaccactacaccactaatccaccaccacacacccccaccctccacacatccatccatcactacccaacataatactgcaagacaataaaacaa

SEQ ID NO: 659137 - DNA, 121 bp, Homo sapiens
ccacgcgtcgccttgaatatgtgtggttagtatacagagccattagtattgtatttgggccactatcttgtaattcaaaataaataacataattattctgtaaaacgaagaacagaaacaa

SEQ ID NO: 659138 - DNA, 1031 bp, Homo sapiens
tctggtcctctggtactcagagttggtcttcagctcgctataggtcccagcagccgcgatgctcgcggctagccgcactcctggtcctgctcaggagacatctgaacacacagtggactccagaacgcagtgaaacatggcatcaccatacaccatcttgagaagccaagtgaagcaaagaacacaaaacacatacgcatgcacaagagtagaagagagatggagaggcaccaccgagagacacaaccctaaacccagatgagaggcatcgcatacacagaaagggggaagaaacgagaaacatagacacacagcggaaagacccacggacatgagagaggacaaagccacacgacaatagagggctacacaacgacacccaaaggggacagacatgagagggacagacgagcgaagaatcaaacgcaccaagtgagcacagccaacaagcgttacaaacagatggacacaagcaacactagaacaccatggacaacccacatgcagagaacaccacccaacagagacgaacagtgagcaccacaaagggtacagagcaaaagacaaacaagcaacataccagaacaacacgcgagcacaataccccaaacgccacatcccaaacgaacaccacgtattaggggataaccatagcccacagagccacgaaacaacacaagcccacgcaacgaaaaacacacaaaggacatcaagagggacacaacactacagagaagcgattcaccagtaacagccaaacgagagaactgggataacaaatcagacaactagacagaaggacaacccacaagaggacagccacatggccacagccacaccagaggaaaaatcagagggacacgagcgacacacacacccaaaagagcacagacacgacacaagagggcaaaacaacagaggactaccaaaacaacaagtggcgaacaaccgaggacagcagagaaacacacagaaacgagcgtagatcggcaaaccacacccagaaacaaggccacacccaactaacactc

SEQ ID NO: 659139 - DNA, 172 bp, Homo sapiens
ttatggaacacagctatcccattcattccaatatgtctatggctgcttaacacgcacagcaaagctgaatagatatgacagaaactctatggccgataatactagctggaccattacagatatactcttcatcactgacctatcttctgagctctttatttacttatcaacc

SEQ ID NO: 659140 - DNA, 81 bp, Homo sapiens
aacctggagtgactatatggatggaatcgaaccccccaaagctggtttcaagccaaccccatggcctccatgactttatca

SEQ ID NO: 659141 - DNA, 550 bp, Homo sapiens
cctcagcataacgctgttggctcatctcaacctctccttccagctcccggtacccgggcctccaggtttctgggatctggctgcttcccacccttcagggccagcggctcagcctcatccagagggagcggcagatccttcagggtctggctccaggttcttcttcatccgctccaggggggcgcgggtgtccggctccttcttcagctcctcagccatcagggcggcatcagtgagggccttctgggccttttcttctggcatggcgggcttccgggagaaggtcctccatctctcctggcattggggaaatatctgtctccagcttcttctgggtgtggatcaggcgggggtcctggggtgtgcagtagctgaacacgctcactgggcatccaggagctccggttctggcgatttttctggctcctctctggtctgttccagaggggcccgcagttcctcgatctcagccggcagcaggttggctctgcgctccaccatagccagctgttccttcaggtcctcctggctccggagagcatcatccagg

SEQ ID NO: 659142 - DNA, 422 bp, Homo sapiens
  misc_feature (36)..(36): n is a, c, g, or t
  misc_feature (133)..(133): n is a, c, g, or t
  misc_feature (159)..(159): n is a, c, g, or t
  misc_feature (197)..(197): n is a, c, g, or t
  misc_feature (282)..(282): n is a, c, g, or t
  misc_feature (292)..(292): n is a, c, g, or t
  misc_feature (303)..(303): n is a, c, g, or t
  misc_feature (320)..(320): n is a, c, g, or t
  misc_feature (336)..(336): n is a, c, g, or t
  misc_feature (362)..(362): n is a, c, g, or t
  misc_feature (376)..(376): n is a, c, g, or t
cccgactcctagtccttcggccgccaccatgtccgnctggctgtcttcattctggacgttaagggcaagccattgatcagccgcaactacagggcgatgtggccatgagcaagattgagcattcatgcctttnctggtacagggaggaggaaggcgccnggcccgctgctgagccacggccaggtccattccttggntcaaacacagcacctctacttggtggccacacatcgagatgccatgctcctggtgtactccttccgtatagacatagaggttttngatattcagngtgaggggganatcgggcacttgtatgntcggttctgcggtcangcttggttcgagacacgcacagtctnaggtcatatagagnacagtggaggagtaggtgcacattacagtttcgggtcgggttagtt

SEQ ID NO: 659143 - DNA, 716 bp, Homo sapiens
  misc_feature (632)..(632): n is a, c, g, or t
  misc_feature (643)..(643): n is a, c, g, or t
cagacacacttgctgatgtagttctagcaccagctctagagcttgaaccggctccaaaatgattacagaattagagtcaatgccaggctcatactatggccagcaccagattcagaggaagtcaggtccagagccaactctagcactagctccaagctagagcctgtgctgcctccagagcctaaacaagagctctagctccaacaccaaagcaactccagagatagaggcagctctctcaactcggataccatctctagagctaaccccagctgcaacaagagctctagctccaacaccaatccagaaatcgctcaagcaccaccactcccagcaactccagggatagaggcagctctaacgccaactctggtgccatctctagagctatgacctgccccagcaccaattcaaggagacagccagtgagagttttcatttcggatacaggtccagaacctcctgtagtatcacctcctgacctagagccactccagcatccacctcacagctaaggctagtgccggctgcacgtcaaacccgactctgccatcacctccagagggagagccagtcgctggcccagaaccacagctagaatcagctctggcaccagctccagtcccagctcncaagatacagncagtgccagccccaggaccagaaccttatggcctcacctgtcaggcatctttttttctgcctggtacctttta

SEQ ID NO: 659144 - DNA, 786 bp, Homo sapiens
  misc_feature (1)..(1): n is a, c, g, or t
  misc_feature (551)..(551): n is a, c, g, or t
  misc_feature (556)..(556): n is a, c, g, or t
  misc_feature (558)..(558): n is a, c, g, or t
  misc_feature (561)..(561): n is a, c, g, or t
ncagacagggtactccttctggctctgatgatgaacgaagactgtctcactacctaaatacataactatatatgactattacaatctcacaaggcatgacacctctaggacccattctcatcctacatcctgctctttctggtgctgatataaaaaagaaaggaagaagaaaagtcacaagaagagggaaggaactggtggtgactgactagcacactgtctgaaatcagggggaacccgtatggctgactgcaatccgcacagaacgagcttgctgatgtcacagcctgaatttccacctgctgtctcatactaacgccaccagatttagcacatgcaacccacgaagaaccttggagatcaccggacatgattaaggactttctagacttctcctttctttccaccaatcacccgctaatcccagaatcctccccctaaaccttttctaatacaagtactgccttaagaccagcgaagagagacagatttgagctggattcccgtatcctcgtgggtcagctcactataaagctttccttttctcacancctangnagntcctcattgaacatgtgataatctaatacctgtgaaaactgactaatcagctgccaataatatctaatatttttcatcatgcacgaattaataatcatcatactctaaaatcttggctgccactcactacatgggtaagccttgttggccttcttcctatggcgcgggacccacattaacatcgcctattatttcgaaggaccagatatactagaagaagggggg

SEQ ID NO: 659145 - DNA, 799 bp, Homo sapiens
tgatctcatcaatctagcgggagagacagcgcataacctgtcctgacgcagtatagctgccactatgactccgctcggatgaattccactttcattataaattcagcgccaaaaaagatgttaagcttgggagtcagacaacggggcaggtgcggcggaagcgttgccgcctaacggtctgtggcgctagatcaggtggtgttgacctggtagcatgaggagaccgaattgctgtgtacgcaacagacctccacttcttctgattgagttactctacatatatgcattggacacatgacatgtagcattaaggtttatactaagtgactagattgaagagcacaatagaagagacctctacttagctcagcgattcttgaaccttggcttacctatttgttgaagatgtctttgtgaaaggtgtactgcaaggaacaaggatgttggtgattgtctccttttacccaaggtggcaccttaattactgtaccttcctcatggacaaagagtttgattctaaagggtgatttctcattgacatactatcaacaagaggtgagaaagctaaatgacctaaaactttgggagatagatcttggctctagtaagtatgtacggctatatcacttgcatagtctgggacgaagaaataagagactattcatcagtacatgcccatctactaccagatgtttttgcacacatgtcaaggggacttaccttattacttccattttatgactagtcggcttgatcctttttgatgaagaactaatcttcaacagaattaaggttacgc

SEQ ID NO: 659146 - DNA, 393 bp, Homo sapiens
aaaaaaaaggaaatcagtatactgaagagataactgcacgcctgtgtttattacaacactatttaaaatggccaagatttggaagcaacctcagtgtccatcaacagatgagttgataaagaacatgtggcacttatacaccatggagtactattcagccataaagagagaatgagatcctgtcatttgcaacatggatggaactggcaattattaggttaagtgaaataaggcaggcgcaaaaagacaagcttcacattttctcacatatttctgggacctaaacattttaacaattgaactcacggaggtagaaagtagaaggctggtttaccagaaactagagagagtagtgggttggggggtagggggatgagaatggaaaatgggtac

SEQ ID NO: 659147 - DNA, 1704 bp, Homo sapiens
ctgtctctcctgctctcgtgcttctgctgctctgtctctcctatccttcgtgtcctttcgcttcttcgtccttcttcgcgcgtggcttcagtgctctctcgcgttctgcgtgtgtttcctcttctcctgttcttgtgtcgccttgcgcgttgacggctcctcgtcggccgtcgcctactgcggtggccggcttgcgctgctgctgggtcgctcgcatgcttgtgttcttgtgtctctcttgtcgtggtgggggctcgcgttcgtctgttcgttctctcttctgctctctcgttctttctctttgtttgacttttgtcattctcttctttctccctctcttgttttcttgtcgcttttctctcttgttcctttgttctttcttgtctgtctttctgttgtgttgtttcgccctcttttgcgtctttcctgtttgctctgtgttcgtgatgctgcttgtcgctgcgctctgcgtcacgtgtactgctctcgctgttcgttgtgttgttgtgttgctctctgcttttcctgaccgtcactgctgccgtctgcgtcctggccgccgcgtgccggcgtgggtgaggtttccctataatatttaaacctcccgggaggtcctgcctcgtcttctttatagtggtgtggaaactccccgttcccaccggtctttccgccctccctgtgggatggatgccgcgccccacattctcctcaccaccccctggtgtttgttgttgagcccccctgccccccttaatggagtaggtgtgccccccccggcgggggccccccgagtctgcccccagtcgtcttccccggggagacgtttcttatgcgccctttaggggcccccgcccgcggggtagccgcggaaggtgatacccgcaacgtttggttcacgaccacccccactgagggtatatccacgtgcctctatgttggagcccccaccgcttataggcgccccatagacttttttttcggggtgggaacccccactctatttagggagaaccccaccatttttgtgtagacacaccccagagatatagcgcacgcgggctcggggtgtaagaccccgcgttttccccgccgagatttttcccccgcgcgaatttattttcgcttccggataccccacccgggcgcttccgcgcgacccacgcattgtgtctcgtgcccctctggtgcaacccccgcgggacacacagaaaaatactccacgtgtctttgttttcaccccgctctcacttttcacagaattgaaataggggagactctcacgggacacacagggctctctcgtggagacttgacacacggggagcccaccactccacacttttcaccacacttgagagagaagtttaaccggccccgggcgctggtggaactcacacgcttctgtaaattcccacgccacctcttgtggaagggcccaaggcccacgaggctctgagggcttgagggcctatgagcgcttataagagccacgccctcgggcacaacaccacgcccagagcccactcttctacccaaggaaattttaaaactatgccacggcgctggtggtgcgcccccgtaagtcccacgctaacttgggaaggctgaagccctcgaaggttcaaggctacccgtgaggctatgagtcaccaccccttgcaccttcagcctgggcgaccccgcgagaccccgtctccagaaaga

SEQ ID NO: 659148 - DNA, 1087 bp, Homo sapiens
gtgggccttttcatcatacatgcgcatgagtggaaatcgttagcccccatggatgccatgctggtaccttgttggcatctcatgtgggctaacgattccactcatgggtgcccaaggtaccagcatggtagcgtcattggaaattctctatgtggtggcggacagagtaattatgataaaagaaacacacgtgacagttgatgcagttctctccacattgcatcctcgatacgataaatgaggatgacaagatggcaatctaaaaacactgacgaagaagacaacttcttcgcgacactaagctgaaccttcaaaggcctatctgcacatgccagattgcgatggcgtcggaacatcgaccagacagcgctgcaactgcccagcagggtgaaaatgtaaaccactaccaatgaagaagatgaaaatggacaccatatgataggacacaaacacgaagttgagtaacaaccatctaattgagtcgcaatgcatggccaaaacttgtgttatggaaagaagagaatagattttaatcgaaaagaatgacgcaaaatatgggagcatagcggtagatataacaataagcagacagagccaacagttagccacgacaccacgactcaccaagtaacaagagacaacaagagatgacggcaaacaatcaagaagatcagaaacgtcgaggaaatacacatgacacacatcccaagagaatatggcaaaaaaagacaattggagatgacaaacgactacaaagagaaaaagataagcatgccagaccgactacagacaaacaaaacaaataagcgaagagatggacaacacaggcaaaacagcacgaacaatggtatgaatggaacatctatacccgagcgccacccaaacacacacatcagcacaacagaatacgcagacaactattgacatacagcaagagcaaagagtgcaatacaaatcaccacaagaaaaaaaagtagaacagaaaaccaccacccaacaaccgacaacaaaaacaacaaaacgaacacagagacacacaaaccaaactgaagccaacaacatcctccacagccagaccaacgccctt

SEQ ID NO: 659149 - DNA, 322 bp, Homo sapiens
ccgtatcggagtgcaatggctaagacgagcagatgtgttgaggtcaggagttcaagaccagtctgggtaacatggcgaaaccccgtctctacaaaacataaaaaaaaatcggccggagtgcaatggctcacgcctgtaatcccagcactttggggaggccgaggcgggcaaatcacaaggtcaggatttcaagacgagcctggccaacatggtgaaacgccgtctctactaaaaatacaaaaagttagctgggcgtggtggcgggcgcctataatcccagctactcgggatgctgaggcagaagaatcgcttgaacctggaa

SEQ ID NO: 659150 - DNA, 110 bp, Homo sapiens
tctgtgcccatagtctcagtgcactcaacggcgtcttaaaaccacaactacgtttgccttaaaactatgccctgggctgggcacggtggctcacgcttgtaatccgagca

SEQ ID NO: 659151 - DNA, 309 bp, Homo sapiens
ggtgactctacaggatctgcgagttagcggggtttttagcaatggcggtccggcgtgggctcttgaccgtttgaacctgtgtgcccggagaagaactcgagtcagcggctatcgtcaggcttttgagttgccatggaactgtgggcaagaccttaggagagacgagcagcctttcaggggaagcgtggagacaggtgatggcgccgtgtttggccttgtagttcccgtcccacagcggggcgagtgagtctcgggatcacgtggggaaaacacgttggcccttgtggaaacccgggcttgtgtggaccc

SEQ ID NO: 659152 - DNA, 549 bp, Homo sapiens
ttagtcatggagggacagcagtcagacccctcccccatgtcttatccgtagacttgaccacatcgtgatgacggtgaagagcatcaaagacaccaccatgttttattccaagatcctgggcatggaggtcatgacttttaaggtaagcacttccccaaatgccaaaattcaggtgggctaaaatttgttgataacactttaacatataacttaactctaaaaaaaaaaccacaggaaatctgagagaaaatataaagagatcaatagaggagattccaaactgaatatttggacttccagagagagaatggagaaaaaagagaggaggaaattatcatagaaacaatgcaagataactttgcagtctctacatggaaaaggttaaccaagtatccagcatgttgacacttaacatggatccttctaaaattatagaacatcaaactgaaaaagtagatcctaagagctttcatagagattaaaaagtagattatctacaaaggaaaaaaaaacaaatatcagattttccaagagaccaaagaccaaaaa

SEQ ID NO: 659153 - DNA, 1479 bp, Homo sapiens
cgaggatttttaccactgggggggcagaacaaagagatagagaggttatggtcaccccacccaacgaaaagaaatgaagaacaaagatacgcctagtatgaggagcggcgatgatgtgaattaaaacaaccgcctgcttgttctagaccgtgggatggaaccactccctcaaccaaggagagttgtgtgggatgacaacacctcttttttgatgagcgacaagacgaagcactcctaaggggtgcccaccaacaattattaattgtgttcgctgcgacgacacaccaattcttttgggctggttggtggatgggagcgcgacacaccctgtctgttgtggaggaggatagaggctgaccacacccgcgcagatagttgattacatcgtgggggggggggcgaaaaacaaaagatgtatggcgacagacacggtgtggttgggcaccctccataggagaccgcctctctcgtggtttaggaaatggatttcttctctcccgcagatgaaggataactattattatgattgtgccctccgcgcggcagtttactcttaccgcggcgggggttgtttctttaaagagagagagcaaccattcccgtcgttgaggagggagccgacatcaacagtattatttgttacatcacacagcgcttctgcgcacgggggaggtggttactcgcacacaccactcatcttgagtggaggcactacacacagtgtttctctcccttctgagagagtactgttgctaaaacattgattagtatggatgagctcggcttccccccctataacaagtagtgttctcactctgctctcgttgaggtgagtgaaggccactcactccaacaacaaggaggggtgctcttgggatgagacacctctcccaccgcgcgtgagcataacttctttgggtaaaccccccgactcttatatcacacacgcgtgtctctctctctctaaatatataaagggggcgaactagagggccctcataggtgtatttgttctctcaagcacggcggcgggagaggggggggagagagaatttacgtgcgagatataagaggggagtttcccccccccagcacagttgagaaagagtcggtatgacgaagcgcagtggtgggcctcatttcaatgatgcgtgtggtgccgcgagagaaggttctcaccaacgcactcctcctccacagacaggcctgggttaggccgacacaatccgcttttcaacggagaaccatccttttatgacgccacaaggagacgacactcactcccgaggaccaccctcggtaagaagagagggaagcacacaacacgggttttggcccctagcagcagccacataaaatagtgagagggagaaaaacgggggcccccataaaaactccgcgcccccccccccccccccccccggtggggccaagggggggtgttgttgtttccacacagaaacccctttttttttttta

SEQ ID NO: 659154 - DNA, 157 bp, Homo sapiens
catagtgtcccagtgtgcgctcaccttgcgtcatcatagtgtcccaatgtgcgctcacccggcctcatcatagtgtcccagtgtgcgctcacctagcctcatcatagtgtcccagtgtgcgctcacctggcctcattccgaatggtgtgctgataca

SEQ ID NO: 659155 - DNA, 184 bp, Homo sapiens
  misc_feature (135)..(135): n is a, c, g, or t
atcggtcggcttctggcagtcaatacatgtgtggtttttgaatcagaatttctctataaagttttttaatgattccaagaaaaattgatgaataaaatatccttcacacatatctaattaagtcagttttacttnataaactatgatgcaattatatgatgtacgacgatgaccgatcatggtc

SEQ ID NO: 659156 - DNA, 557 bp, Homo sapiens
  misc_feature (1)..(1): n is a, c, g, or t
naaaataacaacacatattcacgttttttttttattgaacaaaggactctttttctttggggggccaagttttttgttattaatgaagcccctaaccccctgggccaaagggatcctcccacctaacccttatgagaagttggtaccctaggaatgccccacctggggctttaaaaaaaaattttatttttatttttttggaaaaaacagggtctctttttgttgcccaggctgagcgggaatttttgggctaaagtgatccaaagtgaaactttggcctccaaaagtgctgatgtcaaaggtatgggccactatgcctgggcttttttcttaaaaagggactcctttaataaaaacacctgaaacaaattctgaaagcatttggttttagggggataggggaatgtgaaggtttaagggggaataagcaaaaacattataaccaaattggacccgggaattttagtttaaaagaaatggtgattccaggccccaaattttggttggttaaagcccttgtttttttatttgtagaaggggaataatgaatttacaag

SEQ ID NO: 659157 - DNA, 239 bp, Homo sapiens
attagtcagtgtaagtggcatcaatagccttcagatacaccacaccacaatccatcgacagtcgatcaaacccaacagcagtccatcctggcacaatccatgagtaagggcaaaactcccttcaacatacagtaagatcctacttagctctggcgggcgggggttggggaattacaccttcatttctgatcacaaaaggtgcgtgatcagcacatttagttcaagagactcagttagca

SEQ ID NO: 659158 - DNA, 483 bp, Homo sapiens
  misc_feature (456)..(456): n is a, c, g, or t
acccgaccatgcctgcaccagcacggccactcgaggcccttcgagaatatgtttaagaaggagccggccttgactgcaggggcgaagatcagcaaggaaaaggaagccctctccagaaccagaaggtgaagtcgggccccctaagatcaacggagaggcccagccgtggctgtccgcatccacagaggggctcaagatccccatgactcctacatcctcttttgtgtctccgccaccacccactgcctcacctcattccaaccggaccacaccgcctgaagcggcccagaatggccagtcccccatggcagccctgatcttagtagcagacaatgcagggggcagtcatgcctcaaaagatgccaaccaggttcactccactaccaggaggaatagcaacagtccgccctctccgtcctctatgaaccaaagaaggctgggccccagagaggtggngggccagggagcaggcaacacaggagg

SEQ ID NO: 659159 - DNA, 341 bp, Homo sapiens
gagcttttgcgacccggtacttgcctgctgccaggtgctgaattggatacaggatattgatacatctgagtgtgctgcacgtgctggtcccatgtgtcctctgaggtatgtaggagatatactgggggctgtatagcccactctggactggtgtcagcaccgggatggagtgagttgaatgagtccggggccccggcagaagtaggagtactgtatggatttattcacacgacagcagaggctttgtaggattgaagtccttagcataagggttcaccgttgatatctttacttgttcaggaacagggccctcatctttgtcttctcccttgatgaggccc

SEQ ID NO: 659160 - DNA, 211 bp, Homo sapiens
gtagcgtctgggctgtcagtcgctctgggctgtcagtcgctctggcctgtcagtcgctcgtgggttgggagtaaatccaaacggaatttggctttcctacatgccttaaagtgcattcctatggaattccggctcgaagcatggtgaggcattttaattattcccagtcacacacttccaccctcaggtggtgggcttaggatttccttcc

SEQ ID NO: 659161 - DNA, 626 bp, Homo sapiens
cgacgaagcctgagcgcaagagccaagccgcgccgcgcttggatgtggtgccacgctgctgctgcatctgagcgctaggccctggttcctgggagtcctcgtctgcggtgccgtcgaactgtgcgtgatagctccttagcagaagtttcattatcaagtcatggcatgtctaagcaccgtaatcaactacagtactgcgaggagtacgcaccatacggctgcagtacagtttggccggcatgctgggattggagacgataaaggtctccacaagaatgggaagcatgcatttacgtagtggcactgagaccaattttcatgacatgagctttgctgaaagtaaaacacaagtatctctgtgtcagagcctcagaattgctcagtcccaccaaaaagtaagctaccttcgaggtactggtccctacccagccttccgtggcacttgtgcggtaatagaataggaaattttgtctcacctgtgaatagatcagggtgcctgcggcagttgctggactttctccaccactgtgggccctggagtctgcgatcgccatcgcaaccggaacagatgctgtccttggcggaacagcagcttggtggacttgcgcccaggatttcaataatca

SEQ ID NO: 659162 - DNA, 81 bp, Homo sapiens
acatctgtgtacttctgtgccagcaagcttgaggttagggagacccagtacttcgggccaggcacgcggctcctggtgctc

SEQ ID NO: 659163 - DNA, 253 bp, Homo sapiens
agatagaatcgagctggtaccctatgtctcgatcgttaatagcagcaggcgcggtggatcacgcctgtaatcccggcactttgggaggcaatgtgggcagataacctgaggtcaggagttcgagaccagcgtgaccaacatggagaaactccgtctctactaaaaatacaaaatcagctgggtgtagtggcgcatgcctgtaatcccagctactcaggaggctcaggcaagagaatcacttgaaccctggaag

SEQ ID NO: 659164 - DNA, 352 bp, Homo sapiens
ggcggtggcagcggcagcagagaaggtgaattagttagccactcgatctctaaattgatccatcacacaactgcctcgaaatggattgacggcagctagccgactattatttctactttcataccttgtgttttcaagtgccattgtctgctcgctctcagggtctaaccccttcgcctcccatctctatagccccagctccctcacaggccacccacacccacacacaagagctcagttcccctccatctgcctacacctccttctcctcaaccaatgagatgcaactaatttgtcttacctcacctgatcttcgggaaacaaacggcaatacacgccacttcccggatga

SEQ ID NO: 659165 - DNA, 599 bp, Homo sapiens
ggaagggcatcaactgccatatcaacgtcaacgactgtcgctggtgcagtgtcagcatgtggggcacctgcaaggacctggtgaactgggtaccagatgtgtgttgcccacgtgtggcttctgtgaggcctggcattgctgagctgtgaactgatgactgagtgtgccagcagcccctgccacatgctggctggcctctgctgaggacctggccgactggcttccactgccactgcccccagtggcttctccgtggcctctctgtgaggtggatgtctgacctttgtgagccaatgcccctgccggaacggcgctcgctgctataacctggagggtgactattactgcgcctgcctgatgactttggtggcaagaacttgctccgtgccccgcgagccgtgccctggctggggcctgcagagtgatctgatggctgcgggtcatgacgcggtggcctggtgatgcctggcacagcagcctcctggcgtgtgtggcccccatggacgctgcgtcatgccagccaggtggcaacttttcctgcatctgtgacagtggctttactggcacctactgcatgagaacattgacgacttgcctgg

SEQ ID NO: 659166 - DNA, 703 bp, Homo sapiens
tatcacagcggaatttatggttttaaaaaagactacaaaaaggtagaaaacagctcggcacacttagagactaccacacgtgtgtgtggcaccacttttcaccaccgggagaagggagccccggtgggcacggggactgggcagggccgccccaaaagctatagcacgcggagcacacaaaatagtgatttttatacaaataggctcagatttccccattttatttccctttttctctgtgcccattaaacattttattctctcacaggctgaaaacacgtgagaaaacgggaaagaaagagaaaggacataggaaggacgggaaacaaaaaaccagagaaaagtagaaccaaaagacagacgacaatcgaaagcagcgagaacaaaagagatcacacacacgcaaaacagggaagataagaaggacacacaaagagaacagagcagaaaagcacaagacatgccaagcaaaaagaagggaaagaaacacacggggaaaacgaagagaaaaaaaacaaaagaaagagagaagccagagcagggacaacataacacggaaaaaaagagaagacaaaaaaaaagagaaaacgaaagaaagaaaaaagaaaaagagaaatagacagaacgagaagaaaaaggagagaagaaaaagagaaaggaacaaggaggactacggaacaagaaaagaagaaaacacaaaaca

SEQ ID NO: 659167 - DNA, 225 bp, Homo sapiens
tcagtgctcacttttgagtcagcattttaatcctgttgtgcatactctcataatttttcctttaccttttgcttctttcttcttgaggcagagtcttgctctgttgcccaggctggagtgcagtggcatgatctcggctcactgcaacctctgccttactgaggcaggagcatcacttgaacctgggagagtgaggttgcagtcagtcgcatcgccccactacag

SEQ ID NO: 659168 - DNA, 999 bp, Homo sapiens
gggaacatggggctgtatgctgcagctgcagtgcgtgttggacggcgtggagagccgccagggctctatcaaggggttggttgtactccagcaacttccagaacgtgaagcagctgtacgcgctggtgtgcgaaacgcagcgctactccgccgtgctggatgctgtgatcgccagcgccggcctcctccgtgcgtgagaagaagctgcgtgcctgcacctggccaaggtgctcagttgtatgagttgtttgtttggggaaagggctttctgagtgggtgtggggggccgatggaaagggctctgtttgggcctggcacctagtgcggatgctcaaggctgagttggactctggctcaatggttcatcgggggtgtgagcctgggaatgagtgacctgttgggaagttgggctccagtgcctggtccagcctcccagctgcctcgatttgtgcgtgtgaaccaactctcaagacctgctccgatgatgtcgttgatttatttcacggagaaaaggtttctcctatcactggtcgggcttccagcctcgatgacttaacgagccctcaaggggaacgcacattttctcctggacccccttgatgccggagctgctggtgttcccgcccaagaatgatctgaatgaacacccactgtaccgggcggacacctcatttcttggagggagcagtgcaggctgtctcccagcatgtggtggagcccccgcaaggtcccatgtcatcatgctgttgctgcccaggattaagaacagcagttgggttggtctctgaagaccacagactgtgctttgactgagcaagcggggctccatggcagtgtggcggcggttctgtggacggccagaggacgggggccactgtcggtacgggcaaagatgggcacagagctgatccgaaagtggacggggaccacgcgtatggtagagagactagctctcgggtccactggaggtgggcgtacgctttgtgcgttggtagggcg

SEQ ID NO: 659169 - DNA, 199 bp, Homo sapiens
ctgactcatagaggatcccctcgaatcgacggtttctctagtgtatccggttgaaaggactgagttcgagaggtgcaacagagcaggatggcagaatagaaagctgcacccatcatacccttaacagaacaccttttttttttactttttttttttaaaaaaaaaagtttcgctttgaccccggggtggggttccagta

SEQ ID NO: 659170 - DNA, 484 bp, Homo sapiens
ccagagatcaggcgcggacggatcgcccacggcacaccaggcgagcaaagatcaagactctgtataaacaagaaaaaaaaaattaaaaaaatataaatatagattaacaaagtaacagggaatataatattctcaggtgggtcatatcagcaggaacatcactcatatggtgttcatcagctcaataaaatcatcaaacacaaaacaaattattcaacggtttgaacaatggtagtcagatatccgcttaggggtcaggtcctgattgggatgaatttgcatcacattcgactaaatatggtgcttctaaatcctcactttcacacaaacaaacatcaatggggcaactgtccatatccatttccaaaaaaactatcctcttcaaaactagatggatagtagacatccataggctggatgttgtttatccatattcggctatatatcaagcagctgctttggtatatatccggtttcagtgcag

SEQ ID NO: 659171 - DNA, 845 bp, Homo sapiens
ggcggggccaccgccagcggcgtactgactcaactgcgtcgggcacctcatggagagaatggtacattctaagctccaatgagtaataagcacctcggcgtaggcggactccttaccgcgtggcccgctgtccatcgtgggtgcttgcttccttttgcgaccaccatggtactttatgtagagatactgcggatataactggactgatgcctacgggacatctgctgggggtcatgtcctctgcagcaactcgtaggggatgaccattgggaccaccagacagcacctctcagcgaagcacgagattcatggagatgcgctggactgcctggagatacaatgtggttcaacaacgggatcacgcatgccctcataaagcccccaggttcgtacacatcatagtcccctactcaagcgcctagaaacagcagacaagactggagacaataactgttgctagctgtcgtgccccatccgctgagccatgcgctgagccattcccgctgtgcttcagggaggcaggtgcacaggtgcaccactggggaattactagcccccacctggggggatgttacaacagccatatcgggttattgttaggcggactgtaagtggtaggggggatgtgtgtgtgcacgtgtgtgtgtgtgtgtgtgtgtgctgtgtgtgtgttctgtgacctcctgtccccatggtacgtcccacctgtccccagatcccctattccctccacaataacagatacactccaggactctggggagaggttgaggacaaatacctgctgtcagtccagatactctttttagcataatgagttgggcgtgttgtgtgtgtgggggggg

SEQ ID NO: 659172 - DNA, 1061 bp, Homo sapiens
ggcggctggctggggacagagcaccggccatgagcgcggagccggcaccggatggtggcgcgggggccagccgctgcgggcactgctcgccctgcactgtagcaagatgccttaaataaagtgtggagcctgaagcagaagttttgggagatgctttgccttcctttagaccacattccatcgcctttctcaagatttgctcgctgtgaccacaacgatgtagtgaagtttcctgcaagaaacgggacgattatttggaatggccagacgtattttatggctgtggccttcttatcagcacacgagaagcaaagatccaaattcccaggtcggtgcctgcatcgtgaacttcatgaaaacaagattgtcgcggcattcgggtaccaatgaggactgcctaaagtgggatgcaggtgcatgaacgtagttgaccttggcagaatggacacgcagacgaataagctggacaccagatacccgtacgtgtgccatgcggacgctgaatgccatcatgaacaaaaattcgaacgatgtgaaaggctgtagtatgtatgtcgccttgtacccttgtaatgaatgcgctaagctcatcatccaggcaggtatacaagaagtgattcccatgtctgataattaccttgatagtgacgaggcaactgctgccaggctcctgtataatatggccggggatgacattccgggaaaatacaatacccgaagtgcagcacagcattgtccattgacctttgatcacttacagcagaccgagtacaagagcttcggagttcatcatattcagtctccagaagatcgggatcatggctcataaaacgttgatcatgcccttaatctctgaacgtcaccaatactcctgataacaccaacttcaaaactattgcactcaaaaactttatcaaacaacatcctcaacagcccctagaaaaagagaccacccatttttatcctataaccaccgctataacacatagattaaaccacaccaacaatcaaagactcacaatacaaccaacacaaccaacactcatgaacatctaacaacc

SEQ ID NO: 659173 - DNA, 678 bp, Homo sapiens
ggttatgtagaaggtacaccagatcgcgcttgctctcaggccgagatcgtaatcctcctctgtggcctgtgaaccaccatgtgcacctctatcctgtggtctgtctcctatgatggagctggaaggtcagctttgacatcaatgcttcctggaaaccaaatggctgccagcatcatggccacggcacacactcaatgaggtacactctggcaccatgcctgttttgtggcctgtgaaactggctgatccatttgctatgatgatccagatgaacgaagccattccacagaaagttcaatgagattgtggctcccggcagcgtgcagtgcctggcggtgctcagggacaggctctgtgtgggctactcttctgggttctgcctgctgagcatccagggggacgggcagcctctaaagctggtaaatcccaatgacccctcgcttgcgttcctctcacaacagtcttttgatgccctttgtgcttgtggagctcgaaagcgaggagtacctgctttgcgttcagccacatgggactgtacgtggaccccgcaatgccggagggcacgcgcgcaggagctcatgtggcctgcggctcctgtcgcctgtagtatgtatatgtttactgtggcatatccctgttgctgatttaccacacgaagacaggagttgatgggatctc

SEQ ID NO: 659174 - DNA, 426 bp, Homo sapiens
  misc_feature (67)..(67): n is a, c, g, or t
  misc_feature (83)..(83): n is a, c, g, or t
  misc_feature (125)..(125): n is a, c, g, or t
aaacctatgcccttcaactccctttgtccccctgcccttccctcccttccctgtaccccccagctanagccccgttgggaaanaatgtgtccgttagtcacaaagcattgcagatgtgtcctaanaaatgcccacgctggggcccgggccgtggtgctcacacctgtaatccccagcacttcgagaggctgaggcaggcggattgcctgagctcaggatttcaagaccaccctgggtaacatggtgaaaccctgtctctactaaaaatacaaaaaaattagctgggtgtggtggtacacgcctatagtcccagctacatgggaggctgagcaggagaattgcttgaacctgggaggcagaggttgcagtgagccgagatcacaccactgcactctagcctgggtgactgagcaagactctgtctcc

SEQ ID NO: 659175 - DNA, 167 bp, Homo sapiens
agcaggctgaagcgcaaaagaagaaagtggaggcagaggtccaagttaaaccgctagtcttgttgcaccggtggaggccacaggtgcacacagcatgtaatgccaaaggctgcggggatcgcaggtacagggaccacgaaggatgcgagagatggcggagtcaccga

SEQ ID NO: 659176 - DNA, 414 bp, Homo sapiens
cttcagtgtgctttaatacagatacatgaatgttcacagaagatcgcagctgctgtcactcctgtcgatggaacctctgtagtacaccatatacgagtaggtggcttctcacaccattctgttgcagctgaactagtgcctgcaatgcttctaacgtaggctgaggtaattttgctaatatcatccacagcctactggaggattggtagccgtagctgtgacaagaactggatgcggacagcgtgaagaactcggaacctacataggacgcgaatacgaacccatactagatcattatgcgacctgacacaaacggctagctgcagtttgtgagccagaccctgtcaggtctgggaagaagtctgctagattcaaacctctcagacacacctcctgttgcttcgatggagtctt

SEQ ID NO: 659177 - DNA, 402 bp, Homo sapiens
  misc_feature (20)..(20): n is a, c, g, or t
  misc_feature (30)..(30): n is a, c, g, or t
  misc_feature (69)..(69): n is a, c, g, or t
  misc_feature (78)..(78): n is a, c, g, or t
  misc_feature (127)..(127): n is a, c, g, or t
  misc_feature (172)..(172): n is a, c, g, or t
  misc_feature (300)..(300): n is a, c, g, or t
  misc_feature (324)..(324): n is a, c, g, or t
  misc_feature (356)..(356): n is a, c, g, or t
  misc_feature (364)..(365): n is a, c, g, or t
  misc_feature (397)..(397): n is a, c, g, or t
ccgccgactggtttggagtnagcaaggacngtgacagcacccagaaatggcagcgcaagagcatccgtnactgcagcnagcgctacgggaagctgaagccccaggtctccgggagctggacctgccnagccaggacaacgtgtcgctgaccagcaccgagacgcccattccnactctacgtggggccatgccagctgggcatgcagaagatcatagaccccgctgcccgtggccgtgccttccgtgtggcagatgacactgcggaaggcctgagtgccccacacactccgtcacgccggntgctgcctccctctgctccttctnccagtcccgctcaggtttccaaccggctgccncggcggannaacacgagagtcggtggaccaagatgagcttnccggg

SEQ ID NO: 659178 - DNA, 610 bp, Homo sapiens
gtagtgttggtctgtctctgcgatggtctcagggaggtcaaatatactcaggtcacaccaagcatcagggtccggaaccgatcaagtccagggcttcatagaggctaagaaaccacagcggggatgaggaggttaactgcctccaccacccacttgtaaggcttttctcgtttctggtggggagccttcctggtcctcacgcttcggggaattcctccaagggctctggtgttcgcactgcgtccagatctgtaccgatgggctcctgttccttcgatgtggtggctgctgcaagttcctcctcactgttttcctcctcctttatggtaggagggacggagggccagttggtcagaagacttccctggccttccttgagctgggcactctggaagccgtcctttttctcgagctcccagcggcaagtacactgggggctttcagtctttgtactccctcaagaacctcctgtttccaccttccttttgatgttcgagtccagtgatcttcacagcattgctttcttccccttcattcctgcgccgtggttcctagtctaaacggcccacgcttgactccctttgtccttatgagttattccccttgttca

SEQ ID NO: 659179 - DNA, 310 bp, Homo sapiens
gggaatgagtcaatcttttcaaacataaaaacacagactccaagatagtgcaatgaagctggtacatgctgagagattgggagaagcttttgattctcagctgtgttatttgagtaagagaattccatgttaaccttgttctaatcctgaggataaacttcacatttatagggacaattttgagagaggcatactctggagttcaacagagagagttttatagagcacacgcaccctcgtatatacaccacacatgtgtacagagttatatgtgatatgcagagctatattatgaagaggaggagagcga

SEQ ID NO: 659180 - DNA, 364 bp, Homo sapiens
  misc_feature (4)..(5): n is a, c, g, or t
tcgnntttgagctgtttttccaacttgctaagaaggtcaaagctgacaatgttgatcaggccagctgtcaggcggtccttcccagtcaccacgacgttgaaccactctgagctcaaagatggcatccacccaaggaagctctagtgcaagccgaagcgcacgttggaggagaccaactccagcagcggtcactcctctcagtacaagactgcgatacctatcagaaggatgagctcccccaggaccatgatcgcagccagcagcagactgcctactatgcctatctcaaaactgacttcaggactctgcacagccagcagaatgatcacgagcccgggacccacttcagaaagatgtgcctctg

SEQ ID NO: 659181 - DNA, 735 bp, Homo sapiens
ggccaaaaatctatttttcttggggagatttccacgaaaataaatttggtttatagttcaaaaggtgcgatacacaaatgggattatttgggggagacctttttgtggttcaaaacagaggggtaccccagagagaaagtaatagaggatgttcaccacctcgaccgatgttttctaggcttcttcttgtctcaatagaacatgtcagagacgcttggccccacctggagtgggtccaatgcatatagacatgggagggcgcccccacgttgatagaggacacacatactcggcgtctattttggtgacacacaagagtgggtccaatggcaaccactctcatctggcgtgaacgacttcacacagacacactggttctatccctgataaccaggccacacagggtgaatagcccaatcctctccgcattttggtgttctcgcagaagctcctttcctgttccccccaaaataagaatagctggttccaaagatttgacaatgtcgcaccagagaactagtgtgatcgaaccaggggattcccctgcgtgcgaactataataatagcggtgcgttctacactttgagatgtgttccaaacggagaatatgacatttaagactcatttctccaggagacaatattccatacgcccattgaaataatagtgtggcttgttttccccgacatcaccagaaccacgtgattagctcccagttcaagacaatatccaaca

SEQ ID NO: 659182 - DNA, 673 bp, Homo sapiens
cacctgtaatctcgacactttgggaggccaaggcgggcggatcacttgtggtctcaaactactgagctcaggcaatccacccaccttggcctcccaaagtgctaggattacaggcatgaggcagtgaagccggacctatctttgcaatatatacaaataaaaagctgatttaaagaagatgttagacacaaatataagagataaatccaacagatccaccatttcacggttactaacaactacagtacactaatctctgatactatctgacagagctggaggatgcgaaagaccaagaccacgtggacgtacttgaccacccgtgatcatgctgcgcgttacatatagaaacaataatgatccctctacacaactggacgcaaacactcaacggacatcaaatcaaacggccgagcaaaactcgccaaagtatccactgaacggttagaagcaacacacactacacggacggggaacttccgaacaacgagggagcgctctggaacagccacaaaggatacaggccacacaagacagcttaaaagtagcaccatcgagcgccccgtcacagagcgcgtaggacagccatcaccgatggcggcgcacaagaaagtaaaaacagggacatgacacccacgcgagcagtaatagagagctgcgaggccatggcacg

SEQ ID NO: 659183 - DNA, 348 bp, Homo sapiens
  misc_feature (48)..(48): n is a, c, g, or t
  misc_feature (52)..(53): n is a, c, g, or t
  misc_feature (261)..(261): n is a, c, g, or t
  misc_feature (311)..(311): n is a, c, g, or t
  misc_feature (338)..(338): n is a, c, g, or t
tcgagacagagtctttctctgtgcccaggctggagtgcagtagcagantcannagtgattctcctgcctcagcctccggagtagctaggattacaggcatgtgccaccccacctggctattttttgtattcttagtagagacggggtttcaccatgtgaccaggctgatctcgaactcttgacctcgtgatctgcccaccttggcctctcaaagtgctgagattacaggcatgagccaccgcacccagcctcccaggcgtnagttttttgttcgtttgctttttattttttttagatggagtccctctgtnacccaggctggagtgcaacagcacgantttcagctca

SEQ ID NO: 659184 - DNA, 456 bp, Homo sapiens
  misc_feature (26)..(26): n is a, c, g, or t
  misc_feature (148)..(148): n is a, c, g, or t
  misc_feature (207)..(207): n is a, c, g, or t
  misc_feature (212)..(212): n is a, c, g, or t
  misc_feature (321)..(321): n is a, c, g, or t
  misc_feature (323)..(323): n is a, c, g, or t
  misc_feature (337)..(337): n is a, c, g, or t
  misc_feature (353)..(353): n is a, c, g, or t
  misc_feature (380)..(380): n is a, c, g, or t
  misc_feature (416)..(416): n is a, c, g, or t
  misc_feature (445)..(445): n is a, c, g, or t
aggacactttcatccaaaatgagctnacattgcttcacaagttgatttgggggcccaccaacccccacaaagtggcatcatatgaatgtacaaagaattctgagacaaagatttttattgaatttctggagattaactcacatacatntacacaaatagaatcacacacaccacatatgtcatttttcttttgtttccaaatttatnttatncatttgtaaatactgaaatgttaaatgaacaatgaacatccatatgcccaacatctaaattcaataactgttaacttttgccacatttgcttaatgtagctataaatgngntttgtatttttcanataaactatgtgaaantcaatgaagacatcaagaatgcttcangatgtatcttctaaagtgaggacatggtcatttacnggccatactatttccattatcaatatgtnaggagttaccc

SEQ ID NO: 659185 - DNA, 141 bp, Homo sapiens
cacgaggggcatctaggagctgtcccaccactgcgactcgctgatcacgatcccgaccgagaagctgatcaccgtgctcggccgcacgccaccatgatccagggttccgcgccgccaagactgtgctcgggcggtgcaggc

SEQ ID NO: 659186 - DNA, 232 bp, Homo sapiens
gctgacatgcctgcatagctgactcttagagtatccgcagttgtgctgtttgcagctgcagggtgtcattagctcgcacacgtagccatgtcagacctaagtaggacaattggattatacaaattgctgtcgatatgtctttattttctagaacttttttttattatcaaagacttccgtgatagccattccgaaggtttctatcaattgacccacgccccatccccgaaat

SEQ ID NO: 659187 - DNA, 202 bp, Homo sapiens
cgtgggtcactagcttcaaactcgtacaagacttgcatcttcagggctggctgtgcaggtctggggctaggagggcctggagttcggggtccccaggcgtgagggtcatggttgtgtgtcctctcctgaggaaagtgtgaggtgctccctaacctatgagttccgcgcccgaagggaaacagggtcctggtatcctaagggt

SEQ ID NO: 659188 - DNA, 596 bp, Homo sapiens
ctcagaagaccaggctgtagtgcaggggtgcaaacttggcctcggtgtacctgtgactccccgggcctggttacaagcaatatattctgtctgagccttccgaggggtcggatttacatgcacgtgccaccatgcccagttaatttttgtattttaagcagagacaggggttcaccatgttggccaggttggactagaacttctgacctcatgagactgcccacctcgggcttccaaagtgctgggattacaggtcgtggcaacggctcccggccgcaacatgcccatttctactgagaattaatagaggacttgtagagagagtaagagcggatcggataaatgggtctgggagcagccctggtgcccagctcctcaggtcaggatagcttgctggaccaggttggacccaggctcacaggggtgtgcctggaatgatggaagctgatggagctgccctaggaacgcgcgcagcctcgtgccgaaatcctgcagcccggaggatccactagttttatatcgttcggcaccagtgctggagctccaagctttggtaacctttagcgagggtttaaatgggaagcatggcgtaatta

SEQ ID NO: 659189 - DNA, 649 bp, Homo sapiens
ttattctagaaggatccccagggctgaagcaatcgggtaggcaagccatctgagaaaccatcctcttcataacagggggcggtaaagccgggatccggtgcgggacaaaattcttctctatagtcaactccttcaagcatataaggggtcaaacaaaagcgacggtcttcatgggacaccttcagccaaaatcaggtggtactggccacatgcagtggggctgtcttcccaggggcggtgtcagcatctccaggggtgatcccgtggacaagcgtcctccttagcccggcaccgggaccggcccctcatctcccatctgaggccctgcacgtggccttctgtagtcggactggtcccattttctggtcctgggaacatagctgggtacttttcagatttccctttggtgcacttgggtggcctcttttctggaaacaaacttttctcctcaattcttcccgggtccttcccatccttaagggccggctaacggtcccttctccggggacactggaccacacccacccagtgggggccggaacccttattcctgattagggtgacggatggtcggataaatcatgagaagccctgatatggtggagtggtaaaagtatgtcaggcgcgctgacatacacatgaggtgatg

SEQ ID NO: 659190 - DNA, 460 bp, Homo sapiens
agtcttgaagagattaactgagagtctcgcacctcttaaaggattgaataggaaacatttgccatctatggtctgaaaggcctgccacctatagactactggaaactgcctgcttcactacatagtaagaaccttggagccacaaccccttatcttaacccagacactcctttctattgatcccaggtttttagataataacttaactctcagccaatcagaaaatctttgaatccacctgtgacctgtaagtccccacccttcaaattgtcctgccttttgggacttaaccaatgtatacctcacatgtattgattgatgtcttttgtctccctaagacatataaaaccaagctgcaacccaaccaccttgggcacatgttctcaggacctcttgagacagtgctgtgggccatggtcactcatatttggctcaaaataaaactcttcaaatattttac

SEQ ID NO: 659191 - DNA, 867 bp, Homo sapiens
ggcgggctggggcagccactgcttacactgaagagggaggacgggagaggagtgtgtgtgatgtgtgtgtgtgtgtgtgtgtatgtatgtgtgtgctttatctatatttcttctttttggtggtcggtggtgcgacaggggaggaggtgctagacagaggccgagccgttgaactctgctggaccagagctacagacctatggtcgccgtggaagtgcccgctagagaaagggagaagacacgcagaggggttagcagaggcgaacctccgaaatccgcagatcatgtctctgtgggagtcgtggtctccaagtatgccccacataataaagtagcagaggctactatgtacgactttccgccaacacctaacggacatcttctggagtgactgggctggagagcccagccctgcggacgttcctggatcggctcctgacgaccttctgcatgcaacttggctagtgccctactttcagacagtgtccagcaccttcaggcctcggtgggagagcagggggaggggagcaacatcttgagaacaatcaagacccttgagagcgatatatcagagggacaccccttgaaagctggtggacactttcatgagaatatagattaaggagagaataagagctgtttatggaatcacgtcccggcaggttgcaaatgcgctttgcactgggaacacaggacagacgtcaagtataagacaggctgtggagaagactgcaggcagcaactaggggagaaccaacagactccgaaaagaccagacaagggggcgcaggatgccacgcgtatctgacagcaagaaaaaaccctggaggagactggacacagaagcccggcaagtactgaacagaa

SEQ ID NO: 659192 - DNA, 660 bp, Homo sapiens
tcgcgtcgggcaaaacttaggctaggtacgaggctgggtgttcggctcggaggaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactgg

SEQ ID NO: 659193 - DNA, 658 bp, Homo sapiens
  misc_feature (26)..(26): n is a, c, g, or t
  misc_feature (29)..(30): n is a, c, g, or t
ccctttacggctagtagaggctgggngtnnaatcggccgacggctcggaggaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactgg

SEQ ID NO: 659194 - DNA, 639 bp, Homo sapiens
ggacgcgtgggtcgacccacgcggctcggaggaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactgg

SEQ ID NO: 659195 - DNA, 760 bp, Homo sapiens
tgaggtgatctagaggatctcatgtagtcgctctcggctttcggctcggaggaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactggaaaaaaaaacacaaccaaaaaccacacacaacaaaaaacaaccacaccacacaaaaacaacacaagagcggggggccgcgccaaaaaacaacccccggggg

SEQ ID NO: 659196 - DNA, 894 bp, Homo sapiens
  misc_feature (672)..(672): n is a, c, g, or t
  misc_feature (674)..(674): n is a, c, g, or t
  misc_feature (894)..(894): n is a, c, g, or t
ggacgcgtgggtcgacccacgcggctcggaggaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactggtgaaaaaaaaacaaacaaaaacatcccacaaancnccccacaaccaccaaaccccgcagcaacgacccgagggcagcacagaagccgggaggggggcacaaacaaggaggaacaagacacacgacagcacggtcccagacaaagcgagagcagccacaccaagattcacgtacaacaaagagagtagaacccgagcagcaccaccaaaggagagccaagcaacacgaaagagccgagaacgcaccgggaaaaccn

SEQ ID NO: 659197 - DNA, 810 bp, Homo sapiens
  misc_feature (26)..(26): n is a, c, g, or t
  misc_feature (29)..(30): n is a, c, g, or t
ccctttacggctagtagaggctgggngtnnaatcggccgacggctcggaggaggccaaggtgcaacttccttcggtcgtcccgaatccgggttcatccgacaccagccgcctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactggaaaaaaaaaaaaaaaaaaaaaaaaaaaaaaaaaaaaaaaaaggggggtttttttgggggggggggaaaaaaggtttaaagggaggggtaatgttttggcccctttttggaagggggaaacggggcccaaagggggaaaagaagcgggtcgaa

SEQ ID NO: 659198 - DNA, 430 bp, Homo sapiens
  misc_feature (32)..(32): n is a, c, g, or t
ggggggagggggagggtggcccatacggacgntcgttaggagcgaccggagttccttaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactgg

SEQ ID NO: 659199 - DNA, 427 bp, Homo sapiens
ctgcctctgccctgatcatcaaagccctcaaggaaccacctcaatctgggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactgg

SEQ ID NO: 659200 - DNA, 398 bp, Homo sapiens
  misc_feature (56)..(56): n is a, c, g, or t
  misc_feature (71)..(71): n is a, c, g, or t
ccgcaccaccgcgccaaacgagcgacccgatcccctccccctaaaagaagagaaanaaaggcttattatgnaactggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactgg

SEQ ID NO: 659201 - DNA, 930 bp, Homo sapiens
  misc_feature (484)..(484): n is a, c, g, or t
gccttgtccagtgaaacaccctcggtgtgaagttcagttcgttctctcctctcctctcttcttgtatgaacatggtgcggactaatagcagacggcgttccaggcactatacagaattagtggtggctgctcgagccctccagaaaggtgctaggttcttccacctctgtcattagttcagacgatcagtttcatcgaggacatgctgagcattagtatgcaggtagggaaccccgtttgcgtgcgcccaagtcccaagtggctgaaaggattgggagaattctttagagtggtccccgtaagagattctgaggagcacgagaactcatgacttcctgaaagaggctgggaggcaggggttcaggaaaagcaaacgaggacaaatgcatgtcctttgtcatgcgtgatcacgcggatatgatgatgagggaataggaatctgttctcactttgcatcttggagataacgtctaccttgtttgancccttggtattctagaaactgtaaagtgccaccataaattgtgttggtgcgcaattaggcttgtggaacaggcctctaattaaaaggattcagcgtctagatgtagatgttcagaggtagttgtgacatttgagaatgcgtacgactaatgatggtaacttagacttagtattcaatatgaatgcatcgttcgggttctctcaaccaattaggtgtctagggctgctgacatcactcgtgcctcgtgttcaataacagcatgtggattcgagattgcttcgctgtggccggcggcactattggggcggaaatgggaggggcccatgaacccctctgggaaagcagggatttttcctaactggtttctcggaaacaaacaaattgggcggccgaataacacgggcgccggaatatccgggcaagggccaaacggggaaacggtttcc

SEQ ID NO: 659202 - DNA, 781 bp, Homo sapiens
aggttgatggtatgcaggtccgtgcggtgctttaattcagtgacggggctgtggggtctgtacctgagatctggagtggccggcagtaccaagcacgctccaccatgccgccgaagttcgaccccaacgagatcaaagtcgtatacctgaggtgcaccggaggtgaagtcggtgccacttctgccctggcccccaagatcggccccctgggtctgtctccaaaaaaagttggtgatgacattgccaaggcaacgggtgactggaagggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgccgagactagtctctcgtctctcctctctctgtggggctgcaaaaagataccgccgggggagataacggcaaagagtgcgtgctccgggcgcgatggaatgagggccggtggtccgcgacccattccatcgaggggagcccgaggacgggtactcacaaaaagtgctgagggggatcacaaacttacaatggctgcgaaggggcacctttccagtggccatcttaacacgtcattttttcaaaagacgtgggcacgtggttgaagaatgtccctctaatgcttgaagaagcggaatagtgggcagccgatacctctgtggaatttgaagaaacggggcgtgcttaagcatgggaagggtattgccgcgtactg

SEQ ID NO: 659203 - DNA, 380 bp, Homo sapiens
ctcaacatgaatttgtttcattgaaccatcagaaagtaaagggatcactatctcagccacccgtgtagacacaatctgtggttgtttgacatcaccattattcctgaccaaatttacatattaccaataagcaaccattttcttacacttacacctaactacttaatggttaaaaaaaaaaaaggggcataccattaatacagtgaaaaaaatcacatgttcagggtagctacagcagcacagaggcatcaccagaatacctgtgccagctgttaaacagaagcaacaaacagcaggctttctgtttccatctggaatgctttgttttgattaaaaggtactgtaggccaggctcagtgtctcacgcctataatcccagc

SEQ ID NO: 659204 - DNA, 233 bp, Homo sapiens
  misc_feature (70)..(70): n is a, c, g, or t
catgctttcgagtctggtgagattataacgcgttaccattaaagtatgcgttggatcgttactcctattnaagcagaatatctccgttcaacacttgctgccctgttgcatcagaacatactcgactccgatattggaccttttgttggttagaaatgtcttgatccaatgggatctaattgagctaaagagcttctgctcgcgcagaagaaactaccgggttccgaggctac

SEQ ID NO: 659205 - DNA, 361 bp, Homo sapiens
agctaggcgaatctcctcctccttactatttggggtgccttaacaactgtcgtgactccagagaagccgatccccatttttattgaaagatgtattgagtacaacgtctccaaggacttctggcgcggaactgatctaccgggtgagggtgggacaatctctgagccagaagcggctgccatgatgcatagacgggagttggtggactagctgcatcgcgcaggaagataccccagggggatcagtccagcaggatccaccagaggctgcaggtgctcatgcttgggtgcttgagctatgcggctagtggtgcaagacgagctagcggttagcgggaaacctggtatggagaaggagaggc

SEQ ID NO: 659206 - DNA, 914 bp, Homo sapiens
gatgaacttcctggctgtcaagctcccggcctgtggctgactcaatgcgtgagggctgctgcggaacagtctgccgagtgctgattccctgcccagtgctcctgtaaccgccatggcatgtggccccttgccaatgtcccagcccctgtgaccccatgagcatggcactggatacacctgggggactgccccccaggcaggagagacgaggacgctggggaggggatccagtgctcccaatcgcatgctcagcttcagtgactgccctgctgtccaatcatcgccaaccgtcatgatcctgcctgtgacccacacggagatctccccagaacaggtaacggggcatgtgctgtgctcgtgcgtggtgtggccctgcgcaaggatatagggtccccgatgctcgacctggcacagggttgctgaccctgcaacgccttcgaaagcttctgaggctaaggagtgcaagaggcggggaggctagcggccctccatatgtgaaaaggggacaagcggagtccaacaaggtcctgcatcagcctgtgctcacccctgtgcggagggtacctgggctacctgggagaggttgtggagactaggggcatcctaagtggctctgtttcccgatattcatgtggacaaaagtgcaatggtaacccctggactagttgagccctgtaaggtgcaccaagtatttctggtacagaagggaacatcggtatcctagtgtggacctttcaaccgctaagatggaaccacgaatgtgttattcttcgtgcagtgtgcaagagaaggtttgtcccaagatcatggttagagacgcacttagtgatagacgtcgctccttgacgttataactcgctggtaccatctgccccacggtgcacatgaggggggactgagttcgctaaaggctg

SEQ ID NO: 659207 - DNA, 181 bp, Homo sapiens
cgcgcgacagctcctgagggaaacttcggagggaaccagctactagatgttgtagatgtgtggtattatttctgagggctctgttctgttccattggtctatatctctgttttggtaccagtaccatgctgttttggttaccgtagccttgtagtgtagttcaaagtcaggagctggtcga

SEQ ID NO: 659208 - DNA, 87 bp, Homo sapiens
ctagaagattcagcaaagtacttttgtgctcttggggaactaatatatttctactcatgggggatacccggcaccgataaactcatc

SEQ ID NO: 659209 - DNA, 663 bp, Homo sapiens
gcttctgctgcttctcctaatggcggcgtctgcgatggtccggagcgagggctcggcaatctgggcggcgtgtccagcaacagattataggatgcagtacgccacggggacgatgctcaagttccactatttgtgtttcctgaggttataggcgggtgtttgaggagtacatgcgggttattagtcagcggtacccagacatccgcattgaacggacgagaattacctccctcaaccaatatagtatgatcgacatagcatctttcctgtcagtctttcaaatctagtattaataggcttaataattgttggtaaggatccttttgctttctttgggcatgcaagcgtccataatcactctgcgacacgctgtggtgccaagaaagagataaggtttgatgcaatgtatgattggttttcttcttgagcaatcatgattgagaaccagtgtatgtcaacaggtgcatttgagataactttaaatgatgtacctgtgtggtctaacgctggaatctggtcaccttccatccagtgcaagcatacttgttcaaatttcttgacaagtgaagatgaagctcaatgtgcatatggattcaattcccacagcatcgatcatagcaccacctatcatcactgaagactcttttgcattaggggatcatg

SEQ ID NO: 659210 - DNA, 823 bp, Homo sapiens
caggctggtacgccccgagttatgggatggctttggcttctgatagtcatggactcactaggctgctgaggaagatcaataatacctactggaatcagtcatgagaagtcaagcatggaaattgtgaattgtgtgtgtggccagaccagtacctccaagtgttcagaagatgtgtgaccagacaaaacacagtaaatgctgcccagcaaaaggcaatcaatgctgcccaccacagcagaaccagtgctgccagtcaaaaggcaatcaatgctgcccaccaaaacagaaccagtgctgccagccaaaaggcagtcaatgctgcccaccaaaacacaatcactgctgccagccaaaacccccatgctgcattcaggccaggtgctgtggtttggagaccaagcctgaagtctcaccccttaacatggagtctgagcccaactcaccgcaaactcaggacaagggctgtcaaacccagcagcagccccatagcccacaaaatgagtccaggccaagcaaatgagagcagaagaagtcaaacaaagaagaagtccctggggccatgcctttcactttgtagggtgggggattactgagagtcaggctagacctgtgtttagagaagcagttttcacagtgactaccatttccacccaatgagaggctcctatttcccatcatagctccctaccctagggaggcctccatctggaaatgggaggatgaagaggctagaatcatctttcctagtgatcctgacatttagacagcacagaaataaagagcaataaaaagaaaaaacaaaaaatcttccagggctgaaccc

SEQ ID NO: 659211 - DNA, 879 bp, Homo sapiens
  misc_feature (221)..(221): n is a, c, g, or t
  misc_feature (444)..(444): n is a, c, g, or t
  misc_feature (490)..(490): n is a, c, g, or t
  misc_feature (492)..(492): n is a, c, g, or t
  misc_feature (543)..(543): n is a, c, g, or t
  misc_feature (650)..(650): n is a, c, g, or t
gggcagaattgagtgccacctaagctgggcttctgtgtgccaaaatgctggtgggtgaaattagtgaaattctttctattcattcctttgcccttctcccaagaaaacccatggggaaacaaattacaggggatgaattcctttagaactttccctacttagagtgtttgagattcagtttcaaaaggcactccatctgtgtgtgtggtttagagagcctntgtttgtaaattccattaaatttccttttgtagggcaggagctctgtactcagcagttaaaagattcatctggagtcgcaaaatgaaaagccgtgttctaacctgaggaatcagttaggggacaggagttccgtgggccaggaatgggctcagggagtggggctgcgtgtcacacacagtagctgtgttgcagtggcctagggccttggggattgtctttagngaaacaccctgaggggaagcaggtaaagagcctgggcagtatttgncnagtttcattgttttcctcctgctgaggtctagcagagcccttgctttgtcntctcggctgggtctggctgccagctggtgtgatttgagaaactgaccttacgcgcagtcaaggtccagctgacaaggccttgtattccttggctggccgtgattggncctttcctctgcagaaagcagcttagggaagcccaagcaaggagtgtggccggtagaaggcctcgtcgttccttctggagccagccagcacacaacgttttccagatgcgtgagtctggtttgtgacatcccgttcccttctgccggttggtctgatgcaagaggaggagttacagttgctctgaattttattctcagctgaaaatgtagcacgtgtagaaagtgaacc

SEQ ID NO: 659212 - DNA, 334 bp, Homo sapiens
cggcagcggcggctataggcatgcgacgcggcgcgtggtgagcagtgcgcgcggcggcggtggcggcggtgtgcggggtaccttggctcggccgtgacgcgggtcgagcgccgaatcggccgggggctccgctcgttacgcggaccgggcactccctaggatggtgccttggatctgacgtagtcggcgcgcacagtttggtcccagtacgtgcgtgctcgtaccgcgttaccgcattggtaggcagtcgtagcggcataagctcttatatcgcgggtggtcgccgatcttcggtgacgaattacgtcggcgtaggcctccctggttcgctcct

SEQ ID NO: 659213 - DNA, 221 bp, Homo sapiens
cgttatagtcaccgtggtaggaaaagaggcagattcattgcactgttatctttattatttgtacatgtttaaaattttccattaaaaaaagtttaaaggccaagtgaggtggctcatgtctgtaatcccaacactctgaggggccaaggtgggcagactacttgatgccaggagctcaaaaccagccttgccaacatggcaaaaccccatctctaccaaag

SEQ ID NO: 659214 - DNA, 319 bp, Homo sapiens
tgcaatttcatatggtagttctgtttgtatcttttctctgcatcctcaccagcatctagctatttcactctctttttaatgatagccattcttactggagtgagatgatacctcactggttttgatttgcattttcctgatgattagtgataatgagcttttttcccattttttgggccatttatatatcttcttttgagaaatgcctgttcaggtcatttgcccttttttaaaacagagtagagttttttgttttaatttgtttgtttgtttatttactgttgagatgtttaagttccttgtatattctggatattaa

SEQ ID NO: 659215 - DNA, 691 bp, Homo sapiens
caggctggtacgccccgagttatgggatggctttggcttctgatagtcatggactcactaggctgctgaggaagatcaataatacctactggaatcagtcatgagaagtcaagcatggaaattgtgaattgtgtgtgtggccagaccagtacctccaagtgttcagaagatgtgtgaccagacaaaacacagtaaatgctgcccagcaaaaggcaatcaatgctgcccaccacagcagaaccagtgctgccagtcaaaaggcaatcaatgctgcccaccaaaacagaaccagtgctgccagccaaaaggcagtcaatgctgcccaccaaaacacaatcactgctgccagccccatagcccacaaaatgagtccaggccaagcaaatgagagcagaagaagtcaaacaaagaagaagtccctggggccatgcctttcactttgtagggtgggggattactgagagtcaggctagacctgtgtttagagaagcagttttcacagtgactaccatttccacccaatgagaggctcctatttcccatcatagctccctaccctagggaggcctccatctggaaatgggaggatgaagaggctagaatcatctttcctagtgatcctgacatttagacagcacagaaataaagagcaataaaaagaaaaaacaaaaaatcttccagggctgaaccc

SEQ ID NO: 659216 - DNA, 92 bp, Homo sapiens
ccttgaccgggtcgagcagcgaccagtcgccatccgggagcacatagcccttcggaaatggcgcgcgcagctcgagcccgagcgagcgcaac

SEQ ID NO: 659217 - DNA, 1161 bp, Homo sapiens
cggcgcgcacactgctcgctgggccgcggctcccgggtgtcccaggcccggacggtgcgcggagcatggcgggtgcgggcccgaagcggcgcgcgctatcggcgccggtgtgccggagggagacatggaacgcaggcgacgcggaggaacgatgctggaccagctcgaacgaagctgctgtgacgtgctcggctgccggcaggtgcacgggcgagggtcgtgaccctgcaggcggaatatcacgctgctcaacgtgtgtggctcatcagtcgtggggacctattgatcgtgctctcggcatcttcagttgacggccacactggagcagttgacttcataggacggcacggctcgccggggctggcgctggtggtgtgggccgcgtgcggcgctcgtatcttcaatcggtgggactcagctcgtggctatgcggagactcggtagccagcaatctccaaagtcgtggcggcgagtacgtcctacatgtgctggtaggctcgtacggctcgactgtccggacgttccatcagagcgtctggatctgacgctaggatcattcattgcctggccttcatctgcaagtagaggatcgtggcccttgggtcttccgtcaacgctacactgtatccaagccagcatcgttacctccagctagtccgggtgcccggatgtgggcagccaaagctctgtggcctgcctctgcgatgtctgctgttcacgagcgttagactgctagtgctgttagagtgccgcagcccgggttccggatgcctttggcgccggcaatctcttgtcctgggcccctgcatcatccctgctgaggattcggtccagaatccgggcacagggggatggtgttccaatgtcgaatcccgagtcttaattgtgaaggcacgaactgtgattgggggacacatgtgtcggaattaattcgagggaactatgtcacataggaggaggacataattagaagacacaaggaaaaaattaagccaaaaagacgagacgggccacaaagagcgggacagcacagcgagaggagacaccggacatcaccatgacagaagacacaaaagacggcacgaaaccagggacacgaacaccaaaagaagcaaaaaaggaaaagcaacggagaagaaaaaagaaagaaccgaccacaag

SEQ ID NO: 659218 - DNA, 179 bp, Homo sapiens
aagtacctcgggccatctgctgaaagctgatgctgctatactccggacatatcagctccaactactgggcttaatttccaaccatttgcatatggtgtgaccatcttcttattggtcattacacgtgctgtagcattattcacctcgattttacggccctctaccacggtgctataacg

SEQ ID NO: 659219 - DNA, 180 bp, Homo sapiens
acctttaagaataatgtcctgagtcaggcgtggtggtgcgtgcatctagtcccaactatttgggaggctgaggcaggaggatcgcttgagcccaggagtttaaagctgcagtgccctgtggttgcacctgtgaataactgcactccagcctgggcaacatagcgagacctcatctccaaa

SEQ ID NO: 659220 - DNA, 121 bp, Homo sapiens
cagctcggacaagtcttttcttaggtgtgtgtatttcctttcagagagtgcataacatttacaaaaatacacaccagcagcagtcgtcgctaagggctattaattctgtacctaggcgcct

SEQ ID NO: 659221 - DNA, 475 bp, Homo sapiens
tcctttctaaacttttatggaaaaaaaaaccgagccgaggtgtgctggatcccttttacaaaaaagccgtttctcatacaattggagtgctatggaccccacttaccaccggggctgagagagactgttctctatctacaaatcttaagctccccagagtacatcagggctcagaactggggtcaaagctctgggcaaccaatggtcctgggcatgatgtcgtgggatcccagcaatcagcgtacaggcgacaaatttgtgagattagcacccttgtgccctgggcagaagaaaacacaaaaaaactccgaggggccccaaatatggaaatagggcacaaacactacagcgtgaaaataaccgtgtccgaggcatgccggaagaggcgcattgctccagcggcatgcgaagagaaaccccataaccaggaaaactcacctagaaaccgaggaatccacatggaaaagagaagtat

SEQ ID NO: 659222 - DNA, 245 bp, Homo sapiens
  misc_feature (155)..(155): n is a, c, g, or t
tctagagatcctgtgcggtgctttcactcctggccctgtgatttctagaagaagggagaaggagggaggtgaccggcgagcgctctcaaaggcagctggtgccacggtctgcggacacgccctcccccacacacgtgggatccccgcagcccggnagccgatccacactgggggaaggcggggctgcctgaaccatggagtgacacgcttccgtcctggacttttttgcgaaacatattcgcaaa

SEQ ID NO: 659223 - DNA, 309 bp, Homo sapiens
gggggtttttttttttaaaaaaaaatttttggccaaaggggcctttccccccaaaaggggcccccgcccaaatttttttttttccccggggggtgggggcccagggggggtaaaaaaaacccccaattaaattggggggggaacaaaaaggggggtttttttttggtggggccccccctttttttttttttccccccggggccccccccccctttgggggggttggtttaaaactttccccgggggggttgggggaaccccttttaaaaccccggggagaatttttttaaaaaagggttttttccccca

SEQ ID NO: 659224 - DNA, 1412 bp, Homo sapiens
gggcgaatggctcgtctgtagtgcacgccgcgggccagactgcgaccccggccccgcacccacgggaccccggacatggacgaactgttccccctcatcttcccggacagagccagcccaggccatcgtggaccccatatgctggagatcattgagcagccaccaagacagacggggcatgcgcttccagctacaagtgcgaggggcgctccgcgggcagcatcccaggcgagaggagcacagataccaccaagacccacacccagcatcaagatccatcggctacaccaggaccagggacagagcgcatcatcccatggtcaccaaggaccctacactcaccggcctcaccccacacgagcatagccaccgcaacggactgccgcggcacgcgcttctcactgacgcgctgacccctctgcccggaccgacatgacatccacagaacccagaaacctggcgaactccaccgacgtgacgcacacgcgggaccctgcgacacaggctaactcaagcaccagcccgcatccacagacccaaaccacaaagcacctcccaagctccctatagcacgacacagcgctgccggacatacgacgctgaactgctgctgccggctcccgcatacccagacgcgaccagacgccggggaccccaaacagcgcaagcgacccatcacgcccctgccccgacatgacccatcacatcaatcaccactctttcgacacaccggcacccccaaaaacactggccgaagcccacgagatcaagcagactgcaaccacacaacctcctagcaacccgaacctacgcgagcgcccaaccagaaaagccatccacaaaccgtccgatgaacacagcgacagcccacacacacaagcaccacacgaaagagacacacaaccaccaagacccacacaacagcccgacgcaccaaactcacccaacagccacaccacaacaacaccacacaacatacgaaacacaaaaccacacaccagccaccacaccaccagcacgacaaacacagcgcaacgacaaacaccacccgcaaccccccacaacgcccgccccagaccaccccccaccgcaccacacaaccaccaacacaaacccacgccacacccacacaccccacaccaacacgccaccaccaccacgcaccacgcacgaccaccacacaacgagcacataagccgagaaccgcaagacctgatgccaaagacccgaagaccaagaccgagacaaaccacagaagccacacagccacacgacacccacaacccacctacacacacccacaacagcgcaccaccaccaccacacccaacccacacccaccacacacacaaacacaaaacacgcaacagacaccaccaacgaaacgccgcacgaccgaccacccgacagac

SEQ ID NO: 659225 - DNA, 207 bp, Homo sapiens
taatggtgctcagaaatgtaaacttctggaattcacgtttaaagactaattggagggccgggtgtggtggctcatgcctgtaatcccagtatttgggaggccggggcgggtggatcacctgaggtcaagagtctgagaccagtctggcaacatagcgagaccccatctctgaaaaaaaaaattgttgaaaacacctcagttttctct

SEQ ID NO: 659226 - DNA, 1134 bp, Homo sapiens
gctcggccttagtgtgtagttgtgggtcatagtggcacaagagaagactcttggtacaggtcacgtatggcttctcggtgagcagaagctactgggtgaccatccgtgctgccggagactgtctctcagcaactgggagcatgctggaggacaggctaaggaagcgtgcagtcctgtgttcaggctcgatcagtgagacactctgttatggggcgcctggtggtccgctgtgcagtacacgttccaaaaggacgggtgcccgctgagaagcgcggtcgagacactctaagccatctcgcggtcagggggccccatcgcgttggaagacagcccttgggcagaacaccgcagagagccaagggggtcaggacttggggactcgatcgcgagggacattgaaaggcactcctgtcttcaggcgttgaagtaaggttgcccgtatatggaagttgcgcgtgtgatctcgcaagagagacaagttctcgagaggcaggttccaatggtgcgatacagattggagcaaccctggagagtggttgctggggctgtgcaaggacgcgcccagaggttgtcacctggggcaccaggggcaggggccggggacaagaaggaagggaaaggcaacagggaaagtggcgcaacggaggggaatttcaacaccgaaaaagattcaaaccaaggcccttgaagaccccaaaggaaaggaaacacgagacctgtggcatggatacattgggcaagacgccgcaggcccagtggtccgctaacgtacaagcaacagggacaaaagaccacccagttggcggaacgaacacgggggaggaacatatcaaagccggttcattcagtgcttggaatgcgggaagaaattgaggggcttacaacaaattgaaacagaacagcacggatttaacagtagagcgattccaaaaggggcaagaccgaaggggacatggtccgttatcccggtgagggaacccactgtagatacctcgttcaaagtaagagagaccccgcttacgggtgtacattccaccccatgacgaaaggatcttagcagcagcgtggaactcagtaagaacgacccgtggttgaagagatcgtggggaagaatacccgggcgaattattaccg

SEQ ID NO: 659227 - DNA, 460 bp, Homo sapiens
cttcagcattcaccacagcagtgaatgcatgaggccagaggttttcaaactctttaaataagtgcatattatttatttttatttatttattttgagatggagtctcactctgtcacccaggctggaatgcagtggcactatctcagctcactgcaacctctgcctcccaggttcaagcaattttcctgtctcagcctccccagtagctgggattacaggcgcctgccaccatgcctgggtaattctttgtatttttagtagaaacggggtttcaccattttggccaggctggtcttgaactcctgacctcgtaatccacctgccttggactcccaaagtgctgggattacaggcattagccaccacgcccagcctagcagcaactttttagttatggtggtcagcagtcaaagagggcatagatagctgcaacatacaaaatagatgaaaacttcgaatg

SEQ ID NO: 659228 - DNA, 277 bp, Homo sapiens
gggttttttttcccccccgggcccccccaatttgggggggcagggggttttttttccccccccccttccccttttaccccttttttggggggggggttttttccccggggggaaaaggggcggggcttttaaggggcctttttccccccctggggttttttttttccccgggtattttttttacccggggttcccccccctttttccccccccccccccccccgggggggcccgggggggtgttgttttttgggggaatttaaacctttttccccca

SEQ ID NO: 659229 - DNA, 421 bp, Homo sapiens
acgcggtgcacatgtgtctgtgactctactatagctcactctgtagcacctatattctgtgcacatgtgagagctctcacattctatcagagcagagggaagtctctgtcacgtacccacgccacaagcctcaagaaggctttttgtctgagggcctcattatgcccagactggtggtgctgtgaccaggcttctgagacactggcttcctggagcccatgcatgcccaactgtgcttacatggttaaagccttgaagcagcacatcttcactgtgcctggcaagaatgtgggaagcttacaacccctggtttcctgacttcctcttctgtcccactgggtgcccctttccagattcccaggggctctatgggccaccggcagtgggtctgggcctgtcacagcgtcttgcgtcttctctt

SEQ ID NO: 659230 - DNA, 572 bp, Homo sapiens
taaatctggaatcggtatcacttaaatcagcatcggtatagaagggcaagaaagacagcggttccctcaaaagcagccccatttcttcagcgggcaggggacacaagggacccgaagggccccggttccggtccagagcacaggaggcccaagagggaccagggggggctcctcaaggcagaaactcttatagaattttagaagagggtgcgcccgagctcgaggagacccctcacgagggcggggtgtgcacgaaagggcgggtcagtgccggtgaagaagggtcgggcccaggaaccagcgcgagccaagtgggggagaagagaaatctggcgacaccagcggagagacatgtggggttctttggaagaaaggagggagtggaattaatctgtgggcgtttctaaaaatctggagcagggctgggcgatctttggtgctcttctcacaagcgcaaagatgtgtgggtgagaaccgcaagggtgggcccacgcttgtgggtttctctcacagcgggctcctctggcaaagtgggcgccttttcttcttatttccggaaactaagttttcta

SEQ ID NO: 659231 - DNA, 532 bp, Homo sapiens
cagggtatcttttcccctacaaagcgctcatagtccaggagcctgactaggtggacaggtgattacatagcaatgtaggacaggctgtgatagtcctacaaagaagacaagtgggagtatggttatgaccagttcctcctcttagatttattccttcttctattggctatcaagcaaaagaattggtcctattttttttaactagtgccaattacaccataaattttaaaaactttataaagattaaagacatgagccaccacgcctggcctagaactctccgtttaatggggtaatacaggaacatagtggtaacatctagtaagtaaattaaggaacaaaatttgtgctacaagcaagttaagaatcatattttccaaaattgttaggaaagcccatgacaccttttaagagaggactcctagaactcaagactaaatcacaggttaccctcccttatcagagtttggggtaatggtggctatcgccgcctattcatgagttatccccggcgaaaagggaaagttcacga

SEQ ID NO: 659232 - DNA, 150 bp, Homo sapiens
ggtatctagaggatccacgtatatgtacatgtccacactctgggcatggtgggattgtgacctacctgtcaggcggacagtggccaggagcatgaggacagttgtgtgcactggaagagaaactttttggaaaaccctaaatcaggtaga

SEQ ID NO: 659233 - DNA, 308 bp, Homo sapiens
gtcgacggaagggtgtctgtgtatgtgtatggaatgtgcgtgtatggaatgcccatgtgtatggaatgtgtgtgtgtgtgcatggaatgtatctctgtgtgtgtatggaatctgtgtgtgattatggaatatgtctgtgtgtatggaatgtgtgtgtatggaatatgcctctgtgtatggaatgtgtgtctctgtgtgtatggaatgtgtgtgtgtgtgtatggaatgtgtgtgtgtatggaatgtgtgtgtgtggaatatgtgtgtgtgtgtgcaatgtgtgtgtgtgtatggaccatgtctctgta

SEQ ID NO: 659234 - DNA, 136 bp, Homo sapiens
cgatctgaggatccatggagatgtgcacagggaaggaaataacatagcactttataaacactgtatgtaagtggaaaatgcaatgtctcaaataaaactatttaaaattggcacattcttccaatattggagatgt

SEQ ID NO: 659235 - DNA, 335 bp, Homo sapiens
gcaggcccccccagagggggggggtggccttttggttaggtccctgggccgttcccagggggggggggggccacggggggccggggcccggggcctttttttttcccttgggggttccggggaccacttttggccccccttttgggagggggggggggggttggggggccctgttttccttggtccaagggtgccggccccgggggcgggggacctttttttccagggttggggggccggggggggcttcgggcccccggggggggggggggtgggggggggctttttttttgggcccccccccccttccccctttagggttaacttccctggga

SEQ ID NO: 659236 - DNA, 139 bp, Homo sapiens
gcgggccacttagcaggtggggcagcgcagcaatctcttctccaaccatcaacatcttggccagatttgaactcttcaatctcttgcactcaaagcttgttaagatagttaagcgtgcataacgtgcccgccaatcgaa

SEQ ID NO: 659237 - DNA, 151 bp, Homo sapiens
ttagcggcgccttttccaaagttataacagtatgcattgtaaagcgacaaggatacgctctaagaaacgcattaggccatatcggcactgtgggaaccattcctagagctgaccttacacaacctggactgcccatcaccctgcctatgca

SEQ ID NO: 659238 - DNA, 113 bp, Homo sapiens
gtgctggttgctctagagtgatccccctgtgccgcgccacctgctcatggcctccaccagcagctgtgtctggcgcctaacacctgagatgcccgtttgcctgagactgcaaa

SEQ ID NO: 659239 - DNA, 299 bp, Homo sapiens
gcaacctctccctcctgggttcaagtgattctcctgcctcagcctcccaagtagctgggattacaggcacctgccatcatgcctggctagtattagtattttatagtagagatggggtttcaccatgtcggccaggctagtcttgaactcctagctcaagtgatccacccgcgttgggctcctaaagtactgagattacaggcgtgagctactgcgcctggccctccatcactgctatctaattggcagaatattctcgtcagtccgaaaagaaacccccgtaccataagcagtcacac

SEQ ID NO: 659240 - DNA, 163 bp, Homo sapiens
aggtgaagtctgggtcagaaacacaaaccaagacgcgaggatcctgaactgtttttcgagactcctcgcagctgcatgagcagaaagacaggagccaagaggtcacctggaggtttatttagacttactcatccagtagagatggattttttgattctggaaa

SEQ ID NO: 659241 - DNA, 589 bp, Homo sapiens
gtgatctagaggatcccagcgaccatttgctaaaagaaatacggctgggacgcggtggcacacacttttaatcccagcattttgggaggcgagggggtggacacctgaggtcaagagttgagaccagcctggcaacacggaaaaccccgtctctactaaaaatacaaaaattaggcagccgtggtggtgcgcacctatagtcccaaggttctgggattataggtgtgagccacctgacattacacctgagagcaagaactatttaaggtcagaatttaaaatatcaagaagtcagggcaacatcactatttctggaggagggacaagcaggttgtcaagcttgctttccttgttcagcagtgatgcttgtggacttacagatccagcatgccatgggtccagattgtcactgctctttgagttacatagaaaacttctgagacgcagtaaatactatatttgagttgagggagtaaggattctcatcataatagagttacaaatgttcccatcaccttccaaaagggaggtcccagggtgtgtgcaacttggagggagtcactcggaaacaatggggttgagtgtaatt

SEQ ID NO: 659242 - DNA, 838 bp, Homo sapiens
tctaactcagggtcagcttcctgggggaagcccaccgaccacagtgcctttccagctcactttccttcgcacaggtacccttaacgcaggcaagcccgcctggcgactcctcaggcctaggaaaggcacagactggccagtacgtgtgcgacactcagaagcggcgtaacgcttgggcaaagaggcttgcttgagttctaagaacgcggtagttacaagtcctagtctctgataaaatagactttaaaccaacaaagatcaaaagagacaaagaagggcattacataatggtaaagggatcaatgcagcaagaagagctaactctcctaaatatatctgcacccaatacaggagcacccagattcaaaaagcaagttcttagagacctacaaagaggcttagactcccacacaataatagtgggagattttaaacaccccactgtcaatattagaaagatcaacgagacagaaaattaacaaggatattcaggacttgaactcagctctggactaagcggacctaatagacatctacagagctctccacccaaatcacaaaatttaatccatcacataaataccaaatacattcctttctcagacaccctcatcacactatattctaaaaatttgaccacataattggaagtttaaacacctcctcagcaaatgcgaaacgaagtgggacatcataacaaaatagtctctcagaccaccagtgcacagccaacttagaactcagattaaggaactcagtgcaaaactcaacaatactggggaactgcagagctggcctgaatgagtccgggtacttatcgaatgaggcggaaaaaggg

SEQ ID NO: 659243 - DNA, 830 bp, Homo sapiens
gagcggcagcggagcggagcggaggcggcgctgagtttggtctcccgggcgtctggcgcgcgcggtgtgtccaggtaccccgccgctccctccttcccgaagactcgtccctcgtggccgtggcccccaagggtgcctgttcttgccggggtggtccgggtccagcgcaagagggggcgcgggtttccttctgtttctccgcggaaccattttagtctcaaacgcggggacttccattttttccccctttgcgttcttttctctcccttttttgcttgtctcttcgtggtggtctccctccagaggaatttgaatttattggacgtcgagggactcttcaagaagaaaactttgcgctcaagttattatttatggaagaaaaggggtggggtgtacgggggaagtttgaagaaaaaagaaactctattgagaaatttcttcctaaaaaagattgacgcgttcgttggaattacgtgagaaactttgtggtacttttgaagtcaagaagtgttcccctctcccggtccaatgttacgggtggcatgtggtagtggaaagcggtggccttcactaggggaaattctggtgcccttaccaacaacccagggaggttccacagtggccaggggtgtgcttgagttgtactccgcaacgggggacggcaagatactttgggagggtccctttaagtggccgtggagaaaggtcgttccgctttgtggttagggagtgcgccacacctttaaggggtgaaaggtactttctcccgaagggttatcagacggaggttgagaagagtcacctcggaagaacccttttttccactgggg

SEQ ID NO: 659244 - DNA, 574 bp, Homo sapiens
tgaggtgacccacgcctgtaatcccagcactttgggaggctgaggcaggtagatcacttgaggtcaggagttccagacccagcctggccaacatggtgaaaccatgtctctactaaaaatacaaaaattagccaggtatggtggcaaatgcctgtaatcccagctatttgggaggctgagaaacaacaatcacttgaacctgggagacggacttgcagtgagccgagactgcgtcactgcactccagcctgggcgacagagtgagattccgtctaaaacaacaacaacaaaagggtgagggagagatataacaggtaaagcaattagaaacaagatcagagaataggattcaggaagaggaatcgtggacctcaattggtatgatcgtgctcctcttacgtgagacaccagtgcctggccggggactggcaattccagttgacttgcggaggctagggcaaggagcaacgtgcttgaatccaggaggcggaggcatgcggtgaggccaatgatccgggccataggagttccagcctaggtgacagagcaaaagtctctctctcaaaaaaagtcg

SEQ ID NO: 659245 - DNA, 616 bp, Homo sapiens
ggagaggtgctgcgacgagagctcatcgggttgtcctgcttcaccagtggcttggacggaacaccggcgctcgttccccatcccggtcggcggccatagccagcccgtccgtcagcgtcgttcaccgccactccatcggaacgtgccccaaaggcctccacgcctggctgctccagcgccgcagtcagctcgaccgtgcgggcgccgacagtccttcttcacttatagtctgcacgtccctatgtactgacgcgaagtctcacacttcggcagggtgcggaccaagaaacttaatacaacgcgaggcaacgtctagaaagagcccggcactgaagagccggcgcgtaattcatatcgcctaggagtaccttccgtactgacacatcccctaacggatttgatacgatagtcccgactgatacgtataacgatgaacctgtttgaaacccggtagaattggactgggtgagggctattggaaaaggaaacatttctgaccccgaggaattaaactttttcatttgcgaacacaaattacgttcgaatagaagtgaagaaaggtgaaaacattcgacgtaggagggaatcatcttgaaatgcaaaggagctgccagta

SEQ ID NO: 659246 - DNA, 836 bp, Homo sapiens
  misc_feature (833)..(833): n is a, c, g, or t
aatttatgaagaaaagaagtttaattgactcatagtttcacaggcttaacaggaagcatgactggaaggcctcaggaaatttacaatcatggcagaagacgaagggaaagcaagcaccttctttacatggtggcagaagggggtgggggaggagccaaacacttataaaaccgtcagatctcatgagaactcacttactatcacaagaacagcataggggaaaccattcccccatgatccaatcacctccctccatgtcccttccccaacatcaggaattacaattcaacatgagatttgggtggggacacagacccaaaccatatcactcctccacctcaagccaccttccagagtactattaaaaccagtaaaacctgtaatgtgtagaaataatgtatggggattaactaacccactcaagacacactagcagaaaaagtcaagctactttaaaagaatcgataggggtacatctactatcatctgactttaaccctagtaggtgtttggggaaagagggttgccctacttctataatcagagcagcattacccatcagaagttgcacagtgaaatgaattttaaagatgtagagagtatcagtcagctattgccataatgctgcataagaaaccacccccaaactcagtggcttaaaataatcatttattctcatacttatgggtttgagttgtttggggtaggtaacctgcttcaaagttccatcctgagtccgtttggggaggcagtgactacccagagatgtttttccagtgatgatggtagaaggacaagaactcaagtacaataagcatgtttgttcccagacnaag

SEQ ID NO: 659247 - DNA, 596 bp, Homo sapiens
  misc_feature (418)..(419): n is a, c, g, or t
ctccatgtactctagccttttcatgacactgatattttcgtgacactgacttatagttcactgtttacctgttggtctaacagcaaatcataaacagtagttttcaacatacttctaaggctaaattcatttccagaagtagcaaagcttactagccaaaggctccacatttatcaactcttaagagctagacttgagagcctaacagcctatatgattttgtgtaaattgatctctataccctcagcttcttcatctcaaaagtgagataattgtactattctactttcctcatagtgcggttataacagattatgataatattacaaagtacttaatacttggcatatagtatatatattagctattacgtatctttgcaatttggggatatatgaaaatatagaaattgcatgtnntagttcactgctcgccactaccaatattgggttcattttggggcatcttcaaatgggtgaaatataccattattacagtttatcagtgtgcatctgtatctaccaaggagtatatattggcacacaatgatttctggtaccaaaaaggaaaggtacatataaacatgagcggctgcc

SEQ ID NO: 659248 - DNA, 257 bp, Homo sapiens
  misc_feature (184)..(184): n is a, c, g, or t
tgttattaaaatgtcaaaaaataacagatgctggtgaggttgtggagaaaaaagaacacttttacactgttggggggagtataaatgagttcaaccattgtggaagacagtgtggtgattcctcaaagacttagagacagaaattacattcagcccaacaatttcattcctgggtatatacccnaaggaatatattaacaaattgttgtattataaaagcatatgcacatgtattttcattgcaacacggtctctca

SEQ ID NO: 659249 - DNA, 911 bp, Homo sapiens
  misc_feature (908)..(908): n is a, c, g, or t
tgctgccttcttaccacacacacaattccttggcccccaatccaacctttcccctttccccctctttacccctggcctttaagtgcattcgccctggattccccccttttttttttttttttaaaaaaaaattattgcacaattccagctacagaccatactgaagctcagaattccatctgcagagccgaaggaaagcacactcttacatgtgcaaagggttgggagacgccacacttataaaaccgtcagatctcatgagaactcacttactatcacaagaacagcataggggaaaccattcccccatgatccaatcacctccctccatgtcccttccccaacatcaggaattacaattcaacatgagatttgggtggggacacagacccaaaccatatcactcctccacctcaagccaccttccagagtactattaaaaccagtaaaacctgtaatgtgtagaaataatgtatggggattaactaacccactcaagacacactagcagaaaaagtcaagctactttaaaagaatcgataggggtacatctactatcatctgactttaaccctagtaggtgtttggggaaagagggttgccctacttctataatcagagcagcattacccatcagaagttgcacagtgaaatgaattttaaagatgtagagagtatcagtcagctattgccataatgctgcataagaaaccacccccaaactcagtggcttaaaataatcatttattctcatacttatgggtttgagttgtttggggtaggtaacctgcttcaaagttccatcctgagtccgtttggggaggcagtgactacccagagatgtttttccagtgatgatggtagaaggacaagaactcaagtacaataagcatgtttgttcccagacnaag

SEQ ID NO: 659250 - DNA, 137 bp, Homo sapiens
tctttcgggtatgtgctcagaaaggaacagtgcagcacacacgaaagggttacagagggacacagaggagaccgaggtcagcgcctcaggaggcttatcaacattcagttaggaccgatggaggcgcaggcacttat

SEQ ID NO: 659251 - DNA, 235 bp, Homo sapiens
ttttcttgtagagacagattcttggtatattgcctaggctggtctttgaattcctggcctcaagtgatcctcacgtctcggcccgcccaaaagtgctgagattatagggcatgaggcactgtgtatggctgctatgatttcctttaaaccccccatagtaactagtcgtgaccccttctgtcgtctttctcccagccggtatagttaggtaagttaaggcgggcccgcttcttag

SEQ ID NO: 659252 - DNA, 143 bp, Homo sapiens
tgaatgatgagatggctgtggcaattttaaaataagaccacaataaaagatttctctgtagcatgtgatgctgtctgatagcattttactcgcagtaaaacttttcaaaactggagtcaatcctctcatcattcacctttgca

SEQ ID NO: 659253 - DNA, 108 bp, Homo sapiens
ggagacggccactgcctttcaagtgcatgcagctcactgatttcatcctcaagtttccgctacgtgcccaccagaagtatgtccgacaagcctggccgaaggccgact

SEQ ID NO: 659254 - DNA, 122 bp, Homo sapiens
gacaagtgagcaaaggtttatctccaaacatattagactggatgaagtaagatcagtaacggccacttgcgcaattacaggaggtctcattcccatcggaggtcgaggaggcccaccctggt

SEQ ID NO: 659255 - DNA, 566 bp, Homo sapiens
gaatcacttatcataccaagaagacaggaaaatctcaactgaagtgagaaaagacaagcaaatagatgccaacgtggtatgtgcgttggtattatctgattaagatttgaaagtagccatcacaaatgtgcttcaactgggcgattaaaaacggacatgataaatagaaagttggctgggcgtggtggctcatgcctgtaatcccagggaggtggaggtgggtggatcactggaagccaggagttcaagaccagcctggccaacatggtgaaaccccatctctaataaaaatgagaaaattagctgggcatggtggtacacgcctgtaatcccagctactcaggaggctgaggcaagagaatcacttgaacccaggagagagaggttgcagtgagccaggatcgcaccactgcactccagcctgggcaacagagcaagagtccgtctcaaaaaaaaaaaaaaaaagaaagaaggggaggtggttgtgagctgatttggcgccattgcactctcactcggtctcccaggcgggagggcaggggagggatctcagctcatggtagact

SEQ ID NO: 659256 - DNA, 223 bp, Homo sapiens
ggatcccatgttctccccaacacccggctaatttttcggtatttttagtagaaacgggttttcaccatgttggctaggctgggcttgaactcctggcctcaagtgatctgcacgccttggcctcccaaaatgctgggattgtatacaggcatgagccactgcacccggccttattgttattttaaatatttatttgaccatttttgtgttgggcgataacata

SEQ ID NO: 659257 - DNA, 707 bp, Homo sapiens
  misc_feature (165)..(165): n is a, c, g, or t
  misc_feature (176)..(176): n is a, c, g, or t
  misc_feature (196)..(196): n is a, c, g, or t
  misc_feature (206)..(206): n is a, c, g, or t
  misc_feature (265)..(265): n is a, c, g, or t
  misc_feature (299)..(299): n is a, c, g, or t
  misc_feature (317)..(317): n is a, c, g, or t
  misc_feature (346)..(346): n is a, c, g, or t
  misc_feature (353)..(353): n is a, c, g, or t
  misc_feature (355)..(355): n is a, c, g, or t
  misc_feature (362)..(362): n is a, c, g, or t
  misc_feature (365)..(365): n is a, c, g, or t
  misc_feature (377)..(377): n is a, c, g, or t
  misc_feature (399)..(399): n is a, c, g, or t
  misc_feature (401)..(401): n is a, c, g, or t
  misc_feature (412)..(412): n is a, c, g, or t
  misc_feature (536)..(536): n is a, c, g, or t
  misc_feature (544)..(544): n is a, c, g, or t
  misc_feature (547)..(547): n is a, c, g, or t
  misc_feature (615)..(615): n is a, c, g, or t
  misc_feature (629)..(629): n is a, c, g, or t
  misc_feature (631)..(631): n is a, c, g, or t
  misc_feature (643)..(643): n is a, c, g, or t
  misc_feature (676)..(676): n is a, c, g, or t
agtcccggcgggagcgcgagcagagccggggccgggcccgcagccaggcgccatggggcgcgcgccgcctgtgagcggcggcgagcggaccgcgggcgccgagcagggccaggcgggaggcgtcggcgcccgaggccgagcgagccgcggccgggccgggccgancgccgagcgangcaggagcggcggctgcggnggcggcggcnggatggaggcagcgccgcctccaagatggcggtatttggaggtggtgctggccgacgtnagctacctgattggccatggagaagagcaaagcnacgccggccgcgcgcgcnagcaagaaaatcctgctgcccaatcccancatccgnantgtcatncanaactacctaaangaccggggcgaggttacctttnanaagatcttttnccagaagctggggtacctgctcttccgagacttctacctgaaccacctggaggacggccaggcccttggctggaattctatgaggagatcaagaagtacgagaagctggagaaggaggaggagngtgtggtncgnagccgggagatttttgactcatacatcattaaggagctgctggcctgctcgcatcccttctcgaagantgccaatgagcatntncaaggccacctngggaagaagcaggtgcctccggatctcttccanccatacatcgaagagatttgtcaaaacctcc

SEQ ID NO: 659258 - DNA, 170 bp, Homo sapiens
  misc_feature (45)..(45): n is a, c, g, or t
ccttgtgtagactttgttgagtaatgttcagtttcttgtaaaaanaaaaacacaaagggggaaatttaaaaaataagggggggtcatccccaaattatttttcttattaattaaaaaattttttttggggtgtttgggaaataggggtttggtgggggggtgtgtgggcc

SEQ ID NO: 659259 - DNA, 621 bp, Homo sapiens
tataaaacaagcaaattttattaaagggaaaatttggcgggttatagggttggcgggtgaaatttggtgggtgaaagggtttacttttcaccagtctgtccgggcatggcttctaatggatggtcagagtccaccgggatcaatggataggccagggtgcacactctggtagtatttcccgcatgctggggcccagttcaattattatggccactcaaagctggggcagttggttagcagagaatggaccaatttcggcttgtgcctgggtctggatcatcttcagaagtctggctggtcccccgagggagcgtatcttccccatcttttccataagcgaggtgggagccctagaagttgtaccgactcccaggcgacttttccgtcttcttgggcggaagtctccccgggtccgccgattcctccctccctgggtcgccggagtcctggggtgggcgtaaaagtgggtctacaaatctctcctagccactaggagaagatctgggtctcgacaagtctcaaattatgacgacgcagaagggggatctctacgagcagatgaacgggcctggggcaggtgcctcccgccaggaaaacggcgccaggtgatctccgggactg

SEQ ID NO: 659260 - DNA, 318 bp, Homo sapiens
  misc_feature (15)..(15): n is a, c, g, or t
  misc_feature (177)..(177): n is a, c, g, or t
tacctacagactganccagtgggcttctcctatttaaaaggattttttggctgggcgctgtggctcacacctgtaatcccagcactttgggaggcctaggtgggaggatcacctgaggtcaggactttgagaccagcctggccaacatggtgaaaccctgtctctactaaaaatacnaaaatcagccaagcatggtggtgggtgcctgtaatctcagctgcttgggaggctgaggcataagaatcgcttgaatgcgggaggcggaggttgcagtgagccaaaatcatgccactgcactctagcctgggcaacaagggt

SEQ ID NO: 659261 - DNA, 344 bp, Homo sapiens
aacctgtttccaagggctttttaaaaaccccccaagaaacccttttgcatccttcccacatctcctttgattaggtttattactagatattttttagggcggcaataattcagatgaaatatttgaagaacccttgggtttcccctgataaactgccaactttggctttgaacctttggaaccaatgacctctgtttttaagcagcttatggaggtctttttgctaataaggggttttttaccctttccccccctaaattccctagggggttgcccttccatgccttccagattgtaaaatccttgtttttcattttcaaataaacccattttttagggtttta

SEQ ID NO: 659262 - DNA, 205 bp, Homo sapiens
aactacttctccggcgcgtatgcgcttctctgacctctacatggcctccctcagctgcctgctcaactaccgcgtggacttcaggcgtgctacccacgccgtacgccgctgcagcgacgaggcacccctctggatggaccagctctgcaccggctgcatgaagaggtcagagaagcgcacgaggcgccttgagaagtatgtgggg

SEQ ID NO: 659263 - DNA, 863 bp, Homo sapiens
tgaccggcccaaatattaggtcgttctacgccgatttgttggtgagacgatactgtgctaaaacaccgtctctgtttgaaggtggcccctgtgcactttgaaccgcgtgtgcaatacgcgaaggtcgcgcccttttacaggaggacccgttctttatgaaagatttgtctgctcttgagacgctgtgcttcccctccagtggatacctgttctgcgccccgaagtatccttgggagccaccaatacgacctaaaatgcgggggacttccttaaccatgtccattggcgagaggagatctattttttcttgggccaaaaggtgcccacgcggcccaggacggggggaccttgcggcccccaacttgggcagcccgggtaaaagccggctccccggtccacaagatgtgtttctgcgcccccgcctcgtgcgagggctgggcctccacccacacccgccgaatattttgtcaacacgtgataaaaccacgcacagcagacaccccacgcgtcggcaaaaataggggcgaaaaatgcctgcgcgcgcccccaatgtgttgtgcccgcacccaggcgccccaaaaacatggggtgtttacaggccgggccacactgccgccccggcttgtataacacgtctcagtgtcacatagaaagaggatacttcacaaggcccggggggtgtttaacgacaattcgttcgcgtgaactatacccctgacctcatacaacgggtggcgtcgtgaaaaccaccccccaaacggggcttctcaaacaaacaaagaggagcgagaaagtacataatagatttcccgagggttttgacacaatgtgaaaaattaggtgcttttaggcccacatgacaa

SEQ ID NO: 659264 - DNA, 773 bp, Homo sapiens
aactatccacacaaagaagcactttaatgagaatgaaaaatcaggtgaatgatcatagtacctggttctaacttcataccactgaacaggggcactgaagatggtagtgagagacagatcttgaattgctaacactcatccctgccccatctccacagtagtttgctgtgtgtgcacggagaacgagaatctgtgttgtttaacgggagacgagagggcagtgattgtgggcactttgtccgttggaactctaggctactgcctctgttacagcgagaatagcaacctaccaaggtcataagctcagactcggctacccagcagagggagcatttaaaccagtccctaaccagtggtcagaacctgagtttccacaaagccttcaccacttgtggacataatagtggtccgatggtgcgtaatgtgaaaggcagatctaggccactaatggtattacaaattcttgggcaaagttcctggggtgctgggctaagcttcagaactcatgtgtgtaccttaggtggggcattgccaccctagttgagataccagctggtggtggccaagcgtggttgctaccgtaccacccctccctcaactgcaggtagtacaagcttgcagcttgcctgtagtctcagtctactcgggatgctgaggcaggtgagaatgggcgtcaacctggcgaggcggagcttgcagtgagccgagatcgtgcgattgccgtccagcctgagcaacagagcgagactccatctcagtaaataccctgtcat

SEQ ID NO: 659265 - DNA, 1182 bp, Homo sapiens
tcttaagtaggcacagtaggagcagctactgaagatagcaaagatacacgaaaaaacttccagaacatctagggagaatattcaataggaaaatcgctatggttcaaaacctagacacttttaacagtagaacagcgttctagagtagtaggacgacgtagccagtgaagataatgaatagtacgaatgtagactagactagacagctatacatatttcgacatagagggtcgctagtctagcccatatgataagaggccagatatgtctatggaagtatccaaagtatgcacacgatattactagggctaagtagccacgcaggttataactatgcactagtatagtagtagaacacagctagataaacggaaaacccataccacgacaacaagagcttactatcgataatctaacagagacgagtgcaaacatcagaaccacaattgttacatattgtgggcatatcaaccacaaccaagagacacaaaagaggcgccgcgccggcctctctacagagggtcaatacgcgcactacgaagtgtgtggactccaaaaagcatgtatacaccgcggtataacacacaagaacatatctacaatgaggataacgaagaaaggctagagttaccccaattacatatgcgtggaacggttcgagatataataaaatatagacgccatttacgagcaccacaacacgtagagccgcccgtggcgatcacgcactaatgatatccaccgacatcagtgacctacccgagctgcaatcatgatcggcggagccatagaatacactcacgccgtatacacctacacatgagaacaaacaaccttccagatgcatgctggcagtagacacagaggtgcaaagacatcacataaatccaacgctagcaacaccatggagtgagatgccctctggagttgaccgcgaatcataagctacgcttatcggagacgaacaacagacagaggacctagaagcgccatatagaaccaacagacaacacgctacacatcccacaaccgactcgaggaactgccgtagacatcgcccgggatcaaaacaatgtatgaccaatgccaacgaacgagccgtggcatgtcctatcagcacagcgtagtcgggtatacactacgccaggcgcgcctcgctcacttcagaacagcaacgccacc

SEQ ID NO: 659266 - DNA, 1248 bp, Homo sapiens
  misc_feature (1001)..(1001): n is a, c, g, or t
ggtgggaatatcccggtgattaccccctgtgccgcgactcttacattttctaaagagggaattttccacgacactttcgtagaagaaatcatcctgcgcgaaatgatactacgttgctcactatacaacacgactttctctaggccgcggtgagaaaattatcgcgccctccgtggttttccatcgtaccctttgtgggaatttattctggggccccccacacaccaggacttggggggccttggtaggggaggtgtgcaaccattaatcgctgctttttgagacgcttcacaaaacgcgggccgtccttttaagcaaacaagaagaattggtcatggtgataaagaagacacccctctcttgccaaaaggagcccttctcttcggaagaactgtcgtgtgagggacactttttccacgggtttctttcaccacggaggttttctctcccacgtgttaacacacacaaagggggcactctcacacgaggccttttgtccccgccacactgtgggcccacaaacacacgaggggagggacaaaatatcctttatttatcgacacacagcggtggctctttctttgctcccctgttctatgcgccctctaaacaaaagggtttgtcttctttcccccaaggggagcgctggtcgtcctacagggaggggggcgaacacataattaagacgacgcacaggtggggagagcacacacacacactctgtgggtataggggggagcacacgaggggccccacaccaagcgagctttgtcgagaagaggggggacccctcaagagactctccttgcgcctgtgggtgtctatacaccacccggcccctcttcccgagaaacacaccgagggtgtcgtcacataaacctctccctcacgggagtggccgcctgtggaccacacatctctttctctcttgtcccctgaggacgtctctcccgcccacccagcagcgccgcttctcctccacaggcaaacgtgtctgcgcncccacaggtggggccccacaggcggggaaaaccagccctctggccacaagaatgcacgcccaccccacactgggaggcccaagaagggagaaggcctagagaggtgttggcagctggcccccacacgcgggggcgccacaagattttccaaccttttctgccttttaaaaacaccgtaatctttgggcccgggttttaaagtttttgtagaacaaaaaccctaaagaaaaaggtgtggccttgttta

SEQ ID NO: 659267 - DNA, 158 bp, Homo sapiens
ctgtgcgtcagcaccgactctccatctgaactgccatctgctctagtcataaaatccccacgccagtgcccaagtccatccccatcagcgagactccaaatatccctcctgtctccgtccaggcaagccgtggactagtagccaagcgtggactagtg

SEQ ID NO: 659268 - DNA, 412 bp, Homo sapiens
ctgacatgtcacatttatgccggtggtgagtcttgtgtctgctaaggctccgctcctgttctgggttgtgaaagggttggaaaagcagtccagtgcagtagggtcagacagggctgcatgcagattccagctctgccatgtattgaccttatggcaccaggcaagttactttcctaagtttcctcatctgtaaattaggaataacaagtactttttgggttgttgcaaaggtctaatgagctccacatgcacctccacagtgcatcacctggcatattctgggtacatgatactctctgccactcaacgatgtgttacccaggagccatgctatgtgtggaggaacaatggggagcataacaggcataatccatgctgtcatgaatttcccattctgtctggggacacagcc

SEQ ID NO: 659269 - DNA, 259 bp, Homo sapiens
  misc_feature (4)..(4): n is a, c, g, or t
  misc_feature (104)..(104): n is a, c, g, or t
  misc_feature (107)..(107): n is a, c, g, or t
  misc_feature (126)..(126): n is a, c, g, or t
  misc_feature (132)..(132): n is a, c, g, or t
  misc_feature (161)..(161): n is a, c, g, or t
  misc_feature (234)..(234): n is a, c, g, or t
tggnggaaaagcgcattgaccaccgggctgccgggcggcactagtggcgccttgaagaggaagctgagcagggacagcacggggtggaaggtctgcggcttggngtncatgttagtttagaagttnacgcgntggcacagtttggttagcagcgctaggtncagcatgatgggtgcggccagcagggagtttttatacgtgttgtgcagcaccagtgtgttggttttgcccagnattagttccgaggtatatttattca

SEQ ID NO: 659270 - DNA, 510 bp, Homo sapiens
  misc_feature (502)..(502): n is a, c, g, or t
ctggcaatccacgcatggtaacaggagagagagagtgaagagggaagtgctgtacacttttaaacaaccagatctcatgagaacttactatcataagaacagcaaggggtaaatctgcccccatgatccagtcacctcctaccaggttcctcccccgacattgggaattacagtttgacatgagatttgggtggggacacagagccaaactatatcattctacccccggcccctcccatatctcatcacctcacatttcaaaacacaatcatgccttcccaacagtcctccaaagtcttaactcattcctgcattaactcaaaagtccaagtccaaagtctaatctgagacaaagcaagtcccttccgcctatgagcctgtaaaataaaaaaacaagttagtgacttctaagacacagtggaactacaggcattaggtaaatgcttccattccaaaagggagaaattggccaaaacaaagggactacaggccccatgcgtgnattgccag

SEQ ID NO: 659271 - DNA, 1075 bp, Homo sapiens
  misc_feature (648)..(648): n is a, c, g, or t
tagagaacagagtttggctcttgtttgcccaggttggagtgtgatggctcgatctgtggttcaccaaaaccttctgtgccctcctgtgggtttcaagcaattctcctgtgcctcagcctcttgagttagctgggttaataggcgcatgtgccaccagtgccgtggctaatttggtggtttttagtagagacagggtttctccatgtgtgtgggctcaggggtgggtcttcaaactctcccaacctctcagggtgattctgtgcccttccttgtggcctcccagaggtgcgtgggatttacgggtgtgtgtgagccagtgtggtgccgggtcccgtgtcccccttccttatttatatagggccgtgaatatacaagagttagaaaagagattcactttttcgctttcagcgtgggtgcgcgtgaaaaaaatttttcttagaatataccataacgaggttcttatactctccctctttatttccccttttggtgtataatctcagtgtttgtgacaccccgaggaagcggtgcgtggagaggggggaaactcgtgggtgcttccagcgtgtttgagcgtcttactgtgggtgtccccccgagagaaaagggccgtggtgtgtgaacagtgtgcacaccattcttaaacantgtggcagggggagttgggtgaacaaatttattatcgcccaaatttctgtgtgttccctatagaggtggggggcatataacctctccctctccttttgggggcccatttgtgtgaaacctccacttttcaaaagaggcattctataggggggccatcaattcttttttaaccgaggggtgtcctaataaaaatttcaactctacatttctctggggccttgtgcggaaataaaattcctccaaacgttgggcgcccttggtgcaccacaattttccccaattttgtggtgtcgcgtggaggggggggctatatcccggtgggggtggtttcccctttgggttacccagagggagatgagggaggagcgataaagtcgacacgtatgatcggtaatattatgagacaacgacagaaagtagcgcatcg

SEQ ID NO: 659272 - DNA, 461 bp, Homo sapiens
  misc_feature (59)..(59): n is a, c, g, or t
  misc_feature (101)..(101): n is a, c, g, or t
  misc_feature (365)..(365): n is a, c, g, or t
  misc_feature (437)..(437): n is a, c, g, or t
  misc_feature (451)..(451): n is a, c, g, or t
aaaatgtgctcaacatcactaatcattagggaaatgcaagtcaaaacaaaaaggagctntcacctcacacttgttagggtggctatcaaaagagagataantgttggcaagcaggtggagaaaagagaatccttgtgtgcagtgagaatgtaaattggaacagccattatgaaaaactggttccggccgggtgtggtgctcatgcctgtaatcccagcactttgggaggccgaggcaggcagattacctgaggtcaggagttgaagaccagcctggccaatatggtgaaaccctgtttctcctaaaaataaaaaaattagctgggtgtggttggcgggtgtctgcagtcctagctactccggagntgaagcaggagaattgcttgaacccgggaggcagaggttgcagtgagccgagattgcgccactgcactccancctgggcaacagangcaagtccgt

SEQ ID NO: 659273 - DNA, 275 bp, Homo sapiens
agagagctagctgatcttcaacaaacctgacaaaaacaagcaatggggaaatattccctattgaataaatgctgctgggataactgagtagccatttacagaaaattgaaactggaccttttccttaaccatatacaaaaattaactcaagatggattaaagacttaaatataaaacctaaaactataaaaaccctgggaaggacaacctagggcagtacctttcagggacacagggcacagggcaaagattttcatggatggaaggatgcccaa

SEQ ID NO: 659274 - DNA, 190 bp, Homo sapiens
gtttctctatgtcgggacactcattagcaagaactttgctggctctacttgaggaacatggacatattttgttcccagaggatggatggatggatggatggactaaacagggatttacaggaaagggggaaaggcactcaactgaaggaatggtggatggtcctccagttttcctgcccctccccatgca

SEQ ID NO: 659275 - DNA, 297 bp, Homo sapiens
tccatgtgtcgagagaaattagcatcttggccagcgcggctaaacggcatcctgccggtttaccccccaaatcactgtcgaattgcggccatcgtgtttgacggggcgatttcagatcaagatcacgatcaaaagcgcagatcaaaagaccgctgacttcgtcatcgaaaaggatgtaagggccgcagcaacagcaacagcaacagcaacagcaacagcaacagcaacagcaacagcagagccagctgccacagaaaagcacatatttaaaactgcctaatatctctcggaccaatg

SEQ ID NO: 659276 - DNA, 888 bp, Homo sapiens
  misc_feature (45)..(45): n is a, c, g, or t
  misc_feature (625)..(625): n is a, c, g, or t
cggaggacgcagcagtcgttggctggtgtgccgtgtgttgtgttncatcgtgtgatgtcgctacctcctcggccccggtttaccccagggttcctcagcgcccgtttgtgcccccatttcttgtaccataattcgtccgccgaattccggttccatcccccggctctcatacctgggccccccccttcgcccctggtgcgtgcccttaaccccgggtgcgcccggttcctctctgcgttcttacagctcttctttgcgccctctgtaccacccccaccactcgggcccgggatttggcccctttgtccccgggttgtttatcgggccacccctctcccgggttcgcattaggccccctcccgggtgttttccccggttcgggttaccccgcgcggcgtctgccccccccccgcagcatttgtgtcaaccccgggcgtcttctggtttatggggcagtcctcctcgagattccgcgtctttcttgcttctccccccgccaacacgaagggtcttcgcgactctcttctccccggagccgagtcaagcgcccacgggcgagaatgggtgggacacccacctagctctctgcggtctggccccacccctgtttgccccgtctgccgcnctgtgctctggagacccgttcccccacgctctgctgtttctctcccttgatcggtcacccgcgcctcctgcacccatcgcagttctcctgtgtgcctgacatgttgcacacgggtgccctttgtggtgcctctcccccccgcgtgacgcttcttctccccccgcgccacccccccggggtgatagggtgtatcccccctcccccggttcttttattccctggggggtcccccccaaatatttaaaaaaacttttttcaaaaca

SEQ ID NO: 659277 - DNA, 483 bp, Homo sapiens
caatatttatcttttttaggggggcggttatttccagccgacccttccatggcgatgattgcacactgagagccacaaatctgcattagcatcaccaggcggggcaacccgccatttgtcgctgcatgctgtgcagatcaacaataaatgcctagaggttactttggaggcactgccgcaagcatggcgagctcaaagggtcgccaggtcactgctgtgagaactgagatcaaggccttggtgaccaagtttatggtacactcactcattcatggtattcccccacgtcttatgatcgaacaggaagcgtttctccagtagttcgattctcatcgtctgaaattcccagcatgagtgcgagagaaggtccatatcagtcctgatactcgaaccactgatatcttgaatggaacggtcttgttgccctacgcccgtatatgttgcaagacaaacagcgactgtcatgaagcgcccccctgaaga

SEQ ID NO: 659278 - DNA, 373 bp, Homo sapiens
atatgagcggtctagcatccgattgaatgtagtgcattccatgcagcatcactgaatgcagtggattccatgcagcatggtaaaatgcatcccgattaaacgcagtgcattacatgcagcatggctaaatggatcccgagtgaatgcagtggattccatgcagcatggtaaaatgcgtcacgattgatgcagtcgactccatgctgtgtcattgaatgcagtggattccatgcagcatggtaaaatgcatcccaattgatgcagtggattccatgcagtgtcattgaatgcagtggattccaggcagcatgataaaatgcatcccaattgatgcagtggattccatgcagcgggtttaaatggatcccgattg

SEQ ID NO: 659279 - DNA, 360 bp, Homo sapiens
catgatgtttagtgagaactatacagtggtagaaaagatagaactacttgagataatgcattattcttagcattttataggcattataacatagaatcctccatatcatttcactttctttttacaggcaacttttttgaaggacttatctctactttgctaccttttcatctttattttctcatctcccattgttactccttataggatagcactccactctggtttctcagttgtccaaacaggtgccaactaaagttgctattgagacttaaaaatgctaaaatctaatgggtctttttgtccccccatcttcatcttgcttttcctcttaatatcattcagcatttgctgatcatg

SEQ ID NO: 659280 - DNA, 920 bp, Homo sapiens
  misc_feature (10)..(10): n is a, c, g, or t
  misc_feature (70)..(70): n is a, c, g, or t
  misc_feature (126)..(126): n is a, c, g, or t
  misc_feature (145)..(145): n is a, c, g, or t
  misc_feature (154)..(154): n is a, c, g, or t
  misc_feature (162)..(162): n is a, c, g, or t
  misc_feature (165)..(165): n is a, c, g, or t
  misc_feature (167)..(167): n is a, c, g, or t
  misc_feature (252)..(252): n is a, c, g, or t
  misc_feature (285)..(285): n is a, c, g, or t
  misc_feature (291)..(291): n is a, c, g, or t
  misc_feature (296)..(297): n is a, c, g, or t
  misc_feature (304)..(304): n is a, c, g, or t
  misc_feature (308)..(308): n is a, c, g, or t
  misc_feature (316)..(316): n is a, c, g, or t
  misc_feature (320)..(320): n is a, c, g, or t
  misc_feature (322)..(322): n is a, c, g, or t
  misc_feature (324)..(324): n is a, c, g, or t
  misc_feature (334)..(334): n is a, c, g, or t
  misc_feature (336)..(336): n is a, c, g, or t
  misc_feature (393)..(393): n is a, c, g, or t
  misc_feature (399)..(399): n is a, c, g, or t
  misc_feature (434)..(437): n is a, c, g, or t
  misc_feature (459)..(461): n is a, c, g, or t
  misc_feature (474)..(474): n is a, c, g, or t
  misc_feature (476)..(476): n is a, c, g, or t
  misc_feature (478)..(478): n is a, c, g, or t
  misc_feature (486)..(486): n is a, c, g, or t
  misc_feature (489)..(490): n is a, c, g, or t
  misc_feature (495)..(495): n is a, c, g, or t
  misc_feature (499)..(499): n is a, c, g, or t
  misc_feature (504)..(504): n is a, c, g, or t
  misc_feature (506)..(506): n is a, c, g, or t
  misc_feature (509)..(509): n is a, c, g, or t
  misc_feature (549)..(549): n is a, c, g, or t
  misc_feature (553)..(553): n is a, c, g, or t
  misc_feature (563)..(563): n is a, c, g, or t
  misc_feature (576)..(577): n is a, c, g, or t
  misc_feature (582)..(582): n is a, c, g, or t
  misc_feature (605)..(605): n is a, c, g, or t
  misc_feature (789)..(789): n is a, c, g, or t
  misc_feature (792)..(792): n is a, c, g, or t
  misc_feature (796)..(796): n is a, c, g, or t
  misc_feature (809)..(809): n is a, c, g, or t
  misc_feature (904)..(904): n is a, c, g, or t
tttttacaantgctaaattgtgaatctcagagtcttaagatagaagccaaatatattcctcttgtaaatnaagaaataaacctatttaaatcaccccctgtgtggctccctcatagtaaaaaagcntgggggcataagaggtggnaggcacganataatggncananctgcctgcagccagcacatcaacctgcaccaacccaaggcaaacaccagagccctggacatggccctggagccagggtcccagcnctagtaaccgggggtggggaggtctctgcaccntggganccctnnaggaatngctnaggctgtncttncnanatcattgatncncgggcaggcggcaacatgccaccctccccagtggcagcgccttagaaacagcttgcntattanaatcatggtttaaaaaaaaaaaaaaaaatattttnnnnaggtagatggaggcaggggttnnngggggcccgtacntntnctcagggnttnnctgcnttcntcacntnttntttttttttggccccatttttaagcaggttgggatttttnattnttaaagatanttttttttttttnngtgcnagcgcggacagtggtgatttgcncaagaccccctttttgggaagagccttctgatgctgcttttggcctgcaggttccgtgggggacccgggagctccattcacctgggacggcttctggtttttcttctgcagttttggggatttggcaggggtgctggggctccgggtgggggcgccaggggctggactcttggtggttggcgtnccntttncctgggctgggancttagcctttgtcctgttcctcttcttcctgcccatgctggggggctggctcccgccggtggctgcaggtgtgccatcctccgctggcgtgccancctctgacttgcgttt

SEQ ID NO: 659281 - DNA, 106 bp, Homo sapiens
  misc_feature (48)..(48): n is a, c, g, or t
gaagtctgtacttgtatttttttatcaatttaatttggctggtggtanaaggtgggtatttctgcctttgtaccaagaacttcgagaactgatttattgctaatat

SEQ ID NO: 659282 - DNA, 599 bp, Homo sapiens
  misc_feature (341)..(341): n is a, c, g, or t
atacaatatgacggtgagccatcacgtcactgatgagaacagatcgaactttaatgccttccttagaaattatgttgtattgaagtcaaacctcaatcacaatgaacaaatatatttgcataaggagaggaggtgtatagtgccctggcaggaattaagactaaaacgtgggagtaaagctgtagatgcttctgttgctttttaaccaagaggccacagacacaggccgggaggctgagagggcaacctgccatttggccagcgtcactttgcgattgttataaatactttatcatagcttgagtacagacatgccttttcaatgaaatacatcctgactnattttgcagagggtactagtttcatagggtgactgtaacaaattaacacaaactattaataggtggcctcaacagaaatgtcttctctcacagttttggaggagttggcagggccacgttccctcgaagactccaggttccccttcttgccttctctcggcttctgatggctcccaactgctgggcatcccttgggttacagctgcattgctccagtctctgcctctgtcgatgtgtggcccgcactctgtgtgttgt

SEQ ID NO: 659283 - DNA, 116 bp, Homo sapiens
ggtccgtatttcgagcgaggagctgttgtagttggtggtctgggcgcgtagggggctcgtggaaaaccccggtctgttgtgctgatgcctggtctgctggttcgtttctgggatca

SEQ ID NO: 659284 - DNA, 132 bp, Homo sapiens
ccgcctactactactactgctcgaattcaagcttctaacgatgtacggggacatgacttaaggaacttatttatggatattagtaacatttttctaccatttgtccgtaataaaccatacttgctcaaaaaa

SEQ ID NO: 659285 - DNA, 280 bp, Homo sapiens
cacggttttgctttatgttatttagcggtgatgagagcaagctgaaactgtgagaagagacataaacgcaacaaaccgaggtcatggttcatgtcgtggagaatccagagtgtcccactggtctagacatcattccaattgtagctggtgtggttgctggaatcgttcttattggccttgcattactgctgactactggaacgcttttaatgactaattcatgacagaagggagttcgctaaatttgaaacaggagaaccactgaatgcccaatgggaca

SEQ ID NO: 659286 - DNA, 376 bp, Homo sapiens
caggcttcctccccaggtcatgggctgggccttgcccttttttatggatgcccaaccagggtttgagcccactcccatgtgagacgtcacgcagggcagaaaccgctcccccctttggtttgtttggggacccccaaaaagggattgggatgggtttgccctcccggatgaggatgagcccccccgcccgtccctttggggttggggccaaactgtcagggttcctccccaggtcatgggctgggccctgcccttttttatggaggcccaaccaggggttgagcccactcccatgttagacgtcccgcagggcaaaaaccccccccccctctgcttcccttgggtttttttataaaaaaatttcctgcggccggga

SEQ ID NO: 659287 - DNA, 178 bp, Homo sapiens
gctgagtttggtaatttgcacttggttttgtaaattggaactgctcctctcctcagcccgcaagaagcagataggaagacagtcttcagaccccgagacatcagcgaagaacactctctgattgtgtatctagtaactctgcttggcgtaccgacgctcgagattctgttatcatggt

SEQ ID NO: 659288 - DNA, 1773 bp, Homo sapiens
gagagagagagaatgggcagaagaacaaatgctaaaagagcgggaagagagagagcgcgcctgcacgcagcaacaacgcgcaggacagcagctcagcagcagtcatccaggcagcgggtgaagcaaattcagcacagcacacgtggcaacaggcaacaaacacgccaacagggcagttcggcacaatttgcaagcaaccgcagaacaggcgatagcagcagtgcaagcagcagcaagcactttggctgatcagttcccgttatactaggaacagtgactctacgtaagggagagcatcagcagcattcgagcacaggcacctaggcagcaaacaggacctcgaagcgagcatcctagagtaggaagaaccgaaaggacccgagacaagacagaacaggcgacgctgcgcaggcaccgaagcgcaacacaccagcgcagacgaacaagacgcgaacaacgcgtacgtacacataacaccaaacaacgcaccgcaacagaagacgagacaccgccgagaacaatacaatgcgaagacaactgcaccgacaagactaagcaagcaggagcacaaacgaaaacaagagaaaccacaaaacagacaaggaatacaaggagataaagacgcacgaagaagaataggagaacagcagggacagaggcacgtgacacaacgaaaagagaagcagcaaaagaaaacagacatgaagaaacacaacagaaaagcgagaaaggaacaaaagacagcgaaacagacaaacaagaaaagaaaagagacgaacgaaacaaccacgacaatgccgaaccaggacaaccgatcaaacatagaaacagaaggatcacgaccacacaaaggacataacacaccacacaacaagagaaacaacacacacgacgagaagaagaaaaaacaggagaacaagaaacagaaaaggacacgaaaagaagaaaaacaaaagaacggagacagatcatgcaaagacacggcagacaacaacaaaagcagaacagaaaaacacaagaccactgagacacgagacagaggcagacaaggggaacacgcgaaaagagaacagcaagagggacagaacaccaagcggagcagcgaacagacaacggaccaggaaaaagcaagagagacaccagacagaacagcaaaaaaagagaaacatgggagacctgagagcacgagagcagcaccacggaggaagaacacacagaaggcagcacgcaagaaaagcaagcaacagaaagaagaaaagagaaagcgagcaaagaacggaaagaaaagcagacaaaggagaaaaacaaagaacagagaacaaaaaccgaccggagccatgaatatgagaaaacgacaggaaacgtaggacggacacagaggagatgaccaactcgaacgcgcaacgcaaccgaaggcaaagagaaacaagacgcggcgaagggaagacgagagagaagaggagacacgccgaggagcagaggacatacaaatacacacaactatataacactaaaaaagcaaatagataataagacaaaaaataacgagagagaaacaaacgcaacaagacaacaacaaataataaaataacaaagaaaaaaaataaaaacataaagcaacacaaaacaacataagcatcaaacaaaaacacaaaacaaaacaaagaacaaaagacaagactaagaacaaacacatacaccacacaaaacacgaacacaactaagcactagaacaataaacacataaacacatagcaacaaatacatatataa

SEQ ID NO: 659289 - DNA, 542 bp, Homo sapiens
aaaaaaaaaaaaaaggggcgccgctcgcggatctagaaactagcacagcaggtccgtggatgggctggatgagtgaccaggccagcctctgtctcaggacattccagaaggacaaggagatgtctctccctctcccaaagcaccagcgttcccttgccttcccgtgtgggccctgtgttccggggtttgccctgttggttgaccccaagccttctgtccactttccttaacccagggacccttgcacagccagaaacttgcctttgggccctacggatggccactgggctctggtctaaagtgccttgggcttgtggtggccatcaagaagggagccagtcaaggccttgttgaagggccgttagaacctttgtattataccctgtgcaccagcagttgaccgggcaagagcccaaacccccttccacgggggttcccagcacccaactttttctaaatctatgatgtgacaccaataaaagcccaaggctccttgtgtcagggcaacagaaaaacaagaaaagaagaagaacaaaaagagg

SEQ ID NO: 659290 - DNA, 294 bp, Homo sapiens
cagagatgatgccactgcactccagcctgggcgacagagcaagactccatctcaaaaaaaaaaaaaaaggctgctgaattcgggcagggcttttcagattccgggcccgggtgatatcgtaactccgggggcacctgggttacgtggcccttccaagggccctgcaatttaccctcttcctccattaagcactgggcccatgtctcttacttctctttacccagttttaacaggggccggtgtaagagccttcacccagggaacagtacaaccgtggcggggggggggatcctc

SEQ ID NO: 659291 - DNA, 656 bp, Homo sapiens
ttggattaactatatcttggtcatacatccactctgtccatcagcaactgtagatccttccccaaatgattgctgctggcaaagctgagcaattcatgtctatctgcaacagctgacttcttatcaagttccccaattaggacattgatcagatgtgaatatttaattacaatcggcacttctacaatcatgtactcaaaggtgatatctgctttcaacaatgcttcaggggaaaaatccttttctttacaaacttccatcagttgaggagtcagtcttgtattgcctttagtgagaaacaaccttgggcagtttttatggcatcataaatgagaacgacagatccttcgatgtcatgctggtaactaaactgagaatccagtagtgcccggataactaatgagccataattatgtggactgataccagcccacgtgaagatcatcgaatgtttacatggcgaatgctcctgcattcatatccatcttattttgtacttcaacaaataatcagcagcaagggtcctcaagagtcacctgcatcattcaacttgcactgccgtcttaacactctatacaccccttcagggatccaccaccacaaaaataccaaaaacaaaaaacaaacaaaaaacaacacaaacaaaaaacaaaata

SEQ ID NO: 659292 - DNA, 955 bp, Homo sapiens
gttcgacggtactgcaatgaatgctggagaatccgtcccgggcctataatgagatctcttacccactcagccatggctgacgtgccgtgcctcccggagattgcagcttacgcattgtccgggtgaggacaaataaccatccaagttgagaattctcactgaatgctaagcagcgatctggagccgtcaacaaagtcctcggcgacgggaaagcggtactagccgtaccaatagacctagacgtaggaggcgcgcatcgcaagataatggcgacgagagctagatgggggtgactcgcgactggcagcatgatggtagttgagtgactcttggaagcgggttttcacctgtcctggtagcgtgagcgtgtctcacagtgcgccaagcagcgtgcatcatgtaacaagttcctcttgctgaactcaacacggatcctatagacgagacatcatcgaggttttgtatcaccaacaaatgacacgccataaggatgcctcgagtggatgctagcgagagcaccgtccctcaagcacaaacgcaaaaagacggtcagtggtctcgcagtggcttgtttgtgactagtggatctttctcagagagttatgcggagccctggggcacagactgtggtgggttggtaagaggccaaggggtaggacggaaataccatgtgggaggttcgagggcgagattggaagggccaagacaacaggggagaccttaaggtctcggacagctggattcccaaggtggctcggattgtagacagctaagatagaactccggtagtggcgggaaaattgaagggctcccgaacaagggcctccaagaggcttggtgccacagagggtgacggggccgaagcgctcgggtgatggcctggccacgggaggcaggtcacggctggaccaagccctggtcgaccagccggcctggtcgctggcgccaatcaccg

SEQ ID NO: 659293 - DNA, 195 bp, Homo sapiens
tgagcatgaccttatgcatattcatgtccatccatgctggcctgattcctgatgggtgccacgtgatgcactggtggactctactagatgtctgacgctgcatgtgcatcaatgcttgtgcacttggcctgtctgttttacaactgtctgtgactttgtaaaaccgcttgtgatctgtgacttgtgaaaaaccct

SEQ ID NO: 659294 - DNA, 685 bp, Homo sapiens
cggtagtataagacacgtacactgaagcgctgtaaagtccctgggcggtgcccggatctaacgtctacagtaagctcaacccccttagttacagaaaaactcggcaacaggcagtggaatggatgagacggcaagtcgccgcggacgcctgggctctcagctgctgaacaatgacatcgtttactccaggggtggaaatccaggtccatggctgacaacccaacaaggcggggacccaaattcgtacagagatgaggcagagtggagagaaacaactctggctgggccagagtctccagccactacttcttattcctgggcttgagctcttcggctgcattacgcaggaaaatgtagttttggttctggggattataaaattcatgtccctttgaccagtcgtagctggaagcgtatgcaaatatgtttccatggtgattgaaacagcaagctgagatgggctgatctaactgttccgaagtttttagttttgttctggcatctttgtcccagaagctgaatctaccatcagatcccacagttgcaagggtgccatgaacaggatggaacgcgattccatttaccgcataaatgtcctgaggagctgaagtgtaggttccattagatcgatgacatttaaaggtgaagttatctttggcgggggtcggggggtcgatatagtgaa

SEQ ID NO: 659295 - DNA, 210 bp, Homo sapiens
ggacgagacaggcgatcatctagtcagagagctcgtagctaggactacaggcatgtcactgacttggtagttttttctttgctctctctctctttttctttctttccttctttctttcttttctttctttctttttttttttggtagagacggggtctggctatgttgcccaggcgggtctcaatttccggggctcaagcgaccctctgg

SEQ ID NO: 659296 - DNA, 1047 bp, Homo sapiens
  misc_feature (21)..(21): n is a, c, g, or t
  misc_feature (73)..(73): n is a, c, g, or t
  misc_feature (78)..(78): n is a, c, g, or t
  misc_feature (120)..(120): n is a, c, g, or t
  misc_feature (380)..(380): n is a, c, g, or t
  misc_feature (866)..(866): n is a, c, g, or t
  misc_feature (1022)..(1022): n is a, c, g, or t
  misc_feature (1047)..(1047): n is a, c, g, or t
ggagaacccccaataaaagtntccctgctgtcctggcacaatatacagttaataaaagaaatacatgtaaagnctttnaatttagtagtatatccccttatatttttaaagcagtttcancctcaagaagagcatttaagataatgtgaattttagcaaaatttgtctcacttttagatactatttgtatgtattattgctgtatctatttgaactcagcagttaaccacatttctctctctgttttgaagctaaatgttgccagctacctacaaatgatttgcttaactgagaattttagaactgatgtaaaagactttgtaaccttgttaactgcaaatacttgtgatatcagaaaaagtatcctttacttacaattntggattagaagtggaggtggagttttagaagaacgaccattaaccctttatcgtggaaatagcagaaatgtacaactagtttgctctgaacatggccttgataacaaaatttaccctaaaaatactaaaaagaaacgtgtagaccttccaaaatgtgacagtggctgtgctgagaccttgtttggccttaagaacattttttccccatctgaagacttattttcatttttaaagcacaaaatcacaatgaaggaagaatggcataaattcatccagcttcttacagaattccaaatgcggaatgtagattttttatatagtaatcttgagtttattctaccattaccagttgataccattccagaaactaaaaacttttgtggcccatcagtaactgtggatgccagtgcagcaacaaaaagtatgaattgtcttgctaggaaacactctgaaagagaacagccattgaaaaagtcccagaaaaanaaacaaaagaaaacattggtaatattagatgatagtgatctatttgacactgacttggactttcctgatcaatctattagcctgtcctctgtatcatcttcctcaaatgcagaagaaagcaaaaccggagacgaagaaagcaaagccagagacaanggaaacaatccagagacaaagaaan

SEQ ID NO: 659297 - DNA, 847 bp, Homo sapiens
  misc_feature (180)..(180): n is a, c, g, or t
  misc_feature (666)..(666): n is a, c, g, or t
  misc_feature (822)..(822): n is a, c, g, or t
  misc_feature (847)..(847): n is a, c, g, or t
tgggttttgaaaaaaataaaaagttgaaagaacttccttccccgtggtaaatgggtgggcaagcaacctaaaaaaatgatttgcttaactgagaattttagaactgatgtaaaagactttgtaaccttgttaactgcaaatacttgtgatatcagaaaaagtatcctttacttacaattntggattagaagtggaggtggagttttagaagaacgaccattaaccctttatcgtggaaatagcagaaatgtacaactagtttgctctgaacatggccttgataacaaaatttaccctaaaaatactaaaaagaaacgtgtagaccttccaaaatgtgacagtggctgtgctgagaccttgtttggccttaagaacattttttccccatctgaagacttattttcatttttaaagcacaaaatcacaatgaaggaagaatggcataaattcatccagcttcttacagaattccaaatgcggaatgtagattttttatatagtaatcttgagtttattctaccattaccagttgataccattccagaaactaaaaacttttgtggcccatcagtaactgtggatgccagtgcagcaacaaaaagtatgaattgtcttgctaggaaacactctgaaagagaacagccattgaaaaagtcccagaaaaanaaacaaaagaaaacattggtaatattagatgatagtgatctatttgacactgacttggactttcctgatcaatctattagcctgtcctctgtatcatcttcctcaaatgcagaagaaagcaaaaccggagacgaagaaagcaaagccagagacaanggaaacaatccagagacaaagaaan

SEQ ID NO: 659298 - DNA, 258 bp, Homo sapiens
atctagaggatcttatgtgccattagaatctagcatatgcgggagcattatatgtcctaatactcacttacttgatgcacaatataaagtttcagaataacaatataaattatgaccacaacaatgtagttactataagaattaaatttatggccaggcatggtggctcccacctgtaatcccaacactttggtaggccgagacaggtggatcacttgagtccaagagttcaagaccagctgggcacacattatggag

SEQ ID NO: 659299 - DNA, 131 bp, Homo sapiens
tcgttacttactctgaacagagtgttacactgtggttgtatttgtaaattacgtttgcttctctatctattctgcctcctcttatctactatttatgtttttctatatacctcttcttattaccttgagac

SEQ ID NO: 659300 - DNA, 505 bp, Homo sapiens
aagaaaaaagtactgagagctaccaccaacagcaggaggtgaagtcatacctgctgttcccactctggggttctcaagtgcatgaacagatattgtggcaacaggcacaacgttgatttaacataagtaacaatacagaacagcagttttgccctgttaagagcagaaacattcaactgacatgcaggtatacgcacaactatctaaaaatgagagtcggatcaagattctcacggcggttgttgagctacgagatacacgagcccgggctctaggggaggacctcggagccgatatggcttataacgaagctcttgaacagtagtggtgcaggcttaccatgaggagacctgctaaaccccggagggtgacaaacttagatgtgttaagaaagcatcctttttctgataacggcagcatttaaaaacaggtcagacctccgtgcctatcccacatgtttccacccatcatgggcaatggcacatggtatgcgtatatattgggg

SEQ ID NO: 659301 - DNA, 835 bp, Homo sapiens
agcccatcgtgtcacgacccatgaggcctatgatcgtgaggggggtgaaccatgacctactgcatccggtttgtcccgctgaagatggtgacacacgacagtcagcgtgcagtactaagtggctcagccacgctgccatgggagccccttccgatgttacagccgatgcgtgcccctagggtagaaagggggatgcccacgaaggtccgatgctaggagggccctggcctgtagagagctgaagtctggatgtgccagccgaattcagtatctggacccgggaagctggtgctggaggcctggccattgctgtcgagggccccagcaaggttgagatctcttttgaggaccgcaaggacggctcctgtggtgtggcctctatgtggtccaggagccaggtgactacggaagtctcagtcaaacgttcaacgaggaacacgattcccgacagcccctttcggtggtgcctgtggctttcttccgtctggccgacggcccggcatggcctcaattgtttctaagccttcagggagttccagggctagagggtcaaccagccagcctcttttaggcagtcagcctgaacgggggccaaggtgggcgatcggatgcccaagggtgcaacagccccttcgggagccctgggagggagtgctatgtcgcggacgcttgcccacgatagtattgcttgtgcgcttcatgctctcgggaaattgggcggtttacctggtttgacgtcgagttccagcggacccaccttcccgtggaagccccttcgagatccgggttggggagcctgggccctggggggcccccgcttgcgtggttcggttac

SEQ ID NO: 659302 - DNA, 104 bp, Homo sapiens
agtttcatcacagagcaaatacccagaacatttaccaacatttctgtcactttttctccaacaaacggtaaagaccacgtgaagacatccataaaattaggcaa

SEQ ID NO: 659303 - DNA, 137 bp, Homo sapiens
tcatcggcactcgctatcatcggcacctcgctattcatcggcacctcgctattcatcggcacctccaagaccaattcccagaccctagagaatgacagttaccagagtgaggtgccgatgaatagcgaggtgccgat

SEQ ID NO: 659304 - DNA, 828 bp, Homo sapiens
gaagacaggctgtataaaaaacagccatgggggaaagaagaaaaaaataataaagagaatgaagcaaacctatgagatctagaaaacagtctcaaaagggaaaatgtaaaatgtattgaccttaaggaggaaataaagaaagagatcaggtaagaaagtttatttaaagaaataataacagagacatttccaaacctagaaaaaatattatcgggtagacgaaggtcatagaaaattaagcagatttaatccacataagactacttcaacacatttaataatcaaattcccaaaggctaaggataaagaaaggatcctaaatgaagcaagagaaaagaaacaagcaacattgcaagggagcatacatctggcaacaaccttttcagtggaaatctgacagtccaagatagaggtgcatgacatatttaaagtgctgaaggaaaaaaaaattgaaacaacttttatcctagaatagcatatccagggaaaatagccttcaaacatgacggaaacaataaaactttacaagtcaaataacagctgagggatttcatcaacagtggacttgtcctaagagcaatgctaaagagagttctttaatctaaaagaaaagggacatttaacaaacaattagaattctggaaggttcaaaaattcaagtggttaacaggcgaaatacacagggccaaattaagaaatactgcaacacttgtaattggggggtgtgtaaacccaagtcatattcttggaataggaataggtaaagaaattaatcaaattagatattaaacatattcttagaacttgatggttttaaatgttttgaac

SEQ ID NO: 659305 - DNA, 706 bp, Homo sapiens
  misc_feature (1)..(1): n is a, c, g, or t
nggaaggatacaattattgatcaggggttttaggcttgttaagaaaccagagaagacaaaaaaatgtgatgtagacagcagaatggggatgggatcaaggacaagctagaaaaattggaggtggcagtcagagagggttttcttaaaattgaaattataggagagttatagttgtagataaagtgtaggtctcacaggaaagagaaatggcagacagcaccactggaagaatggagagaagaggtgctgtggctgggcacagtgggtcacacctgtaatcccagcactttgggaggccaaggagggcagatcacttgaggtcaggagtttgagaccagcctggtcaacatggtgaaaccccgtcgctactataggcaggagactcacttgatctgggaggtggctgttgcagcgaaccgagatcgttcaacactgcattccactctgatgtcagagcaagactccattttcataagcatattacaaagccctcctaatttatactggttcttgaactcctagtgcgtacgaaatgcatcttataactttctgtttcaaacatgcaattcgctggaacacctcactctcatttatactgtcataacttaatgattgacctcaaattgctcctttttccgggtctataaatccatcctcgagtggttatctcccttctctctacttgttgtcgtcccgtcttcttccg

SEQ ID NO: 659306 - DNA, 82 bp, Homo sapiens
ggcacgacgaagaagaggaagatgaggagtcagggaatcagtcagataggagtggttccagtggccggcgcaaggccaagaa

SEQ ID NO: 659307 - DNA, 554 bp, Homo sapiens
gggagtggagagagaatggggagggagagagaaagagaaagagagagagaaagagaaagagacagagaaaagaaactatgttgtttaaaactgccagcgtgaaagtccatggggtgtgaaatgagtcctggcaactggccagggacgttagcatgcttgtgcgtagttgtcttccccactgtttatgtcttgtcttgcagaatcagcattcaactgcgacatgtgttccctgcagcatgacgttagtgccgctgcccactgccttgcagtgcctggactgatggtcaagatagagctttcctgtcacatgaatactgtttgggccaggaagatccggaacacttgcgggcttgggccaatctacctggtcccccactggcacacactgagtcgtccagggaaaatgcccggcttctgttgtgtgttgtactgtgcagcctttctgggcagagccgtggagaaggtggacgtagggcaggtgtgacgcgcagaggtgtgtccggggtggcactgggtcctttcctgctttacgtagggtggcggtggctcttccc

SEQ ID NO: 659308 - DNA, 1128 bp, Homo sapiens
ggagagaactagtctcgagtttttttgatggtattttccaggtagtccacggtatttaatgggaaaacatggatatatatttttcttcacagcttgaatcggaacacaatatggcccggtttaaaaaaaacaaaaccaaaacattccgaaattgtccacagcctcacgcctacctgcccttaccctcagatctggagatgggtctcccattatgcccaatccctccttccctcagaggctggttgccacagggtggatgaaaagagattctacaaagcggggcaggtcccaggaaaagccactggactcgaccgtgggcagtagagggaaaaccaggggttggcagcggtggacgtggacaacggcagctgggggcgagcacagaagacacgacacagacaaggagaaaaaagacacagacgcacaggacaccagccccaacctataggacaaagcaattgtcacccaccaaggacaaaacagatcacaacagcaagggacagagccatccacgactccgacgaacgaggagcaaaaaaaggcgaggcacaacacaagatgagacaaacgcaacgagcgcacgagaaacaccggacccagaggcccccaacagacataagaagcgaacaagcgccccccaaacacacaccagagagacaacacggagaacaacacaagaggccccccacagaaccccacaacggcattaacaaaagcacgaacgccccacatgacaaaagagcgcgccgcacaaggacacgtgaacaccacacacaaattgcgacccactagaagaacaccgaatgaagccggcaccaaaatatgcagaatgtcacccaaacgcatgaagcgcacgcacacccaccgcgaacggcaaaccaacaaacaacagactacaacgaaccaaacacggagacaacaacacaacagacaaacagaccaataaaacaagcaacaaacgccgaaatccgaaccagaaacgaacaccaacggacaacgaaacacaggcaaaccggcaaaagacagaaagagacaccagacacaagacaaactccaaagcacacggacgcggaaaaagacacagcgaaaaacaaacaacaacaccacacgccacaccaaaaacaagaa

SEQ ID NO: 659309 - DNA, 251 bp, Homo sapiens
cagacgtctctactaacgatacaacaaattagctgggcgaggtggcgggcgcgtgtaatctcagctagtcggaggctggggtaggagaatcgcttgaacctgggaggcgaaggttgcagggagccgagatcatgccattgcacttcaacctgggacacaagagagaaactccataaaaaagaaaaaatctcaagacactggaaccgactagttcctgaggtgacaacccactatgactgacgttagcctca

SEQ ID NO: 659310 - DNA, 138 bp, Homo sapiens
cacatgggcagtagcagaggggatactaaaaactagctcacacacacacacacacacacacacacagagcactgttccttcttccagacagagtgctccaattacagagcagtatatgggcaaaacaccagtgaagct

SEQ ID NO: 659311 - DNA, 211 bp, Homo sapiens
aaaaataactgagtacacagtaatcaatgagggggtatcaataactcctctcattattgcccaagataacagaatatagagatagaaatattagtgacggctcactaacatcacacgatctacatacggtctcccatagctatcacatatacacccccttgaggaactacatgcccttcctatacctacttaattcgagcatactagacaa

SEQ ID NO: 659312 - DNA, 1003 bp, Homo sapiens
taagaccctcatcaatagatggagacttacagaaatagtcaaaccacttctacaaaatgtgccagttttcaggcgggggctttcgaagccaaaggtgagtgtttgtggagtgttaaaggtgaaatattagtgtggcggattgaagcagattaggtgaggaaagttgagccaataagtgacggtgaagtccggtggaagccgtgtgtggctacaaaaaagtgttgacggccgtaaatgccgtcggaaagtggtgaagggagacttcgaagtacctctgaggcttgttaggagggtacaacatagagacccagtaacacattgtaatagcgcagtgcttgatatttattgggttctcggttggttctcctattagcactatggtgagctccaggtgcattgatactcctgatgcgagtaatccggtctgtgtttaggagtgggacttctaggggatttaccggggtgatgcctgttgggggcctgtgccctcctaatgggggggtaggggctcatggctgggacgtgggtcaccaggggtgcgatgatggttccttggcggattgactgtccgtctgtcttgctcgcctcgtgttcggctcggtcgtcgcgttgcttggttgtccgtcctttggttggtttcgggtcgcccttgcttgtgtgtcttctggctgctgtgtctctccggcgcttcgcctcctctctgtctttgctcgcctggttgcacgtgctttcgtgcctgtccttgccgtgctggccgtgcttgcctttggtgtgtggcgtctgtttggcgtgccgtgggtgcggcgctgtcacggcgcgtgctgcgcgtccctcgctctgtcctttgctgcccttgtgcgtccctgcattgcgctgtggctggttggttggccttgcgcgcgcgctggcggcgtgcgtggcctgtgtggctgtgctctggggtgtgtgcggtgctgccgtgctctgtggcgggcccgttgccgctggtccgtgctctagcggc

SEQ ID NO: 659313 - DNA, 438 bp, Homo sapiens
gagactttaagactacctctgacactctggatgtcattgttactgcctatcttacactgttcttaccgggctctgacacatgctgtccttactgccacactagcgacactgtatagcacaccgttgtcgtctaggaagcagccctacattaccgagctatagtgtcctcatacgcctgatatccagatgctgttctctcataggacctacttcggggtcgtcgagaccatctatgtgcgatcatacgcatgcatgttcgcttttgcgattgccacctctcatagcacaggcctccacagtccatatctacatgtcgagcctgtatatgatgtcatgtcttataaccctgaagtattgtacccagacgatgtgtggactgccagtccagacatcactgtcatgcggtacttctctactcacggactatgatcgtgaggg

SEQ ID NO: 659314 - DNA, 526 bp, Homo sapiens
agcatctccgttgaaagatacacttgaggcctcacttctcattgtcccaaaatgtcaaagatcctcctaaatgtgatggcataggtatcttaccatggtaaactaccttcagaatgcgtgtgagatctagctgacatataattcaaaaattataaataacagtagtagggtcatatttagcacacaggaaggcggtggtctatgtaaggggcctccccaacagtaggcagcatgtaagggggtataaataagataacacggtgcgtcaatcctttataaatcatgacgggtgttgcacatcacatatatgacaagcacaacgttatgatctttagttctagagtgcaacaaatctgagatccaattccaggctgcctcacacgatcagcggctcggaatctaagttacatcatcggttgacctgactataatagctgtaaccatgccacggaatggtggtgagcattcagtgaactcattcatatgatatggcacatagcacaaggtcgggcctatgataaagatg

SEQ ID NO: 659315 - DNA, 195 bp, Homo sapiens
  misc_feature (3)..(3): n is a, c, g, or t
atnagaggatctggcgagtgatgtcatcttgtatccaggcttggaggcaagcagagatattgaggcaggagtcgagacagctggtcacatggtgaaacccgtcttataaaataaaaattagtggcatgggggcgcacactattaatccagctactccggaggctgaggcacgataattactagaaaccgggagcg

SEQ ID NO: 659316 - DNA, 546 bp, Homo sapiens
cggatggaaggtttgttgtaatcctgtgtcaagcaattctatcagtgttatttttccaacagcatgtggctcactttgggtctctgtgtcacattttggtaattctagcaatatatcaaactatttcactatgattatatctgttatggtgatctgtaatgtgtgatcattgatgttactatcgaaactgggttggggcatcatgaactgaacccatataatacaaggaacttaattgataaatgctgcatgtattctgactgctgcactggccagacatcttcaattaggccaattaataaccctacaatggcctctaagtgttcaagtgaaagagttgcaggtctcacattaaatcaaaagctagaaatgattaagattagtgaggaaggcatgttgaaaactgagataggctgaatgctaggtctcttgtgccaaacagccaagtcgtgaatgcaaaggaaaggttcttgaaggaaatttaaagtgctactccagtgaatatatgaatgataagaaaatgaaacagccttactgctgatatga

SEQ ID NO: 659317 - DNA, 115 bp, Homo sapiens
attgctagtgtgagagtgggtcccaaacatcccaaacctgataggtatgtaggctttcatcaccatatacttcaattctaagataggtggttgtgcatacaaccatacacacatg

SEQ ID NO: 659318 - DNA, 967 bp, Homo sapiens
gtgccgagcctttgggcctctagggcagggtggcgcgaacaggggggccggtcggattcccgagttgttggacacggggcttccacaggggtgcccgcaagactgtcggcgcgcggtttttgtgcgggccgtgggtgtgggtggacccccccccgcgggggccgttttcgagttggcacgccccccttttgcacgcgcgtggcccacccaggggacccattggtcggccgcgaagggcgcctgtgtcccaaatagggcgaacactcttcctggaagagatagtcaacgcaggaaactccgtgggggtggcgggcatatcaacaggcgccgcgtggagggaacaatcccaccacatatagagagaaaggagcactccttgcgcggtcacaattccacagaaaggaagtttgtgaccacacgaagaggatccacatcccccacccgggaatcttcactttccctggaggagaggaaactctctcgtgttggtgtatatttgtgacgacaccacacactgcgagcccacaaccaacactcgtgtaaatgtagaactttctacccttgggggcgccagaggagccacacatctgatcgtgcgtatcacaaatcatggtggtgtaaaagccattgggcgcggtggccacaccaccacgaccgcggggcacgcactccccctatagccaggggacctgcgaccccctctaattctcccaaaaccccgaggagtggagagatttctaccccccctctaagaggggaccatctcgggagagtggtgtgggaaccccttggtggtgtttttgttcacgaggccacctttttggaaaaatatttttgtgggtataaaacacaaataagccaggaaaagacccacacattggatttatattttttttcccaaattttggccccccgggtttttttccaaaacccctcccctttaaaattaatttggtgccgggagtga

SEQ ID NO: 659319 - DNA, 163 bp, Homo sapiens
tgtgccgcagctataccgtgcttgctgcgtgcggaacacgctactctgtgtccccacttcttgccttagctcatgctggcttaatgtgagctcagcttaggagtccttccctcaggagcctttgctttctcagtcaggtgcgttgataagctgggtaccgtgc

SEQ ID NO: 659320 - DNA, 1447 bp, Homo sapiens
tggcaggcaaaaatgagtttatggctttaaagaaaaaccccgaaaaaacaccagcaaacacctccgtactagaacgagttatttagttgtgtgacctcaggggcatataaaaaaaacctcagaattacatagaattttactctcgtggggaggggggtgagtggctctcactccctctccttccttctcccttattcccttttaacaccagatgtggcaccctcatagagaggtgtgctcccagtgtggtgccaataacagagttcagcgtgtgaacctcttattctccccagcgtgtggccgtgtggccgtgtgttccacctctccgagggcggaagtttaagcccggccccacaaagtgataaaatagtgccccgtgaagaggtggtcgtgggaaacaagacacaaaaaaaacatagtgagagcggagtggggcgtatagcgcaagtgtggaaaacgcctgtgaaccctgtaaagtctctaccacaagctaatgaggtgcacacgtgtgggcgctctccccacattggggggagagtgaagaagctgtgtgccctctctcccagagttggatactctcctgtgggacaaaaaacctgtgccctccaagtgtgcattctcctctcgctctctctctctcgccccaagaaaacccccccttagggcgcccacgagggccaatgggggccaccacaaagtggggtcgtgctacaagtctaaatcaaacggggggggcggtgccgtgtctccaagagagaacaatgtgaggtgtgaacctcacaaacttccttctctagagggggaaagggcgtggctctccctggggggccccatagaggggggtgcccctggcgctggacaacaaaacaccaaaacccacgcgtgacaacccgggacctcgtggaaaacacggtaccacaacgggtaaacaacacagggacccctgttgatgtgcccaaaaaacccccgggtgtatgcgcgtgggaaagcacccctgggcaaacaggaggtcctggcaccaccaagacgccggggaaaacaacaaccccgatgccagcacacaggtgggaccacgcggaaccacacgtggggcgcacaccagagcctcgggcccaaaaaaaacgtgttaccccccaaaaaaccccggctccacaaaactcttccctgggggcccattctgtacagagaatccgaccactacaaacggccgcggagatcggccccaccacctaaatgcccagcaccgggacaacaaccggcggcgccaacaaaaaccaccaaccagagctaccaacaccacaatagaaaacaacgggaaccgcgtacctcacaccacaaacagagcccgcaactcatcacacgagcgcaaacccagcactcgacaacacacggcacggacaaactcaaaccatgaataacaaccacacatacaacccagtagatcacg

SEQ ID NO: 659321 - DNA, 112 bp, Homo sapiens
tgctggaactgtggatcacttagtttatttctagtggagaatggactatttgggccttgggacctagaagcagcatggagggaagtctgatcatttaaaagtggtcaagatc

SEQ ID NO: 659322 - DNA, 264 bp, Homo sapiens
aagctgtgcagtggctctggactgctctgagaatagagcccaaacttctagaaccttggccgcaagctcctcgcctgccctctgtctcactttccaaagcacttaggtgcctgcctgcctggacttctctgggatgctttcatctcaccctgctctcctccttccctcatttcctccattctcttctcttctttctaccctattcactgggcaaactcctaaagcaggttgctgtttagatactgtttacccagtgaatagggt

SEQ ID NO: 659323 - DNA, 603 bp, Homo sapiens
  misc_feature (225)..(225): n is a, c, g, or t
  misc_feature (237)..(237): n is a, c, g, or t
tggagctcgcgcgcctgcgaggcacaggccagcccagctccacgaggactgaacaaggtgctgtctcactgccaccatgccggaagtcgagagaaaacccaagatcactgcctcccgcaaactcttgctgaagagcctgatgctggccaaggccaaggaatgctgggagcaggagcacgaggagcgcgaggcttgagaaggtgcgctacctgtgcagagcgcatncccaacgctgcngacccgtggcctgtaccatcaagtgacctagaatggaaacttgtagccctgggacagcttggcatcgccaaagggttgtgaagcgttgcggttgggacttgacgagcaagctgactaaccagaaccattagacagtggccacaagaattggcctcacatactaaacaacccaggggaacagatatacacgggacaccttgacaaggcttgcacagggtggaatgcgaccctccgaatgtgggacagtttcaaggaagaccacgggcccctgacgcatccgacgctccggtgatcatcggacctgaacggcccaatgctaccgtggaaacaccatgcatggagactaccaacagccacaacagtgat

SEQ ID NO: 659324 - DNA, 467 bp, Homo sapiens
  misc_feature (38)..(38): n is a, c, g, or t
  misc_feature (70)..(70): n is a, c, g, or t
ggtcgactactactactaaattcgcggccgggtcgacngagaggctatgtgaacaggaggagaggctacntgaacaggaggagaggctacatgaacaggaggagaggctacgtgaacaggaggagaggctgtgtgaacaggaggagaggctacgtgaacatgaggagaggctgtgtgaacaggaggagaggctacgtgaacaggaggagaggctgtgtgaacaggaggagaggctacgtgaacaggaggagaggctgtgtgaacaggaggagaggctacgtgaacaggaggagaggctgtgtgaacaggagaagctgccagggcaggagaggctgctggaagaggtggagaagctgttggtacaggagaggcggcaggaggagcaggagaggctgctggagagggagaggctgctggaagaggtggagaagctgttagaacaggagaggtcacaggcaagagcaaga

SEQ ID NO: 659325 - DNA, 232 bp, Homo sapiens
tagtcagcgccagggatgcggatccccttttgcagaactcatatctcgagcagtttacattaaaaattagcctcccttcagttaaaaacccccattggggttagtcgtgtctggcttgtacctcgttgccattagtgatctttctagaacatgaggaaatcaagtcgtggttagaaaagcctggagctaaaagtggcaaagcccatttcctgtcctctgctggaacatgctg

SEQ ID NO: 659326 - DNA, 599 bp, Homo sapiens
  misc_feature (414)..(414): n is a, c, g, or t
  misc_feature (436)..(436): n is a, c, g, or t
  misc_feature (460)..(460): n is a, c, g, or t
  misc_feature (543)..(543): n is a, c, g, or t
cagtttaaatgctggaaaaaggacgtgagatttgatgctagggaaggaggcatggggttctaggcaagggagacagtctcttaggcctggagcaaggggccaggggcctgggcaggccacagagccccacagtgtcctcgctaccctattaatgggccaggaatttggaagccagccaccacatgtcctcatgcccagggtcttccggcaggtggagctgaagagccaagaggctccgagtctgcagcagcagccagaccagtagctggagccccagtcccacaaggagcttggatgtgcggacaagcagggtggactccccaggagcacccaggcttgagtggagaagctgttggtacaggagaggcggcaggaggagcaggagaggctgcatgccattcttttcgggctgcngagaacagggagctaaacatcnccatcatctaagagcgggtcaagnaattgaaaaaaaaacaacaaaacatttaaggggttaatatcctacacaattcatttacttcatttgaatgttagagccacttntgtttatttgtgtttctaatttatagtttaaatttatttgtgtttctaaaaaaaaa

SEQ ID NO: 659327 - DNA, 237 bp, Homo sapiens
aaacactctccaagtatgtgcacatccgcatcaagcatgtcctattgtctttcgttccttccttctcgtctctctctctttgaggaaggatctcacagtcacccaggagccaccgcgcctggcctcttttattgttctcttgttcatgtcaattttctctttgtctgacacctttctaaaatgctggtcactttcagatccacgatctgttgctctaaggtggtggagatgtgcaag

SEQ ID NO: 659328 - DNA, 747 bp, Homo sapiens
  misc_feature (414)..(414): n is a, c, g, or t
  misc_feature (436)..(436): n is a, c, g, or t
  misc_feature (460)..(460): n is a, c, g, or t
  misc_feature (596)..(596): n is a, c, g, or t
  misc_feature (622)..(622): n is a, c, g, or t
cagtttaaatgctggaaaaaggacgtgagatttgatgctagggaaggaggcatggggttctaggcaagggagacagtctcttaggcctggagcaaggggccaggggcctgggcaggccacagagccccacagtgtcctcgctaccctattaatgggccaggaatttggaagccagccaccacatgtcctcatgcccagggtcttccggcaggtggagctgaagagccaagaggctccgagtctgcagcagcagccagaccagtagctggagccccagtcccacaaggagcttggatgtgcggacaagcagggtggactccccaggagcacccaggcttgagtggagaagctgttggtacaggagaggcggcaggaggagcaggagaggctgcatgccattcttttcgggctgcngagaacagggagctaaacatcnccatcatctaagagcgggtcaagnaattgaaaaaaaaacaacaaaacatttaaggggttaatatcctacacaattcatttacttcatttgaatgttagagcccccagcaggccatctaaggtagagcagctacaagatgagaccaccacctaaggaaggngctagagagtgtgggaagacagctcnggctgaggtggaaacaatcagatgttgagtctctgacagagcaggagagagctacgtgacagagagagctacgtgacagagagagcacgtgacagagatagcatcatgaccttgcatatatgatt

SEQ ID NO: 659329 - DNA, 976 bp, Homo sapiens
  misc_feature (38)..(38): n is a, c, g, or t
  misc_feature (295)..(295): n is a, c, g, or t
  misc_feature (643)..(643): n is a, c, g, or t
  misc_feature (665)..(665): n is a, c, g, or t
  misc_feature (689)..(689): n is a, c, g, or t
  misc_feature (825)..(825): n is a, c, g, or t
  misc_feature (851)..(851): n is a, c, g, or t
ggtcgactactactactaaattcgcggccgggtcgacngagaggctatgtgatctcctgaacaggagacaggaggagaggctacgtgaacaggaggagaggctacgtgaacaggaggagaggcaacgtgaacaggaggataggctacatgaacaggaggagaggctacgtgaacaggaggagaggctgtgtgaacaggaggagaggctgtgtgaacaggaggagaggctacgtgaacatgaggagaggctgtgtgaacaggaggagaggctatgtgaacaggaggagaggctacntgaacaggaggagaggctacatgaacaggaggagaggctacgtgaacaggaggagaggctgtgtgaacaggaggagaggctacgtgaacatgaggagaggctgtgtgaacaggaggagaggctacgtgaacaggaggagaggctgtgtgaacaggaggagaggctacgtgaacaggaggagaggctgtgtgaacaggaggagaggctacgtgaacaggaggagaggctgtgtgaacaggagaagctgccagggcaggagaggctgctggaagaggtggagaagctgttggtacaggagaggcggcaggaggagcaggagaggctgcatgccattcttttcgggctgcngagaacagggagctaaacatcnccatcatctaagagcgggtcaagnaattgaaaaaaaaacaacaaaacatttaaggggttaatatcctacacaattcatttacttcatttgaatgttagagcccccagcaggccatctaaggtagagcagctacaagatgagaccaccacctaaggaaggngctagagagtgtgggaagacagctcnggctgaggtggaaacaatcagatgttgagtctctgacagagcaggagagagctacgtgacagagagagctacgtgacagagagagcacgtgacagagatagcatcatgaccttgcatatatgatt

SEQ ID NO: 659330 - DNA, 113 bp, Homo sapiens
aatcaatgctgaaaacggagctaaccaaatacatgctgatgttcacttccttcagataaaatcggttttcatttttcacagcaaagacaaagtctagatacttaatggtgctg

SEQ ID NO: 659331 - DNA, 809 bp, Homo sapiens
  misc_feature (128)..(128): n is a, c, g, or t
  misc_feature (476)..(476): n is a, c, g, or t
  misc_feature (498)..(498): n is a, c, g, or t
  misc_feature (522)..(522): n is a, c, g, or t
  misc_feature (658)..(658): n is a, c, g, or t
  misc_feature (684)..(684): n is a, c, g, or t
actggctactccccaggtagtggtaaccaccagaagtggctagagagtgtgggaagacagctccaggctgaggtggaaaacaatcagatgttgagtctcctgaacaggagacaggaggagaggctacntgaacaggaggagaggctacatgaacaggaggagaggctacgtgaacaggaggagaggctgtgtgaacaggaggagaggctacgtgaacatgaggagaggctgtgtgaacaggaggagaggctacgtgaacaggaggagaggctgtgtgaacaggaggagaggctacgtgaacaggaggagaggctgtgtgaacaggaggagaggctacgtgaacaggaggagaggctgtgtgaacaggagaagctgccagggcaggagaggctgctggaagaggtggagaagctgttggtacaggagaggcggcaggaggagcaggagaggctgcatgccattcttttcgggctgcngagaacagggagctaaacatcnccatcatctaagagcgggtcaagnaattgaaaaaaaaacaacaaaacatttaaggggttaatatcctacacaattcatttacttcatttgaatgttagagcccccagcaggccatctaaggtagagcagctacaagatgagaccaccacctaaggaaggngctagagagtgtgggaagacagctcnggctgaggtggaaacaatcagatgttgagtctctgacagagcaggagagagctacgtgacagagagagctacgtgacagagagagcacgtgacagagatagcatcatgaccttgcatatatgatt

SEQ ID NO: 659332 - DNA, 864 bp, Homo sapiens
taacaatcgggctgttgtgcgctggcgtcggttcgctggctatccagtacaccaggcgctaaggtcgtagggtgcgccgaggaaaccgttactaggttaccggcgcgccggtcaggatcgttacgctattattagtcgtacgacacttactagatccggaagaatagtacacccctgtcggggccaagtacgactgcacacattgttagcacgtcgcccagccagtcttacatagtcgggaggtagcagagcagggtcgtaaagtcctgtatttgcgcagcactagtgcgctttacagacgccgataccgagtgacccaagacaccagcgacaccttcgatacccttgtgagtcgacaaccacactaagatacgcgatacggataatcgcacaactttctcagtgttagtatcagtatctaagcatccggctatgcttaaccaggcaacacgagctacgaagcgcttgggctccggcgcgctgcacgaatacaactgtaggacacacatcaagcccgctgtcgttctgctcttagtcaccagatcacactgcgggcacccgcgtcaggcactcaccaatacatacactcagcaggcaatctcaaccgagccaattaccattattcctgaccccccgactataaaggccgccaaacgcggtctacaagctaggcattattctttgtagcatgttacacaacactaagtaccacgtcattccagctgaatcagcacccgatcaaagcgcgcatagggcaggcttagggacggtaaactacaaacaactaggccgcttacgacgcattaccagcaacattggcgcgatttcacacacccaagtactcaggcactccggacgctaagg

SEQ ID NO: 659333 - DNA, 360 bp, Homo sapiens
ggtgatctagaggatcttatgctgctccctcttcacaaagagcccattgatcccgtcaagacatctgggggaagaggaaaaaaaaaaacaaaacagcccaccagaatgtgtggccggaaacctgcccagttagctcctaggccatggattgtgggcggccactgcaccttctgggtaccccattccccttgggaggccccagcccccgaagaaggcccaaagccctttggtggagaaaacagggaaggtgacaacaccagttgaatggcaaacgccttctcccccaaagcagccactgggaatccagggccaacgaaggtggcaacacaccctttccttgaagaagggaaggcagccagg

SEQ ID NO: 659334 - DNA, 290 bp, Homo sapiens
ttctcagcagtccatctagctgagcatcttgtgccgatcgtagcactgtcttccgctgcctcctgtacctgcggcttccagcgctgctggcgcatcttccaaatgctctaggactgtgtttgctcggggtcccccgacgtgtgatgctgcgagctgcttggcgatagtagcgtgcattctcattctcctcctcattgtttgcatcttgttcagtgtatgtattcggctttcggatcagagggttcgccagcatccgggtggccatgtggagccacagtgttgccaccatg

SEQ ID NO: 659335 - DNA, 1546 bp, Homo sapiens
tcccctatatacagctccctgtgtggtgtgcagaacaaccaacgcacgttgttgtggacccacgcagtagtggcccttgtggatggagttcacacacactgtgtgttgccacaaaaactcacgggctttgtaaactacgtcgtccgccccgttttctcttattctcggggctcctcttaagggtatccgaagggcctcttgtggtgtcgcctcaaaatttttctctgcgccgccgagggactataatagttgtgttgtggcccccacccacaggtgcatgttttcgtcgttactgtttaggcggtgggttagtcccaccactatgagagtggtgtgtattctctgaagtgctcccacatctaattgctcccctccgtgaatgttcaattgatgcacataatgtcgtttctgtgtacacctgggtaccccacccacgccggggggggtctcctatccactgaggaaatagtccccctctgagtggtgtttctgccacccgtgtgtttgtaaattctcactcgggtccccgattttatcttgtttgtcctgtggtaccataggtagcacctatggtggccacaacatatgacctcccgtggggccccaacccccaacatattagggcccccccatcgtgtttctttgtgggttacaacagagagaggcccgtttttctcccatactcaaaccccaaatgttttggcccaaagagagagtttctcacataggagggagagcactcacatagaggacacatcctcaaagagtgaagcgcccatttctcttcttgctcgtttccccacagaattttttttaagatgatacaccccttgcacacagagcaccatattgtaatattttaagaatttggcaccaaccccccctggttttcctgttcattctcttgtaagagccaaccacactgtggatttgtaaaaagagtgggccccgcgcccaacacacaggggataagagagagtgtgtccacaggccctgtggtacccccttgaaagcacatggtgttaatgagagagatgtgcccccgcacatcacaaagcctcacggatatgagaggcacattttgtcccctgccacaggagatgtatcccccctgtgtctggtcttgttgtgttctccgcctctccatctcatctgggtcttgtccccgtgtcttcttgggccatatctgcggtggggtgtatagagcaccctctcagatgtctcagaaagagagaccttgtccagacttgtctccagaatagaggaaccgagacgccatcttctctcctggcgtgtcctccagaaagagaggccagaatattggctgcgcccaagaaagaaagactgcccaagaaagtgacacccttgcccccacccaacatccccagaatattcaaagaggaggttgattgccaaaaactgtgcccaagggggaggaaggaggtcacaccccatatgatgatggttttcatgactttgaatgaaattaatttttgtacatctagctgtatcgaggcatcaggccctgaataaaccatcccttttt

SEQ ID NO: 659336 - DNA, 105 bp, Homo sapiens
gtcacacagatttggccaaggtgttagctcagaaacaacccaagttaacgtgaagccttttcatgagctgtttccaacacggtcggtcccggcgttggagtatcc

SEQ ID NO: 659337 - DNA, 673 bp, Homo sapiens
  misc_feature (521)..(521): n is a, c, g, or t
ctcagcgtgtacgtggtatcaccactgacatctccgtgtggagatttgcgaccagtacgtactatgtgactatcattgaggccccaggacacaaagactttatcaaaaacatgattacagggacatctcaggctgactgtgctctcctgagtgtagctgtcagtgtgggtgaatttgaagattgtatttccaacaatgggcacaccctagagcatgcccttatggcttacacactgagtgtgaaacaactatattggcggagttaacaaaacgggtgtcactgagccaccctacagtccggagagatatgaggagcttgctaacggagtgagctcttacattaagatggctacaaccccgacacagttgcatgtgtgccaatatctgggtggaatgatgacaacatgctggaagcaagtgcttacatgccttggttaaaggagatggtcacgcgtgaggatggcaatgtcagtggaaccacgctgtttgaggctctggactggatactccaccaactctgntaactgtcaagcccttgcgcctgcctctacaggatagctacagaagtgagggtttgggacagcccctcttgggccgagagagaactgtgttttacacccggcctggtggggcctatgcttccattaacggtcaacggaaggtttattttctg

SEQ ID NO: 659338 - DNA, 191 bp, Homo sapiens
  misc_feature (118)..(118): n is a, c, g, or t
  misc_feature (123)..(123): n is a, c, g, or t
  misc_feature (135)..(135): n is a, c, g, or t
gtaatctgcacaccaaacctccatgacataattttagctgtgtgacaaacccacatgtgtaccctgaaccaaaaataaaggtaaaagaaaaaaaaaaatccctgggtgggagagagtncaatntaggtgagaggnctgatttttggtacagatagtggtcccagtggggctgtactctatttatttccgtg

SEQ ID NO: 659339 - DNA, 723 bp, Homo sapiens
  misc_feature (283)..(283): n is a, c, g, or t
gagcgtaggctagtatactactactaccgccaaggcgtagtagctacgcccactagatatcggtgtactaccgaaaagggggagtacatactaggcataaaatagtacactataagcctagctagtaattacaaggctacctaattacgaccagataataagtagaactataagttacacaccaactaagcgcaaaaacaacagacagccctaatagctagtacagtagaattaagcaggtacatacagactaagtagctagagtactaaggggtaactaggncagagctagtaggctacgaatattacccagagtatacgaggtaggtagggactacaccgctactaggccagggtagctatataaggaaacatagtagtacgtaggaggccgaatagtataagcaccataccaaaacctaggcgccgtaaggcatacgtaagagtagaacacaacccaaaaacgataacgccatactagtatctagccctaggctagcctacagccctaaccagcactaggtacatagtactaaaaggtacatacgtaataagagggaagtaatcctagaaactatacctataaggtaagtaagaaggataaaagtaagaagggctaacaaggaagaccaaggaagctagtataagctacctataaagaaactataaaagcctaggaatagatatacaaaaggtactaatagccttataagcgaatagaga

SEQ ID NO: 659340 - DNA, 441 bp, Homo sapiens
  misc_feature (76)..(76): n is a, c, g, or t
acaacgctcgaccagaattatgatttctttgcactctcttcccttcagccagacctttctggaagaaatcattcanttaaataaaatggatataccttgctaggtccttgggatatttaggttcaagtgaagaaggtaaagaataggaaaatgcctttaagtccaggtgccatggctcacacctgtgatgggatgccaaggcaggggaggatcagttgagcccaggagttcgagaaacagcctgggcaacatggcaaatccccgtctctacaaaaaatgcaaaaattagccagacatattggtacacacctgtattcccagttactcgggaggctgatgagggaggatcgtttgggcccgggagttcaaggctgcagtgagctgagatgaacccactgtgctccagcctgggtgacagagcaagacactgtctccaaaaat

SEQ ID NO: 659341 - DNA, 164 bp, Homo sapiens
agcgatggacacttgtacccagaagttttggatgctagcagagagatctatcacgacacagtgatatagccactgcacgtccatggcctgtgggaacatctcaatgacctcgcatctttttaaaatacaaaaggcaggagggctctcgtacacgatccgcgtct

SEQ ID NO: 659342 - DNA, 202 bp, Homo sapiens
cgctcactcggcaatcaaacaaaaccagagtcatctggggaaaagtaactcgggaccatggaaacagctgtagcatcgtgccacattccgagaggcaaacaacctgctaaggccataggacacagaatccgagtgatgctgtacccctcaaggatttaaactaacgaaaaatcaataaataaatgtggatttgccgaggtgg

SEQ ID NO: 659343 - DNA, 1506 bp, Homo sapiens
  misc_feature (676)..(676): n is a, c, g, or t
tggcttgggctttatacaaaaaacccaaataaccaaaaaattaaagcgataatattaaaacacactctctgtgtgtgtggagacctctcccccagccccccaacaccatgtggtggggagaaatgtgggggggttcttgaaacagagaaggggagaaagaaaaagcccctctcaccaacacccacaagaggggctcacgccaaagaacacatatttctctgcggggtctcgagcttagggccagcgtgtgtgtgtgggtgtgggacacagaggggtgtgttggaggaaagtttgttccccaagaagtctctcccgggggagagttggaggggtgtgggcaaaacgccaatatataacgcaccccgcgtggagagagagagagaagcggctggggatatctcttctggtgagagccaggtggtgaacctcatctctcccattatatctctcttctctccacatatctctcccgcgtgagagcggggcgccctgtagaacctttttaacaagagagaaaagatatctgggggatatctgtgggggagatgtgggggctctctagaaccccttgtgcgccctgtggagagcgccctgtgggggcgctctatgagcgcgacaagtgtgtgggcgtcgagcgagtgagagagtatataacagagagagacaaaaaaaactntcagagacacccccagagagaagagaggaggaggacccccacaagaagagcgcccttatctcccgcgagcgcccccagaagagcactagtgtctgctgtgacacgacacccgaggggggacgaggcgcgtgtgggaaacgagtcttctgcgcgagagagggcgacgagtaatcacgcactttgggggggggagacacacacccagacaaacatgtgggggccacccctctgttgagaggtactcttctgaaaaacgaccctttaacaaaagttggggcccccagaggggtgccccccacccagaggggggggcgcgcagtggatcaacagggggggggtgcttgttccacaccacgggcccctcctgtgtgtagaccccccagcattatggtcgccccccggaggggaaaaacaaataaaacaacaaagggcgagcgatcaacggccgaaaaaacaccatgttatttttccctccaaggagataaaataagaacccccttaaacagagggggagagaggaaaaacacctcttcctgtagagtggaagagtcgcaccgaacggcggtgtgttgctcactcaaaccgcacgggacaagctaggattttaccacacccccgccggcggcgattttctccccgccaggcgtctgtaacggaggagacacatcttattgatgcatgagtcgtttgatgtcgccacccaatgtgatgcctcgttgtctacaccgagggaaggagaaacctcgtttcttcacaactgattgagtgaggacagcggaccacctctgtatttatatgcgacgacaaacacgcgaggggtgcaccaaacc

SEQ ID NO: 659344 - DNA, 392 bp, Homo sapiens
gattctattcctagtagtttttctttggtgaagggccctgtcctgaaagggagctgtattagtccattttcacactgctgtgaagacatacctgagactgggtaatttataaagtaaagaggtttaatggactcacagtttcacatggcttggaaggcctcacaatcatggtggaaggcaaaggaggagcaaaggtacatcttacatggtgtcaggcaagagagcatgcagaggggaactgccctttataaaaccatcagatctcgtgagacttactcactgtcatgagaacagcatgggaaaaacctgcctccatgattcaatgaccttccaccaggtctctcccatgacacttggagattatggagttacaattcaatgtgagatttggg

SEQ ID NO: 659345 - DNA, 433 bp, Homo sapiens
ccccagaccccaagcccataaatgggaagggagacatgggagtcccttcccaaaaaactccagttcctttccttttttgccttttcccactcccttcccttgggtttttcatatttaaaggtttcaatttctgtatttttttttttttgagagaaaacttgttgattttttatgggcaggggggggctacaaaaaagccccttttttcctttgtttgcaggggagtgtggccctttggcctgggtggaacagtcatcctcccccttccccgtgcagggagcaggaaatcagtgttgggggtggtgggcggccaataggatccctgcctgccagtttttcaaacttttttatatatatatatatatatatatatatatatataaaaatgccccggtcctgctttggtcaataaaggatcctttgttgtttcgta

SEQ ID NO: 659346 - DNA, 635 bp, Homo sapiens
tctatgatactatgtaacatcagaaaacatataatacaatatagttgtcttatagccatgctcccattttagatgacagctagttagcaactcctacgtgttagtttaatactttacaaatgcataaccgatattcagtcagcattataaaacctttaagacagaaggctgtcaagcagaatagacagagggctcatcatcacttatgtctgaatcttcatctactccttcaataaccgatttcttccctttacaacaggatacaattaatccaatcaaaaataccccaagaaaggcccagttaccaaaatagtaagcagcactgaagaaccagaacttgtgaaggaataggtatgtccgggtaacagtacactgatcttcaggagcttctgcatcacatctctttgacacagaaagggttgaattgcctttatgattatcagaagttatattagtctctattaagtaattttggcttccatacataacatattggggagcaagactatcaatcatgtagctagtgtgaaggacaataagcagaagtatcatgcagagaaaaaggagtgcttggggcctggttctacctcttctgattttatataatctaatccacaagaccatatgccatattc

SEQ ID NO: 659347 - DNA, 384 bp, Homo sapiens
caatcctcccatgttagcttcccaagtagctagaactacagggttgtgctaccacgcctggctaatttttaatgttgttttatctacagagcctggctatgttgcccaggctctctcaaactcctggcccaagtaatcccagcactttgggaggccgaggcgagcggatcacgaggtcaggagatcgagaccgcggtgaaaccccgtctctactaaaaatacgaaaaaaaaattagccgggcgcagtggcaggcgcctgtggtcccagctacttgggaggctgcggcaggagaatggtgtgaacctgggaggcggagcttgcagtgagccaagatcgcgccactgcactccagcctgggcgacagagcaagactacaactaaaa

SEQ ID NO: 659348 - DNA, 792 bp, Homo sapiens
  misc_feature (114)..(114): n is a, c, g, or t
  misc_feature (178)..(178): n is a, c, g, or t
  misc_feature (233)..(234): n is a, c, g, or t
  misc_feature (254)..(254): n is a, c, g, or t
  misc_feature (258)..(258): n is a, c, g, or t
agcgggggagtggtgtgattcccgaccaagatggcggccgtggggcgagtcggctccttcggttcttctccgccgggattatcctcgacttacactggcggccccttgggcaangagatagcgtcgggcaacggtggcgccgcggcagggacgacgaggacgggcagaacctttggtncctgcatcctcagcgaggtctccacccgctcgcgctccaagctccctgcgggganngaaccgtgctactgctgggntganagatggagctggaaaaaacaagcttaactcacagacacccacattccagggcacatagcaggacgtcatcacagcaccacggcacgcaggcattgcgcaatattctgctacttaaactgtgccatgcatgcaagaccagggcatgcatcaacacaagattgtaactgttcggatcttagcatggagcacctatatccacaaaggtcctccgttaaatttcgcactggaatgccgctatctctgaaggatactctagttatgctggttgtatgacatgtcaaagccttggactgctttggcacttctttacagaacatgggcaagtgtcgtctagagaatatgctgacaaactgacaatcctcctgacgaacatgacaccacatggaacaaaagtcgattagagacttccaagaactctgtagagccacggagaagacttcccggcttctcgccagagaagaaatactgcgtcgcaagaagacaacgcatgacagtgtacgtttacctctgggtgcggatacacttagcacatac

SEQ ID NO: 659349 - DNA, 114 bp, Homo sapiens
gcgcgtgctgctgcagaagctgcaccatgctaaggctgttgttttccacggcgtggatatgcggggagcggccgctcttaatgtccactgcgtcgatatcggcaccacccatca

SEQ ID NO: 659350 - DNA, 158 bp, Homo sapiens
acagcgtacaacgcacggtgagaaattgcgatgaccaataggcaggctcaacctcgatctcactggatatagaccgagccgtttcgacccaggtattcacgccgttcataaaaatagtcgagttagatcttcgtcattgacggccagggcggcgagtt

SEQ ID NO: 659351 - DNA, 922 bp, Homo sapiens
agcggggacgggagaggcgagagcctcgtgtctgcgcatcacccctgtgtgctgggagtgcttagacctagtgggagtggcgggcaagggcatgaggatcgcgagtggctggatggacgtgtaacctctgcaagatggcgtggagtgcggggcggcatgagaatgtagtgctgcatgtactatttagtgagtagttggctctatttgctgtcactcaagcagaaggaaggagccagtgcttttggcttccaaattcactgctgaacagatacgccggtgcagggacgagacctgaccttgcagtacaatcatctacacatgttggcgtcaagtgctagcagttagacgtggaactatctgatgattccttccctccagaagacttggggattgtgtctggaatgctcaatgtcaacatggtgaccggattgcccctgatagctaatgtctgccactactgtggtcctgtgccctctcaatgctggttatttcaacttgcagctcggcaatcaattacttacctggtcccatgagtgatgggcccggttgtgattggtctctaccagatgcagcctggacagtggagtgaatcctgtggttcatacggagagttggaccaggcgattcctccgcctcattattctgagactgggcagcctttggggtcatgagccttccctccatcgggatcctcctggctattgtggtactccagcgagaggaaatatgaccattcccaaaaatgaagaatgaacggaattggggctttccacagtcctacctctcgcatgaaatcccaagtgtctctccaagaaatgcaggtgctttccagaatccagagggtatcttaaatgcaatctcttctcgtctagccttggccacttctctggatcctgcctggtccacaaccatgtgaaggacg

SEQ ID NO: 659352 - DNA, 798 bp, Homo sapiens
  misc_feature (139)..(139): n is a, c, g, or t
atagtctttgaacccaagggccaacggcattatcaccactggggtgtaagggccatatttgtttttagcctttcttaaaccggataaaaatttttctccgcgcaggtgccctgggaggattaatggtctcggtaagtanaaacccaaaacaccagaaggttatttgatttttaagaattctgttagcaacacaatgtttgtaaagggggggtgtggaaggggcccccagctctgtgcactagggcagaatgaacggaatgtggggggacaccctgagctttaggcaaaataaatttattgtctaaaaaaaatataacctatattatatatatgttatacatacataaacttttattttttttcttctgaaacagtctcgctctgtcgcccaggctggagtcaagtggcactatttgggctcactgcaacctccgcctcccgggttcactctgggcctggggctgttgaaaggttccttgctaagggggttctctctcctaaaagctctaggaatccaaggtggaatcagaggtggaaaacagaaatggttgggatattctgaaaaaaggtcagaatgtggtcaaaggggaaaaaaccaaaggattgcccgtacgtcagggttgtttagcatcttagaaatcatttagggcagggcccagtggctcacgcctgtaatcccagccctttgggaggcataggtgggaggatctcttgagcccaggagttccagaccagcctgggcaatacaatgcgactcccatctctcccaaaattcaaattaaataaaaaatgaaaaga

SEQ ID NO: 659353 - DNA, 431 bp, Homo sapiens
  misc_feature (6)..(6): n is a, c, g, or t
  misc_feature (22)..(22): n is a, c, g, or t
  misc_feature (126)..(126): n is a, c, g, or t
  misc_feature (137)..(137): n is a, c, g, or t
gcagcnaccggaccaccgttcntaaaacgggtaacttgcacacaatttcttaaccgtcacctaagggaaatgcacggtgtatggtggaaaaaactgtatctaacactgaaactactacggactccntcatgagtccnacagtgataaaaaaactactgtactgggcaaattggcgtctaaacccactctactctaacagtctgatggtgcatagtacgtaacagcctgagtacgaatgcccttacacagccacagattctaaacagacagatttatacagacatcattgtgttgtattttaaggaaaaatttccatttacaatttcacattaactcatataaaaataacttgaccctacacaaaatgtccttttagcaacattcaaagtaattaactgttacaatttccaaagcggcagaagtattgaagc

SEQ ID NO: 659354 - DNA, 902 bp, Homo sapiens
agcgggggtcgcgatgaccgcacggtgtgaaccgtcctgagcagggcccacgcccggtccaagcggcccagccacctgggctgtgagcggcggtcatcccgttatgtctgccctaaatcacgtgtacatgaatgatcgcgagaggcgacgagcgttgttcgaagttcgacggcgtaattggtgcaactggggtagaatctagagattcgggaaaggtccgcatacttaagtgcagactcagttattcgctcaccgagattatgtacttgctctcaatgaggtaatcccagagtcctttacttcagtaagtacactcacgccaagatgatcgtgtgaccacaggtggaaacgaaatgctcagatagggtgttcaacatgcacaaacgacacggtggcgctagcaagggttgacatggcgttccagcaataagcttggattatcccccagggacttgtgggaagaaataggcaagagtggcagtgaactaagatacaacgtgtcgcttgggcagctcgttgttgatatacaggagcttaagacattttgcactaaggtgcaagagctaatgaggggagcgtatccttacaattggcaggacattccactgtacggtagaaagccagagaggctacgaagaattgcgcgtggaataagcagggggttgcaggttgcctgggactgataactaagcgtttaccactttgtcctttcccgtttccagtggaaccacttgggcacgtttcacaaaacccacgttggcgaccttcactcgaacgtttttaactgcaaacgccggtcgtgccattgacactcaaccgttggacactcacttccaatcgccaacctttcattggccaaaaacgtcaagaacgacccctttcagcaccccagacgggacatg

SEQ ID NO: 659355 - DNA, 206 bp, Homo sapiens
ccggggtttttttttgggggtcccctttgcccaattcagggccgattcccggtgtttgtggcctttgaatccagggttgggccataaataaaccatttcgccattttttttttccagaattttttgttaattttttgtaagaaccaattgtctatagggaatttgggaaaaaaaaaatttccaataaagggtttattattattgga

SEQ ID NO: 659356 - DNA, 114 bp, Homo sapiens
aacattacactccgtcatgtactattctggccggagccaaactccaacttaggaacgcactcagagatcagcattataatcctctctcaaggacttcaaacatactactcccac

SEQ ID NO: 659357 - DNA, 171 bp, Homo sapiens
accggacaggtaacctgttactgcataacgtatcgagattacttcattggccttaactccagagttcactgccagtcccccgcgaatcgcttcaaatgcctcagcaaacttcttaacagcatactgttcaactccacgacctgtctctccctatgctctgatctgtttggc

SEQ ID NO: 659358 - DNA, 1020 bp, Homo sapiens
  misc_feature (48)..(48): n is a, c, g, or t
  misc_feature (195)..(195): n is a, c, g, or t
  misc_feature (260)..(260): n is a, c, g, or t
  misc_feature (364)..(364): n is a, c, g, or t
  misc_feature (419)..(419): n is a, c, g, or t
  misc_feature (454)..(454): n is a, c, g, or t
  misc_feature (463)..(463): n is a, c, g, or t
  misc_feature (478)..(478): n is a, c, g, or t
  misc_feature (488)..(488): n is a, c, g, or t
  misc_feature (517)..(518): n is a, c, g, or t
  misc_feature (538)..(538): n is a, c, g, or t
  misc_feature (540)..(540): n is a, c, g, or t
  misc_feature (558)..(558): n is a, c, g, or t
  misc_feature (596)..(596): n is a, c, g, or t
  misc_feature (605)..(605): n is a, c, g, or t
  misc_feature (753)..(754): n is a, c, g, or t
  misc_feature (977)..(977): n is a, c, g, or t
cgaaaaaaaagaaaagggatgaatgattaaattgagtagagtaagtangagtagtatataaacacgagttaaggtttttacggcagttaaccattgataattctgaaaattagctaattgtatggaccagcgttcagtttttcaacaaatatgcagacactacgacccaaattattaagatattcactgaacacngtgctagagtgagaatagctgatgtcgttctactctgcatgaacaactggctcattctcatgcancatatgtcagctcagttgtgatctgccataagcagctaacagtgaagcttctacgtgcatgagatgacagacctagcactttggctatctgacctcgagatacnacctagtatgatagcagtctctcgtagcagacacaagcatatatgatatgatctnagtaatagaggagaagcagatctgaatggatttcnataatagcnttcctctagttaacntgattttttnccacatatgtatctttcacagatcagttnnggagcatcaatttagcacancntggcttaatactgcacanacacatagtaaagcattatgcttttatctatgtcatcnatggtttcnatgggaatgactcatccttcctctttaacactctgttctaatatggtttactataaataatgcagacagagagagagagagagagggagcaccagcgagagcgagcatgtgcagctcagcacaaggcccctgcactgttaggtcacannagagccgagtccaacagacaatcctaaggtgaatcttgggctcagtggatggacgagtgttggttcaatggagaggaaaagcaaacattcctctctccactattcaagtgttcggggcaaggaacattgtcaggaaaggggaaaaaatacatgctgagtatatgccaggtaccaggctaagatttgaacacacaagctcctttaaccttccagagccttccanagaggcagagtcagaattctaactcaggccactgtgctcgtgc

SEQ ID NO: 659359 - DNA, 260 bp, Homo sapiens
gtaaaacatgttctcatcatggttaatgtctatgatacggtagtgtcagggcgaaatgtcatgatctatatgaaatgccttcagcaagtttgtgcactaataacaggtattactttaaatcagcgttagagtttgtgctcctgcaactgctgtgaaaatttctctgagtaattgtgagttgtgaatgatcccagaccacccttgagattttgtcaacctgcctaagtcaatatgaatgtgtaaaaagatgtgtgctctga

SEQ ID NO: 659360 - DNA, 100 bp, Homo sapiens
caggcagaagtacatccagatggacagcatcctctccaccacagtctcagacctgcgcagcatcagcttgaagttctagaccaccacgtactgctccagg

SEQ ID NO: 659361 - DNA, 1541 bp, Homo sapiens
  misc_feature (675)..(675): n is a, c, g, or t
ctccggcaatggcagctgacccttatactggctctgtgctggacgtgcgtgatagacatcagggacagacaaaggtgtgtgcgagagtgccatgagtgggacatacctgcactgatgacttcgccctgcccttgcccaccggggctggaagattcctgaggaagatggattacaccactcagcttcctcaacagctcttccatgaccactggctgtcttgtgataggcgtgttcttcatccgtcgttcgtgggaccgatttagtacgatgcatgcgcacaggtatatcttgagccagtaggtaactgttggcattccgaatcgatcgtaagtacggcagttggaccccctgtacactgtgactcctgagtcgagcaggcgcgtgaaatgcccaaacgggatgggtacacggggacatgaggtgtagggaactccagctggcccgaacgttatgggcagcgtaacgctaacggggagttccatgcatcgaaaacgatggtggaagacctacgtaggaaggggaaggggggggccccttcacgcgacccgagatcttttccttggaactcctacttcatatgtcgcccccaagaagcgcattgggcttggggcaacgtcaacacgggttgtggaactatgggcaaaggaccgcgtcgtgtacaacccatgagaaatnccccacggaaagggccgggccctctattgagcaaaacatgtaccttcttccaacttctgaggctaagcgcattatgaaacgttgtttacacctcctggacaaccggcggctgaacaggttggactcggtgcgctcacacggaatttcttggacggtggaaaactcggtgccgatgtgcgacacgccgtatgacaactagggatgcgtttgcggtggcatcaacggtgcgccttcggtttgccaattctaccctccaaaaacgattgtcagtgggaggcatgggctacttgtggaaggaatagtaggagaaggacatagatacacataggaagtgtggcttattacaaccaactccttttgcggaccacattgccgggcactgcgtgccacacttcccttgcggtgtgacaccatatccgcagccttccagggaatgtcgacacgcggtgatatgtaaaaggctgtgccccccgtgtccagttatgaaacggaaagtacacccacacaaatttgcgacggacgttggcagcaccattgtggcgtggccccaaagggcatcgagaaacggggaccgatgagcggatccaatggacagggcgccccagacgggggggactagagtggcacgggtccatgagaacgcggaggatcgcgaggaaacgcctataggagagtgcggaacggaaacatcgggttgactatgggcgaaccagaagtgggaggacagttgatgtgcaggacgcacgcccccaggagttgagaggaacaacggcacacgcagcccaagtccccatccgagtctcctacaagataggagggtcgccaaccccagggatatacggtcccgtagtgggtcacactcgcca

SEQ ID NO: 659362 - DNA, 113 bp, Homo sapiens
cagagcaagctaagtctccagattgagagggccaatacaatctacatctagacacatattgtaaaatttggagtattaaggatagaaggaagatattaaagtggccagggaga

SEQ ID NO: 659363 - DNA, 137 bp, Homo sapiens
  misc_feature (69)..(69): n is a, c, g, or t
gccagagtgaggcgtagaggcacgccagccagagcctgtggagagactccgtctgctgacactaacggnctgggaaggtgggccccttcccttgggtcttttgcaacttgacttcccccaacttcctggacccttgg

SEQ ID NO: 659364 - DNA, 530 bp, Homo sapiens
tgaggatacccgaccagcctgcccagggccagcaaagccttaccacctcaagcttttccactatacctatctatgctcaagaagtagggcggctactgaagacatgctggtctctcccaagtctttcctcaggatccacacatcagacattcatctctattctccaaagagcacaccatggctgctgtgttcctctccttctcttcttcctcttttgataccttttctttatcttttagcttctccttatttagagtgaactggattggattagctgctggtctcgtccttaaataatacatcccagtcttcaaaccctgcttccagccgtagaagtgcatactagtgagtttgccatagttaggctcagcaatgtggatgttcaaagattggctttgatcaatgaaagcacctctctcagctgccatcttgagaacagttttctgagagatttcccacacagttttataaagttgcttcaggtcatcaggaatttctggtatgctctgaatagagccattgcatgcaat

SEQ ID NO: 659365 - DNA, 232 bp, Homo sapiens
taaaacaaaacctaattttttcaacaagcaggttttccagggaaataatttgggctaatggaaatttcaacccccggggtaaaggaggtttaactgccttaagcctcccaggaggggggaattacggcccccattcttaaccccgggttatttggcagaccctttatttgaccggaccccagtttggttttttccaaaggaaccccggccttttttctttcaaatagcgggg

SEQ ID NO: 659366 - DNA, 648 bp, Homo sapiens
tgttctgtgaatatagtgtagctcttacgcgtgctcatgatgaccttattgtctggaccaaaatttaggacatattaagcgtctgtaaagtaaagaaggattattcttacgcctctctgctggcttgtgctaaggtctttgcagatgatgttgttttgaccaccccttaacatcttggtgtatgactttgctgaaggccttattttcttattctctggtaactactccttatatgctgatgtctcccaaatcttaactctcagcccaggtcttacccctgaacattatgtagacacgtttctctgcaacagccctaactggactttccctgcactcagggtgttcaagatgaactcaacattgccattcacaaaaatcacttactgatgaatgacaccaccattcatatgacacctttacatccagccagcccccaagtcctgatgctcctacttccttgactgttcttctgacctctctcttctgggccttaatcctttattaactcggcttgcctgcctcacatcctccaaactggctaatttaaggggaaacccctgccttttctaggctgcctccctaccctagaacaagcagggcatttgtgaccagatcctcatcctgtatcgtaggcctcttgctgttctc

SEQ ID NO: 659367 - DNA, 138 bp, Homo sapiens
  misc_feature (16)..(16): n is a, c, g, or t
ggatttgctggtgcantacaactaggcttaatagggacatgacgggcaggaattttcaaggaccaacaatgtatgacaaaataaacagaaacacttctggggataagaaaaaaaaacgttagaagcttgaattcgagc

SEQ ID NO: 659368 - DNA, 436 bp, Homo sapiens
acttctagactcaaattggttccattgatttctatgtctatacttttgctaatacaacctaatcttcttgattgtaaccctgaaattgggaagcatgaccatgaccaggtgtgatttatcccaagagtgcaaagttggttcaacatccaaaaatcaatataatacaccattttaatagaataaaagtcaaaaagcacatgatcgtctaaatagatacagaaggaggatttaaaagtatgcaacattccttcacccaacaaatggaaggaatgtcctcaaccgataaagggcatctacaaaaaatcaacaaccaacatcttactaaatgacaaaagatagaatgctttccccctgtgatcaggaaccagacaaggacgtctgccattgccatttgtattcaatgttgtgctggaggtcctatccaggacaattgggc

SEQ ID NO: 659369 - DNA, 908 bp, Homo sapiens
ggaggagaagtaggactgctgtgattaggactggatcagaccgaagaggggcgttttggtatttggtgttatgtgcatgggtggttttatattgataattgttgtgatgaaattgatgtgccctaacgatagagtgagacactgctatggatggacatgagaaagatggttagagtctacgtgagtgcctccaagggtgggagtcgttcccttgctaacggagggtagacctgttcaacctgcttcctgctaccgagccgtccactactagcaggatgcagagaccgcgagcaggcgagagtgcaggctccgagctcacgcagcctacatgcatgcgtatccactagcgcctgcaaaacgcacccgataccggcagcctcccacgcaccgatcccagcggcaacctctgtccaggtccgcccacaccccctcctcacccatccacacgcccaatccactaagccacggcccccccaccgcacccacagtcccgcacacatatctccaccctacagccccgcccagcttccacgcgagtcccggccacccaacgcactggccgacccgccacccaccctccgcaccgcgccgcatccgccctccgcccacagcccgctctgtcccacccacagctgccagcacaccccacaccccaccccgcccgaccctacctcaggcccccaggcgcccacggcccaaccaggacacaccacacataagagaacaaatcccccaccactccgcacacctctccccccctcctacctccccgtcgagcaaacagcgcgacgtcccaacgaccacacagcgtccacaccgcccccgcacctacgcagcacagccacacagcacacagcacccctcgaacagaccgcaaccactctcacggcgccaacgaccccggagac

SEQ ID NO: 659370 - DNA, 203 bp, Homo sapiens
cacacctgcatgcttgctcacctcataggtgggagactgggacaactgagaacagcatcggagcacagaaaaggggagacatcacactatccactagcctgttgtgcgggatgtgcgggaagcgcgtactgggtagcattaggagatatacctaatgttaaatgacgagttaatgggtgcagcacaccaacatggcacatgta

SEQ ID NO: 659371 - DNA, 510 bp, Homo sapiens
cattaatacacaatgtgtttaatagctgacattgtgttgaaaaattacattgcaagatgctgttcacagaatcagagggttgcaccaaaacacatattaagcacctcctgataagtacacagtccttgtatgaatttgtttaaagcaaatgtttggttaatggctcgtacgactttgtttaaaatctttatggaaaatgaatgggaaaatacttctggaaccggcgctgctgaaaaactggatggacgctgtttatgaaaactctcttttgtcctggtggctttaagctgtggatttccagtgccttctaaagagtcctgaccagccacgcttatgtttaaaaaaataacatatgaaatgcaaattttaaagtgtttacagatattctttctttaaaatgcattgaaattgcaatgttgccaaatccagtgattttatttatatgatcaaatttttattgtaatgtaaaatttaacttaaaactttggaaaataaaagatttttgaagta

SEQ ID NO: 659372 - DNA, 126 bp, Homo sapiens
tcagcactccttggcgttggtgtaaataggcggtgttttctcgtgtgaatgagggttttatgttgttaatgtggtgggtgatgtgagacccccatagatattgttggtgttgttgacattcacata

SEQ ID NO: 659373 - DNA, 327 bp, Homo sapiens
acaggctgggctgacataccactgtccccatgcaggcggggaactcctctttctgtcatccattgattatcatcgtgtttctaacggattatatgacagggcttaggcacaatcagctcatgaactgccctcctcatgctccacctctccctattgaatcttgttggtacagatacctgagaaacgctggttgtctgctgccacttcagctcatccaggggctgagggaacaagctggccattagccccgaggtgcaaaaccttcaaatacaggttgccagcacggatggcttgtacttggccttcagcaactccagtgagggatcc

SEQ ID NO: 659374 - DNA, 293 bp, Homo sapiens
ctagttagaagtttagcaggctgatggatggatgagatcttatttctcagcaagatcaaagcttggcaaaatgtcattcgcagatcgtggatccaatacggtatgatggcaggagagaagatctttcacctctggaggaaaattacttaggtactctgggtagcagtgactaatctgtgccataaacatcaccagctctgctagttcttggctgggtttattgggtggcaatttgaaaatctccacatgggattggtagtgattatactgctatggaaacttctaaaactagg

SEQ ID NO: 659375 - DNA, 203 bp, Homo sapiens
gactcggcacctccttaatgtgtgcccagcctggagtgcagtggcatgatcatagctcactgcaaacttgaactcctgagctcaagtgattttccaacctcagccccctgagtagctagatgtgctccaccactcttagctaatacttttagtttatgtagagatgggttctcattatgttgcccaggccggtcttgaactcc

SEQ ID NO: 659376 - DNA, 938 bp, Homo sapiens
cattcactcagccagggaggtcccccccccccgagatatttaaagggcacaaagattcgccccctccaggacatgggggaacccccttccggaggagcgtttaaaaggtctctctgcaaatacctgttgtccggaacaccggggctataatggaacttctagagaaaagacgcccctcgtatttgtgtcgtcgtcgcgcctgttcatagatccccctttagggtcacaagtgcgctccgaggattaacgtgcccgtgattcagaatatgctgcgtgtttccccgccgctgggtaactggaagcacaccatggatgaaaaaatctgagtcttctagttcccaaggcagagttcccggccgcattggtcccccttggttgcctggttatgttccgtcccgcccaatactcctattgcggcggtttccccggcataacggcccttgctgccaacccccttttggtctggtaggattggccctgatagtgccctcgcccctcggcttgcggttgatgccccgataaacgggtggggttccacccccagaagttgctcccacgctgctagaccaacgcgtgttctgatttaagtaacaccgcgcttcttggagcatgaacccccagttttccgcccgcacgggcgatacctcctctgggggggttgcacccggtgggcctgctacgccccccccgccaccccgctatgtgttgttgccgacaagtcaaaccgaccgcggcccagtgtccagctttgctatagtcttcccccagggtgatagcccaacgaagaatggcacatactcctcagagggttttgtagtagtcagatactcgttatttagagtggtggacaccacctagatcctccctgggtgcgtggcggtcgcagcacccagaagagggatacaaccgaaattggaccttctcaaacaaacaaaaca

SEQ ID NO: 659377 - DNA, 213 bp, Homo sapiens
ccccattaacataatgcatgtaaaatacctgttcttatctatacaaaaaatatatgatatatacaaatatgtgtatgtctaggttaaagaataataaagtaaatacccctttacttgaagaaatataaaattatgccaggcatggtggttcacatctgtaatcccagtacccttttacttcagccaaaataaatataaaattcctagtagctt

SEQ ID NO: 659378 - DNA, 371 bp, Homo sapiens
  misc_feature (44)..(45): n is a, c, g, or t
  misc_feature (164)..(164): n is a, c, g, or t
  misc_feature (176)..(176): n is a, c, g, or t
  misc_feature (179)..(179): n is a, c, g, or t
tatggaatcgagtacttgatcgtatgagtctcagcggacttatnnactatagacatgcttagggagcgtacgcacctggtggcgagaaaactcacgattagaggcagagttcacattctccaccatctcatcccactcccacacatcaagaaaacgcgtaccanaacgacgcttantanaggtatgacgaccaattaaaccgtgaacaaaagaatagagctgcttatgagcttgctgtgttgtccatacaaaatccaaaccgcgatgacgatgctcggcaagcgcccgcacatgatctggcgtagtctgacgcataccgctaccaccatacttcataccgaaccacttccatgcttcatccacaaaaacta

SEQ ID NO: 659379 - DNA, 335 bp, Homo sapiens
cgtcgacgcagcgttagtagtagtagtggtggtgatattagtagtagtagtagtagtagtagtagtagtagtagtggtggtagcagtagtagtggtagtagtagtagtagtagtagtggtagtaggggtagtagtagtataagtgatattagtagtagtagtggtagtagtagtagtagtagtagtagtagtagtagtagtggtagtagtagtagtggtagtagtagtagtagtagtggtagtatagtagtagtgcagtggtagtagtagagtagtttaatagtggtacagtggtagtgctgtagcattataggcatagtgtggtaggtcgacgc

SEQ ID NO: 659380 - DNA, 321 bp, Homo sapiens
  misc_feature (48)..(48): n is a, c, g, or t
  misc_feature (107)..(107): n is a, c, g, or t
  misc_feature (156)..(156): n is a, c, g, or t
  misc_feature (246)..(246): n is a, c, g, or t
  misc_feature (299)..(299): n is a, c, g, or t
gatctaggctcgccgcaacctctgcctcccggctttaagcaatgttgngcctccatctcccgggaagctgggattacaggtgcgcaccaccatgcctaatttttgtntttttagtagagagtagggtttctccattttggccagactggtcttganttcctggcctcaagcaatccaactgtcttggcctcccaaagtgctggaattacaggtgtgagctgcctcacctggcctggaaaaacagcnttccatgagataggaccttcaccagtgacttttatgtcttcagaatttaatgntctttcccatcatcctatatcc

SEQ ID NO: 659381 - DNA, 518 bp, Homo sapiens
  misc_feature (1)..(1): n is a, c, g, or t
  misc_feature (13)..(13): n is a, c, g, or t
  misc_feature (147)..(147): n is a, c, g, or t
  misc_feature (224)..(224): n is a, c, g, or t
  misc_feature (319)..(319): n is a, c, g, or t
  misc_feature (322)..(322): n is a, c, g, or t
  misc_feature (378)..(378): n is a, c, g, or t
  misc_feature (427)..(427): n is a, c, g, or t
  misc_feature (453)..(454): n is a, c, g, or t
  misc_feature (463)..(464): n is a, c, g, or t
  misc_feature (503)..(503): n is a, c, g, or t
ncacaactgccgntaacaaatgtgcaccacaagcacactgttgtatccaacagatagaaaggactttcaaaaaaaaagaagctggttgctctctgaggaagggagaaagaccatctcaacttattagaaatgtggtcacgtctttgntcacttcttcaaagtgcaggtggaaatggcctgtccagtttccaaaagaagatgactagcagggagggaaccctgtntctgcagttgtgcgatcagagtatcttaaatagaaaggtatggccttaggcctatcagctgcccccagccgaacctgtgaagatgtagaaaaganaanacgttccctggctccccccctagtccctgctatggtggagggaggccacacacaanctagggaggaaactgtgactggaatcaactgccctctgaaggacttggnctactggcatacatacaggaggttgnnttacagatnntgggggcggaccactgatttctctgaatacaaatgaacntggggagatccaagt

SEQ ID NO: 659382 - DNA, 822 bp, Homo sapiens
  misc_feature (14)..(14): n is a, c, g, or t
  misc_feature (21)..(21): n is a, c, g, or t
  misc_feature (42)..(42): n is a, c, g, or t
  misc_feature (45)..(45): n is a, c, g, or t
  misc_feature (57)..(57): n is a, c, g, or t
  misc_feature (644)..(644): n is a, c, g, or t
  misc_feature (693)..(693): n is a, c, g, or t
  misc_feature (774)..(774): n is a, c, g, or t
  misc_feature (811)..(811): n is a, c, g, or t
gcaattccaatccntaagggnatcatttttccaggactcttngangaaaggaaaaanccaactaaaaaaatttttgaccactttttgtattttttccttaagagctatttgtggttgttgaggtttgaaaagctgactgttttttttgcaggggttcccaccaatttggaaggcattgaagcttgcaccttttcatgtacagcattaaaattttacctctctctgggatttaccagcttaagagtccaactcacttccagtgcccaaaagggcacccaccagaaattccagtaaatcctcatttgaggaagctctcccttgtttactctgttaccacattggggaaatttttaagtttttcactttgggagtttttgtttgtttcttcttttcctttatccacttttcttcttcctggtagactaggtttatttatctgagcaataacttctatgttggtttcagtggctggaattaaaacaaaacaaaacaaacttccaaacagtgtgttggtgctttagcgattgattgatgtacagaacacaaatgtctagtttctagtgtcactgatgaactagtgatgtagaaaagagacttctctggtaaagtaattggccacagctggtattttgggctttctcccnggtccccttcccttctcccccattttttgggaagcctgtatcaaatggnacagtttataatggtggaataaatccctcgtcctaacataacactaaatgccggattaattagagccattagagcacagcntcttctggccctctactggttgcacagccagaagggntgctgctttgg

SEQ ID NO: 659383 - DNA, 331 bp, Homo sapiens
cgctaaggcacttcctcatctttatttttcccagtctcatgaggcacgcacattataagatctttccacttagatatctagccatctaaagatggagatgatgaatcattctacctatacaaacaagctagctattagagggtggtatagggtatgcaactcataagattacagaggtgtcttcccaatctgaaatctcaatgttctcagtacgaaaaacctgaaatcagcatggcctatgttaggaaagtgctattcacccagtaaacccaaaaaagcataatggataatgctggccattttgcctttctgacatttccttgggaatctg

SEQ ID NO: 659384 - DNA, 1051 bp, Homo sapiens
ggtgccgtgcgagtgacgattgctgagttgcgatggccgagaccctgcatcgtgcatcgtgtcttgtggtcaagctggaaagcattgagaagccctaacgccttgagagactgtgatgtccaaagagttacctacttagagctcctacgtcacacgttgtggtctagtccccggagtgagatagctggaattgagcgtatggtgcgcggtccctcgcttactccgcaaacttccttcctttcgctattactggtcgtcctgcgttcgagtggccgcaggtggctcgcttaggtggtccgtggtcggggcaccctcggctcttctcgtgcgatagttttgggggcatgggcgggtccctgctagggtcatctcgcggatccgtgttgttccatgtactctcctgaatttattggctggtcgcccggactcgtcaatagggtcaccgagtttagccctctgtgcgtgaccattcctcacatggggcgggtggcgaggggtgtggctgcccggcggtagatgaagtgcacgagtcttcattccttgtcgcgtggccgggctactgtctcgtctctcaccgaggtctcgatcgttaagacgccgtgctctcttcccggcacgaactttggctggagccccgatgggcttcgtcttcccgtgatctcctccacgcgtctcctgtgatcgtgttcctggacggaccggcgtttcccctacgaactaataacgattccagctcgtgggcctaccagtgtcattgtcgtcgcacatcgtgtttgcgtccccgatgtgtggctcttgtggagccccttgctggctgtcggcgtatcccggttcggtgttcaccgagtccatggccacagtggccgggcatgcccggcgtcacgggaggacctatcttaccccttctccgtgtggcagaggggcgggaagataaggcgtagccgggggctcccccagtttcacccggtggggaataccggttcccagccgggttcaccacgggccacgtttttgggcccacacaagcgggttctcttgcgaagcgcgcatt

SEQ ID NO: 659385 - DNA, 439 bp, Homo sapiens
  misc_feature (16)..(16): n is a, c, g, or t
agttcgacggagactnctcttgggtcaatctagaccccaagagagggttcttggatcttgtgcaagaaagaattcagggtgatgccacagtgtgaagtgaaagcaagtttattaagaaagtaaaggaggaggggcacggtggctcactcctgtagtcgcagcactttgggaggccgagacaggtggatcacgaggtcaggagatcaagaccatcctggttaacacggtgaggcctcatctctactaaaaatacaaagaaattggccaggtgtggtggcgggtgcctgtggtcccacctactctggaggctggggcaggagaatgggatgaacccgggaggcgaagcttgcagtgagccgagatcgcgccactgcactccagcctgggtgacagagggagactccatctcaaaaaaaaaagagagtctccgtcgaactgg

SEQ ID NO: 659386 - DNA, 916 bp, Homo sapiens
ggaatgtaagtggattggagggcagggagaaaaggtccaagtaacaggtgaagtttattgccgtgacgtttactcctttctagatgaaaaccaagcacagatgtgtaaaacttctaagattattctcctctatccacagattcacaaaaattaatataatttttaatgtagtgacagcgatttagtgtttgtttgataaagtatgcttatttctgtgcctactgtataatggttatcaaacagttgtctcaggggtacaaactgtttgaaaacaagtgtgacactgaccagcccaaatcataatcatgttgttctggctgtgataggtttggaagcctttttcattattgttttagcttttatgcttgctgccattatttcagtggttgcctaatatttaaaatttacacttctaagatagagacccaatgtgtaaacaatcatgcatgtgtgatacagagacagtttatatgagcagattcaatattattcataagcatgtaattccagggacttctatgtgagatgactactaagcaaatatctagcagggtagctgtcatatagtctgatggatttcgtctcctgaaagagacatgccgcagcagccgggtacccacgcagcggtgatctagacacctttctggtgcatgtcctcccactcatgagtcattatcatcatgcgcattatctgatcagtcctcacattttacatttacatcaacagagaggtccttccgcaaccggtccccaggcgccacttagcaccgaaaaccgattggacacggccatccggtttcagcgcgaaacgcaggcgccgcgcaatgctcgtccacgactctccactttttcctaccagggcgattacgtagaaggagacaaggtaatgtcgccaggactaacacaagaacaaaac

SEQ ID NO: 659387 - DNA, 200 bp, Homo sapiens
gtctaaggcccaaactctaaccctagacttaacctagctcctaagcctaaaagtaaccctagctcataaaccttaacgtaagtctaaccctaacaataattttaaccttaaccctaacccccgtaggaataatattttaccttggtggggacttacttaaaatgttccccagcttttctttttcttatttacttccttct

SEQ ID NO: 659388 - DNA, 173 bp, Homo sapiens
ctagacctgttgttctctcctgggcgaatcctcctgctgcttagtagctggtactacaggtccatgctaccatatctggctaattatttttttgttgagacaagggctctctatgttgcccaggttggtcttgaactcctggcctacaagcaatcctacctacctctagcctc

SEQ ID NO: 659389 - DNA, 149 bp, Homo sapiens
tgggtcagaggacgcttacgacggcaaggattacatcgccctgaacgaggactgcgctcttggacctgtggtggacattgtgagtcagatcacccagcgcaagtgggagacggccatgaggcggagcagtggagagcctatctggaggg

SEQ ID NO: 659390 - DNA, 294 bp, Homo sapiens
agtcctggttccactgagcaaccctgcccagcccaagacccccaggctagagggtaggggacgatgcccagcagcttacctgataccaggtctagacggctctgccctgcagagacagcccaaatgggtggggcatggggagggtggggaggcagggggcagcccactggctggtgttggtcttcagggcagaggtctcgtctggctgggcttgacatggcaccctcccctttgtgttctgtggcctcatctgctcagtttcaccttcagagggggggtccggcttgtctgaat

SEQ ID NO: 659391 - DNA, 298 bp, Homo sapiens
aaacctagaaaactgaacaccaggatagtagcagtggaaatacacagccacacagcatgaaaatgagagaatccagccagatataaatctgtaagaactaagccacagggataaaatggttccagcattcccttggctgtcctcatagcctcctttctctcacacccagttataaattctctcctattggtgaaaaattacatgctttatcaaaagctatgaaagttactgatttatcccacctccttttaacactgaagctcaatcttctaaacagaatttctttccagaatcatgc

SEQ ID NO: 659392 - DNA, 187 bp, Homo sapiens
gtgagattttcacaagtcttccaaacagtgtgaaaatgtgaacctgaacaggtaactgatttaatatgatttagatcaatgcaaaaacctcttaagaaacaaaagcacaggctaggtgcggtggctcactcctataatcccagcactttgggagggcaacctgggcggatcacatggccactcaata

SEQ ID NO: 659393 - DNA, 394 bp, Homo sapiens
tggcccattgcacaccaaggaagatcttagaatctgacaggggaagctgtgtgcctttgaaaaccgtgtcttcatttccaatttggaagagagaagcgtgaaggttaccctttctcgaagctggcccctggcttgggctcctctcatttctctagacccttcttaagagtctggggtgagcacctcctatagaactcagtatgggggaacacagccaggggtcccttcatcagcctcaaggtcaggacaccttgagacagcagcagacccagaagctctgagggggaaaataccccacaatataggaaacacaacccaagacaatccttaaagtgtcagtgtccatggagaggatcccacagctctgagctaacacagtcagtgccacatagac

SEQ ID NO: 659394 - DNA, 400 bp, Homo sapiens
ccccctaaattttggtttgtttccttgaagaatgcggcgaccctgttttgcgtttttgtttgggcaggtcaggcccccagttttgataaacggcagtaaccagtaagggggcccttttttttttttttccgcaaggcattctttgaagctatggagaaattttttttgccccttcgatcagagaatacccctgccccagtaaagccttttttccccccccctccctcccgggggtagttttactaaattgttgttttgttttttattttttcaataaactgtcaaacgccaaaagggtggggttatgatgttttcataaaggttttatcagccgggtattcagttttttatgttaaatatttaaagtctatgatgatggaagaaaaacataaaaaacaaa

SEQ ID NO: 659395 - DNA, 1297 bp, Homo sapiens
gcggatactggctcaagaggacgatcagaagccagtctctgatgcccaccgtcattctccaggcttcagtgcctcaagccctgtagacacgagaaggcgaggcctaatgttgaagccaccggacaaggaggcgggttaggtgcggccacatccaaggccaaagcgagaaaagtcttactgcgcacgcgcactagacagccgataggagccaccgcaatggaagccgtccggagagcgagcaagagcccggagccgacagagatacctggaccgtgcacctgggaaacgacgatgactgcatcccaaaacagtcctgaaccgggtcccgcatgacagccaagaatgcatccagagatgcaagagagataaaacagaggagacataacacaggatcaaactagagatatgcaaaaaacacacatgacacagaggctggaaaaccgaatacaagctgcacagaaacacaatggaaacaagcaacaaatcacacgacgaaccagaacaaatagggaaccaagatgaaatgaagacaaatgacagaaacacgactgaccagaagaccagcaccaacatgagaaaccaacgatcaaaccgacatgagcaatgacaacccgacaagcaccaatagaatgcaagagaaaagcaacacagggaaaaaccgcaagacccccggaaaagaaaaaacaatgcacgaacaggacaacacaaaagaaaaaaacaaaaacaaacaccaatggaggacaacagaacacaaagagaagaaccacacaaccaaacgaaaccaacacaacacggacagcgaaaagacaaaactaagaaccagaaagaacaggaacacacacacaaactagcaaccaaagaaaacgaaacacaagacaaaaaagaaccagtgacacaaacgaacgcaagcccaacaaacgagaacaaggacaaacaagaaacaatgccaacgagaacaagaacaagaaaaaacccaaaaaaacacaagcgacgaacaaacccaaacaagagaacacagaaacgccacaacaggactgagacagaccaacaccaaaaaaaaaaaaaaagaaagacacacaacacaaagacagaagaaaagaaaaagagaagaccagacgaacatgaaggaacagacaccgaaaggaaaaaagagcacggacgagacagcaaacaagaaagacaaaagaacagacaaaagaaaaagaacaaccaaaccaaacacaagcagacacgaatgaacaaaagacaacgaaaacaaaagaaagacaaaacataacaaaaagtgcgactacacata

SEQ ID NO: 659396 - DNA, 727 bp, Homo sapiens
cgaagagagttagggccttgcgctgaattaggctttggcttaagggaatgttgtgactgatttgatctctccagaccactcacactttctcccatcggcaataaggctgttttgctttcttatcatttggatattcactggagtagcactttaatttcctttagtaacttttcctttgcattcacaacttggctaactcttcggcacaagaggtctaacttttagcctgtctcagcttttgacctgccttctaactaagattcataatttctagcttttgacttcaagtgagtgatacgcaactcttctttcacttgaacacttagaggccgctgctgggttattcattggcctgtgttatgtctctaggaataggacggcccgaggagagggagagagaggagaaaatgggaacaactgggccggggagcagtcagagcacacacaacacttatgaagtacgctgtcttatgtgaacgtgctttgtggcactccaaaacagttacaaaagtcacatcagagattactgatcacagatcagaaatataataataatgaaaaagtttgaagtattttgagaattaccaaaatgtgacagagacacaaagtgagaacatgctgttggaaacatggcatcaatagatttactccatgcagtggtggcacataccctccatttgtaaaaacaaacaaaaaatgcaatatctgcagagtgcaataaagcaag

SEQ ID NO: 659397 - DNA, 813 bp, Homo sapiens
gggagaagcaggctgacttcctggacaagcagatgagccgggatgagcaccgagcccgagccatgaagatccctttcaccaatgacaaaatcatcaagccgtgcctgtggaccgagttcaatgatactgcgtgtccgaaataccagttgagtgaagcccagtctgagcctcatccgaggacatccgtgcgccggggctaggagaactgaagatggcggcgctcgtaactgccgtgaagcgctaagctggacttaccgatcctgaatctggagcgtgatgtggaggacctgcagctgtgacaaagcccggctgctgcgggcagaaagtggagttcctgcgctcctctgcgacagatgaagcagaaggtccgagagcctgtaccaggaggtgtttgggcaggtgcggagatgagaacggacggacctagcttcgcccgagtcagtatgcggctccagtactgcctggggactggggaagtgtccgtccgtcatcccccgcacgatggacgagacagcaggccggggcaggagaggaagccaagggaccggaggaaagtgagcctggggaagaagggggttttgaaagcccgatcaaagagctgaatagatgttagaagggctggatgtgtgacctggagctggacctacaagggggattagatgcgttcttatccaatatatcttctcaggattgggatgattgggcggtcagtgtacaagaagaggaggggtggtggctcagtcactcgggtggagtggaagtgcacggacatttaaaaggaaaggtctaccttaccttctgtgagaaggtgtg

SEQ ID NO: 659398 - DNA, 154 bp, Homo sapiens
caatctcatgaggagagaggaacatgctgccgaaacttgatgacatgctgcagaaccaacgaggtggccgaatcttaccttcaggatatctaagaaagcagactgtgatgactgggagagcgggctgcattgcaatggagtgtgcattacatta

SEQ ID NO: 659399 - DNA, 878 bp, Homo sapiens
agcgggtgtctgagttggggtgcctcccctgaagggtcccatctggaattcccaaagatctcctctcattagctgggcatggtggtgcgtgcctgtaatcccagctactggggaggctgaggcaggagaatggcttgaaaccagtaggtggaggttgcagtgagccaagatcatgcgactgcactccagcctgggtgacagagcaagactctgcctcaaaaaaaaaaaaaaaaaagagagagagatctcctctcaggggttgtcctcttggctgccccttccacacagggtctgagttccccccagaaagtataaccggggggtctctcccagaaccgttaccaggcctcacgggggttgtgctgcccctgatccgggccatcatggtatggtcttggcctcccaccatttccgccgccgaagttcccgggggcttctgggctgacccaccacctctacatcctggctctatggtcctggctcatcatccatgggtacgctttggccctgttccagctgaccccgtttccacatcttctcccgggtcccagcaatcatctatgggggcgaacaagctggtgagcctgaacccggaaaaacggtggagatcagcgtggttgaaggcggacctgctgccctcaggagtgacccacctgcggtaccaccggcccacagggcttcgacgtaccagctcagggcagtggcgtgcggaatcgcttgcctggactccgggcggaccaacgcgattaccacgcctttcacactgacctctggcgccttgaggaccccgcttagcctgcaccatccgggcagcaggcccttggaccactcgctcgggcagatctatctagccccgacgttgccagatttccgattcc

SEQ ID NO: 659400 - DNA, 847 bp, Homo sapiens
cccacgcgtccgcttcactttcgatcaagaatccaaataataagcaggagtaacataaagataatcaaacagactttacacagctgacttggagattgtgtgctgctatgctgcttgatgctagagagagtaagacggcgccgtgtcgcaagtgttctagaactatttacacagagcactcttcatctacaagagagaatggtctactccaagatagtaggtgctcacgctcgcttcccgttgttttcgcatcctgtatgtactcgattcagggggtgattagtgttaccttctctggacttgctatgtagacgctcttagattgtgtgactctttcccatctcttagatggttggttgctgcttgcttggccatgccttgggttggtcccctcgcactgtcttgtgctggtgctcctgatgctcccgaggggaccgcataagccgcacttgttgatattggagtggctgtaccttcttccctgtggaattcagtaacaatcagcatcgagcaagactcgcaaagtaagaacacaggcgctctgcacttgtaaacacgaacaaacaaaaatcgcatagtcttgaggtttgaatgaagaacgatgcctccaagcaacttttgcactttgggatcgaaccgagggtctgccacagtcccgtagtcgtggttgccccccttctccccttgattcgatcgaaccacgactacagctgatggggcatagtcctttctcgaggccaattgtttcccttggaattaattgcccttccttcgttagggattatactacataggaggctttttcgtaggttgcctttttgaaatatataacaaaaaacttttcaaa

SEQ ID NO: 659401 - DNA, 148 bp, Homo sapiens
ctatgctttgttaactgtgtgaacctctcctattggaaattttgttccgtgtttgtgtaggtaaataaaggcagacatggtttgccaaccccaaaaatcattagttgtagagaagcccgattataataaattcaaaacatttggttga

SEQ ID NO: 659402 - DNA, 133 bp, Homo sapiens
gattcttattacggaagatgtggacttagcctttttatgctgtcccttgccccacccagtataattatcacagtatttgtttaaactcatgtacggtgttatctgatgatataaattcttttcatggctaaaa

SEQ ID NO: 659403 - DNA, 165 bp, Homo sapiens
ccctgcttctccccagggctcacatctgccggtgctgggtgcagctctgttttttagacaggttctcgctctgtcacccaggctggagtgcagtggtgcaatcacagctgcgtgctgcctcaacctcctggattcaagtgatcctcctgcctcagcctccggagt

SEQ ID NO: 659404 - DNA, 316 bp, Homo sapiens
ctagttattgctcttacagatatatgttgagacggattctccgccgcagctgtactgatactgccccataacaagctcaactgtcagccaggtgcgtcttatgctacagtaatggatgtttgtcgtccaagtccctgtgtaagtttatttactctgcttaccctatctgtgctaaaacagtccgttcagagggatggagtgggagagggcatactgttaagcagcattttgtagctgtatttttgagacggagtctcactctgttaaccacgctgtgagtgcaatagagtgatcttgtgtcactgcaacctctgtc

SEQ ID NO: 659405 - DNA, 837 bp, Homo sapiens
aaaaaattaagtttaaaaattaaaagattagccaggcatggtggcatgtacctgtggtcccagcctcccgagtagctgggaccacaggtacatgctactcgggaggctgaggtgggaggatcgctagatcctagagctttgaggctgcagtgagctgtgattgtgccactgcactccagcctgggtgatgacagagcaagaccccgtctcaaggaacaaaaacgttgccaaagactctgttaaaaggctgaaaagacaaactacgtgctgggaaaaaaatatttgcaaaccatgtatctcacaacagactcatatctaaagtatacaagaaacactcaaaactcaactggaaaaacaaacaagcaatccaactagaaaacaagcaacagacacaaggaaatatttcaccaaagaggatgtacagatggcaaataagcacatgaaaaatttcaacatcattagcaattagggaaatggaaattacgagcatggtgagatatcactacacattgttagacaactctttttaaaaagtgacaataccaaatgctgcaaaggatagagagaaactgctgatgggattgtaagatagtacaaccactacaggatcaaggagttctacgggttcttgagaacctaaagatatgcttaccatatgacccagcaaatgtacatggggcatttatcccagagaaatgaaaacctacgtccacacaaaaaatctgggaccatgaatgttctaggcgatctatcgtattctcccaaagtggaactagccactcttttcaacatcgactggttcgcgggatttaatcctacccggaaaacgcctcgcta

SEQ ID NO: 659406 - DNA, 408 bp, Homo sapiens
tgatcagctcggccccggttacgctagagggcagagtatctgggggcatgtgacctagagaaacagcagctagggcagctatggagtgcttgcccacccctcctccaaccctagacagtgcagctcgcagctctgacagagacctctttcttccgcttgaggagaggagagaggagaggactttgtcttgcatcttggatactagcttacagtaggagggggcactggtcagagtcatgagacccccctttcaggtctcagctttgggataacatctctagacaaactctgggctacaagggaacctgctcccttgaagggaaggactcagtaatggcaggattcttcactatctgactaaagagcccttgggccttgaataatcagcagtggtaaccaggtagtaca

SEQ ID NO: 659407 - DNA, 134 bp, Homo sapiens
tcacggacttcctggaccccgtgggttcctggagataaaggcaaggatggattacctgggacaacaacggccttcccggatctaagggaatcaccctgccctgtattattacctgggacttgggctatcaaggt

SEQ ID NO: 659408 - DNA, 458 bp, Homo sapiens
  misc_feature (10)..(11): n is a, c, g, or t
  misc_feature (49)..(49): n is a, c, g, or t
  misc_feature (57)..(57): n is a, c, g, or t
  misc_feature (60)..(60): n is a, c, g, or t
  misc_feature (62)..(62): n is a, c, g, or t
  misc_feature (225)..(225): n is a, c, g, or t
tgagctctgnngagggtggaaggaggttggttgatattgttgttcttcntgtgaagngtncnaactccttcagctacttcagtctcctgtcagcaagtacttcttagcatcagcaatagtgtctgtgtttggtgtctgcagatgtgatgaatctctagatagggtagtctctgggtggcctttccttcagtctctgctccactctttgtccctgcatttcctttngacaggagcaattctgggttaatatttttgaagatgaagtaagtaagccccatccctcaaccaggggccatgcctaacctctgtttatgctctctgcaagttctatctcccctttgttgaatattgcagctaatgtcatctccattggggtcctgggaagcctcttgctttcctggcatctggggaccttctaagaggctaatccacaagtttgccaactccaactggctcca

SEQ ID NO: 659409 - DNA, 316 bp, Homo sapiens
attaagcacagagatgggctgtaaccagggatgaaggatgtccagctcaagctagagcacgcagaaggggagagggacggggtggatttgagagacattgtggagatacacttaacagtttggatgtaaggccaggcacggtggctcatgcctgtaattccagcactttgggaggccgaggagggtggatcacttgaggccaggagttcgagactagcctgaccaacatggtgaaaccccttctccatcaaaaataccaaattagccggacgtggtggcgcacgcctgcaatcccagccactcgggaggctgaggc

SEQ ID NO: 659410 - DNA, 352 bp, Homo sapiens
ccacaaagaagggcttcaaaaataagccgcattggaacacacctcacctcactaagctgggtgtgctgtcagtgacatggagtgatggaatccttccttcaaatgccagctgccaatgccttaagccctcctgtcctcctgtagtcctactcttcacttccattcccatcatgtgggggtcttggtccaaggctcagcttctctccactgtccatccctcctatcatctgtagagcagagccagcagttgtgtgccttgggcccagggaaccctccatcaactgagacaggactcagtatatggttcttgggtatgccctccaggtggaataaaggaccagatttgatttct

SEQ ID NO: 659411 - DNA, 664 bp, Homo sapiens
tctctccacactggttataaataaccagaactatatgaggagcccaggtaaaaaatctaataatctgatcaaaaaatgggtcaaagacttgtatagacatttcttaaaagaaaatatacaaatggcaggcagggatatgaaaaggtgtttaacatcactgatcatcagagatatacaaatccacactacaatgagatatcatctcaccccagttaaaatggcttttatccaaaaatcaggcaatagcaaatactggtgaagatgtggagaaaagggaactctcctaacactcttggtgagaatgtaagttagtataaccactatggagaacagtttgggggttcttcaaaaaactgaaagtagagctaccatgtgatccagcaatcccactgttggatatatacccaaaagaaaggaaattagaacattgaagagatatctgtactcccctgtttgtggcagaactttttacaatagccaagatttggaagcaacctaagtgtccatcaacagataaatggataaagaaaacctggtacttatacacaatggagtactatgcagccataaaaagaatgaggttttgtcatttgcaacaacatatatggaactagaggtcattatgttaagtgaaataagcagtgtggagagagggtaccgagct

SEQ ID NO: 659412 - DNA, 226 bp, Homo sapiens
cttcggtacccattggtccgagagaaattagatgcattacctagtatattacaacagagccattaattcttgctagcttcatcaacattaactggtttgctattcatgacgctgctgaggaatcagttctttctgcagagcgttcatgtgaattgctttttgcgaaatgtgcaagttccttttgtacatttactaaagctttatttactctgttaatttttacctc

SEQ ID NO: 659413 - DNA, 327 bp, Homo sapiens
gggggggggacatgttgaatattattaacccattttacagaggggaagcaagggttaaaaaaagtttaaaagggacccaaggtcaggggcaaaaatgggaggcaaaggggaggcacccattttaaaccccacccctagggactaaagccgtagccaacaaagcagtagtaatccgggttgttttaaggctggacgggactaatggggaggacacaggcattgggggcctaatccttggttgccgaaaattgatcggggatgtcaacaggccgggggggaacctcctccgagcggtagtagaggaaatattgaggggcactgtctgcc

SEQ ID NO: 659414 - DNA, 885 bp, Homo sapiens
gttcgtattgctatgttcttctgttatttatttcagcatggactgttcatttgaaacctttttctagttattagcgttttaacagttacaagctttaaatggcaattttttctttttcttttttttttttttttttgtcaaaacccaaaacacaggtaatgcacaacattgatggctgcatttaaccttcaaaatattggtccttattgactgggtctccttaattattgtccacttgtcattagaatgcagacggaggggactcaccatgaatatctggggttgatccccagatgtgtgttgctttctctattgcaagcagattccctgtggaattacttcggatttatccccttttaaagaatttttgcccatatctggaagggccctatattttggggaggagccatagatcccgggttatccctatttttaaaacaaatgtgtagacacagtgaactctattcggattatcgagaaaggagtagtttcactatccctctaagagtatactcgaatcagacattcaaggatgtactaatggcactgttgtcatttccaatttcctaaaaaagttggtttacgtttgctaaatcgtgtaaatgcatcattaacttcgtcttaacattcccttttttacccaggtaactcctttttcgtcacctctggttaattggaagaggtttttggccccgtaatattatatttcccccttacaataaataactgtcctccatattctttataataacgccactctgtaaaagccaaaaaacagaaaaaaatatatatgagcagatagtaaacaaaaaaggcgggcgctataaatcacaaggggcagatataggctaccgttgttaaaagcccagtatgactatatacagg

SEQ ID NO: 659415 - DNA, 284 bp, Homo sapiens
aaaaataacctggccagtggctaccttggagatagcaggaagcaggaagcagggagcagggagtagggggagttgccagctgggtaggatccagattgtagacagtgggtcttccagcaaactgcacaggagcccttattctccagtaatggggccattatcagccactgggtggcccaaaacaaacagaggcttatggaagataaaatccctcagacatcaccgcagacgcatgggggtgacatgcaggagtcaaggcggccgagtagcacaggcgtcgacgc

SEQ ID NO: 659416 - DNA, 608 bp, Homo sapiens
agatagagaccctaggaaggcgatgctgggatctatgggttctcaacagagggccttacggggccactgaacaccaaccacgaatgggaggctcaacacaactgaaacgcacgtcctcacagtcctggaggcccgaactcaaaaccaaggcgccagcagggccacgctccctccacggagcctcggggagcagaaggtcttgagacgagacttgctcccgcaaccctttcccagctgcagctgcctctccgccatctctgcctccatggccacgcggcatcttctccctggcatgggctgaaccaccgcatctcgggcaggtctgacggcgtttctatcagcacagcccacaatgatggtcttctccctcgcttcctgattttgtttgacatccaacctcctctcagatgctgtaaactataagctgtaccattgttttatgcactaacagggaagaaaaaaatgctggcaactaaaccgtgaggtcccttcaagagtaaaatggaacctaagaggaagacggaacctaacagagatgtcgggaggagaagcagcatgcatcttagaattgataagcacgatacatgacgacaggtgttttggttaaa

SEQ ID NO: 659417 - DNA, 477 bp, Homo sapiens
agatagagaccctaggaaggcgatgctgggatctatgggttctcaacagagggccttacggggccactgaacaccaaccacgaatgggaggctcaacacaactgaaacgcacgtcctcacagtcctggaggcccgaactcaaaaccaaggcgccagcagggccacgctccctccacggagcctcggggagcagaaggtcttgagacgagacttgctcccgcaaccctttcccagctgcagctgcctctccgccatctctgcctccatggccacgcggcatcttctccctggcatgggctgaaccaccgcatctcgggcagggaagaaaaaaatgctggcaactaaaccgtgaggtcccttcaagagtaaaatggaacctaagaggaagacggaacctaacagagatgtcgggaggagaagcagcatgcatcttagaattgataagcacgatacatgacgacaggtgttttggttaaa

SEQ ID NO: 659418 - DNA, 155 bp, Homo sapiens
aacgccactcggtgcatttccccaggcgctggcaggggcactgattcctagcagatgaggcctcccttccccttcccaggccgcccctcctctgacgggcggccagagcagggccgagttttgcgggggagcctgggtgcgcgccgggcggccgc

SEQ ID NO: 659419 - DNA, 122 bp, Homo sapiens
cgtcttgctaacagaagaactgatgcaatcctaggaaggcttgggcctacaccggcccaaccgcaggggggagggaggctacgcgcccggccttccccagcattgtgctcgtgctgccgcac

SEQ ID NO: 659420 - DNA, 798 bp, Homo sapiens
gaggatcgcttgagcccaggagttgggaccagctcgggcaacatggggaaaccttgtctctacaaaaatcagggaaactggctgggcagggtggtgcgtgcctgttttctcagttacttgggaggctgaggcaggaggatcatttgcacgcaggaggttgaggctgcaatgagccatgattgcaccactgcactccagcctgggttacagagagagatcctctcttgaaaaagatgaacaaaaaaacccaaaaatgcttgccaaaaaaacacgaaaagaaattagtatatattcttttagacttatggtctacatatacatatatgtagacatgtatattttacttatatttctcttaaatggagccttgcactgtcacccaggctgaagtgcagtgggcacaatttcagactcactgcaagctctgctccccgggttcaagcagattcctcctgcctcaagacatacactagtttgattgggatttgacagggtcacgcaccattgccgaggttactaggagataacgagatacaagaggatatttaggagagaaggagaatgagaggtatagcgagattggagggaccaggggtgggatataattaaaaagcacgtaccgacgtagtagaggggctatgcagcgatattaagcaggtccaaaagtgagtgatgtggaaatacatgaggaggtgttaaacacaagcggtgtgagggggaccgaaaaagtgtattgattgtgtaaataagaaatattgttgtgggtgagcgtagttaaatgatgagcacaacaaatga

SEQ ID NO: 659421 - DNA, 408 bp, Homo sapiens
ctctagacgatcgcgttatgaggaggagctgacccagctggaggctttggttgggcgggaccgagccagctacgaggccgggagcgcacgtggcggaacggctgctcatgcacctggaggagatgcaacataccatctctaccgacgaagaaaagagtgctgccgtggtcaacgcgattgggctgtacatgcgccaccttgtggtgcggaccaaagagtggagacaagaagtctggggaggaacttcttccggaaaacggtgatggggaaccggctggtcggacgagcctgccaagaccaaagaaggggctgagaaggatcctggattgcggccgctggaaccggggagagccccaggttccagattttcgagacctcaaagcagaggttgatgccgagaagccaggt

SEQ ID NO: 659422 - DNA, 572 bp, Homo sapiens
  misc_feature (125)..(125): n is a, c, g, or t
accatcaaaaatcacctgcactgaaaatcggaagaaaaaaatagaggatgagaagaatataaaacaaccataaaacaaataacaagatgacaggattatctccctacttattaagaagaacattnaatgtatatgaactaaactataaaatccaaagacatatactgcgcttaaaggatcaaaaaacaagatccattgacctaatgcttacaagaaatacacttcacttataaaggcacacatacacagaaaataaaactgtggaaaaaagacattccatgccaataaaaaaccaaaaagaccaggagtcactatacttacaacagacaaaatacatttcaacccaaaaatataaaagacaaacaaaggcactaaattatcttaaatgggtcaattcaccaagaagatacaacaattttaaatatatatatgcatccaacaagggagcatccagatatataaaggaaatatcattagacataaagagacacataggccccaatacaatatttattggagacttcaacaccccactttcaccattggacatattttccaaacaaaagatcaac

SEQ ID NO: 659423 - DNA, 1251 bp, Homo sapiens
cggggtgttttttcccaccacgcggcgatctgtgtgttttatagactccctgctctcccacgggttttttggggggggagagtacgtccgcatcgtttagtgagtagagggtgttggttttcctacagcgaggatgtttgtggccgcggggtgctaccgagagtgatatatcccctcggcgggatatctccctgtgggtgtccccctccggggggtttatacttcttacgcgcccccctctgaagtgttgtgaaacagggggaccacattatgttggtgagaaagtactctgggcgccctctcttgttgataggggggagaaataaaaaaggggggcccaccatacgtgggaaatttgtggaagggaggggcccccctcgggggggaaataaaaaagggctatactgtttggtcgccacagccccacacacacgggttttgttctaaaaggtgtcacaacagatgtgaagtggcgcgccttttgccccacaagagaggagagaattttttgtggagcaccacgtggtgacgccccaaatatcactggagaggtgtgttaatatctctttataagaggaacgcggggtgagtaccatagagagaggcacaaccacagaaaactctgttctatgatgggcgttatatacacaccaccgggagggtggtgtatcccacagagagacactctggagagtagagacgccccacactaaacacatatttccgcttgtggttctgagcaagggcaacggggacacacactgtgggggtgggaattgtcctattgggggcgtgggtaaagggccccgcgggcccccctttgtggggagatatcacaaaaggtttttcggagaaatggagaagagagataactggggagagatatcgggtgttctcaccggaataaaacacgaggggtccaaaaaccgctcccacgctgtgaaaatcttttcacgagaagaagacctcatttaacaggaaaatcaagggtgggaggggagagctctttccataagggtaagacgatttccctacacagtgctctgataatatagtgaggtattttaagcacccagagtttttgctggtttcgtgagtgttgttaaacacagaggcgaatcataagtgagggttggtagacttccccctaggaaactggaaagaggtttttttgaaaaaaatatttgcccttttgaaaaggggccccccagtcgctttctccgaaataaaaaaaacaaaattgggggggta

SEQ ID NO: 659424 - DNA, 608 bp, Homo sapiens
aggagttacgatcatgtatcggacattgaggtgacaacacatctcacaagcttatagatgcacgacaagctggcatatctatgaggtcgatgtgtgaacaaatctggatccgtctgactgtaaggacttgtacattactaaacgttcaggctcctaacgcacacggtctaattcgaaggccaatattagccacctgctgtagcagggatatacagtggaggtgttagcacttagaaagacaggacaatttccgaacaggatcatctgtgattatggaaagggcgttaactgccacggatatgtggcgagcaatttaagtgagaaggcgcactgttgctgtgcaagactttgaggtgacaggcttgcatactagagaggaggtagcctcaatgctcaagacactgtctgacacacactcggatgtggatccacttagaagatcatatgagaggggcattacatgtgactcacatagtgtcccggagtattactagagtcttcatctagagaacagagttgtcactatgcgtgcagagtcactaagcgcatgtgttagggcatttgggttctatcacacagcgccatggtggcttaacgggcccgtgggg

SEQ ID NO: 659425 - DNA, 159 bp, Homo sapiens
actttggacacagtggcagcatggagaggtggggcctttaagaggtgattggatcatgaaggctctattcccactaatgaatggattcatcatgggagaactggcggctttataagagaggaagagagacctgcgctagacccttagcacggtcagtcc

SEQ ID NO: 659426 - DNA, 261 bp, Homo sapiens
tgcccaggccattatttctttgaatatcttgctacttctttctctaaacctctcccttggaacttccaggatggttatgatgcacttaatgtcgtcctatatttctctgaggcttgcgtcatttttatttgtttggtcttgctctgctcttgggattgcataatctccatcaatagtctatcttcagattcactgttgatattatctgctagttcagatctactgttgggctcctctagtaattctcctcacttcgggaaa

SEQ ID NO: 659427 - DNA, 110 bp, Homo sapiens
atcaagctttgatagagtctactcaaaacatcttctactaattacaaaagatgtttgagtagactctatcacagcttccttcctttgtatgaagaattgaagactgacca

SEQ ID NO: 659428 - DNA, 123 bp, Homo sapiens
ggcaatgcaaccacatatgcccaagcataatttgtgtatttttagtagagacggggttttgccatgttggcctaggtgggttttgaacctacctgaacctcaaggtgatcctgcccgccttgg

SEQ ID NO: 659429 - DNA, 1397 bp, Homo sapiens
  misc_feature (1)..(1): n is a, c, g, or t
ntatacgttcggtcttctagctctacgtcgttgtggtcgtcccctcacctcctctcgggctgaatttgctttgttctgttcctggtgcttctgcttctcaggttttttgtctggtgtttgctcgttgctctcctctctccctgccggtgtctttttctttcccccctccgttgtggtgtcccgtttgctgcgagtgctccttttatactagccccgactgtgtggttgaatcgttctcgttcttcgtctacagaggtgccaggtttgtgtgttgagtttttgacagacgacctatgcggtggggggctgatctcttatagctgatgctatgctggttactaaaatgtgtttaccccggccctctttgttccccaatgaccctcgggttttaacctctgttaccccccacgtgggtttacccacaccgggagccctctgtttaacgtgcgcgcgacacaacgatctccgctgtgtgatataataatttggggcccctttttacaaaaaggggtgtaagaaaacacagaagtgtgttaaacccgcacactggttactctccccggtctccccctttctaaatatatactaataaggtttaccccttggcgccactctttttaggaataccccccatttgcgccactattattaaatagaccctaatggttgaagaagaatttggtagtgatcccccacacttgttgtgtaagatgtagaagaggtggcacccagtcaccccagtggttgggggaattcttgccactctaagagtgtgtgtaatttagaagcccccccttggttttcttttctgacctcgcaccttgttctccactagtaggtaaaatgtctattgcgccactttatatacccctgccactaagtgcctccacttttaaccaccactcgttaacccccttctatgctgtatataatgccacacccctcaaactgtggggattttaatttaataagggccttctagagaaaaaccgcagcgttattttcaccaccccgccactcacttcttaagctcaaccctttctgagaactagttatgtgcacgcctctttcacattgtgttgtgttggttggtctcacaaaactaggttgaagtttttctccctcctcgctcgaggaaaccacgctatccgcgagtttcttttttcttgtggcacatttgtaattataaaaccttggtttgggggaaggagccccaaactcccgccccctgaacctctgcccattaagatggtgttgggttaggttacactctggttactgtcctgggaaaatcactttttatagagatggccttcccagtggtttttaaatttactgaaatttttaggtccattatgtatgttgactaaatttaccaataaacttgtttatcccca

SEQ ID NO: 659430 - DNA, 2476 bp, Homo sapiens
  misc_feature (338)..(338): n is a, c, g, or t
gttactgtcccgcgaacccacatccctacaaagcaggaaagtatgcttgggagaggccaagtgagtggggaatcagcccaaagccaggcgtccagggtctccctcacctgaagctgactttttccccaccttggacagagggcgggagatgccatccccactgaacccagtgctttcaccagccatattagctcccactcaccccccgtcgtggaagcctcggccgtcacacctgcagggccggggcgtgcatggcctcagggatggcctgttcagctgctgggtgactcgggtccaggtgcctcaccacctgctgagctctgtgtgatttctggacncttctgctcgttgcctttgggctcagtgaagagtctggagtttatctggagtgaggtggccggttcttggtgggatctgagcaggtccattcaggagcaggaaagttcatctcagaccctaaatccagccacgtcatgccacgcttaacacctctaacaacttcccctggcacttaggacagcgtctggctccttccctcggctcatggccctcagaatctgcgtcacatacaccccagctctcccgataggtctctgcactcgctgttgcctctgcctggaacagtctccctcctggtgtcattgtctccgtggtgtgtccttcctgaccttccacctccaccaggtgccgacacttccctgaccccagtaacctcttctcttgggtgggtgaatgccacctgctgatgtctgatttattcatcggttttcttgtctgtagtctgtcccccttggggacagggactcgttgctcatgttcacccggcaggctggacacttcgtggagggctccaaagctggcagatcccggggccgcctctgtctctcccaggccctgcgtgttgcggtgagaggagcatttgtgtctctgtggtttgctgctggagctggtgaccgggagagaaacaagggagacaagggtgcccagacaggtgcggggctcagccaggaggcagaagacgtggacgtgtcccgggccaggagggtcacagatgcaccacaaggcactctgtgtggcactgggaacaggaattctgggagtcagtctgcaagggcggtgggcgttgctcacctgggagaagcctttagagtgggcgttgagcaggccattagctcgtgccctgaggaggtgcatgggcggcatgggctctccatggaaattatgtgggcgcgaatggatgtggctctgcgctcacctgggcgaggacttctggccggtgccggggcactctgcatgaccctggcagaatcgagctgccctgactatgaaaggggaagaagagcatgcctgaccctccaccggcaccccacccctcactgctccacctggggcctgcctctgcgggtggctgggtcctggctgactgttgtgactgttgaggccctgggggggtggcgcatgggagttaggaggactggccaggtggggcccactatgcacccacccccagtgtcaggtgcttctcctctcctcctccaccacctcctcctcctcctcctcatcatcatcctcacttgttgaggacgtcctgtgtgccaagtggtttatatgcccagcctcatttaatcctcagaatgactccatgaggtagctactaaaaccccccacttaacagatgaggaaactgaggcctagagaagctcaacaagttgcctaagttccaagtttcctctcccaactctcctaccctctcctcttccttctcctttctcccattcttccctgcctcttccctaactagacaattttttattgagtgtctcccaggtgcaggcatgagccaggtgctgggaaaatcatgataacccagctccttctggtcattttctcagctggttagaggctgggaggacacgcaagttcagctccagccgactggggcattggtggtagcccctggagacattgtgcaatggggctacgaggctgcatctggctccagggaagcgtgttgcaatccatgagtgatgtctgccatgcgtacaggcatggagagtgaggcgcctgtactgtctttctgtagaccctagactggtggggcctctgaaatgcatccagacactgtgctgggtgtgttgcatggccctcccaaccaattcagtatttttctccccattttccagggagaaatctaaggcgtcagaatgtaaggttcttattggaacccaggctccagggtccctggttttctgtgacatcatgctgcaggaccctgtttctctctttgctttggctgctggggagctcagaagggagctttaggcttgctctcagtcaccacattagctcaggggtttgggcatttttgtcgccgtctcctttgggctctgtctcctccctgctgtgcttcctgaggagcaggccggatgtaagttatcaactataaataaaaccaagacttccgttctggctctca

SEQ ID NO: 659431 - DNA, 106 bp, Homo sapiens
actgcttttcccagaaagctgatactgcttctggagaaggggaaatactgactacctcttgcttggcatgaaataaactgctatcctccccttttccagcatcctt

SEQ ID NO: 659432 - DNA, 231 bp, Homo sapiens
gccttatgagcagggcgcagtgattataggctttcgctctaatgattaaagaatgccctagcccacttcttaccacaaggacacagccatacagcgcccttatccccagtactgacgttattatcgagaaccatcatgcctactacagttcaagccatataggccctgtgcacagtacggcctaagcacgttaacagttactggcagtgccatccatactgcatgctagcg

SEQ ID NO: 659433 - DNA, 594 bp, Homo sapiens
ttgtcctcgaagatgagatatactaatggtgaggcgccatcggacgacaggacagcggaggtggggaggaggaagaggcggcgggagagcgagatcatccccacctcgtcgtcttcgtattctttgtccaggaaaaaaatactccaggagctgaggacaatatcagcgtgtcggggcggcgacgacttcttctcgcccccatgctactcttttttcttctccctcgcattctgtatgctaccgaatgtaagtttcgcgggcgaggcacagagcgcccagcgcacacagagagtatgctctttatgtccctgtatatatataaagagagagagtagaaaaataatacgagggcacacagagagagagaaacactcacgacagagaatagagaaagagagatacacatcttgtgtgacaaagcccccaaagaggagcgaggacagagaaccagaaggcgccgcgctccgcggtctatggagaagaaggtgcgcacccctctgtttttgatggaagaaagtgaactggcgcccccctcgcaaaaggtggtggtgagatccccactgggaagacagccccgcaataaacaagcaaaca

SEQ ID NO: 659434 - DNA, 2288 bp, Homo sapiens
  misc_feature (338)..(338): n is a, c, g, or t
gttactgtcccgcgaacccacatccctacaaagcaggaaagtatgcttgggagaggccaagtgagtggggaatcagcccaaagccaggcgtccagggtctccctcacctgaagctgactttttccccaccttggacagagggcgggagatgccatccccactgaacccagtgctttcaccagccatattagctcccactcaccccccgtcgtggaagcctcggccgtcacacctgcagggccggggcgtgcatggcctcagggatggcctgttcagctgctgggtgactcgggtccaggtgcctcaccacctgctgagctctgtgtgatttctggacncttctgctcgttgcctttgggctcagtgaagagtctggagtttatctggagtgaggtggccggttcttggtgggatctgagcaggtacagcgtctggctccttccctcggctcatggccctcagaatctgcgtcacatacaccccagctctcccgataggtctctgcactcgctgttgcctctgcctggaacagtctccctcctggtgtcattgtctccgtggtgtgtccttcctgaccttccacctccaccagtctgtcccccttggggacagggactcgttgctcatgttcacccggcaggctggacacttcgtggagggctccaaagctggcagatcccggggccgcctctgtctctcccaggccctgcgtgttgcggtgagaggagcatttgtgtctctgtggtttgctgctggagctggtgaccgggagagaaacaagggagacaagggtgcccagacaggtgcggggctcagccaggaggcagaagacgtggacgtgtcccgggccaggagggtcacagatgcaccacaaggcactctgtgtggcactgggaacaggaattctgggagtcagtctgcaagggcggtgggcgttgctcacctgggagaagcctttagagtgggcgttgagcaggccattagctcgtgccctgaggaggtgcatgggcggcatgggctctccatggaaattatgtgggcgcgaatggatgtggctctgcgctcacctgggcgaggacttctggccggtgccggggcactctgcatgaccctggcagaatcgagctgccctgactatgaaaggggaagaagagcatgcctgaccctccaccggcaccccacccctcactgctccacctggggcctgcctctgcgggtggctgggtcctggctgactgttgtgactgttgaggccctgggggggtggcgcatgggagttaggaggactggccaggtggggcccactatgcacccacccccagtgtcaggtgcttctcctctcctcctccaccacctcctcctcctcctcctcatcatcatcctcacttgttgaggacgtcctgtgtgccaagtggtttatatgcccagcctcatttaatcctcagaatgactccatgaggtagctactaaaaccccccacttaacagatgaggaaactgaggcctagagaagctcaacaagttgcctaagttccaagtttcctctcccaactctcctaccctctcctcttccttctcctttctcccattcttccctgcctcttccctaactagacaattttttattgagtgtctcccaggtgcaggcatgagccaggtgctgggaaaatcatgataacccagctccttctggtcattttctcagctggttagaggctgggaggacacgcaagttcagctccagccgactggggcattggtggtagcccctggagacattgtgcaatggggctacgaggctgcatctggctccagggaagcgtgttgcaatccatgagtgatgtctgccatgcgtacaggcatggagagtgaggcgcctgtactgtctttctgtagaccctagactggtggggcctctgaaatgcatccagacactgtgctgggtgtgttgcatggccctcccaaccaattcagtatttttctccccattttccagggagaaatctaaggcgtcagaatgtaaggttcttattggaacccaggctccagggtccctggttttctgtgacatcatgctgcaggaccctgtttctctctttgctttggctgctggggagctcagaagggagctttaggcttgctctcagtcaccacattagctcaggggtttgggcatttttgtcgccgtctcctttgggctctgtctcctccctgctgtgcttcctgaggagcaggccggatgtaagttatcaactataaataaaaccaagacttccgttctggctctca

SEQ ID NO: 659435 - DNA, 191 bp, Homo sapiens
caaactagttcagcctctacggccggcggggcggcgcgctgttgtgactctagataactcggcgatcgacgcccctgtgtgcgacgaccattcgaagtttgctatcaattcgatggtagtcgcgtgctaccatgtgacacggtgacgggaatcagggtcgatcgggagaggagctgagaaaaggtaccaca

SEQ ID NO: 659436 - DNA, 130 bp, Homo sapiens
  misc_feature (49)..(49): n is a, c, g, or t
  misc_feature (66)..(66): n is a, c, g, or t
  misc_feature (111)..(111): n is a, c, g, or t
  misc_feature (123)..(123): n is a, c, g, or t
gaggctgcaactcccggaacaacagccacaacatcaggagcaggagcgncagtctgacggcggcanagcctcccccaccccgatccccacagtcaccgccccgtccctggntgcggcggaggnggcggcg

SEQ ID NO: 659437 - DNA, 145 bp, Homo sapiens
gcgatatgctttggtcgataggactcgcaatcagtaaggagacggccatgccttacaagtgcatgcgatcactgatttcatcctctagtttcacgcagcagtgcccaccagaagtatgtccgacaagcctggcacgaaggcagac

SEQ ID NO: 659438 - DNA, 2309 bp, Homo sapiens
  misc_feature (338)..(338): n is a, c, g, or t
gttactgtcccgcgaacccacatccctacaaagcaggaaagtatgcttgggagaggccaagtgagtggggaatcagcccaaagccaggcgtccagggtctccctcacctgaagctgactttttccccaccttggacagagggcgggagatgccatccccactgaacccagtgctttcaccagccatattagctcccactcaccccccgtcgtggaagcctcggccgtcacacctgcagggccggggcgtgcatggcctcagggatggcctgttcagctgctgggtgactcgggtccaggtgcctcaccacctgctgagctctgtgtgatttctggacncttctgctcgttgcctttgggctcagtgaagagtctggagtttatctggagtgaggtggccggttcttggtgggatctgagcaggtctctgcactcgctgttgcctctgcctggaacagtctccctcctggtgtcattgtctccgtggtgtgtccttcctgaccttccacctccaccaggtgccgacacttccctgaccccagtaacctcttctcttgggtgggtgaatgccacctgctgatgtctgatttattcatcggttttcttgtctgtagtctgtcccccttggggacagggactcgttgctcatgttcacccggcaggctggacacttcgtggagggctccaaagctggcagatcccggggccgcctctgtctctcccaggccctgcgtgttgcggtgagaggagcatttgtgtctctgtggtttgctgctggagctggtgaccgggagagaaacaagggagacaagggtgcccagacaggtgcggggctcagccaggaggcagaagacgtggacgtgtcccgggccaggagggtcacagatgcaccacaaggcactctgtgtggcactgggaacaggaattctgggagtcagtctgcaagggcggtgggcgttgctcacctgggagaagcctttagagtgggcgttgagcaggccattagctcgtgccctgaggaggtgcatgggcggcatgggctctccatggaaattatgtgggcgcgaatggatgtggctctgcgctcacctgggcgaggacttctggccggtgccggggcactctgcatgaccctggcagaatcgagctgccctgactatgaaaggggaagaagagcatgcctgaccctccaccggcaccccacccctcactgctccacctggggcctgcctctgcgggtggctgggtcctggctgactgttgtgactgttgaggccctgggggggtggcgcatgggagttaggaggactggccaggtggggcccactatgcacccacccccagtgtcaggtgcttctcctctcctcctccaccacctcctcctcctcctcctcatcatcatcctcacttgttgaggacgtcctgtgtgccaagtggtttatatgcccagcctcatttaatcctcagaatgactccatgaggtagctactaaaaccccccacttaacagatgaggaaactgaggcctagagaagctcaacaagttgcctaagttccaagtttcctctcccaactctcctaccctctcctcttccttctcctttctcccattcttccctgcctcttccctaactagacaattttttattgagtgtctcccaggtgcaggcatgagccaggtgctgggaaaatcatgataacccagctccttctggtcattttctcagctggttagaggctgggaggacacgcaagttcagctccagccgactggggcattggtggtagcccctggagacattgtgcaatggggctacgaggctgcatctggctccagggaagcgtgttgcaatccatgagtgatgtctgccatgcgtacaggcatggagagtgaggcgcctgtactgtctttctgtagaccctagactggtggggcctctgaaatgcatccagacactgtgctgggtgtgttgcatggccctcccaaccaattcagtatttttctccccattttccagggagaaatctaaggcgtcagaatgtaaggttcttattggaacccaggctccagggtccctggttttctgtgacatcatgctgcaggaccctgtttctctctttgctttggctgctggggagctcagaagggagctttaggcttgctctcagtcaccacattagctcaggggtttgggcatttttgtcgccgtctcctttgggctctgtctcctccctgctgtgcttcctgaggagcaggccggatgtaagttatcaactataaataaaaccaagacttccgttctggctctca

SEQ ID NO: 659439 - DNA, 207 bp, Homo sapiens
cggcacgaggcctgttgcgaagatgctgctgggagctcagaagggagctttaggcttgctctcagtcaccacattagctcaggggtttgggcatttttgtcgccgtctcctttgggctctgtctcctccctgctgtgcttcctgaggagcaggccggatgtaagttatcaactataaataaaaccaagacttccgttctggctctca

SEQ ID NO: 659440 - DNA, 338 bp, Homo sapiens
  misc_feature (28)..(28): n is a, c, g, or t
  misc_feature (37)..(37): n is a, c, g, or t
  misc_feature (39)..(39): n is a, c, g, or t
  misc_feature (52)..(52): n is a, c, g, or t
  misc_feature (132)..(132): n is a, c, g, or t
  misc_feature (150)..(150): n is a, c, g, or t
  misc_feature (153)..(153): n is a, c, g, or t
  misc_feature (170)..(170): n is a, c, g, or t
  misc_feature (174)..(174): n is a, c, g, or t
  misc_feature (194)..(195): n is a, c, g, or t
  misc_feature (208)..(208): n is a, c, g, or t
  misc_feature (228)..(228): n is a, c, g, or t
  misc_feature (230)..(230): n is a, c, g, or t
  misc_feature (240)..(240): n is a, c, g, or t
  misc_feature (264)..(264): n is a, c, g, or t
  misc_feature (279)..(279): n is a, c, g, or t
  misc_feature (326)..(327): n is a, c, g, or t
  misc_feature (332)..(332): n is a, c, g, or t
  misc_feature (334)..(334): n is a, c, g, or t
attcacttccatggtgactagtgtttgntgtgcctgntnttatattctgtgntgcatttctccccactccctgccctgcttaataaacagcaaaccaatatctaggaagaatgactgggggataatattggngtattggccccatggcangancagccagcttggcatcngggncccggtgccacactgcggtnncttggtgtggttntcgcagcctcttccctgccngncttgctcccnttgacccacgctgtctggtggttnattctctgccctganccaccaccctggactggcccactctccagagctggcacaccctgccnnttgtntntttt

SEQ ID NO: 659441 - DNA, 926 bp, Homo sapiens
cgcctcctgcgaaggtagcttccaggtgtctacaggggagcccggggtcatgctggcatcattcattctccacgcatcagatgatcctgtggccctcagtgccaggccccactggccctctggcgcacatcagtgactctgatgttctcccccaccgcatgctgcagtctgatggtggagacagaacagcagtcccggatggtggaggcaatgcccagagctgtggcagccaccttgcagccgtgaagcaccagtgggaatgacagtcaagagaaccacggagatgccagcccctggacccacagcagcagcacctgcttccagactcagagtgtgagaaaaaaataaactcctatttgtttatggcaagagacaaggtctagctctgtgatgcaggccggaggacagtggtgtgatcacagctcactgcagccttgaactcctgggttccagcaatcctcccacctcagcctccttagtaggcgtggctacagtaatggcacgcacagccacacagaagctcggagatccctggtttaaagcatttaaagcctctgtgacacattgaccaggcaacaattcactttccaccactcagtgccacgaaagtgccagctctaagctggggcttcctgtgcacgagatgactccactgagtgcacacacaaccaccgtgcggacaccaccccctggcagactcattctgggaaaacacctccaggccagacatcggggccagtaacccttcgtacccctcgacatacggtgtggcccttgggccctcgagcccacagtcaatcaccacagagcgtctgctgctcactcagatatcctacaccacaaatggtgttgcacctcgttctggaacgtcgggacaacgttcacgcctcacgtcaccgccccgacttctgcaccacgcgcccacc

SEQ ID NO: 659442 - DNA, 483 bp, Homo sapiens
ggactatgagaatcgaacccatccctgaggaatccaaaattctccggtgccaccatcaaaaaaaaaaaaaaacaaaaaaaacaaaaaaaacactttttgtggggccgcgcctttgggccctgtggaagaagagttttttagagaccaccattcgctgtgtgtgggcgcgcgcgcgcgggcccacgtgtggtgttaggtgtgaacaccgtgtggccaatttgaggtgtgctttccattgagagaagaaccttcgcctggcggtctcaatcagaacaatgagcggccgtgggaatttctctctccaccattatttaaaaaagcgcgcccggggcgggcacacccacagaacggtgtgttcgtgataacaaaattctccacaatgtggagactctctcagagagagcgtctccactaacaggggggaatccccatatctcaaccacggagaggctcccacaaggcaaagtcttcgaaattctttaa

SEQ ID NO: 659443 - DNA, 437 bp, Homo sapiens
gggaggggactgtctgtctttggaaatttcctcatctgaccaagaaagcatctttccaaaagaaatgcaattgtcttaacacctcccctagaggtctcatcaaataaccaagaaagataaaccccagaaagagatgagactgggaatcatcaccacacccagacagacttcatctattcttctgagagcagctccaagagattgcctggaggactttatctgcttaataagacaagctttgttcctgtacagctccgcccctcaccttcctgtaatatctgcctcccacctccccagtccatacatctcctccctcctgtatgaaaaagggtatacaagcttctgtgccccattgggttattgggaaatcattctcctgtgattcccctgtgccatgcacactaaaataaaattttgtatgccttttctcctaaaaa

SEQ ID NO: 659444 - DNA, 610 bp, Homo sapiens
  misc_feature (70)..(70): n is a, c, g, or t
  misc_feature (167)..(167): n is a, c, g, or t
cgggtgatgttggcgggctcgtttgtgttctggttggcatccattgcttgctcctgggcgcccaacctgnaagtgatgatcatcattcgggtgatccagggtgctgccggcgcggtgctgatccctttgtcattccagctgatcatcaccgagctcccgcccagcanaatcgcaatgggcatggccttgttcgccttgtccaacagcgttgcccaggctgccgggccatccattggtggctggttgaccgatgcttactcgtggcgctggattttttacctgcaactggcaccgggcattctcttgttgctggcggtggcatggtccatcgatgccaagcccatgcagttgagcttgctcaaaagcggtgattggggcggcatcctggccatgatcgtcggcctggggggcttgcagatcgtgctggaggaaggtggtcgcaaggactggttcggctccgatttcattgtgtgggtgtcgttgatcgccggcgtcgccctggtgtacttcgtgctgtcgcagttgtacgggaggcgttcattcatcaacctgcgcctgctcaagagctacaacttcggagtggccagtgcggcgatgttcatgtcgacgc

SEQ ID NO: 659445 - DNA, 2082 bp, Homo sapiens
  misc_feature (41)..(41): n is a, c, g, or t
  misc_feature (43)..(43): n is a, c, g, or t
  misc_feature (52)..(53): n is a, c, g, or t
  misc_feature (55)..(55): n is a, c, g, or t
gaacgccgctagaggccatggggacccaggcacagagcggngncctctcatnntncccatggtcaagggggtcagtgccttcccggggtggattacggatggtagtatcttccttctcctcagagtccattcaggagcaggaaagttcatctcagaccctaaatccagccacgtcatgccacgcttaacacctctaacaacttcccctggcacttaggacagcgtctggctccttccctcggctcatggccctcagaatctgcgtcacatacaccccagctctcccgataggtctctgcactcgctgttgcctctgcctggaacagtctccctcctggtgtcattgtctccgtggtgtgtccttcctgaccttccacctccaccagtctgtcccccttggggacagggactcgttgctcatgttcacccggcaggctggacacttcgtggagggctccaaagctggcagatcccggggccgcctctgtctctcccaggccctgcgtgttgcggtgagaggagcatttgtgtctctgtggtttgctgctggagctggtgaccgggagagaaacaagggagacaagggtgcccagacaggtgcggggctcagccaggaggcagaagacgtggacgtgtcccgggccaggagggtcacagatgcaccacaaggcactctgtgtggcactgggaacaggaattctgggagtcagtctgcaagggcggtgggcgttgctcacctgggagaagcctttagagtgggcgttgagcaggccattagctcgtgccctgaggaggtgcatgggcggcatgggctctccatggaaattatgtgggcgcgaatggatgtggctctgcgctcacctgggcgaggacttctggccggtgccggggcactctgcatgaccctggcagaatcgagctgccctgactatgaaaggggaagaagagcatgcctgaccctccaccggcaccccacccctcactgctccacctggggcctgcctctgcgggtggctgggtcctggctgactgttgtgactgttgaggccctgggggggtggcgcatgggagttaggaggactggccaggtggggcccactatgcacccacccccagtgtcaggtgcttctcctctcctcctccaccacctcctcctcctcctcctcatcatcatcctcacttgttgaggacgtcctgtgtgccaagtggtttatatgcccagcctcatttaatcctcagaatgactccatgaggtagctactaaaaccccccacttaacagatgaggaaactgaggcctagagaagctcaacaagttgcctaagttccaagtttcctctcccaactctcctaccctctcctcttccttctcctttctcccattcttccctgcctcttccctaactagacaattttttattgagtgtctcccaggtgcaggcatgagccaggtgctgggaaaatcatgataacccagctccttctggtcattttctcagctggttagaggctgggaggacacgcaagttcagctccagccgactggggcattggtggtagcccctggagacattgtgcaatggggctacgaggctgcatctggctccagggaagcgtgttgcaatccatgagtgatgtctgccatgcgtacaggcatggagagtgaggcgcctgtactgtctttctgtagaccctagactggtggggcctctgaaatgcatccagacactgtgctgggtgtgttgcatggccctcccaaccaattcagtatttttctccccattttccagggagaaatctaaggcgtcagaatgtaaggttcttattggaacccaggctccagggtccctggttttctgtgacatcatgctgcaggaccctgtttctctctttgctttggctgctggggagctcagaagggagctttaggcttgctctcagtcaccacattagctcaggggtttgggcatttttgtcgccgtctcctttgggctctgtctcctccctgctgtgcttcctgaggagcaggccggatgtaagttatcaactataaataaaaccaagacttccgttctggctctca

SEQ ID NO: 659446 - DNA, 189 bp, Homo sapiens
gctcgacagaaaagaaaagaaaagaaaagaaacgaaaacattagcctagcacagtggcacatgtctgtagtcccagacacttagaaggctgaggtgagaggattgcttgatccagggagtttgaggctgcagtgagccctgatcgtaccactgcactccaacctggggaacaaagcaagactgtgtctc

SEQ ID NO: 659447 - DNA, 2454 bp, Homo sapiens
  misc_feature (338)..(338): n is a, c, g, or t
gttactgtcccgcgaacccacatccctacaaagcaggaaagtatgcttgggagaggccaagtgagtggggaatcagcccaaagccaggcgtccagggtctccctcacctgaagctgactttttccccaccttggacagagggcgggagatgccatccccactgaacccagtgctttcaccagccatattagctcccactcaccccccgtcgtggaagcctcggccgtcacacctgcagggccggggcgtgcatggcctcagggatggcctgttcagctgctgggtgactcgggtccaggtgcctcaccacctgctgagctctgtgtgatttctggacncttctgctcgttgcctttgggctcagtgaagagtctggagtttatctggagtgaggtggccggttcttggtgggatctgagcaggtacagcgtctggctccttccctcggctcatggccctcagaatctgcgtcacatacaccccagctctcccgataggtctctgcactcgctgttgcctctgcctggaacagtctccctcctggtgtcattgtctccgtggtgtgtccttcctgaccttccacctccaccagtctgtcccccttggggacagggactcgttgctcatgttcacccggcaggctggacacttcgtggagggctccaaagctggcagatcccggggccgcctctgtctctcccaggccctgcgtgttgcggtgagaggagcatttgtgtctctgtggtttgctgctggagctggtgaccgggagagaaacaagggagacaagggtgcccagacaggtgcggggctcagccaggaggcagaagacgtggacgtgtcccgggccaggagggtcacagatgcaccacaaggcactctgtgtggcactgggaacaggaattctgggagtcagtctgcaagggcggtgggcgttgctcacctgggagaagcctttagagtgggcgttgagcaggccattagctcgtgccctgaggaggtgcatgggcggcatgggctctccatggaaattatgtgggcgcgaatggatgtggctctgcgctcacctgggcgaggacttctggccggtgccggggcactctgcatgaccctggcagaatcgagctgccctgactatgaaaggggaagaagagcatgcctgaccctccaccggcaccccacccctcactgctccacctggggcctgcctctgcgggtggctgggtcctggctgactgttgtgactgttgaggccctgggggggtggcgcatgggagttaggaggactggccaggtggggcccactatgcacccacccccagtgtcaggtgcttctcctctcctcctccaccacctcctcctcctcctcctcatcatcatcctcacttgttgaggacgtcctgtgtgccaagtggtttatatgcccagcctcatttaatcctcagaatgactccatgaggtagctactaaaaccccccacttaacagatgaggaaactgaggcctagagaagctcaacaagttgcctaagttccaagtttcctctcccaactctcctaccctctcctcttccttctcctttctcccattcttccctgcctcttccctaactagacaattttttattgagtgtctcccaggtgcaggcatgagccaggtgctgggaaaatcatgataacccagctccttctggtcattttctcagctggttagaggctgggaggacacgcaagttcagctccagccgactggggcattggtggtagcccctggagacattgtgcaatggggctacgaggctgcatctggctccagggaagcgtgttgcaatccatgagtgatgtctgccatgcgtacaggcatggagagtgaggcgcctgtactgtctttctgtagaccctagactggtggggcctctgaaatgcatccagacactgtgctgggtgtgttgcatggccctcccaaccaattcagtatttttctccccattttccagggagaaatctaaggcgtcagaatgtaaggttcttattggaacccaggctccagggtccctggttttctgtgacatcatgctgcaggaccctgtttctctctttgctttggctgctggggagctcagaagggagctttaggcttgctctcagtcaccacattagctcaggggtttgggcatttttgtcgccgtctcctttgggctctgtctcctccctgctgtgcttcctgaggagcaggccggatgtaagttatcaactataaataaaaccaagacttccgttctggctctcactctagtttcctggtgcattttttttttttaaagttcttaatcaagggaggggatactcctaactgaagatgacatcagcatcagctggccccggggggcaggcccccagcccccaggcccgtgtgggccctgaatgcccccattatgaggggtaacctcattaca

SEQ ID NO: 659448 - DNA, 2266 bp, Homo sapiens
  misc_feature (338)..(338): n is a, c, g, or t
gttactgtcccgcgaacccacatccctacaaagcaggaaagtatgcttgggagaggccaagtgagtggggaatcagcccaaagccaggcgtccagggtctccctcacctgaagctgactttttccccaccttggacagagggcgggagatgccatccccactgaacccagtgctttcaccagccatattagctcccactcaccccccgtcgtggaagcctcggccgtcacacctgcagggccggggcgtgcatggcctcagggatggcctgttcagctgctgggtgactcgggtccaggtgcctcaccacctgctgagctctgtgtgatttctggacncttctgctcgttgcctttgggctcagtgaagagtctggagtttatctggagtgaggtggccggttcttggtgggatctgagcaggtacagcgtctggctccttccctcggctcatggccctcagaatctgcgtcacatacaccccagctctcccgataggtctctgcactcgctgttgcctctgcctggaacagtctccctcctggtgtcattgtctccgtggtgtgtccttcctgaccttccacctccaccagtctgtcccccttggggacagggactcgttgctcatgttcacccggcaggctggacacttcgtggagggctccaaagctggcagatcccggggccgcctctgtctctcccaggccctgcgtgttgcggtgagaggagcatttgtgtctctgtggtttgctgctggagctggtgaccgggagagaaacaagggagacaagggtgcccagacaggtgcggggctcagccaggaggcagaagacgtggacgtgtcccgggccaggagggtcacagatgcaccacaaggcactctgtgtggcactgggaacaggaattctgggagtcagtctgcaagggcggtgggcgttgctcacctgggagaagcctttagagtgggcgttgagcaggccattagctcgtgccctgaggaggtgcatgggcggcatgggctctccatggaaattatgtgggcgcgaatggatgtggctctgcgctcacctgggcgaggacttctggccggtgccggggcactctgcatgaccctggcagaatcgagctgccctgactatgaaaggggaagaagagcatgcctgaccctccaccggcaccccacccctcactgctccacctggggcctgcctctgcgggtggctgggtcctggctgactgttgtgactgttgaggccctgggggggtggcgcatgggagttaggaggactggccaggtggggcccactatgcacccacccccagtgtcaggtgcttctcctctcctcctccaccacctcctcctcctcctcctcatcatcatcctcacttgttgaggacgtcctgtgtgccaagtggtttatatgcccagcctcatttaatcctcagaatgactccatgaggtagctactaaaaccccccacttaacagatgaggaaactgaggcctagagaagctcaacaagttgcctaagttccaagtttcctctcccaactctcctaccctctcctcttccttctcctttctcccattcttccctgcctcttccctaactagacaattttttattgagtgtctcccaggtgcaggcatgagccaggtgctgggaaaatcatgataacccagctccttctggtcattttctcagctggttagaggctgggaggacacgcaagttcagctccagccgactggggcattggtggtagcccctggagacattgtgcaatggggctacgaggctgcatctggctccagggaagcgtgttgcaatccatgagtgatgtctgccatgcgtacaggcatggagagtgaggcgcctgtactgtctttctgtagaccctagactggtggggcctctgaaatgcatccagacactgtgctgggtgtgttgcatggccctcccaaccaattcagtatttttctccccattttccagggagaaatctaaggcgtcagaatgtaaggttcttattggaacccaggctccagggtccctggttttctgtgacatcatgctgcaggaccctgtttctctctttgctttggctgctggggagctcagaagggagctttaggcttgctctcagtcaccacatttgtcgccgtctcctttgggctctgtctcctccctgctgtgcttcctgaggagcaggccggatgtaagttatcaactataaataaaaccaagacttccgttctggctctca

SEQ ID NO: 659449 - DNA, 781 bp, Homo sapiens
  misc_feature (338)..(338): n is a, c, g, or t
gttactgtcccgcgaacccacatccctacaaagcaggaaagtatgcttgggagaggccaagtgagtggggaatcagcccaaagccaggcgtccagggtctccctcacctgaagctgactttttccccaccttggacagagggcgggagatgccatccccactgaacccagtgctttcaccagccatattagctcccactcaccccccgtcgtggaagcctcggccgtcacacctgcagggccggggcgtgcatggcctcagggatggcctgttcagctgctgggtgactcgggtccaggtgcctcaccacctgctgagctctgtgtgatttctggacncttctgctcgttgcctttgggctcagtgaagagtctggagtttatctggagtgaggtggccggttcttggtgggatctgagcaggtggaggcaatgcccagagctgtggcagccaccttgcagccgtgaagcaccagtgggaatgacagtcaagagaaccacggagatgccagcccctggacccacagcagcagcacctgcttccagactcagagtgtgagaaaaaaataaactcctatttgtttatggcaagagacaaggtctagctctgtgatgcaggccggaggacagtggtgtgatcacagctcactgcagccttgaactcctgggaggatcacttgagcctgggaggcggaggttgcagtgagctgagattgtgacattgtactccagcctgggtgatagagtgagacccccactcaaaagagaaaaaaaacagtagt

SEQ ID NO: 659450 - DNA, 785 bp, Homo sapiens
cttgttttgaaagtcccctccattgaaacacgcacatctaatttgtccttcagttcggttggactccacgctgaacgtgccatgctccattgccccgtgagtaactccatgctcttgccggtttcacacggcctctcagagctggagcctttgttcaggagccctgggcagctttcaggaagctcttgggctcatcagcttcctctggctgaagccgccccagtggaatcatggggatttcttactttgaaggtggggccacccgcagactgtaaccggctggttcaagatcaaggacttccccaggccacctgcctcagaggcaagaaaggctcagctgagtcccagacactcctcgctgtggcccctccttcctccctgctgggcaggcccccctcaattctgtttgccagcagggcctagtaacactgaaagacgaaaagggaaataaaataaacacaattaataggctaaaggttactgaataaagtggcagcagtaaataaattgactactgtgcaaatacaaagacatgaagacatgaaacccctgctctaaatgaccactcaccaagagcaaggcctgggctggaggcagggagcacctccctaaggagcactccctctttcccggagtgagtcctccttctagatggaattcagtccgggttcctcttgagccacagtccctgttggggcctatctcagtggactcaagatcctgaacttcttccagattgctgactacacatttgagtcacccagagattaaaagaaaaaacaaat

SEQ ID NO: 659451 - DNA, 210 bp, Homo sapiens
agtgacgcacaccctgggttcaagttggatctggagtggacgcacgagtgtgttattttcattattcatacaatattttctatatatccggggcaacggagaatttggagtccgattggggggggtccttcagagaaccacagagcggtggaatcggcgcggaagtgccaggttcacacgtgcagcttgtggctcgtgttcatcttgcag

SEQ ID NO: 659452 - DNA, 767 bp, Homo sapiens
taaaaacaaaggttaatgtccgtgtaacggaaacatttccgagggaaagcagttcacagcaggcaccgagggcccacgtggaatgggtgtggatgctcaggctgggaggtggacgctcggggcggcccgctttgggggcaggtgcggccgggttcaccggccgtgcaggggtcattcccgagcaaagtggcgtgggagcgagacggggtgcagaaccaagacaagggggacccgtgggtgcaccgtgacaccaagctggccccacaaaaaaggcggtaacgcctcaggtccccaggcagggatgcccccaccccgaaggcctcgtgggggcgtccgttcatccgggaaagagcttccggaattggccgaaggcggagtggctgatgatgaccctaacgtcggccggccggtcctcggggatcaggtcaacctcctgaacgggggcctccttatacggccagctgagctgggcccctgggagcctcacacggagagtgaggatcgggttcccgcgagacctcaaaaccgccgaatcgagccgagctcagctccgggagcccgggacccgcagagcagaacgggacgacgtagcggaccgggggatgtacccgggccacgagggtcccacctttgttgtgaacctccaacagggagtccacgggagcggggagggcactggccggccacgcagggtgggcaaaacgctggatacgggagcccgatccgggggggctgcgtccacaggtgaaatgagaccggtggggcag

SEQ ID NO: 659453 - DNA, 876 bp, Homo sapiens
  misc_feature (876)..(876): n is a, c, g, or t
ggcgcttccgggcaggggcggggcttccggggcgcctcaggtcgcgggcgcctaggcctggttgtcctttgcatctgcagtgtcgcagtcgttccggatgtgcctctgttgcgctggggtgccctgtgttgctgggctcttccggtcggccgggcctcgagggctggcggcgcccggcttcggctttttcgggagaagctctctgaaggccggccacccggggttggtggcacccccgggcccttccggggtttggctccaggggtgcggcgacagggttccagaagggggaggccggggaccttcgttgggggccttcggggggaccccgtggcgccccgtgtggggattgggtgcacttggcgggctcccgtttggcacacacaggcaggcggggaaaaacaaaagccttgggggtggagatccccctcggagctggcatggacacactcaagagggagggaacaagcaaacacatctcccagaacaggctattaaaagccccctcccattaagggattgggtctggaagggtgtgggcagctggaaaaacctgagtgggggaccaagaaaaggcgaaaatttaaggggcggagaaaacaggtctgcccgggggagaagacaaacatccaggcggtccacttttcaaatcatttaacaacagatggatttcccaccaacatgtggggtgggtggagagggaggagaccccttcgaagcgggacacagaagggtttgaacagaaagggaacgcttgagtgtggatcattcaactcccaatttcgctgggttggaaggttcatacacgaattggttgattggggacaagaaggctttggttggtggacgtggcaatcaatccaggaggaatggagn

SEQ ID NO: 659454 - DNA, 750 bp, Homo sapiens
gttactgtcccgcgaacccacatccctacaaagcaggaaagtatgcttgggagaggccaagtgagtggggaatcagcccaaagccaggcgtccagggtctccctcacctgaagctgactttttccccaccttggacagagggcgggagatgccatccccactgaacccagtgctttcaccagccatattagctcccactcaccccccgtcgtggaagcctcggccgtcacacctgcagggccggggcgtgcatggcctcagggatggcctgttcagctgctgggtgactcgggtccaggtgcctcaccacctgctcgttgcctttgggctcagtgaagagtctggagtttatctggagtgaggtggccggttcttggtgggatctgagcaggtggaggcaatgcccagagctgtggcagccaccttgcagccgtgaagcaccagtgggaatgacagtcaagagaaccacggagatgccagcccctggacccacagcagcagcacctgcttccagactcagagtgtgagaaaaaaataaactcctatttgtttatggcaagagacaaggtctagctctgtgatgcaggccggaggacagtggtgtgatcacagctcactgcagccttgaactcctgggaggatcacttgagcctgggaggcggaggttgcagtgagctgagattgtgacattgtactccagcctgggtgatagagtgagacccccactcaaaagagaaaaaaaacagtagt

SEQ ID NO: 659455 - DNA, 303 bp, Homo sapiens
  misc_feature (221)..(221): n is a, c, g, or t
  misc_feature (302)..(302): n is a, c, g, or t
ggctaacaaacttttagaaaagtgttttagtctcactagtaagtaacaaaatattggggcagggcacagtggctcatgcgtataatcctagaactttggaaggccaaagctggtggattgcttgagcccaggagtttgagaccagcccaggcaacattgggagaccctgcctctacaaatatacaaaaaattactgggcatggtgacacacacctgtagtnccagctgttctgaaggctgaggttgggaggatcactttgagaccaggagaggtcaaggctgcagtgatctgttgatcacanc

SEQ ID NO: 659456 - DNA, 339 bp, Homo sapiens
tgggagctgccagtgcaatggcatgatcttggcttgctgccacctctgcctcctggattcaagcaatactcccacctcagcctcccaagtagctgggactacaggcacattcctcaagcctggctcattttttgtagagacagggtttcaccatgttgcctgggctggtcttgaactcctgggctcaagcaatttgctccctttggcctcctaaagtgctgggattactggcatgagccactgcacccggcccggatgtttttatagtttgctttttaagatcatgcagtggacaacacaatttaggaaatcaggagagcaaaatctgtataccacatg

SEQ ID NO: 659457 - DNA, 761 bp, Homo sapiens
gcgcaggacgcaagcgtctgccggcgtggacgggtgccgatttgacaagatcacagctgcggaaaatggacagtgaggtgcagagagatggaaggatcttggatgggatcgatgatgctgggcgagaagacaagctggcttatgaggatgtcgcaataccactgaatgagcttcctgaacctgaacaagacaagtggtggcaccacagaatcgtgtcaagagaacactgaaatgaatgtggagcagacttgagccttacagtacctccatgagaatgttccccccattggaaattgaacgctgtgggtcctttcttgtggatggattttctcaaagtacacagataaagcatggtttgtttcagtctccaaattcaaacctttgagtaataaatcagcgactcaaagaatgtacacccattgagtttgtggtagcaaagtgcaatgcgaacattgaatgagaaactgagatttctcagtaatggtgaatatttggtctttaaacgtaaaacgtcttcatgtgaagtagcttatattttgaacatggatgtgtgttaaagcatttggctctaagctctgatttgtgcttgtgctgtcaagagtttagaaacttccaaattaacttatgtgtgttcgttgtaacacagggtgattgaacgtattgaagaagggaaaggggaagaaaaggaagcagaaattaggggaattttgaatttcataatttcccaaattgagaagatttcgggggggattagcggtggt

SEQ ID NO: 659458 - DNA, 163 bp, Homo sapiens
ccgtcgcagcctgctgcgtgccgccgcgggcgcttcaccttcagcgcctgggtgcgcgccgaccagccggccggcgagcagctggtgtcgcccgccgcgatgccggcaacgcgctgctgatcggtatcaaccagggcgtgcccttcgtcgaagtgaacggcca

SEQ ID NO: 659459 - DNA, 239 bp, Homo sapiens
  misc_feature (9)..(9): n is a, c, g, or t
gatctctgntcctcatgtcgaagtcagccgcatcttcttttgcgtcgccaagccgagccacatcgctcagacagctactgagagctcacctcctcacaagacggctggtccatgtggagaacattcaaagttgtcttccctggcaggttctgggaggcctcatgtaaatgcaaaacatgacaatgccagtttacacttcacttcctccagcgcaacccaacgtgcagccttcctgtcct

SEQ ID NO: 659460 - DNA, 642 bp, Homo sapiens
tggtacccagtttgtgtaggaggacactacaccagcactgttttgccagtaattagctgtgggcttagagtcgcggcgcgagtaaatcggctcaggacccatgccattgccacgagcaccggacactacccagccacacagaatcaacacatgattgccaccaacaaggacccgaaggacctttcggccaccctttagcacagtttatgtgcactagttatgttacaactcaactacacccaccacaaggggatccgtgcacgttaccgattactaggactatgacataaacctccagccttactttggtgggcactacttccccactgatctgcaggttgtggatcttctaccagttacaggtgccgacccagggcctgcctgacactggactcgcagaaacccacgttgttatacacctcatgtctcctacgggaatcatctacagaaccacctgcaaagtggaggggtcgctgaacagcctctacccggaggccgactgtacacccacctagtacgaggcccatatagagggctacgcggagggcagagaacgctgcccactaatactaaggctactactacatcagcagcagcagccgtgggttggtcgtcttctcagttgtcttgtggtagctggcc

SEQ ID NO: 659461 - DNA, 213 bp, Homo sapiens
  misc_feature (48)..(48): n is a, c, g, or t
tggcatatttgtatctcttttatgacaggagatgggcaaggagtgcantcgttgaaagttaatttatttcaaacctttacacagcttcttcattcatgcctcacaaatatctttgagaattaaggtagccattatttcccattttaacaacttgataaaattagaaagtattggtaagggctgggaatgggtgggtccacaacctgggagaat

SEQ ID NO: 659462 - DNA, 381 bp, Homo sapiens
  misc_feature (83)..(83): n is a, c, g, or t
  misc_feature (89)..(89): n is a, c, g, or t
  misc_feature (200)..(200): n is a, c, g, or t
  misc_feature (204)..(204): n is a, c, g, or t
  misc_feature (237)..(237): n is a, c, g, or t
  misc_feature (306)..(306): n is a, c, g, or t
atgagacatcaacgcacagaccatacgctgctcgacaggctatcaaatgccctggaacacgaggcaaaaatgcctgtcatcgngtgganaacaccatggagtccctcctggtggacattgtggccgacctacggcctggcttcgatgacgttgatgccgaagagttcggaaccagcctgcagggcgagaccgaactgganggcnatctcaccttccgggatgtgctgcaccgcatgntgcatcgcctgacctactacgtggagaccaaccgctatggtgaggccaccaaggtccccgtgacctccnaagagttcatggatgtggtttcgacagtggacgggttgatcaatgacttcccggatctgccggtgtcgtcactgg

SEQ ID NO: 659463 - DNA, 386 bp, Homo sapiens
  misc_feature (327)..(327): n is a, c, g, or t
  misc_feature (355)..(355): n is a, c, g, or t
  misc_feature (370)..(370): n is a, c, g, or t
  misc_feature (382)..(382): n is a, c, g, or t
aattcggaacgagggtgggtttcatacaaggggtgcagagatggtttaacatacacaagtcaatacatgtgatacaccacataaacataatttttaaaaaaaatcacatgatcatctcaatagatgcagaaaaaacattcaacaaaatccagcatcctttatgattaaaaccctcagcaaaatcgacatacaagggacataccttaatgtaataaaggccatctattacaaatccacagccaacataatactggatgggggggaaacctggaaggcattccctctaaggatgggggacaggacagggtgctcactcttcacccactnctctttcaaatggtactggggagtcctnggccaggggcctttnccaccagggggnaggg

SEQ ID NO: 659464 - DNA, 146 bp, Homo sapiens
ttaaccggtgggaaacttccggaattggtcgaaccacttttccaaattgccatattaaggcgggggtttcaaacccaaagggatgttggattgtaaagggaaattttatttggcggttaaaccaaatagggaggaaggtgaaccca

SEQ ID NO: 659465 - DNA, 379 bp, Homo sapiens
  misc_feature (171)..(171): n is a, c, g, or t
ggtccaggttttttccagggggtttgggctgatggtttccatggaaacaagggtaggggccaggggtggttttccctgcttatgtttttcgggattttgggagccccccctctatccgtttccattttgttttgggggccccagggccgaaaagccaagatttcatgaaanaaataggtttttccccttgccctaagatcaatttgaacttttttagccccgtcaggggggtttgtttcctaaaaaggcattttttgccaggggattccccccaaggttggggccccccttggaaaatgaaaaattgcccccccttggggtagacaaaaaccagttccccttggggttgtggcctaaaaaaaaccctttttttttttta

SEQ ID NO: 659466 - DNA, 405 bp, Homo sapiens
  misc_feature (405)..(405): n is a, c, g, or t
tgggctttccaagaaaacacataactttgaatcaacacaaccagcccactagcctacattattacgcatcatccgctctactcatttttgtaaccgaaatgtcaacaagcaagcgctatttagcgtagttccccgaacccttttccgtccgtacgccgcctagacaacgccccactccatagatagctaaactacgctggactccgtaaccccttcgacaaatcaagtggcaaggcacaactggggcttgtggccatgccatttatcgcattccccttgggcattcaatgcacacagcacacacacatcgaaaccgcgaatactatcagcaccttggccaaggaaccattgggccctggtcatcgacggacacgcacacacaagcggaaccttccaaagcaccgn

SEQ ID NO: 659467 - DNA, 154 bp, Homo sapiens
  misc_feature (12)..(12): n is a, c, g, or t
  misc_feature (83)..(83): n is a, c, g, or t
  misc_feature (128)..(128): n is a, c, g, or t
cccacatccttnccagcacccttaggaaggcccaggcagggctgttgcagcggacctgggctgttctgtgttgaaggagtgtncccagtgcccttggaggacctgtgagagccacctcacaggcagancccaccaggcagggcaaggagatctc

SEQ ID NO: 659468 - DNA, 176 bp, Homo sapiens
  misc_feature (46)..(46): n is a, c, g, or t
  misc_feature (130)..(130): n is a, c, g, or t
gattggccactgcatgtacagtcagccaggtccagactgtggaccnctagactcctggcctggcagtcccactggcccccatgattcccgcaacctgtcctgggcccagagtttctttggcccttaaagnaggcaggggggggcccagggctggtggccaggcaaactgggaattc

SEQ ID NO: 659469 - DNA, 401 bp, Homo sapiens
gatggaaggtcgtgtacactgtagccccagcgctgcgtgcagcctgccaactacagctggtaccaggcgggcagtgctcgaccaggccctgttacagtctacccctacatgcatgccctggacaccctatatgtgcctctgctggtggatacaggggtgcccctagtcactggtgccactgtccttggtcaccatcagttgctgcttcatgaagaggcttcgaaaaagggtgatcctttactccccaggtcttgcaggtgtcgagtgtctaccggcccagttacaagccctcttctggtggcctggacaccctctccctcagaccactcttcctataatttatgggccctcccactaccaagaatggggagaagtgcctccccttccccattcattccctc

SEQ ID NO: 659470 - DNA, 1647 bp, Homo sapiens
  misc_feature (596)..(596): n is a, c, g, or t
  misc_feature (719)..(719): n is a, c, g, or t
  misc_feature (793)..(793): n is a, c, g, or t
  misc_feature (847)..(847): n is a, c, g, or t
tggggggttggtatctggcgagccttttctcccggggactcccggtctggcgcgccaagggatgttgaaaaaatctgggaatgatgacacagctctccttctttcttcttttttttctttgtgcgtggcctctctcgcggggttcgtgggagcgggaggaggcgtgggcataaaaaaggggtgagtgaacgtggggcacatttctcttctccagaagcgtggtgagaagtgcctcgagtgtggagcgcgtggtaggaaaccgtggtataaggtggcattgtggcgggtgtgggagccatgagggatgtgccaccttgtggcgtatagagcgcgcccgtgtgtcaaggagagcctcatgtgggacaagagcctctgcggagaatcttctatatttacagagtgtggtctccactctgtgagagctctctgtggagaaaatgtgtgggaggccctctctctcttctcgagagagacaccccgaagagtctttatgagaggccacaaacaaagaagagcgggggggacactctcccatgtgtgtggccccacccagaggggggcttctcaaaaatgttgctgtgaagatgtgtgtcccnagctgtgggcacacgcgtgggcattatctccgagtgggcgggcccccttctcttttttatatctgtttcctcgctgtgagagcccatctccagaggagaaatatatttgtgtgcgggctcttntctttctcccctcacaagggtgggctcccttatattctatatctctcgctgtttctctcctttggggagggggncgcactctacaggaatacgcgtggcctcatcccttgtgtgccacaccatgtggnggactcctgtgggggcgggataaaccctgtgcaggcggcggttgaggggcaccacgtcgggttgtagaacgccgtgaaatataactcgtggcgctccgtgaggataactccggcgaagaacagcgggcggaaaaaaacttccttctcgtgtcccaggggaaggggggccggactccctttccacagaaggtccaagttggggggtcttacaaaccaccaaaatttctcgtgggaagttctgccaggaaggggggggacccaggaccacaaggcccttctctgttggggtgggaataaaacgccattttcccaaggacacccagcggcgggggggaacatgttaccccccccaaagaaagggggaaatcaactgggggcccttggaatgcgaactcccggagcaaaaagaggggcgctacacaaaggggggtgtctctaccacaaacacccgacttgtggtaaaaggcgcccaaaaaaacgcgggcgaccaatagtttgaacgggtggaaaaatacccgcccccgggtagtacgggcgcacgaaagaagggagggcccacgaagtgggagaaggggacaagcgcgccaaagaagaggccgcgaagagaggggtagcgaggagaacaccaaacacggaagataaactaagggagaggggggagagcacaaacgggtcgggccgcacaaaccaacccacgacgacgggggacagagatagtatagcaaccacggaagatccctatagcgagagatagatgcgcaactacaggttacggaaaggactagaacaaagagcgagcg

SEQ ID NO: 659471 - DNA, 145 bp, Homo sapiens
tagtgttcgatagctttaaatctcactaaacaaccaaaatatgtacagagataagcactaaagaaaattacgcaggaagaagaaattagatttttgtttgaaaaaaaaacggaaaagaaaaaatttggttacgtttacaaaagtg

SEQ ID NO: 659472 - DNA, 945 bp, Homo sapiens
  misc_feature (533)..(533): n is a, c, g, or t
tccagttctaaaaccaaattttttattctcttagtttgtgaaaagggaggggttaaagtggttgtgttctcgtgtttatagttctccagaagaaccagaaacagaaggcccaataggtctagaaatttttaggaaaagcagaaatttcatctcattttatagaggagaggattttctaacacattatagaaattttctatacacacattataaaatctcatctccgagggcccctcgagggagcgtgtggcgagaagttctccgtgtgtcacccataagtgtgcctcaagccagagaggccgaggtgtgtctccatatatgtgcctacaaagatgtggagagacaacaggagacaacctctcaccacaggaatattttcttcccctctcagggctgtgcgcccctctcacatcttcacacaattgtcgggagacaagtctcctgtgtgcgccgcggtgacacatgtgctgtagaggctccctgtggacaggagacgcagaaaagagagggggtctgtgtgcgggtgtctctcnagacacagagaaacccgcgtgggcacacacgagtgtgactgtggcgtgacacgcagcctcgaggggggagaggggcccttctctcgagcgcgccgttggagaaaagcgggcgccgccaccgcagacatctataggaggcgcgcgagacaccgagacactctagagagagtagtcttaaagaggtgcccccgtgttggggggcatcatccggtggccctacctctgtgcgggcaaaacgggacaagtcaagggcatattgcgcacacgtcatattttttaacccccacgacaagcaaaccggggggattcctctccctcccccaacagtctccgtgggggtgttgccccaataacgccaccagggggggcgtgaccacggtgtgggcgcacgggtgcgcaaaagggacacaac

SEQ ID NO: 659473 - DNA, 517 bp, Homo sapiens
tgggctccataaattttcctggttggccatggaaatgtaaaagtggattatttaattacatttctcagtttaagtcctcgtgtaagtgctcgggaaattttccaaaaaaaattaaaagagtggacgtgaaaaaaaaaaaaaaaaaaaaaaaaaaaaaaaaaaaaaaaaaaaaaaaaaaaaaaaaaaaaaaaaaaaaaaaaaaaaaaaaaagaagaggcgggggcgcgcgcgccaataatacactcctcctccgcggcggaggccgccaccaaccagcagcagcagcaccccacctttgtttctgaaacaacagcagggcgcgcaccaaaggagaggagcgagctctctaataataaagaacgagcgaagccgcgcgcgccgccgctcaataaaaaaaacagataacatggagggagaacacaaagggcccacagagggaaatcacttgggaggagaagagccaaaacatttggtggggggtggaaacgacaaaggggaggaaaaccaccccacgaaa

SEQ ID NO: 659474 - DNA, 717 bp, Homo sapiens
tagtaaaaacaggttttccccatgttggtcaggcgggtctcgaactccggacctcgtgatccaccggcctcggccttccaaagtgcgggggattacaagttggacggccattgcaccgggctaattggccctattttaaagtcaagcaaggggaagaataacaagattatttagtaatcagtttcatgacactaaaagtcatatagtcatagggttttcatcttcatatcttggcctaaattcattggctcacagtgcgggaaccaaaattggttcatctcatgattccctacttctgaccttaagggaaagtaagtggctcagaaaataggtgcagggtcaataagtggcacaaagtgggggctgcaattattggctaccataagagctacaaggctggattagaaatgatctcaaaaccttttagaatttccaaaatcttcacatttacggaaccggtcggacatatatggggtcttggaaaattccaggaacgagtgattagttcactcttccccattattatataagcgctaatcagggcaggggattatcttaaccatcatatcacttcattgagatttctaacatactccaattataaacggtcatgtaattccccatgtggaacctcctccacggggattactgacgacatattagatggttcaaccaggctggaaattccctctggggaattccatggaaccaattgta

SEQ ID NO: 659475 - DNA, 433 bp, Homo sapiens
cagtgtatccctgactgatatgctggtgggtatctgggcactcctcatccattttgacacaacacagcacatacatacacacacacacacacagcagacacacaaacaaacacagacacacccactcctgatagtaggaagaacagtattgtggacaaagaggaggctgaaggctgtatgacgccttgagacatcaactcagtgtatgtgtggaggtggcggaaatgtattattacctggacacactcttcaccctttaggcctaaaacatagctccacctccaccgggacgtttttgcacaagtgtgttcctttgagagactcaccagatgctgtagtgcatatttggttctccaatagaaatatattttgtatttatagttcctagaggatatgtgtgttttgtacttagcagactctatagcaccatctt

SEQ ID NO: 659476 - DNA, 195 bp, Homo sapiens
  misc_feature (133)..(133): n is a, c, g, or t
  misc_feature (140)..(140): n is a, c, g, or t
ggtcgcggagcagatactggaatccatacttcagttgggcgagccgtgaggtctcggtcgaaactactcaactcggccgtcctagcacaaaagcagccatagacaacacacaaacgagagggctgggctcccnttccagngaagatttatttaaccaggctcccagctggaatttcactccacaggacacagttt

SEQ ID NO: 659477 - DNA, 343 bp, Homo sapiens
taaaggtagaaaagggaagaggaaacaggcacaaaatcaaaggaggacgaggacaggagagatgagacaacaccaaagaagagaaaaagtaaggctagaaaagcgagagaggacagggaaaacataaaacgggaggacgacagaggaaagagagagtcaggtatagagaagaagcagtatgagacatggacgaagatagtacagagagcagagagtagagaagcgcagccgaacagacacactcaatctctctctctctctctctctctctctctctctctctctctctctctctctctctctctctctctctctctctctctctctctctctctctctctct

SEQ ID NO: 659478 - DNA, 1916 bp, Homo sapiens
cggacctccacactgagccatgcccacccccgacgccaccacgccacaggccaagggcttccgcagggccgtgtctgagctggacgccaagcaggcagaggccatcatggtaagagggcagggcgccccggggcccagcctcacaggctctccgtggcctggaactgcagccccagctgcatcctacacccccaccccaaggtccccgcggttcattgggcgcaggcagagcctcatcgaggacgcccgcaaggagcgggaggcggcggtggcagcagcggccgctgcagtcccctcggagcccggggaccccctggaggctgtggcctttgaggagaaggaggggaaggccgtgctaaacctgctcttctccccgagggccaccaagccctcggcgctgtcccgagctgtgaaggtgtttgagacgtttgaagccaaaatccaccatctagagacccggcccgcccagaggccgcgagctgggggcccccacctggagtacttcgtgcgcctcgaggtgcgccgaggggacctggccgccctgctcagtggtgtgcgccaggtgtcagaggacgtgcgcagccccgcggggcccaaggtcccctggttcccaagaaaagtgtcagagctggacaagtgtcatcacctggtcaccaagttcgaccctgacctggacttggaccacccgggcttctcggaccaggtgtaccgccagcgcaggaagctgattgctgagatcgccttccagtacaggcacggcgacccgattccccgtgtggagtacaccgccgaggagattgccacctggaaggaggtctacaccacgctgaagggcctctacgccacgcacgcctgcggggagcacctggaggcctttgctttgctggagcgcttcagcggctaccgggaagacaatatcccccagctggaggacgtctcccgcttcctgaaggagcgcacgggcttccagctgcggcctgtggccggcctgctgtccgcccgggacttcctggccagcctggccttccgcgtgttccagtgcacccagtatatccgccacgcgtcctcgcccatgcactcccctgagccggactgctgccacgagctgctggggcacgtgcccatgctggccgaccgcaccttcgcgcagttctcgcaggacattggcctggcgtccctgggggcctcggatgaggaaattgagaagctgtccacgctgtactggttcacggtggagttcgggctgtgtaagcagaacggggaggtgaaggcctatggtgccgggctgctgtcctcctacggggagctcctgcactgcctgtctgaggagcctgagattcgggccttcgaccctgaggctgcggccgtgcagccctaccaagaccagacgtaccagtcagtctacttcgtgtctgagagcttcagtgacgccaaggacaagctcaggagctatgcctcacgcatccagcgccccttctccgtgaagttcgacccgtacacgctggccatcgacgtgctggacagcccccaggccgtgcggcgctccctggagggtgtccaggatgagctggacacccttgcccatgcgctgagtgccattggctaggtgcacggcgtccctgagggcccttcccaacctcccctggtcctgcactgtcccggagctcaggccctggtgaggggctgggtcccgggtgccccccatgccctccctgctgccaggctcccactgcccctgcacctgcttctcagcgcaacagctgtgtgtgcccgtggtgaggttgtgctgcctgtggtgaggtcctgtcctggctcccagggtcctgggggctgctgcactgccctccgcccttccctgacactgtctgctgccccaatcaccgtcacaataaaagaaactgtggtctctagaaaaa

SEQ ID NO: 659479 - DNA, 1823 bp, Homo sapiens
cggacctccacactgagccatgcccacccccgacgccaccacgccacaggccaagggcttccgcagggccgtgtctgagctggacgccaagcaggcagaggccatcatgtccccgcggttcattgggcgcaggcagagcctcatcgaggacgcccgcaaggagcgggaggcggcggtggcagcagcggccgctgcagtcccctcggagcccggggaccccctggaggctgtggcctttgaggagaaggaggggaaggccgtgctaaacctgctcttctccccgagggccaccaagccctcggcgctgtcccgagctgtgaaggtgtttgagacgtttgaagccaaaatccaccatctagagacccggcccgcccagaggccgcgagctgggggcccccacctggagtacttcgtgcgcctcgaggtgcgccgaggggacctggccgccctgctcagtggtgtgcgccaggtgtcagaggacgtgcgcagccccgcggggcccaaggtcccctggttcccaagaaaagtgtcagagctggacaagtgtcatcacctggtcaccaagttcgaccctgacctggacttggaccacccgggcttctcggaccaggtgtaccgccagcgcaggaagctgattgctgagatcgccttccagtacaggcacggcgacccgattccccgtgtggagtacaccgccgaggagattgccacctggaaggaggtctacaccacgctgaagggcctctacgccacgcacgcctgcggggagcacctggaggcctttgctttgctggagcgcttcagcggctaccgggaagacaatatcccccagctggaggacgtctcccgcttcctgaaggagcgcacgggcttccagctgcggcctgtggccggcctgctgtccgcccgggacttcctggccagcctggccttccgcgtgttccagtgcacccagtatatccgccacgcgtcctcgcccatgcactcccctgagccggactgctgccacgagctgctggggcacgtgcccatgctggccgaccgcaccttcgcgcagttctcgcaggacattggcctggcgtccctgggggcctcggatgaggaaattgagaagctgtccacgctgtactggttcacggtggagttcgggctgtgtaagcagaacggggaggtgaaggcctatggtgccgggctgctgtcctcctacggggagctcctgcactgcctgtctgaggagcctgagattcgggccttcgaccctgaggctgcggccgtgcagccctaccaagaccagacgtaccagtcagtctacttcgtgtctgagagcttcagtgacgccaaggacaagctcaggagctatgcctcacgcatccagcgccccttctccgtgaagttcgacccgtacacgctggccatcgacgtgctggacagcccccaggccgtgcggcgctccctggagggtgtccaggatgagctggacacccttgcccatgcgctgagtgccattggctaggtgcacggcgtccctgagggcccttcccaacctcccctggtcctgcactgtcccggagctcaggccctggtgaggggctgggtcccgggtgccccccatgccctccctgctgccaggctcccactgcccctgcacctgcttctcagcgcaacagctgtgtgtgcccgtggtgaggttgtgctgcctgtggtgaggtcctgtcctggctcccagggtcctgggggctgctgcactgccctccgcccttccctgacactgtctgctgccccaatcaccgtcacaataaaagaaactgtggtctctagaaaaa

SEQ ID NO: 659480 - DNA, 107 bp, Homo sapiens
agagtgttcttcgagatattacgtctttcgattaggaagtacagcacaagactttcttcacctattgttaacacatcaggctcagtctcactgcagagaggatgaga

SEQ ID NO: 659481 - DNA, 1647 bp, Homo sapiens
cggacctccacactgagccatgcccacccccgacgccaccacgccacaggccaagggcttccgcagggccgtgtctgagctggacgccaagcaggcagaggccatcatgggccaccaagccctcggcgctgtcccgagctgtgaaggtgtttgagacgtttgaagccaaaatccaccatctagagacccggcccgcccagaggccgcgagctgggggcccccacctggagtacttcgtgcgcctcgaggtgcgccgaggggacctggccgccctgctcagtggtgtgcgccaggtgtcagaggacgtgcgcagccccgcggggcccaaggtcccctggttcccaagaaaagtgtcagagctggacaagtgtcatcacctggtcaccaagttcgaccctgacctggacttggaccacccgggcttctcggaccaggtgtaccgccagcgcaggaagctgattgctgagatcgccttccagtacaggcacggcgacccgattccccgtgtggagtacaccgccgaggagattgccacctggaaggaggtctacaccacgctgaagggcctctacgccacgcacgcctgcggggagcacctggaggcctttgctttgctggagcgcttcagcggctaccgggaagacaatatcccccagctggaggacgtctcccgcttcctgaaggagcgcacgggcttccagctgcggcctgtggccggcctgctgtccgcccgggacttcctggccagcctggccttccgcgtgttccagtgcacccagtatatccgccacgcgtcctcgcccatgcactcccctgagccggactgctgccacgagctgctggggcacgtgcccatgctggccgaccgcaccttcgcgcagttctcgcaggacattggcctggcgtccctgggggcctcggatgaggaaattgagaagctgtccacgctgtactggttcacggtggagttcgggctgtgtaagcagaacggggaggtgaaggcctatggtgccgggctgctgtcctcctacggggagctcctgcactgcctgtctgaggagcctgagattcgggccttcgaccctgaggctgcggccgtgcagccctaccaagaccagacgtaccagtcagtctacttcgtgtctgagagcttcagtgacgccaaggacaagctcaggagctatgcctcacgcatccagcgccccttctccgtgaagttcgacccgtacacgctggccatcgacgtgctggacagcccccaggccgtgcggcgctccctggagggtgtccaggatgagctggacacccttgcccatgcgctgagtgccattggctaggtgcacggcgtccctgagggcccttcccaacctcccctggtcctgcactgtcccggagctcaggccctggtgaggggctgggtcccgggtgccccccatgccctccctgctgccaggctcccactgcccctgcacctgcttctcagcgcaacagctgtgtgtgcccgtggtgaggttgtgctgcctgtggtgaggtcctgtcctggctcccagggtcctgggggctgctgcactgccctccgcccttccctgacactgtctgctgccccaatcaccgtcacaataaaagaaactgtggtctctagaaaaa

SEQ ID NO: 659482 - DNA, 1925 bp, Homo sapiens
tccatctctgtctctttctccttctctctctcttcctgcttttgctccctaagacgtttgaagccaaaatccaccatctagagacccggcccgcccagaggccgcgagctgggggcccccacctggagtacttcgtgcgcctcgaggtgcgccgaggggacctggccgccctgctcagtggtgtgcgccaggtgtcagaggacgtgcgcagccccgcggggcccaaggtcccctggttcccaagaaaagtgtcagagctggacaagtgtcatcacctggtcaccaagttcgaccctgacctggacttggaccacccgggcttctcggaccaggtgtaccgccagcgcaggaagctgattgctgagatcgccttccagtacaggcagtgaggggcccctgcgctcgggacccagactccgtcctgcaggctgacgctggacctggggggtgggagggaaggacaaaggggaggacccatcttgtcaccagcatcagtgcctcctgccaggcagctctgctccagggctttccatgtccccaaatcccagtggggaaactgaggcccaggggggctagagcaacctgccgaggccacatagccggctcacggcacagtcagctggggtgcaccctcctgtccatcctccaacccaaaggcctcgctgcactaggcgggtgtggacctgtgcccagtgaagctccctccctccctcctgcccttctcactccccgaggggacctgctgaccactggccccctccccagcggcgacccgattccccgtgtggagtacaccgccgaggagattgccacctggaaggaggtctacaccacgctgaagggcctctacgccacgcacgcctgcggggagcacctggaggcctttgctttgctggagcgcttcagcggctaccgggaagacaatatcccccagctggaggacgtctcccgcttcctgaaggagcgcacgggcttccagctgcggcctgtggccggcctgctgtccgcccgggacttcctggccagcctggccttccgcgtgttccagtgcacccagtatatccgccacgcgtcctcgcccatgcactcccctgagccggactgctgccacgagctgctggggcacgtgcccatgctggccgaccgcaccttcgcgcagttctcgcaggacattggcctggcgtccctgggggcctcggatgaggaaattgagaagctgtccacgctgtactggttcacggtggagttcgggctgtgtaagcagaacggggaggtgaaggcctatggtgccgggctgctgtcctcctacggggagctcctgcactgcctgtctgaggagcctgagattcgggccttcgaccctgaggctgcggccgtgcagccctaccaagaccagacgtaccagtcagtctacttcgtgtctgagagcttcagtgacgccaaggacaagctcaggagctatgcctcacgcatccagcgccccttctccgtgaagttcgacccgtacacgctggccatcgacgtgctggacagcccccaggccgtgcggcgctccctggagggtgtccaggatgagctggacacccttgcccatgcgctgagtgccattggctaggtgcacggcgtccctgagggcccttcccaacctcccctggtcctgcactgtcccggagctcaggccctggtgaggggctgggtcccgggtgccccccatgccctccctgctgccaggctcccactgcccctgcacctgcttctcagcgcaacagctgtgtgtgcccgtggtgaggttgtgctgcctgtggtgaggtcctgtcctggctcccagggtcctgggggctgctgcactgccctccgcccttccctgacactgtctgctgccccaatcaccgtcacaataaaagaaactgtggtctctagaaaaa

SEQ ID NO: 659483 - DNA, 1200 bp, Homo sapiens
ccacgcgtcgcccgtcgtaggcccctacgggctacctagaacctttcgctgacgccataaaactcttcatcaaaagagccccatataaacccgtcacatcctatccatcacccgtctacatcatccagcctcctgaccttcagctctctactcatcagcgtcttctactatcgaacccccgatcccccatacctcaaccctcctggtcaaagccgtcactacttaggcctcactatcatttctgaccccagcctgcttatgccttaagctcgtttagcatcaagtgcgcttgctgatcaagaggtgcagcatcaaagaccgtctagaatctgagcgccactgactccggcgcaacgtggcagagcaagtagccctatagcaaggtctcactattgaacgtcagctcctagctcaattacatatcttacctatctacacagttaccttacattaagctgcgtctccctatctactccatcatccaaccccattattccaccccctacgaagtaaaccacccctcctgcacttcacttcaccctgcctcgaatccactgtaccctctttgacgccccacgttacacctacctacgaacttaaaggccattccgccaacaccgttacgcgcacggacacgaccccatattccggaaaactccgccccgttatatgacgcgccatgtggtccccgaacaagggttggaatggcgtcccacggaacgcgactttaacggcatcgatccacaggggccctttttccagacgccaggtccgggaacactaacccggtgcccggacaaacgagtaccctccccctttttccaggctccccgctacgcttatccctttaccactcacaagacccccggactaaatatacacacctaaaacatcacaatttacaacttcccacttacactctccaaaacactcaaccacaccattcccatcccccactaatagccgagacactacttactacgccattcagcgagacacagccacaacgctacaccttacgctcgcacactctgacacacacactcccttcaacccacccgttgacaacaacccataccgctatacacacgctacacaacgccacctccacactttactaccacggactttacacactccccactaatcgaaacgcccccataaaccgacttggtctatataacatccacacttccgacc

SEQ ID NO: 659484 - DNA, 1476 bp, Homo sapiens
cggacctccacactgagccatgcccacccccgacgccaccacgccacaggccaagggcttccgcagggccgtgtctgagctggacgccaagcaggcagaggccatcatgggccaccaagccctcggcgctgtcccgagctgtgaaggtgtttgagacgtttgaagccaaaatccaccatctagagacccggcccgcccagaggccgcgagctgggggcccccacctggagtacttcgtgcgcctcgaggtgcgccgaggggacctggccgccctgctcagtggtgtgcgccaggtgtcagaggacgtgcgcagccccgcggggcccaaggtcccctggttcccaagaaaagtgtcagagctggacaagtgtcatcacctggtcaccaagttcgaccctgacctggacttggaccacccgggcttctcggaccaggtgtaccgccagcgcaggaagctgattgctgagatcgccttccagtacaggcacggcgacccgattccccgtgtggagtacaccgccgaggagattgccacctggaaggaggtctacaccacgctgaagggcctctacgccacgcacgcctgcggggagcacctggaggcctttgctttgctggagcgcttcagcggctaccgggaagacaatatcccccagctggaggacgtctcccgcttcctgaaggagcgcacgggcttccagctgcggcctgtggccggcctgctgtccgcccgggacttcctggccagcctggccttccgcgtgttccagtgcacccagtatatccgccacgcgtcctcgcccatgcactcccctgagccggactgctgccacgagctgctggggcacgtgcccatgctggccgaccgcaccttcgcgcagttctcgcaggacattggcctggcgtccctgggggcctcggatgaggaaattgagaagctgtccacgctgtactggttcacggtggagttcgggctgtgtaagcagaacggggaggtgaaggcctatggtgccgggctgctgtcctcctacggggagctcctgcactgcctgtctgaggagcctgagattcgggccttcgaccctgaggctgcggccgtgcagccctaccaagaccagacgtaccagtcagtctacttcgtgtctgagctgagtgccattggctaggtgcacggcgtccctgagggcccttcccaacctcccctggtcctgcactgtcccggagctcaggccctggtgaggggctgggtcccgggtgccccccatgccctccctgctgccaggctcccactgcccctgcacctgcttctcagcgcaacagctgtgtgtgcccgtggtgaggttgtgctgcctgtggtgaggtcctgtcctggctcccagggtcctgggggctgctgcactgccctccgcccttccctgacactgtctgctgccccaatcaccgtcacaataaaagaaactgtggtctctagaaaaa

SEQ ID NO: 659485 - DNA, 1430 bp, Homo sapiens
cggacctccacactgagccatgcccacccccgacgccaccacgccacaggccaagggcttccgcagggccgtgtctgagctggacgccaagcaggcagaggccatcatgggccaccaagccctcggcgctgtcccgagctgtgaaggtgtttgagacgtttgaagccaaaatccaccatctagagacccggcccgcccagaggccgcgagctgggggcccccacctggagtacttcgtgcgcctcgaggtgcgccgaggggacctggccgccctgctcagtggtgtgcgccaggtgtcagaggacgtgcgcagccccgcggggcccaaggtcccctggttcccaagaaaagtgtcagagctggacaagtgtcatcacctggtcaccaagttcgaccctgacctggacttggaccacccgggcttctcggaccaggtgtaccgccagcgcaggaagctgattgctgagatcgccttccagtacaggcacggcgacccgattccccgtgtggagtacaccgccgaggagattgccacctggaaggaggtctacaccacgctgaagggcctctacgccacgcacgcctgcggggagcacctggaggcctttgctttgctggagcgcttcagcggctaccgggaagacaatatcccccagctggaggacgtctcccgcttcctgaaggagcgcacgggcttccagctgcggcctgtggccggcctgctgtccgcccgggacttcctggccagcctggccttccgcgtgttccagtgcacccagtatatccgccacgcgtcctcgcccatgcactcccctgagccggactgctgccacgagctgctggggcacgtgcccatgctggccgaccgcaccttcgcgcagttctcgcaggacattggcctggcgtccctgggggcctcggatgaggaaattgagaagctgtccacgctgtactggttcacggtggagttcgggctgtgtaagcagaacggggaggtgaaggcctatggtgccgggctgctgtcctcctacggggagctcctgcactgcctgtctgaggagcctgagattcgggccttcgaccctgaggctgcggccgtgcagccctaccaagaccagacgtaccagtcagtctacttcgtgtctgagagcttcagtgacgccaaggacaagctcaggagctatgcctcacgcatccagcgccccttctccgtgaagttcgacccgtacacgctggccatcgacgtgctggacagcccccaggccgtgcggcgctccctggagggtgtgaagaatgacttaggctcaatcacatactctctttagaaagtgcgagggggttcaccgagtcacccagctggtttatacatagacaagattttgcaatggagcgaatgcatggttccagacgaggggaagacatcctgaagg

SEQ ID NO: 659486 - DNA, 162 bp, Homo sapiens
cgtgaccaccctggaacacaaggaagtgaaatggacgtaccctggagaataacgtagcaagaagtgcagcaaaacgaatctgcggccaagaggtgaaatcaagggtaaaatgatgggaagtgatgacccgtgagaaaaaaaagcctggggagcagcgaagag

SEQ ID NO: 659487 - DNA, 165 bp, Homo sapiens
attagcggtctttcctcaaaatgtaagcaactgctgcgttagcatgagtaggcacccacgtattaacgatggttcatagactttctgttataagcatgtgccacctgtaccctgtagcatgttggccagtgaacgccatgatccgatgttctcgagctttcaagg

SEQ ID NO: 659488 - DNA, 1788 bp, Homo sapiens
cggacctccacactgagccatgcccacccccgacgccaccacgccacaggccaagggcttccgcagggccgtgtctgagctggacgccaagcaggcagaggccatcatggtaagagggcagggcgccccggggcccagcctcacaggctctccgtggcctggaactgcagccccagctgcatcctacacccccaccccaaggtccccgcggttcattgggcgcaggcagagcctcatcgaggacgcccgcaaggagcgggaggcggcggtggcagcagcggccgctgcagtcccctcggagcccggggaccccctggaggctgtggcctttgaggagaaggaggggaaggccgtgctaaacctgctcttctccccgagggccaccaagccctcggcgctgtcccgagctgtgaaggtgtttgagacgtttgaagccaaaatccaccatctagagacccggcccgcccagaggccgcgagctgggggcccccacctggagtacttcgtgcgcctcgaggtgcgccgaggggacctggccgccctgctcagtggtgtgcgccaggtgtcagaggacgtgcgcagccccgcggggcccaaggtcccctggttcccaagaaaagtgtcagagctggacaagtgtcatcacctggtcaccaagttcgaccctgacctggacttggaccacccgggcttctcggaccaggtgtaccgccagcgcaggaagctgattgctgagatcgccttccagtacaggcacggcgacccgattccccgtgtggagtacaccgccgaggagattgccacctggaaggaggtctacaccacgctgaagggcctctacgccacgcacgcctgcggggagcacctggaggcctttgctttgctggagcgcttcagcggctaccgggaagacaatatcccccagctggaggacgtctcccgcttcctgaaggagcgcacgggcttccagctgcggcctgtggccggcctgctgtccgcccgggacttcctggccagcctggccttccgcgtgttccagtgcacccagtatatccgccacgcgtcctcgcccatgcactcccctgagccggactgctgccacgagctgctggggcacgtgcccatgctggccgaccgcaccttcgcgcagttctcgcaggtacgcctgcggcctcggagggagcctggggtcacccagggctggcttggcgccgggggcgggcggggatcgatgtgcgggtgggtgaagtgtgctgcctgctcccgggccccgccaaggaggctcggcgccccgagggtcgcgcggcatagggcggggctggagcggagcctcccacggcctgtgctgccacctgccggctacctgggaacggcgcccacgggcttacgaatatggtcaaggagggctgcctggcggaggaggcccggtgtaggtgcggatcctgggcggccagggaaggtctctgccgcccgggaagtgtcccagagacccctggaggggctgctgacacccccggtgcccccacctcgagcattgacccagggcttgcctctcccccatccttcatcctccctgctccacaggacattggcctggcgtccctgggggcctcggatgaggaaattgagaagctgtccacggtgggttgacccctccctgcagggcctggggtgtgggttgggggtctgaatccaggcctcacctcttgccgtccaggctgaggcctctccttcacccacgaattgtgaccctcaacctggcctgcctgcatcctggcttggctcctg

SEQ ID NO: 659489 - DNA, 333 bp, Homo sapiens
ccgacggtggaggccgccgcgcgcgcgctcgcaggcaagcgctggctgccctccgtcctgcaagccagcgctacgccttagaaaaaaacggccccgcccgctcgcgcgggcaacccgacaaaggtggtccgagccgagtgctcggaccacgcaagccacaatctattgaagaccaatcatgaccaagaccaccgcagccaagtccgacaaaaacgaactgatccgccatgccatcacagcatgcggctacctcgtgcgctggggttcccggctgaccttgcccgagtttgccgcagcgatccgccgccactcgacggaccaacgcgccgaagc

SEQ ID NO: 659490 - DNA, 232 bp, Homo sapiens
  misc_feature (79)..(79): n is a, c, g, or t
ggtcattaagagtgtcgcagacaagttctgaaaattaagaagaatccccccaagattgcccaacactgaactacagacnaacactattttatttaaataggagacagctttctaaaagtatacattctctaataaaaatagtttattattttgaatgatttaatggttttctacacaatttacatcacaacatgtaaattttagcagtaacatctgattctaacagcacatc

SEQ ID NO: 659491 - DNA, 125 bp, Homo sapiens
aagctccccaacaagaaatagaagtgtgtagattttttgaaaggtaaatgcttcacaataaacagtcttcttgggtagtacatgtgtaacttgtgattgtttaggactgctcttgttgggagctt

SEQ ID NO: 659492 - DNA, 211 bp, Homo sapiens
ccggggggggggggggcccccccccccccctggggccttggccccccccccccccggggggaaacccccgggggggcccgggggggggggggccccccccttttgggggggggcccccccccttcccccggggtttcccttggggggggggggggggggggggggcccccccccccccccccccggggttaaaggggggggggggtttaga

SEQ ID NO: 659493 - DNA, 365 bp, Homo sapiens
  misc_feature (256)..(256): n is a, c, g, or t
  misc_feature (316)..(316): n is a, c, g, or t
  misc_feature (323)..(323): n is a, c, g, or t
  misc_feature (358)..(358): n is a, c, g, or t
  misc_feature (364)..(364): n is a, c, g, or t
tatgacttggttaaaatatactcttgatatcagcagaagtaataagcagttgaaaataattgagagtcatatgagcgttaagtaaattgattttctgagcaacacttgctacttgcttgattctttacaaagaaagtcaatatttaaaagtatccagcctacttggcttacataaagcttagatttaatgatgtccatatttactattcatacattgtggtggcaattatatataattttcccttttttgatatcntcacatggattttggaatgtacctaggttttgaggggggggttttaatggatattttttnaattaanccccctccaataaaggttggaaaagggggttaatngggggna

SEQ ID NO: 659494 - DNA, 836 bp, Homo sapiens
ccaaagcccataaaaataagaaaattataacgaaccctggagaaccgaaagatgaagcgaaaatctgttcgcttcattcattgcccccacaatcctaggcctacccgacgcgtcgagatactgagtcattgctatttccccactcatattggatccccgacctccaagatatctcgatcaacaaccgattaatcaccacccaacaatgacgtaagtcaaagctaagcctcaatagacagaatgagtaatccatacagcagagcatctaagaggaccgaacctgatctcttatactagtatccttaactcatttttcatttgccacaactaacgctcctcgggacatcctgcccttcgactgcatatttacacgcaactcatcccaagctgatgctaatatacacgctattcccattgggctcatctccccttatagagctggagcgacagttggagtgtattaggctcatctggtgcttagatgattaaaaagtgccactaggcccacttcttacctacaaggctacaccgtacgaccccattagtcccgcatactaggttattgatcgaaagccgatcagtcctagctcaattcaagccaagtagccctggccgtacgcctaagccgctaacattactgtcatggccacctactcatgcacctaattggaagcgccacctagcaatatcaacattaagcttccctctacagcttatcatcttcacaattctaattctactgagtatctagaaatcgctggcgccttaatccaagcctacgttttcacacttctagtaagctctacgtgcaggaaacagatttacatccaccatac

SEQ ID NO: 659495 - DNA, 213 bp, Homo sapiens
tcaagagattccctacgcgtgtccaatggggtgaaacgctgtgtgtcctaaaaatacaaaaattggctgggcgtggtgggtcaagacaatagtcctgagtactcgggtggctgaggcatgacaagtgcctgaacctgggaggcagaggtggcaatggaccaagatcacgccactgcaccccagcctgggcaacagagtgacactcggtctcga

SEQ ID NO: 659496 - DNA, 200 bp, Homo sapiens
gctggagcccgccatgctttctgaccgaggcacctcaccaccaccgtgttaacttcccgtttcatcctgtcatcacgaacagtcgctgagctaccttcagagcccattacgaccttcccagctgctgaaaggccaagggaggtgaggctcttcacaacccattggggctccatgctcctcgagaggggaaatgcaataat

SEQ ID NO: 659497 - DNA, 970 bp, Homo sapiens
  misc_feature (790)..(790): n is a, c, g, or t
gctacaaagcgggggtggttaccgtctgcgagcttttccggggggtttgtttgggcgccggcgtgccgcgcctttttttttggtgcgcccggcttgttatagaggcttgttgctccgtgagtgttgccttgatcgttccgttgtgcccgcctgttggtgtggcagctgacggcttcgcacgcaaccatctggggtggtgattatgcatggccgacttttgttgacggcgctctcgcggcgggatgttgttaagcacccctctgtggtggatttaattgtctctgcccccccctctgtctctcttctgtgttgtttctttgctgcgcgcccccacgacttacttcttgcgacggatgctctcttctgtagatcatcccgcacggcggggggttgacgatgctgctccccgctctctgctgccactacttacttcatactgtgtgtgccgccccccctcgggtggtttgtgaactcctcgctgggggttaccccccgctcgcttttcgcggcgcggcgagttatatatttgtctgctcttcccgacacacacaatgttgtccccccgcactctttttttgttgtggtcgccgcgcgccgcacctctgcgtgagattcctctaggtttaacacaatctgggttggtgctactctccggatgtgggacccccccacttcgtgtaataatagatacatctcccacacgttgttgtgcaccatctgtagaggctggtgccacacaactaggtgtgtgaaacaaaataggttagtttttccgggaggtgtttgaacncacaacccgctttgttgcgccacaaccacccaccggggatgaataatccgggtcattatttttaaattttggggcccaccccccttttttcccccccttttttagatattttcccccaaaattttttaaaaagggccccttttttccttttaccccccctttcccccctttaagccccca

SEQ ID NO: 659498 - DNA, 819 bp, Homo sapiens
  misc_feature (60)..(60): n is a, c, g, or t
  misc_feature (819)..(819): n is a, c, g, or t
gggcggagggggggagggcggggggggagggggaaaaatcctgaagggaacttttcccangttaccagtgaatggctcaaccatagaaccaaaatgaatgtgcgggtcacttatcttccgggcaactgctctttacactccccaccaacttataaaactgtgcttattcatcattttccatattactaactcttatattttgaaataacgcaatgcaatcatgtttataggaaatgtatattcaattcatggaaaaaagtacatctttcactctggagaggcttttcttggttagttgaaaagcattaaacacacataatggtgactaaaattaatagtaatgcatggttcaaaattactaaaaaaaaatccaaatggtttcactacaatgaaatcactctgtgaggtggatgggatggtaattagcttaattgaatcatccccctatgagtgcatgcatcagagcatgggaggttgccgggggaacacatccattaggatttgggacctatgatacaataaaaacaatttacttcttggaaaaagtgacacagttgacaaggatacgcgtcgcctactccaaaagaaaggacaaatgggcccgctggggctaaggggggaggtgtgggggcgcgtcccctagggagggggacctcgtcaccccggtaaattactgatacagccggggcgcaggggggcgcgacatgatatatcacctcaagggccgaatctctgttaccaagagtagccgggacgcaggcatactcttggcgccagcggccggcgcgggcccgaaacgacacgaggcccgctattgcn

SEQ ID NO: 659499 - DNA, 143 bp, Homo sapiens
cgaccagaggatccccggatgtgcttgctccgggaccccgagatctcggccagctacccccgcggccgccacagcccctcagacgacttgggcggccagccttctacccggagctggggccctacagctcccgggaccccgaa

SEQ ID NO: 659500 - DNA, 848 bp, Homo sapiens
  misc_feature (3)..(3): n is a, c, g, or t
  misc_feature (6)..(6): n is a, c, g, or t
  misc_feature (10)..(11): n is a, c, g, or t
  misc_feature (21)..(21): n is a, c, g, or t
  misc_feature (497)..(497): n is a, c, g, or t
  misc_feature (605)..(605): n is a, c, g, or t
ggntcngtanngctatgtgcnattcttgagatgtattttacataagggcacgttcctctagtcctagaccgagctctctaacaacactctttctcccccacccctgaatccaactcccccagaggcgtagccaccctgccgggtacacagagctgaggtcactggactgaacactgccagaaatgaggttcacttcctgaaatagctcttgaacacaggagtgaatgggctgtggattcaggtggaatatttattaatgcatcaagcaaacaggtagtgcgaggtgggaggtaggcatgaggctgggtgctaggtgctcagtaatgactcaaatctaagtccacaggtcctgggcagtgggagtggagatgcatgcacagaaaaacggtgcaagtgccaggcgaggtggctcaagcctagaaccccagcactttgggaggcttacttgagaccaggcgcttgagaccagcctggacaacatagcaagaccttgtttntacaacaaatttaaaaattagggccgggcatggtggctcaagcctgtgagcactttgggaggccaaggcaggtggatcacgagctcaagagttcgagaccagcctggncaacaggtagtgaatcctgtctctactgaaaatacaaaaattagctgggcatggtggtggacgtctgtaatcccagctaccaggtaggctgaggcaggagaatcgcctcaggtgaaccaggaggcagagattgcaatgagctgagataatgccactgcattccagcctgggctacagaatgagactctgtatctcaacaaaacaaaacaaaacaaaaacacaacagtctgtttgtggtagcac

SEQ ID NO: 659501 - DNA, 404 bp, Homo sapiens
  misc_feature (337)..(337): n is a, c, g, or t
  misc_feature (373)..(373): n is a, c, g, or t
  misc_feature (403)..(403): n is a, c, g, or t
tgagacagggtttctctatggagccccagttgtactggaactccccctgtagaccagattagtctcaaactcaagagaactatctccctctgactcctgagtgtgccaccatgaccatcaaatgtctttaagtctatggatcaggatgatttaaaaatgggcacaactagttagtcggtggttacctacaataagccaaggaatcattttattatagtaacgatgatggaacagaaaagccactcattagttcttttgtaaatatactactaccaagtccccagagtacatgaaaggacattctcctttagagaagcagcagctaataaaggcgtgnctggccattatttacaacctggtactgacttcatgnctgggatggaatgtccggctgaaatcaccnc

SEQ ID NO: 659502 - DNA, 205 bp, Homo sapiens
  misc_feature (19)..(19): n is a, c, g, or t
  misc_feature (30)..(30): n is a, c, g, or t
  misc_feature (32)..(32): n is a, c, g, or t
  misc_feature (38)..(38): n is a, c, g, or t
  misc_feature (67)..(67): n is a, c, g, or t
  misc_feature (80)..(80): n is a, c, g, or t
  misc_feature (115)..(115): n is a, c, g, or t
  misc_feature (119)..(119): n is a, c, g, or t
  misc_feature (123)..(123): n is a, c, g, or t
  misc_feature (126)..(126): n is a, c, g, or t
  misc_feature (152)..(152): n is a, c, g, or t
  misc_feature (154)..(154): n is a, c, g, or t
  misc_feature (178)..(178): n is a, c, g, or t
ggacattcagactgagcgngcctaccaaangnagccgnccatctttcaaaacaagaagagggtcctnctgggagaaactngcaaggagaagctcccgcggtactacaagctgcancccncctnggncttcaagacacccaaggaggctattntngggcacctacattgacaagaaatnccccttcactggtaatgtgtccatccg

SEQ ID NO: 659503 - DNA, 122 bp, Homo sapiens
  misc_feature (45)..(45): n is a, c, g, or t
tgttgggattacaggcagaagccaccgcacccaacattactctgngcttctttgctttgacccagaaaggagacaaagcgcaggagactgcactttccttcaagcttctggcatgcacctgc

SEQ ID NO: 659504 - DNA, 811 bp, Homo sapiens
  misc_feature (334)..(334): n is a, c, g, or t
gaagagagtggggacgcttcggcttcggagcgggagtgttcgcttgtgccagcgacttaaaaagagaagttacatatgggtgatgtagagaaaggcaggaagatttctctattatgaagtgttcccagatgccacaaccgttgagaagggaggcaagcacaagactgggccactatctccatggtctcttgtgggcggaatgacaggtcgaggctccgctggatactgctttactacagcacgccaaatataggaacatacaggtcattcatctggtggagtaggactatcactggatgcgagtacttctggagcaatcccatagtaagtacantccctgggaacaataacatgattctttggtcgtgcattgtgacagcacaggcaagcacacaggcgcgagacgtactaatcagcgttatcttcaaaagataagccttacgtacatgcacgtaatcaatctggccaacatgcgctctgatgttcattaacagtacacacgagcataatgctctctatgaacgttgtgctagtgtgtcaccgatccgtttgagtaagatcgtcatacacctagaattcagaatcatgagatgtagtgacagagatatttggttggggcagtcgtgatttataaactaagactggcttgtggttaagttgaatatgttcagttctggaatattaatagtaactccaattcagtagcactggtatcactgtttaccccttttaaagatgtgattagacttcgttcgtaagtgttccacttttcacaaagatggtgagtgccatcttgaaattactggagatg

SEQ ID NO: 659505 - DNA, 340 bp, Homo sapiens
atactacggtggtttacgctctaaacaaaaactcttaggccggacatggtggctcatgcctatcatcccaacacttaggaggctgaagtgggtggatcacttcaggtcaggcgtattgagaccagcctggccaacatggtgaaatcccatctctactaaaaatataaaaaattcgccgggcgtggtggcgggcgcctgtaatcccagctactcaggaggctaaggcaggagaatagcttgaacctgggagggggaggttgtagtgagccgaggtcatgccattacactccagcctgggcaacgagagcaaaactgtctcaaataatgataataaataaaa

SEQ ID NO: 659506 - DNA, 253 bp, Homo sapiens
attagaggatctacgctggccaatgcaccgctgggcctgctgcctactgcaggagaggctgaggtcacccctggacggtataggtgtatagggggaactggtggggtcgtctggtgcatagaggacatcaggatgactgcgtcgctgtggtcaacacttaattcgttctgtattccacactcatatgggtcctacaatcattccttatgacattgaatagagtgaggggtctgttgccattgggccaggcggg

SEQ ID NO: 659507 - DNA, 557 bp, Homo sapiens
tgtggggggggggacaacccccaaaaaatttttttttaaccccccggcccgggggggccaaattaacccgccgggggggggtgggaagagatgatcttagtaagtaggcgccgcacgaaacaacctccgtcgaggagaatggaaacggcgacgcgggtggtatagaaagagagggcgccaatgaggtgttggtggtctgcataccgccaacatccttcgagcacataatcaactgatagaggaactctcttggagacaaccacagtctcgcctccgtggatgacaagccataacgagacaaatataaagcaagacgaaggtgcgtcactaggggagagatctataaaactctctattcaatctactctgtatcgagaggaatatacaggacgaatgtataatgaaggactagcggtgaggagataataggagagacgacaacatctctccctcccacgagagagaagatatgtaggcgcacccgatttatttatggccactcttctacacgaggagcgctcgtatgattggtaaccaccacgggaggctccaaacaa

SEQ ID NO: 659508 - DNA, 256 bp, Homo sapiens
  misc_feature (64)..(64): n is a, c, g, or t
  misc_feature (67)..(67): n is a, c, g, or t
  misc_feature (70)..(70): n is a, c, g, or t
  misc_feature (73)..(73): n is a, c, g, or t
  misc_feature (84)..(84): n is a, c, g, or t
  misc_feature (90)..(91): n is a, c, g, or t
  misc_feature (117)..(117): n is a, c, g, or t
  misc_feature (172)..(172): n is a, c, g, or t
  misc_feature (180)..(180): n is a, c, g, or t
  misc_feature (198)..(198): n is a, c, g, or t
  misc_feature (207)..(207): n is a, c, g, or t
  misc_feature (210)..(210): n is a, c, g, or t
  misc_feature (219)..(219): n is a, c, g, or t
  misc_feature (225)..(225): n is a, c, g, or t
  misc_feature (231)..(232): n is a, c, g, or t
  misc_feature (242)..(242): n is a, c, g, or t
  misc_feature (248)..(248): n is a, c, g, or t
  misc_feature (255)..(255): n is a, c, g, or t
atcctcttttgcctggcctttgagaataacttactgtgtgacttttcggcaagttccttccccnacnctnggncctcagtttcncacttnnggaaagcaaggagttgaccagatgancacaatgggccttcctagctctggccaccaagaatttgtgaacattagagctccnggtctggngggtagagccagagctgntgactggtnctntctgtcctncagagnggactnnattggacctnagaggntcgcagng

SEQ ID NO: 659509 - DNA, 942 bp, Homo sapiens
  misc_feature (642)..(642): n is a, c, g, or t
ggctgcatgtgccttcttctgccacctaaatattacttcccttcaaatctgcctttgaatcatcatttttaagaaaaaataaaacatgtagtggtagtgatctaactggggtttcaattcgctcagaaacaagtttgtttgcacagacggaaaggaaagaagagtagtgtcctattcgagtaaagtacaaagtgttgattttacaaaagagtaggtaatctttgagagcaattcaaatcagtgctgacagaggatactgatgagaaaaagcgatgtgcttcttattataaagtacatttaaagtgcagggactaaccttattttattggggacaggggaggaggaaggaaatgattatggtacccagacactgggctaggctgcaaactttatctcgatttaatactcccagctgtcatgtgagaaagaaagcaggctaggcatgtgaaatcagtttcatggattatcaatggatttaggagggcatcaatcagctcaactcaagatttcataatcattttgagtattgagattgtgcctcaaagttgtagtacctccacaatacctccagtgtttccggtgtaacaaaccttcagtgagtttggaccatgtgtgctcttgggtctgtgggctggaagtacncggtgttgagggagttaacaactagaaagtctttagtacaacaactggtctaggggacacctggtgcttccctaacacacgtgatggtcatattgctcaataaaggagtctccctaatccagggtctaatgatgccgaccatatttgtaatttgttcgggtacctcttttaaacactcttgcttcccgcgaataattgggggtacaacacggtcgactcctgggccaaaaacaccggggtcacttatccacctggcacgcgcccgcggttggaacctctctggggtgggcttatcagaaa

SEQ ID NO: 659510 - DNA, 709 bp, Homo sapiens
acttatccgaacatgctggatgtggttggcatcatttacaggctagaaaagtgtagtaggcatagagctgtactgccacagcctgctgacgaagtatacagtcatcacagtcgcaggctcctgctaagtgctcgtcaatcatgccactcttactttgcttctttcttaatagagcactggtgtcccggccgtgtggcccaggcatggtctcgaaggtccgtggcagtcaggtcgtatccatccgtgccctgtagggcatcgcacggaagatacgggggagtgaagaaggctcttgcttctgaaagctctcaaagttgtgaaactggggtattatcgtctggtacatctgcgcactagattggttaatgcttacttggttctgtaatcactgagattgggtcggagatattctccaatagagtgatctttgctagcggatgatgcctaaagaagtctcgaggcatggcgttctggttttattcagggaatgctgtataatagtccatcagatcagggatactgggcgcttcttcatgtatgtaacagcatattaaacgggagacagtgatgaatcagctacaaaggtaatatggtattaaagatcatgtttacgataggctgctcaatgtgtatttatataggcatgctttgtaaaaccatgctgggtgatgaaagattagttttagagagaaaatgtcatctgtgacgg

SEQ ID NO: 659511 - DNA, 281 bp, Homo sapiens
  misc_feature (111)..(111): n is a, c, g, or t
  misc_feature (116)..(116): n is a, c, g, or t
  misc_feature (147)..(147): n is a, c, g, or t
  misc_feature (163)..(163): n is a, c, g, or t
  misc_feature (216)..(217): n is a, c, g, or t
  misc_feature (240)..(240): n is a, c, g, or t
tcagtcgcctcgccctgcctgtgcacatgtcatgtgtgactcggggagaggctcctgctctgatgcgtcagccctccagcctgcagctgggggccccgatgccagccgggnactcnatttactcccctcttctgagtcggtacctgnctggggttcgtggganacccagacctggatctcttacgcctacctgttccttctctgtcttggaggctnngggatttgagattgacgcggtgnaactctgtccagttttcaaaccacacagataagcctttgac

SEQ ID NO: 659512 - DNA, 418 bp, Homo sapiens
  misc_feature (391)..(391): n is a, c, g, or t
gcggtgtgaaagaggctaatcgtgagcggaggccgtactccctgcactgcgcagggaccgccttggaccgcagttgccggccaggaatcccagcgtcacggtggacacgcctccctcgcgcgcttgtcgtccacatgctcacccagctcatgagctgtggaattatgtggccacactgcgaggagatcggttctgagtcggaggctatcgtaagactcccacatgctgtctggagcgatgaacgccggcatccagacaccattccaaggaggtgcacgagaacagctgtgtgaatccagctcacttgttgacactacttctacttgaaggaacgtgtaatacagcttactctgcagagaaggaagatggctgttttcgaagaggacgacgnaggctgatacaggtgatgcatgccccg

SEQ ID NO: 659513 - DNA, 81 bp, Homo sapiens
gccgaggacacggccgtatattactgtgccaaagatccgaacggtgactatttgggggcctttgactcttggggccaggga

SEQ ID NO: 659514 - DNA, 118 bp, Homo sapiens
cggcccccatgccctgaacaactctttttattttatttttttaagacgggttctctctcactctgtcgcctaggctggagtgcagtgctgtgatctcggctcaccgcaacctccacct

SEQ ID NO: 659515 - DNA, 314 bp, Homo sapiens
gtggtttacatgctgaccactcgggagcagagtggcagttaccaggacatgggttatctagacagctggagttctcatcctggctccacggcctgacacttagcccacctcagttccttatctgaaaaatggggatgatgtgacaatatgtagtctaatggagccacagggaagactgagataatccatgggaagcaccaagcaaggacagggcacctgggaagttcaggaatcgttggcagtgctcctcatcatggtaaccatcactgtcactgttattcctgtttcacctgctctttggctttttagctgat

SEQ ID NO: 659516 - DNA, 244 bp, Homo sapiens
gcggccgcctactactactactactactactactgctcgaattcaagcttctaacgatgtacggggacatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaaaaaaaaaaa

SEQ ID NO: 659517 - DNA, 602 bp, Homo sapiens
tgcatgcagtgtactgcacttatgggaggctgagcaggcagatcgcctgaggtcagaggtcagaagtttgagaccagcatgaccaacatggagaaacccccccgtctctactaaaaatacaaaattagccgggcatcgatgtacatgcctgtaatcccagctactcaggaggctgaggcaagagaatcgcttgaactcgtgaggcagttgcagtgagatcgcaccactgcactccaacctgggtgacagagcaagattctgtctcaaaaaaaaaaaaaaaaaagaaaactctgacttttatttcccaatggtttccattcccattgagataattggagaagtatggggataattgggggaagtaatctgagagattatttgaccaagcacttttagaagaaaaacagttttcaaaacactaaatagaaggtgaccacaattttttttaaagaaatatgcttaaaatgaccacaagggcaatattagattataacaaaatccttgggggataggataatagggggtaatatattcccttctttgtctcttcatttggatctttaaaatgtcaccatggtgccatgactatctggagaaaaaaa

SEQ ID NO: 659518 - DNA, 401 bp, Homo sapiens
aattcgcggccgcgtcgacacggtgcgagaagacgacagaaggggcctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaaaaaaaaaaa

SEQ ID NO: 659519 - DNA, 823 bp, Homo sapiens
  misc_feature (357)..(357): n is a, c, g, or t
  misc_feature (433)..(433): n is a, c, g, or t
gatcgggcgcacccaccccagatgccgcctggcaccaagcgcagccgccgctgccgcactttccacttgtattgatcacctctcagccccgcgcagccggctcgcccgagcggaccgcggcagcgcgccagcccttggcagccccggagcagtcgggctccgggaggaaactccttgggagcgccctgtccggggtgccctctgcgctctgcagtgtctttctttctgcctgggaggaggaggaggaggaggaagaggaggaggaggaggaggaggaggaggaagaggaggaggaggaggaggacgtctggtcccggctgggaggtggagcagcggcagcagcagcagccgccgcgncgccgccgctgccgccgccgccggaaagggagaggcaggagagcccgagacttggaaaccccaaagtgtccgcgancctgcacggcaggctcccttccagcttcatgggcaaagtgtggaaacagcagatgtaccctcagtacgccacctactattacccccagtatctgcaagccaagcagtctctggtcccagcccacaccccatggcccctcccagtcccagcaacaccagcagtaataacaacagtagcagcagtagcaactcaggatgggatcagctcagcaaaacgaaactctatatcccgaggactgcctccccacaaccaacgaccaggaactggagaagatctgatacaaccatatgggaaaaatagtctccacaaaggcaagaaaggataagacaacaaacaaatgcaaaggttatggaaaagtcgactatgacagccctgcagcagctcaacaaa

SEQ ID NO: 659520 - DNA, 422 bp, Homo sapiens
  misc_feature (34)..(34): n is a, c, g, or t
aggatagcagaatgagatgggagtggagagaagnagcaggaagatgaggagggtaggagagaggggcctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaaaaaaaaaaa

SEQ ID NO: 659521 - DNA, 372 bp, Homo sapiens
gtcaatctagaggatctcctgtgaaacgagacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaaaaaaaaaaa

SEQ ID NO: 659522 - DNA, 364 bp, Homo sapiens
  misc_feature (17)..(17): n is a, c, g, or t
gtccggaagcatctggntggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaaaaaaaaaaa

SEQ ID NO: 659523 - DNA, 888 bp, Homo sapiens
  misc_feature (64)..(64): n is a, c, g, or t
  misc_feature (414)..(414): n is a, c, g, or t
  misc_feature (777)..(777): n is a, c, g, or t
gcccaagcctggtggcttacaagggtgtgggcctgtaagtgcacagaaatcaagaattgaggtntgggaatctctgcccagatttcagaggatgcatggaactgcctggatgtccaggcaaaaatttgctgcaggggtggagccctcatggagacctctgttagggcagtgtggaagggaaatgaggggtgggagcctccacacagagtctccactggagcactgcctaatggagctgtgagaagagggccaccatcttccagaccccggaatggtagatccactgacagcttgcaccgagcacctggaaaagccacagacactcaatgctagcccatgaaagcagccaggagggcagctgtaccctgcaaagccacggggtggagctgcccaaggccatgggagcccaccttntgcatcagcatgacctggatctggagcatggagttaaaaaaatactattctggaactttgagatttaatgactgtcctatggatttcggacttgcatggggcctgcagccccttcattttggccaatttctcccatttggaagaggtctatttacccaatgcctgtacccccattatatctaagaagtaactaacttgcttttgattttacaggctaatagacaaaagggacttgccttgtctcagatgagactttggacttgaacttttgagttaatgctgaaatgagttaagacgtcgggggactgttggaagagtgtgatggtggttgaaatgtggggacatgagattgggagagaccanggtggaactgatgcggttggctgtggtctcagccaaatttcatcttggatggtagcttccataattcccacatattgtggggggaccggtgggaggtcattgaatcatggt

SEQ ID NO: 659524 - DNA, 385 bp, Homo sapiens
  misc_feature (28)..(28): n is a, c, g, or t
ccagaggattagtggaaggagatatcgnggctttccggcggtgacgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaaaaaaaaaaa

SEQ ID NO: 659525 - DNA, 170 bp, Homo sapiens
acgagataggcagacaggtcgagctgagtctgacaagtgagggctgaagatctgtgattgggtccaggttggagctgtgtccttagggcgatgtctagagcagctctggtgaggtgagcctgggtccccgtgggcaagcagaccagcacaaagggcatggggtccagcac

SEQ ID NO: 659526 - DNA, 160 bp, Homo sapiens
gttttcccttaaatttccccgggggggcccttttttaaaaaaagacctttggagggccgccttggtttctatttaaaaaggaggttttttttcccccaaggggggaaattggggggggaaccgggccaattttttaaaaggggggtttgggggggtttta

SEQ ID NO: 659527 - DNA, 366 bp, Homo sapiens
cggacgcgtgggcgacccacgcgtccgacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaaaaaaaaaaa

SEQ ID NO: 659528 - DNA, 804 bp, Homo sapiens
  misc_feature (272)..(272): n is a, c, g, or t
  misc_feature (286)..(286): n is a, c, g, or t
  misc_feature (289)..(289): n is a, c, g, or t
  misc_feature (302)..(302): n is a, c, g, or t
  misc_feature (317)..(317): n is a, c, g, or t
  misc_feature (330)..(330): n is a, c, g, or t
  misc_feature (354)..(354): n is a, c, g, or t
  misc_feature (376)..(376): n is a, c, g, or t
  misc_feature (378)..(378): n is a, c, g, or t
  misc_feature (405)..(405): n is a, c, g, or t
  misc_feature (411)..(412): n is a, c, g, or t
  misc_feature (421)..(421): n is a, c, g, or t
  misc_feature (432)..(433): n is a, c, g, or t
  misc_feature (441)..(441): n is a, c, g, or t
  misc_feature (451)..(451): n is a, c, g, or t
  misc_feature (453)..(453): n is a, c, g, or t
  misc_feature (456)..(457): n is a, c, g, or t
  misc_feature (461)..(463): n is a, c, g, or t
  misc_feature (465)..(465): n is a, c, g, or t
  misc_feature (471)..(471): n is a, c, g, or t
  misc_feature (490)..(490): n is a, c, g, or t
  misc_feature (497)..(497): n is a, c, g, or t
  misc_feature (504)..(505): n is a, c, g, or t
  misc_feature (510)..(510): n is a, c, g, or t
  misc_feature (527)..(527): n is a, c, g, or t
acttagactaaacgtgaacagtattatatggactctcacaacgctcttagagaatccgtgaatgtgaacagacaaatgtggctaaccatttgattcttcagtatgccttctaatgtggctattttatttatgtgagactctaaacctgattgtcctaatatataaaactaaaagatttgtaaagggagtgtctttagaaatagatgaaatgtagaatgttaaaaattattgctagggtagtcttttttttttccagaaacctaattagggtnttaaatttggtgtnttnttggttttttttntttaaacagaagctntgttatttcattncccattcccagaaagggagttaantgaagataaaaatttatttttnanggtctttatggagagaaacttggtttnctgatnntgacctatngcagatgtttnntataaatnctttctttanantgnntgtnnncngtagtncccaacacggtaaactcangtgaaantagtaanntgatncttttattactaagacngtcatgcattctgaagcagtgggctttttttataaccattaggaagtaatttccctctagctcctttccttactagtctccgtgtcagaccattagtgaggtacttggttcaaattaacaaacatctagtattaacttccaattattcactcccaatcgggtcatctttcacactattgtaattatacctaatttctgctaaattcccatttacaattagtttcaacttcacttttattcaacccagttggttctgggtttcccccctggttgccag

SEQ ID NO: 659529 - DNA, 213 bp, Homo sapiens
  misc_feature (19)..(20): n is a, c, g, or t
  misc_feature (39)..(39): n is a, c, g, or t
  misc_feature (42)..(42): n is a, c, g, or t
  misc_feature (49)..(49): n is a, c, g, or t
  misc_feature (63)..(63): n is a, c, g, or t
  misc_feature (76)..(77): n is a, c, g, or t
  misc_feature (91)..(91): n is a, c, g, or t
  misc_feature (114)..(114): n is a, c, g, or t
  misc_feature (121)..(121): n is a, c, g, or t
  misc_feature (184)..(184): n is a, c, g, or t
  misc_feature (190)..(190): n is a, c, g, or t
gagtatatattttgcttgnnctttcatgcagtttctaangcnaatgctnatttaagtgttttncggttttgtttgnntctgtatttattgnagttctggtcatagaccagcgancttggcncgtcatggctgcatgaacagccaggaacatagttattggggaacttcatggctcaaaaccttntgaatnatttaacttattttgtatgttgc

SEQ ID NO: 659530 - DNA, 129 bp, Homo sapiens
ctgggtgggggaagagggtggggagaagtgtgagctccttcgaagctcctgctgcagctggctccctgctctgggccctgcaccagagctgccaccctcttccccagccagccctcttccccagcccag

SEQ ID NO: 659531 - DNA, 487 bp, Homo sapiens
  misc_feature (4)..(4): n is a, c, g, or t
  misc_feature (42)..(42): n is a, c, g, or t
  misc_feature (146)..(146): n is a, c, g, or t
  misc_feature (150)..(150): n is a, c, g, or t
gacnaagcggttgcatggttcaagggggaatcaaatggaagngcatttaagtcaagccggcttgttccttgccatggcaaagttccaagaagttcccaaagccaagtacatttggaaagtgcttcccaattggcgcacccagtgtnaaancagggcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaaaaaaaaaaa

SEQ ID NO: 659532 - DNA, 103 bp, Homo sapiens
gcggccctagtgtgtagatatctgcagaattaagctgaattccagcacacgtggtcggacgtaactagttggatcctgagcgtcggtaccaaatgacttgtga

SEQ ID NO: 659533 - DNA, 359 bp, Homo sapiens
ggcgactgatccagaggatcccgacagccagagtaggcggtgtggtgtaggcaggagtggtagaggctgacgtagtgaggtggaggtggtgccggcgagagatggaggtggaggtggaaggggaggcggtgttaggagtcagcttcctcttggcactctttttttttcttgcttttctgctcctcctctgtgctgtccgcacagaggaggtggacagcacagagaagaaccttccagacagcactcttcctggaccggctcctggatgggtccccgctgccgcaggaggtggtgatgagcctgtccaagtgctactcctcctactgtgctgtccacctacctctgggttccgagctcga

SEQ ID NO: 659534 - DNA, 363 bp, Homo sapiens
  misc_feature (24)..(24): n is a, c, g, or t
gccgcaggatttaggcaaaagacnacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaaaaaaaaaaa

SEQ ID NO: 659535 - DNA, 147 bp, Homo sapiens
ggtcacgagcgcccagtacccctgaatttaagccagctgaaagtactccggaggaagcagagtttcacaacagcatcataatgcgaggtacagtccctttaccacagcgctctagatgacttggaggcgctcgttgccggcgtaccg

SEQ ID NO: 659536 - DNA, 545 bp, Homo sapiens
aattcgcggccgcgtcgacacggtgcgagaagacgacagaagcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggataaaaaaaaaaaagtcgacgcggccgcgaatttagtagtagtagtcgacccgggaattcgggacgggtactggaggggtgtccagttttcccaaaagggagccgtttaagctctggttaacacagggcaaacggtttcccggtggaaatttttatccctcccaaatttccacaaatatgggggt

SEQ ID NO: 659537 - DNA, 267 bp, Homo sapiens
atttgggggccccgccctttgggtgttttttttttggggcccctttccggcaaggttgccgggggttttttttttcccccccccccgttttcctttaaacgggcccccccctttaaagagggtttaaaaaaatgtttcttgggtaatggggttttttttggggattggttggggtaacccctggggttaattttaaaaaatagggggttggcccccccttgttggggtggtttccttgtttaaaaaaaaaaaaaccttggtttttga

SEQ ID NO: 659538 - DNA, 146 bp, Homo sapiens
aaaaaccccaaaaaggccccgggccccgggttttttggaaaccccttcccaaaatcccggtttgggggggggttccccccccccccccccatttttaaaagggtttttaaggggttaaaaaaaaggttttttttttttaaggggga

SEQ ID NO: 659539 - DNA, 968 bp, Homo sapiens
gttattttttgattaaaaggtttctagacttttgttgtttgtttgttttattaaggccggaagaaacatcagaatcgattgagggaccaggaaatggggcctctagggaagagaaggcattctgctagatggcttttaaaaatatttccgccagagtcacttgtctcattaacaacagtttttgtcttagaagtctctctgtgattttataaactagcatgattttgttatgaatgcatgctgctctggttctctaataagcccaacatgcatttgcatcatgtcggcaataagcactttttttgctgtgttaacaatgtcatcttcattgttgtgtgcctgtgttttgactgtgacctgtcacatgaggttgggtgtggaattttccacttgtggcatcgtgttggagctcaaaaagttttggattttggacccatttcggattctcggattcttctggattaggaattctcaacctgtgctatcagccaggaggtataaatgatgtctccttgtgggtttaaatataacttattacttaagaagttggcttgtcacttggtatggatcataatttatgcttcatgagcctctaccttatgattgtgctttagtcatcttttggcattggtgtgatgacaccaggtttccataaggaaagatcccattgtgtgggtatttctaaaagtaaagaactttttctaattttgcgcctttaatttttatcctttccttgaattagttccttcaatgatgttacacttctaccctatcctactgggacaaatgccccagactggggcacggcactacggttcttaccgtgattggctacccgtgtcgggttgccgcgagagggtatcccttcaatgtgcaaacgcggcttgatctgaacacttatcgacaacaaactatactgcacacaaagtgtacaaagggggctacaaaataccacgccatccaagtcg

SEQ ID NO: 659540 - DNA, 713 bp, Homo sapiens
gctgcggttgctaagtatcgcctgcggagtaactgcatagattctgtccgtgcgcgttgctgacggttgtgttccgtgccttcctcggcgggccggactggtctccagatatgctttgggttcgtctttcatttgctgcagggaacttccatgcctctaacactcatctgcagaagactgggacggctgaatgtcctctattcttgacagagcgtattatttggatgcctgatactctcatgttgatcttgaagaaactgggcgtgatcattaagtattgggtgaatgtgtagttgcccgcgtacatgggctgaaggaagtgttcaagcgagaaaagacgatggtagaggttattctatcagtgcttagaaatgggtatgtccgttgaacttgggaaccctgacaatggttggtgttggtcgctgtgtggaaaatgataagttaaattaaagggacatcgacgagtataggtgagggacggagtatggctcgcattatgtgtaccgattccgaggttcagtgaaaggagttgcttcgcttcgatgatttacagagtcgctcgttttgattgccgctatcggaaagagagagacgcggacttcaggttgtgtccctccagtgacgctgtgtaagcacaaggtgcgctcgtcgaatggaccacctctgtggatgggtcccttacgaactaccaagtgacgcgagaccccgaatga

SEQ ID NO: 659541 - DNA, 1496 bp, Homo sapiens
  misc_feature (107)..(107): n is a, c, g, or t
  misc_feature (249)..(249): n is a, c, g, or t
  misc_feature (256)..(256): n is a, c, g, or t
  misc_feature (288)..(288): n is a, c, g, or t
  misc_feature (621)..(621): n is a, c, g, or t
agcgaatcgattatcctgcttccgcacccacaaagcaagttaggaacgctgagtcacctatcatctactgagcagacaatgtaacttagacgtcgctatggcgccangcgactatccgacatccgatatcatatcgccgagcgcgctgatgctagggatcgatccgacgagtcaatcctctcatacgagtaaacgatccagcaatcctacgaatcagtaagtgctgactagtacgccgccatgctagtnttggtangactgaatcttatcgatgtaaggtacctagantaaccgcagggtctatcatctcagtcaagaggccttgtgaggcgaagcgtgggagcataaggtatcacacacgtgaagatagatcggttgctcctctcgcatgtagtggtccgtctatgtccctcggcatcaagagcagaatttactggcatatgcttggaactctcttgaaccacctcacatgcgtacatactgtaatcgtacacgtgctcttcgggggaatcttgtccgtgactaaggtgtggatgcgccacagcgcataatccaaggggataccaacgtgctatgtgcacatcaacgagtcttagcgcgcattccgcacattttatcccnaaagagcagacacttaccgtgcgcgcaaacccctcgttgtgtaaggacaccttctctgttcagtagctcatgatagccctagttcattttcattctctttttcacaatcaccataatgctctagggggtagctaacatccatattaccataaatacatataaaagagggccacacattacaacactattccaatccaaccaaaacacacaaatttcaatcccaaaatacatatacgaagacgcacacacatttgcgcacattaacccccaaaaaataacacaaaaaaaatgcacccacattcttatccaggtcctttgatcccgtggtcacaattaaaattcaccatgccaagttccctaactttcttacccttatttctcctaccccaaagtccctaaggactatgcttaggggcaattcagcgttaattaacctaaacttataacaatgaaccctggcaaagccttacaaaacaagcccaaccctttcctttcccgagaacccaccggcccggtgaaagaggaaagaggaaagaaacgccccccaagtgtacttaagttaacccaagaagcaagccccgtaaaattttccatcgaacggtcatggtattcccggagggggtcgacacccccctgtgagacaaaggagttgtacagatatattacccattagaagagtaccgtaaaaccaccaagggggggacgatattcacgggggacgcatataaattgctctccccgccgacgatagtatgttggtcgtcaagaccctatttagcggcagaacgtctcccgcggggagaaagactataacagtagagaccccacattattcgtagcgagaacacaatatcacgcgatataatcacggacac

SEQ ID NO: 659542 - DNA, 318 bp, Homo sapiens
cgcttcccatgggtagtgcccacaacgcttacatattgaaagtgttagccttttttccccagacttgttggcgtaggctacagagaagccttcaagctctgagggaacgggccctccttcctaaattttcctgtcctctttcagctcctgaccagttgcagtcactctagtcaatgacatgaattatagcttaagtggggaactagtaagtagggcttgctatactgtccctagatagtaaagtaacaccattataatgaatttagagagcataggtaatccatgtaactgcctagaaacaacactgtagtaaataat

SEQ ID NO: 659543 - DNA, 214 bp, Homo sapiens
ctggcgtcctcagtacacggagctgttccggatccacagaacagaacatgctcaggatcatctcgaagatcatgatcacagcgagcacgatggcggccctgcttatgaggtacagcttcccggagacgaggacatcgatcttctagatggcagtcctcctatgaagaggtatgctagatgcggttttttgtataccgggatacccgagctcgaa

SEQ ID NO: 659544 - DNA, 262 bp, Homo sapiens
gtccattccaccagactgggctaccctgagtgcggataagaacgatgggtggaacaagagcaacgccggagcccaggtgcccagaggactttcttccagcttctgcggtccttctttgtggagagcaaggtgacatacacggagataactctggctgtggtgcattgaacctacaagtgggctggggtaggtggttcaggccgtgtaagcccaggattttgggaggctgaggtgggaggatcctttgagcccaggagttgga

SEQ ID NO: 659545 - DNA, 1774 bp, Homo sapiens
  misc_feature (1492)..(1492): n is a, c, g, or t
  misc_feature (1774)..(1774): n is a, c, g, or t
cccacgcgtccgggcatggggcaggggcccagttcgtcagcagcagacactctgtgacagttttgtcaagtccctgctttgtgaagtaaatattctcagcgacaaaaaaagaaaaaaaacaaaaaaaaaaaaaaaaaacgggggggggggagaaaggaggttccccccgggggggccccgggtcagggggaccccacgcttctgctctgtggcccaacagcgggggccccccaatatcaggaggagagcagccgcgatttgtctatgcacgcgctgagcgaccggcgagacgcacagggcaaaaaaacagacgcaagcagcagggggcgacaaagcgtgggcacacacaggaagagcaacacggtggagaagaagaggaaccctcattcaacctgagcgtgagagaggcgagagcaccacaaaagaggtgggagcaaaccagacaaactaccacctccagagagggaacaactttacacagcacctcaccaaacaggggggaccacaaaattaatactaaaaacaatacaaaaaacaagagcgggtcaacaataacgggtgcgtgaatacacacacacctacgcagcacggagatcgatatatagaggtgaccgccggcgaccgcagtgacaggccggatgaagaaagaactaacttgtgcgcgccccaaccgcgcggagaggaacgaacagaccgacgagaaacgacaagacggagacgaccaccgctatatatatcattatcaacacaccgagactgggggagcgccgaccttaccacacgacgaacgaacattcagaacgaacggaccacatggagcatacaggatcgaccaacacaacacgacaacagacgcagcgagagagagaagagatgcaacgagggagaacgaaccgagcggagcaaggacgaccgcaacaggatacggcacgcacaagcaataaggaggtagggagagcgagagaaaggagagcagagaggtcgaggaccgagggagggtcagaagtgtagaatgagagagtgagactaagaccgtagagagagatagagggagggctgtacacagaagagcaggacagagagaggagagagaacgcagcagaacgagtgagaaggacagagaccgaaaggacaagagcacgacagcgaagaagaggagagcagaggagggaagcgcgaggaggagaggaggaagaaggagagcgaggaggaaggcaggggaggagatgagagaaggcgggcgaagagggaaggagggaggagcacgcgagggtggatgaagaggacaggcatgggtgaggatagcagattggagagaggcgacgaagcgcaagcggaggatggcggagacgcggacggaagcctgggggctgctcggagtatgccagcgcgatagagaacagagcggacaaggaagggaggggatgagcgaggcaagactcgaagtgacggatgagagccacggagcgagtgagctgcacaatgcgacatngaggtcagacgcgaggcgaggcgtgtagactagagcgagaatgaggacgacatcgaggatcgaagcgatcgtcaggaggagagagagacgtggagagagacgagcacagctcagtcggctcgtgagagcgagtgcgtgatggaactagcaaagaagaagagcgcagacgactagggcaacacaacggagcgacaggaaagagactgtcgagaaggatgagcggtgagcgagaagcaccaggacgagtgcgagaagagatcgagacggggagaacagatgagn

SEQ ID NO: 659546 - DNA, 109 bp, Homo sapiens
ggcgcgaattcactagtgattagagactgcgagaaggagcccaaacaatctacatatgaagtacaccctaagaccatcaattctaatctatcaacatatactaaataag

SEQ ID NO: 659547 - DNA, 175 bp, Homo sapiens
atcccccgtccgtcgaccgcttgctggacagcgttttttccacagttttcagtaccaacctgaagatgcttcttgaggagtcttgtcacttatccctaggtgcctctggcaggccccagtgttacagaagcagccggttcgcacatggatgttgtgaagaagcggacgacggacg

SEQ ID NO: 659548 - DNA, 446 bp, Homo sapiens
gtcggaccggtgtctatcgatgcacactaaccggtgtgaggtgtactcattgcagttttaattgcatttccctgatggttgtgatgttgcgtgttttctcatatacctgtaggccaattttttttttttagaaatctctactcaggtacttggcccattttttaattaggttatttgctttctggctatgggaagtggtctgagttccttatatatttgggatattaaccccttatgggacatatggttggcatatattttctcccattctacaggtggtctcctcattctgttgatggtttccttggctgtgtagaagctgtatagcgtgatataattccattggttggtttcgggtgttgttgcctgtgctttagaggtcacatccaaaaaattatggcccaaactaatgccacagagcttttcctctgtggcatcgataaaca

SEQ ID NO: 659549 - DNA, 806 bp, Homo sapiens
taaagaagtaagcctttatttcctggtttggcaaataaaacgggctaagtgggtggcttttgggtgattagtcaaagagaccaaatcccatatcctcgtcggattcctccgattcttcctgggttttcaaccttagcgggggcgtgcagcagcagcgaggagcagcgggtgggggcagcgagccacgaggggcagcagccacaaaggcagagtggatcagccaagaaggcctgaccttttcagcaaggtgggaagggtgtaaccgtctccacagacaaggccaggactcgttggtacccgctggatggatagaagggggtacggagtgcaccagctggggatagccaatcggcagacagacacgggcaacatgggggagcgccctccaggaagcgagaatgcagagttccctcggggatatcaagcacttcagggtggatagatgcgtgccatgggtcgaacaccggcgggatgaccagcccaagggagacgggggagcactgtgagcatgtcagcagcgtggtacgcgggccccacttgtctccagtcttgatcaagtggacatcagtcaggatccaagggttgccccgggagatcatacgggggataccctaaaagctggagaaagggaggtctctcagggcgcagaaaacaattgtctgggtgacagtgattcccatggggcagggcccaccagggaggaagcggccctattggcagcaagtggcctgtccaaggagcgcctgggaccaaagcaatcccggatagggagtccaaggggcccgagcgaaggcggcaggtccacc

SEQ ID NO: 659550 - DNA, 899 bp, Homo sapiens
cctcccgtggcggggggataaataaaacagcccttcttttgtgaccccccccctgtgcttgctggtgacgacccactcccacctcgtgtgcgttcccccttaatgaacaccctgggtctgatttttacctctcgcggcttttatatccattatctccgcgggtgcgattaatcatttttctccctgacgagacgacctcttgttgcctcccttgtgcgctctcttttttggtggcgactcccattaatggataccacacactttgtttgtgctcagacaaagcatgcacgcggtgtggtgtcgctcgcctctcgtcgatatcctccgcggaggattttgtttgtccgccccgcgcggcgtccctccctctctctgttctgtacacacacacccgcggttggtttgttttccgtgctcgtcccgagcgggggtgcttctattcaccctcccggggcgtcgtcccctgattgttttgtgtatttgggtgcgccccccgcgccccccccatattttgttctgccgcgccgcgcggtttattaccaaaaatttttgttggcgggttggtgttttttgttcctccccctcgcaccccccgtcgtgagggttttctttgagcttctccctctctctcccatacattgtgcgcggcgcgtttttccggcggcgcaacacaattttttttgtggcagcccacgagtttctctggcggcttctctcgctattttgggtgctgcatcttctcttcacctgatggtggtctgtcccccccctcggatgttttctctctgtaccaccccccacaaccctttgtggttttaaccccccccccctattcccctttttagaaaagggggttaattttttttttttttccccttttttgggggggggggtgttta

SEQ ID NO: 659551 - DNA, 300 bp, Homo sapiens
ttgaaatagggcccgtatttaccctatagcattcccgttaccccctctagagccaaaaaaagggaaaggttaaaaaaaaaaaaaaaaacaaaaaacaaaaacccggctgagatggcggcgcccggaatccggggaagcggctgcaaagggtgccgccgcccaaggcgaagaagggccggcctgagcgaaagaaccgcccccagcaggagcaccaccacggttaagcaaagaaacccaaaccccgcccggaaaggcagccgaaccatggagactaccagtccatcgaacgctaatgcctcc

SEQ ID NO: 659552 - DNA, 446 bp, Homo sapiens
gatgcaatatttgagagagggacttttgctgaggtttctctgaggtttttttgatgctttataggaactattttttaaaaaaagccatttccacccaaggacacagtggatgtgtttccctgactccagcagggcaaggattgtagccgagaggttgtgtggctgggctctggtgcctcttcctggccagacactttcctcctgattccttggcaccttgtctttctgtctgttacctgtctcctgcctgccatctgaatctttgcagccactctgacttccatcttgggctagacacccttgcctgccccttcttctgcctaagaatgccctttaggctgggcatggtgctaagctgtaaccccagcactttggaaggcggaacgggcagaaacctaggcaaggattcggacccaacctgacctaaatgggaaactcgccttagt

SEQ ID NO: 659553 - DNA, 345 bp, Homo sapiens
aggtatgaacgattctatcgagtggcagtgtcatcgagcagtatatatctagcgcacagatatgcatttcagaatattagccatttaccagcgtttggtaatgttacgcagttctggagcttgatagctgtggatcatttcctgtagtgtgtaaatctgttgccctctgcccgctttgatacagtaaactttcgcaggaatgggcaacctgagagctgttaactttcatgctacagaaagctgctggccattctcttgcattgcgacaagaattgttacctgtcattttgcactgtagattgctggcagatgctttacagtcaatagtgttgcagtgggcttccg

SEQ ID NO: 659554 - DNA, 129 bp, Homo sapiens
tgccgagtgtgcccagactggtcatgaattcctgagctcaaacgatctatctgcctcggccgtctcaaagacgctgggattaccgagtgtgagtcactacgacctggccttgtggattaaactaatatt

SEQ ID NO: 659555 - DNA, 185 bp, Homo sapiens
gaatacatctctgctatttaatattgtacttgaagtcctagccagaataattaagcaagaaaaaataaaatccaaattagaaatattttccgatgaaatgtttctatataaagtcccaaagtatacacacaaaacaatgaaatctaataattcagcaaagattcataataaatttagggttgatg

SEQ ID NO: 659556 - DNA, 388 bp, Homo sapiens
cctaaagagacggcgaagtgacgattcaggccgaagtatcatgtggactctctcggacatcgccatgctggatgttgcccaagttggtcatatcgaccatgagtatgaggtactgaggcagctgctggtcgcagcagcttatggcgccagcacagattcagtacatcatccgcaaagcccaggaagatcatgcagcagatggcaaggagggcacctgtcatggccacaaattcatggtgtgggaatgccttacactgctcatctgctgtcggctggtatcgtcgaggtcctgaccactgaggcgcgcagtcttcacgtggcccctgaaggccgggatgagggtgactgtgtccataattcccagcatcgagactatccaactttgatc

SEQ ID NO: 659557 - DNA, 1025 bp, Homo sapiens
gcgtgggctccgagatcgagcgcatgggcctggtcatggaccgcatgggctccgtggagcgcatgggctccggcattgagcgcatgggcccgctgggcctcgaccacatggcctccagcattgagcgcatgggccagaccatggagcgcattggctctggcgtggagcgcatgggtgccggcatgggcttcggccttgagcgcatggccgctcccatcgaccgtgtgggccagaccattgagcgcatgggctctggcgtggagcgcatgggccctgccatcgagcgcatgggccctgagcatggagcgcatggtgtcgccgcgaggtatgggagctgggctgtgagcgcatgtggcccgccgatggtagtcagtcagtggtgcgaccggcgcgtgcagcacatcatggccaacaataagtcatgcgagactggatgggccatggagcgcatgggcaccaacagactcgcagcgcatgggcctggagcgcattgggtgccaacagcctcagagcgcatgggccccgacatgggcccggccctgggcgctggcattgagcgcatgggcctggccatgggctggcggtggcaggtgccagctttgaccgtgccatcgagatggagcgtggcaccttcggaggacgctacgaaggtacctagggtggagctggacggccatgctcctggggtggacaggaaggactgccagatatatggaaacatctgacatacgattttcacatggaaccatgctaccggaccaattccacgaattgagccacgataagcaagccgactcaaactgccgaagggaaagccccaagggggctgtgggatcgcacaagcaccggctcccacaaggtgcccaaaaagcacgccagcatgaagaacgtccatcaaagtagaggccgaaaaacattacgattgactgaataaaacccaacacaaagcattatgacactaacaagccaccgactagatatccatcacacaatcaatgcgggagatacacgagcacacacaccaa

SEQ ID NO: 659558 - DNA, 478 bp, Homo sapiens
ggtaacgcagtaagcactgtcaactcttactggtatttcaatttaactcctcacaagaaccgtggagaggtcggaatcaacatatagggatggatgagatacagagccccagaaaacagtaatgtcacctatgagttaaacttctgaaaagtaaaccggcatatgtatttaaatattgcttcaaaaagcgaacctattagaccggataacatgtacctgacggtaggaaaccaacagaagaaaaggtgtcaagaaacagggcatgttctaacacaagggaggtgctctacagtcagggaacattcagattacatcaaggagcatctcagttgctccttccaccaagcaacccccaccagatgatctgctggggatgctggtacaagttgtgggactgcatgctactgtctagagcttgtctcaatggatctagaacttcatcgccctctgatcgccgatcacctctgagacccaccag

SEQ ID NO: 659559 - DNA, 175 bp, Homo sapiens
  misc_feature (20)..(20): n is a, c, g, or t
cagttttacgaagtttcaantagcagcaaagcacttaggtgacttgggtgctgttaaagatattcagttttataagggaagcaaagcatgaaagttcagaaaatttgcagccggacagtgcaatagaaaagaaaatcccggttgagtgtggtggctcatgcctgtaatcctagca

SEQ ID NO: 659560 - DNA, 247 bp, Homo sapiens
ctatgactcttctccagctgccttttgagggagggacatggaagtatgacagagggtagaggatgggcctaaggcctttagatgcccgtctcaccttaccattcttgagaatccttcgagccttttctcctcctcaaccacaagctttgatatcctggagggagcctttctctgacgaataactggccttactgtcccaccactgcatctcccattgctttgcctcagagagcccctagccctttaa

SEQ ID NO: 659561 - DNA, 133 bp, Homo sapiens
caacggcgcgtcgcttacattaaggaacacaagtctggcgcggtcgccaggctagagctgaggggacgatctggagtcactacaacctccacctccggtgttcaagcacttctccggcctcagcctcctaagt

SEQ ID NO: 659562 - DNA, 553 bp, Homo sapiens
ggttttactcagtttttccaggtttggtttttgtttcttttgggtctgtaagtgatttcttcttgtcttacccttatccatattatggctggggggcagagaaaagagcctctgattcttatacacacccctcccaagggagagggtcttttcttataaaagacccggcgcgcccccgctcacaagaacaaagcagcccgttaataaagaaaaagaaacaacacgcggggagagtggccgtccacccacattgttttaaacactcatggaaccgcactcctgatctgtcaccagttacgagctccctcattaccctaaacaaggctcgctgaacatcgaaaacagagaaaatttttatatataccgatggcacaagggagaatggcaataaaaactgcacctcgggaaaaacacgttgaaaggatgtacacactatactgggcctaaaagctcagtgccacaggtatgttacgtgggcctttaatacataggcggaacttgacactaacaatttgcagactcagggaacaggcttttgtctacaataactatc

SEQ ID NO: 659563 - DNA, 402 bp, Homo sapiens
agtgacgaccttaatggtcttcatggctctcatctttaacatggggtagcctatgactcctctaggaacagcttgttactgacttttcatgtattatctcgattgcgtcttccagtgacggctaagtgggtcctggctctgttgggcgtgattcctcccagagggatgggcagcaggaacctgtcgtccgtggtacctgccgggttccaaccttggtctgtctgactccagcctcccgacagtgtgagcgtccgtggtacctgccgggttccaatcttggtctgtctgagtccagccccgccacagtgtgaccttcggtggtacctgccaggatttcaatcgttggtctatcttatacaagccacctgaacgcgttgacgtttggagatgccagccggtttc

SEQ ID NO: 659564 - DNA, 130 bp, Homo sapiens
ccgtagtactctgcttaaatcttgtcgttctgtttcccatatctaggtccattagaagccccttcaatcccatcgatcccttttcccttcaaatcaaggcgactccgagatagctttcttggctggcggg

SEQ ID NO: 659565 - DNA, 868 bp, Homo sapiens
  misc_feature (243)..(243): n is a, c, g, or t
atggctccttcctccagctgggggactcttataggggactggggtagagacataacgagtgcccgtaggagggcgtcagagattgtgctgactaggctcagatccaagatagcgttggcgttctatgcaatttcccctatggggacttgatcgtggtgctcctatcgtgtccatcgttctcttgtgtttctctttcttcttcttggatcagtgcgtacgatcctccttctcccttggttgacncggagtggggccgcttcctcgttcgtgccgtggcactctgtgcaggctcgccgctgtctcgtcgttttgctgtgcgtgttctgcagcgccttgtgtgtgttgtctgtgtcgttcctttgcggagacgcttctctgtcgagatggtaacgcctattgtggggacttatatgcgggtttccctatgtcctcactctgtgtgcacgcggagctctattcttctatgtacggtcagtgtctttaccacgttgagagacataaccgaggcgtttctctgccacccagtgtgtcgtttcggggccacacggatatgtgcgctttatcggatctctcatctctgtgtatcctctgcttcttgttgtccccacacgcacactgctgtcgtggggccgctactctcggcgatagggttgcgtcggtcggggggggatatctcccaagtggaggtggtttcgagcgggcgcaagtctttggcgctccctcgtgtggcccttggacgcccctgtgtgtgttgtctctttctcgtgccatagattggaagctgctactccggggccacccgggggggtggtagttgtttggctttgttgaggttctctctcctctcttcgcccgtgtggtgttatcg

SEQ ID NO: 659566 - DNA, 340 bp, Homo sapiens
tgcgaggagatctagaggatcccacggggatttgtgccgtatccagcaagataatacacagcagactatccaattcacatgaagcagcagatgcaactctaactattcatctccaagatggaatggtcacaaacacaagcctcactagctcaactaaatatcatccccaatcacccagtgacctctaagtatcactagtggcatgccaaaataatttctctgaaatgcctcaacaaagcacaaacccttaacttatggagggaagagacaaccacaaatgtaaagactccattaccttctgtggcaaatgcttggcaagtaaatgcttcatttctcttat

SEQ ID NO: 659567 - DNA, 873 bp, Homo sapiens
tgcgcttggttaatttttgtattgtagtagagacaggatttcaccatgttaggccaggatggtctcgatctcctgacctcgtgatccgcccgcctcggccttcccaacgtgctaggattacaggcatgagccaccgcgcccggccgggacttttctttttcttctgaggcccccattcagtccgaggaatgtagccttcattcagcgcaacgtactgtttgtgttctcatggtgctctcagacctccagccaggtggtggagagcgagcactgccagccacttcagtgcagggtgtgactgagccgcaaggacagcggggtcaggtgtccgggcgccaggtagttctcagaacttggtacatgtcaacttgtccagcccaactgcagcccaggacagcctgtccctgttcccattctacagacaagacgcggaggcagccgggagggtgaccaaggggagctgttaaccccagatgtctggtgcagggtccaaggatgtgaccacatgaaacagaacacatagaggccgaggtggcaaacctgttctgtggcagggacaagccggggacccgagggtgagaaaggtcctggccccaaatgcagcttgggcctcctgactgtagcacagggggaccagcctccccactgaggcttggtctctagagggtctgcagagatgctggcacctcttgttgtgggcagctttgaatgctgacctccataagatggggcctgggggccagtacaggccctgcatcaggtgccctccaacaaggccctctgcaaaaggcttatgctggttgaccagcccctgagagcaccacttcaagtgtcggggcagttgggaagacaaccacttttccaaaatgtaac

SEQ ID NO: 659568 - DNA, 575 bp, Homo sapiens
  misc_feature (271)..(271): n is a, c, g, or t
  misc_feature (350)..(350): n is a, c, g, or t
  misc_feature (385)..(385): n is a, c, g, or t
  misc_feature (471)..(471): n is a, c, g, or t
  misc_feature (483)..(483): n is a, c, g, or t
  misc_feature (487)..(488): n is a, c, g, or t
  misc_feature (525)..(525): n is a, c, g, or t
  misc_feature (552)..(552): n is a, c, g, or t
ggggcacaggcagacccctccccccaccacacacacacactgcttatcctctgaaagctatgtggccttcataaaaatattaacagttcttttacagtaatgattttcccctatgaggctccccagtgaggaggctgtaaatgacactgaccaccagcagccctgcagatcaaggctgttctcttctcggccagcccagaaccagcctctgctcgctccctccctgaggactcctgtctctgacctctgcacacatgctgtgatttgtctncacctcacaccattccccatcctcacctttcagaactcactggcagtgtcccccaataccttccacctctctccagaanttaccttcccatctcaatgtaagggaacttgcttnttccctcagagatctgctgtctctgctgcaagtaatagctagttttcatgcattttgttctgtctgactttaggttgttgcattgntctcccaacctncttnnacccatggcctggaggcagaattatatacctgtgaanttgcttttctttctagttcctctcctncaaaacctcagtccttctggaaa

SEQ ID NO: 659569 - DNA, 269 bp, Homo sapiens
actggacaacgcactcaatggaatcagctccctctgagccccacgccagcgtggccacctcagatctctagctctcctctcctctaccattctctctatggggaggggagcaggcaggaggagcagaaattgccaacattgttacagccaggtatgggagcagcctagggagagcccccatcatgcccaccacccactctgggactgggttcatccttgagctatccccttccaccctccttggctggttaataaattctgaacttgga

SEQ ID NO: 659570 - DNA, 158 bp, Homo sapiens
ccaatagcagacacagcccgtgcaggtgatgtgaaggcaccctcggatttctccagcctgtgttgtaacctctgcgtcctcaagcacacacctggcaagagtcttcttccctttgaaggcgaatcatcattgttgctattgacacttctcaaactagg

SEQ ID NO: 659571 - DNA, 299 bp, Homo sapiens
gtgccacagtctgcgccaacaataaccatgtgatgcccacttacaaatgccttgccatatcaactaagtctgaattcttgtcatctttacatccttttcatattcgaaagaactatcacctatgtgtataatattgatctacatggcagtcacagatgaggacactccgcgcacagagtttgacagcttgccgagagccatgaagctgctcctaggcagtggcgtctccacacttgtggctaagtgctgagccactgacgcatacaatcaccctatctgagatagtagtacaatggcgt

SEQ ID NO: 659572 - DNA, 1521 bp, Homo sapiens
  misc_feature (445)..(445): n is a, c, g, or t
  misc_feature (464)..(464): n is a, c, g, or t
ggagagccttgtgctgagtccgatgcgccgtcccgtccagacggcgacgtcagctcgagcattggtatagatgatcatcgcctcggtctctgtcagtcagagatccggcgtcctggtgcatgtgccaagggctctggcttcggcggaggcagacgcatcgcgcgcgccggtgtctgctctttcccacttcgctatcggtgcggcgcgccgccaacggagggctagtgactgtggagtgcgttgggcgattaggagtcgagaatatcgcgaattcgcttgagtcgtagcgtgagagccgaaggacgcaagagacgaaggatagatcggctcatccctctacacacgtaaacacgctactccgcaagtcacgaggcactcgtgatatcacgatcactcgagagcatgagagcactggacaatagagacagcataggatcatccggcnaccatatcatcattacatnacagacatgcagttgtgcggttgtcgcggtacgcgcagcagagcagcgatcgcctgtagcgtagctggaacgccgcaaggcctgcacactgcaacacggccaagagccgaaccggacaggatggaacgatagacatccatgagatcatgagtgaccgtatgcacacttaccacacaagcccatagtcacattgtggctgtatcgctaatgccaggggctagtagcttatgtccttggttactggcgtctggtgcccgttagcgaattcggcagtacagggaatcggaacgttccagggagtggatgagggggtacaaacctaattagcttggatgccttacacgtcatagcggaaaggtggggtaaattgccccctaaatcgccaaattgcctatccccttgtagggtacctgggagcctgggggccgtgggaccacggagaaccttggaaataatgaatataacccatacaatagacatgcatccctgtcaaccggaggcctgccgcggctatactcaagccattcacaccaggccaccgagggccgggagaccagtggaaaaccggggacagtttaccatgtaacaagggacagaaggccatgaggacaaaacgcactggccactttccacatccacggccatgaggacaggtgccaacgaggaaagagtacccagtcactcgttccgggagaaagaaaaaaaaatgagcctagcgtgcaaagcggcatgcccaaatgcccaatggggaacaggagcggacaaccaagaccgaaagggaacaaacaaagcatccggactgggacatgatactcggcagtcaccacacgaacaatcagtcacaccacaaagtgatgggtgacagcgaacaaaacgaaacatacacacaatattgatgcgagcgaacacacacgggcagaccaaaacaagaaaatacgtcagaaaaaaaaaatcaaactcgcgaaacaggagggcgtgaacagagccacacaagtagaaaagaaaatacaacagtgatcggtcaacacacatatatttttcctgatagttattcgcc

SEQ ID NO: 659573 - DNA, 333 bp, Homo sapiens
aaagcagtaattctggggtttaacacggtgtccctgtgttttgactgtgtagcgggaggcaaagacagtatcatgctcacacctgtactcccagccacatcgggaggccgaagtgaacggatcacttgaggtcaagagttcccgatcagcctggccaacatggcgaaatcccgtctctactaaaaatacaaaaattagctgggtatggtgccaggtgcctgtaatcctagctactaggtaggctgcagcagaagaattgcttgaacccaggaggcagaggttgcagtgaactgcgattgtgccactgtactccaggctgggtgacacagcgag

SEQ ID NO: 659574 - DNA, 261 bp, Homo sapiens
  misc_feature (248)..(248): n is a, c, g, or t
gactctacaggatctcaccgtcatatgtcacacatccaatcaacggacataacattagcacgtgtaacatagtaacccacttaaaatttagaataaattaggaaatttcaatctataagtgtcaaacaacaaatgagttataatatttttctaataagaaaaatatcacctgggaaactatggagatactaacatcctatgatctaggctggccacccattttgagagaccaccacgagatctcaagngcatagagactac

SEQ ID NO: 659575 - DNA, 121 bp, Homo sapiens
tgggcgatctagaggatcccaaatgcaataaaattatgaactcgtgatcatgtggaggctgtcttcctcatgctgtatatttacattctcacctcatccttgcaatttctcatccttggga

SEQ ID NO: 659576 - DNA, 374 bp, Homo sapiens
  misc_feature (54)..(54): n is a, c, g, or t
  misc_feature (167)..(167): n is a, c, g, or t
gacagcggttgcacgaagcgctcatgggccaggcgcaacagggcgagcaccagngccggcaccaagacatcgatcaacacgaccgaagccggcgtctgccgcgcatccgagcgcaactgcgcacagcgcaactcggcgttgtcaagcaaggcatcgcgcaaggcgangatgctgttcattggcggcacgaacttcgcggcgaagtcagccggagtcatgccaaaccggccatcgtcatgccccgtggacaggacagactgcaccagcgcggcagcatgcacgaagtagtcctgttccatggcggcatggacctagacgagacggtcggtctgctccagcaggctcacgcgcaaggacagcagatggcgcagctc

SEQ ID NO: 659577 - DNA, 820 bp, Homo sapiens
  misc_feature (284)..(284): n is a, c, g, or t
  misc_feature (301)..(301): n is a, c, g, or t
  misc_feature (343)..(343): n is a, c, g, or t
  misc_feature (388)..(388): n is a, c, g, or t
  misc_feature (392)..(392): n is a, c, g, or t
  misc_feature (399)..(399): n is a, c, g, or t
  misc_feature (413)..(414): n is a, c, g, or t
aattcgcggccgcgtcgacgcgagaagacgacagaaggggggctcactgagaaccatcccggtaacccgatcaccgctggtcaccatgaaccacattgtgcaaaccttctctcctgtcaacagcggccagcctcccaactacgagatgctcaaggaggagcaggaagtggctatgctgggggcgcccacaaccctgctcccccgatgtccaccgtgatccacatccgcagcgagacctccgtgcctgaccatgtcgtctggtccctgttcaacaccctcttcantgaacaacctgctgccntgggcttcatagcattcgcctactccgtgaagtctagggacnaggaagatggttggcgacgtgaaccggggcccaaggcttatgctncacngccgtgnctgcatctgggccnngatttgggcatcttcatgaccttctgctcatcatcatcccagtgtggtcgtccaggcccagcgataggatcaggaggcatcattggaggccaggacgctctgcccgtgactgtatccacgtacttctatcttacaattcctctgcctgcccccaagaggcaaggagctctgcccttgaccttgttatccagtactccaccttccattactcgccctgtccccacagcgagtcctgcatcagcccttatcctcacacgctttctacaaatggctcaatacgtgttcatgtctgccaaacaacacacgagacaacacaacaagttggcgcgcccccaaacatttcatcacactgtggccgggcagatgttgcgccgtcagcgctaagaacgcgcaaggggttcaaaac

SEQ ID NO: 659578 - DNA, 267 bp, Homo sapiens
ttttaaaaaaaaaacccccccagaagggtggggggctttggcctgtgggttaatttaacccccccttttgtttttttttccgccccttgtttccccccccgggggccgggaacaccccttttgcaaaggggggggttttgggtttcttttaagcccccccttttttttcccccctttggttgcggcgggcggcaaaaaaattttgttccctcccctgggggccccctttttttttttccaataaagggtttggggggggggggttta

SEQ ID NO: 659579 - DNA, 257 bp, Homo sapiens
cagaacaacgccataagatctcctttccaagaagtagccccttttccccccatgcctgccccttcccctgttttggggccccccctttcccccttgggtcagccccctaaaggtaagtccccccttgggggcctttttggaaccgtgtgtgagtgagtggtccccccccaacattgtacccaaagtctgtccccaaacattgcccctggcgctgttaggccggaattaaaatggctttttgaggtttggtttttcca

SEQ ID NO: 659580 - DNA, 338 bp, Homo sapiens
gaagatcagagttttgttttttttttaattcgttctatttcagtagctttagaggggtagaaatggtttttggttacatggatgaactgtatagtggggaagcttgtgcttttagtgtacctgtcacccaaatagtatacattgtacccagtacccttctgagtctctagggtcctccaataccactctgtgcctctgcatacccatagcttagctcccacttataagtgagaacatgctgtatttagttttccattcttgagttacttcacttaggataatggcctccagttccacccaagttggctacaaaggacatttcattcctttttatggtt

SEQ ID NO: 659581 - DNA, 1572 bp, Homo sapiens
  misc_feature (1254)..(1254): n is a, c, g, or t
cactactttttgtggtgtgggagtgttgttgcctcactatcacccacgcggtgtgttgtgtgctcgtcgttgtgtgttgatatctctctggctgcatcactacccgggcggcgcatgctattatttgttgtggggggtctcgttttctctgtgtgagggggtgactacctcacctatattagtttcggtggggcagtgggtttgtttttttttgagatcacgccaacaccaccaccacaagaatggtgcgccctctttgagatccaacgctgggtgtttatatatgtgttgactcttgtggtgattgattattacctgtggaggttgctggctgtgcgattggttgtgggcaccacaccatcggcgggggggggtgtttaactaccaaaccaccgcacacgcccaccatgcgggtgggttggtttactcaccccgctcagtattagttgtgggtgttgcgctttcttttttatcctcgggggaggagaacaatgagggtgttggagacccccgcactacttcgtcggcgttgtgtggcgctccctctgtgagccaccacactgtgttgggtgttttgataaggtgcaggccttcgtgggagacaccaacgacagggggggtaccgaaaaggacccccccgcgcgtttgtttgctgtgtttttttcccccccgagccgtggtgttgtggtcacgaccgaccgctgtccccaccactggtggggaggtttatcatgattagggggtggttactaccaccgtgtaattacatcccctcttgttagagttctgccccccatcagggtgtgtgtaaaaatggaccccgctcggcgtcgtttgtatggtgggtccccccaccgtgtgtgtgtctgttggcgtgtgtggtatcgctgagagtgagtccccgctgctcacaccccccgtgtgggggggcccagcagcacagtgtttcttctcacgccgtgggctgctctcctcttctccatatatatgtgtgtggagtaggccatattttgtgcactttgagactctttcccccccaccacaagaaatgtttatcttagggggtgtgtaataacacacacacactttgctcctcacacacaccgcccaacactctctctattatctctttctctctatagagagagacaccctctctccacaagtgtgtatcacactttccgcgcacaccccgcacaccacaggtgtgtgtcccccccgtagagagagagagagttcacacccctctctctntgagagagtctctcactcacacaggcacagaatgttgcgcaccgccacaggggcccccgcggacgccccctgtgcacagagggtggcgggttttctcactgaggggagggggccccacaaccctctgttgggcggaccttccctcgaggcctcgtttgagggggccaccccccttgtgcacattcacggcttaggcccctcgggccgggagtgccaccccctgctcctttcgcgagagaacttccctctacccctccctggtcccctggctttagactcacccccttttccccacattaaaacccttttgcccaccca

SEQ ID NO: 659582 - DNA, 289 bp, Homo sapiens
ataagaatgcgcgctacaatgctcagtgccaggagacctatcctcgttactcaagccctgcacccccgagaccatagcaaaggccacatctaagaacgggaacgcaatggacttcacgccatgccttgatgcccttgagcccctcgtgtcacattgggcctggcccacgccctccctctcccaggcccgatatgtgacccaccagtgccttctgtctgctcgttagctttcatccatcatgccctggctttgtccctctcactccccagccccaccccgtcgggtggag

SEQ ID NO: 659583 - DNA, 385 bp, Homo sapiens
  misc_feature (197)..(197): n is a, c, g, or t
  misc_feature (235)..(235): n is a, c, g, or t
  misc_feature (256)..(256): n is a, c, g, or t
  misc_feature (283)..(283): n is a, c, g, or t
gatggtcacagtggctcatgctgtaatcccggccctttggaggccgaggcgggaggatcacttgagcacgggagttcgagaccagcctgggcaacacggtaggaccccatctctacaaaaaaaattaaaaagttgggcaggtgtggtggtatgtgcctgtggttccacctgctcgggaggctgaggtgggaggattnggcccaggaggtcgaggctgcagtgagctatgatcgtnccacttcacttccagcctggncgacatagcaagaacctctctcaaganaatataaaataagccttcatttatgtaatgatcaaaataagcctaatatgaaatgaaaatgagtgaaaactgagtgcaaatgttatgctaacagagagctga

SEQ ID NO: 659584 - DNA, 200 bp, Homo sapiens
tatagaggatccgatcaggcgaataatgtggaatagggagctgtctaagccatcgagtcggaggcttcattcactgatttcccctattctcgaggctacaccctagcacgaaagctacgccaaaatccatatcactatcatattcatctgggtaaatctaactaacttcccacagtctcgccggatgggtaccgaggctc

SEQ ID NO: 659585 - DNA, 298 bp, Homo sapiens
ctcatcacattgagagtagttcccataggttcctagagttatagtcctttagtgctctgtgttgatatagatcgatcacacttagattagtatcttcaattggggccccagtattttaacagaaattttgactaaacagatcaactctaaaggaagtagacccattcttcaacactcgctcactctggtgtcaccttggttatgataccctcctctacttactatacctttgttagtgttgtcattctctgctttcaatgtgtctcttatctccttctcctgccgagtccgctgcatt

SEQ ID NO: 659586 - DNA, 397 bp, Homo sapiens
  misc_feature (342)..(342): n is a, c, g, or t
ttcaaccactgaggcagtgaaaccaacacagctggtttctcttaaacacatacatgttcatgctcattataaaaaggcacacaccagagagaacatatgaaagcacaatggtcttttatctcgagaataaaagagctggtatatttgtacatgtgtgaaagaaagtctgtctgtggttatttcctgaacattgtttgtaatcacaagagaagaaaactgcccagatgcccatcaggagggactggcttgatggcattatgaagtatccattccacggaatacctagcaccacgaaaaaggaatgatgtggtactttatgaactgatatagaatttctccccnaaaacaccactaaataaatgtgcagaacagtatatagtatactgctacttgtgtt

SEQ ID NO: 659587 - DNA, 577 bp, Homo sapiens
ccatcaccaccgcggatctagggttccagcaccagccacgcacgctcctacaagaggaccttgggcacttcgccccaatagttacaaccaagaggggagtgggggtgaccatgctcccactctcctggctgcacggtgccagacacgctgcatggagcaaagcggagaaagcagctccagcacagggcccttgtgcccccaggcagaaggcatgacccagccacaagagtaagtcctgacacctccacagctcccagtcggcgggtgcccctccctccccacggagacatagggcggggcagatctaggcgccgagactcccagccatacccgacagcgggctttccctagcacctcctcattgccaaggaggcggaaacccggggcctgggcggggtgcagggggggacggccaaggggagtggcatcacggatcagtacggcccctccggccaaccggatcccaagaaggcggaggaactcagacttcacgccccctccctaaagcgccctgaatctacacgcgggagacccccccctacccctccccgaccccagcaggccagagcgcggccgc

SEQ ID NO: 659588 - DNA, 348 bp, Homo sapiens
aagttaagggttttaaggaaaaaaaaacccgggggtttcccttatcctaaaggtgccggtgaaagaaaaccccgggttgggggggggggtcctaaaaaaattaaagcgggttttccccgggtttttaagcccctggttcgggttttttgattcaagttttgggcccatcttttttttggccctttcccatttttccccggggggttttgggggggccgaatttcccttcgggggttgggccaacgtcttaaaaagccctttgggatttttttaattcccttttttggggttttttagggccaaggggggttttttttttttttttttacccttttttttggcccccca

SEQ ID NO: 659589 - DNA, 683 bp, Homo sapiens
tgcaccagccatttttttccattccattccattccacccgggttgattccattccattccattccattccattccattccactagggtggattccattgcattccattcctatccattccattcctttccattccattccactggggttgattccactccatttcattcctttccatttcattccattccattactctcgggttgattcaattccgttctattccatgccattccattccattcctttgtattccattccattacattccattatggttaattctccattctattccattgctttccattccattccattccactcgagctgattcaattccattctattccattctattccattccattccattccattccattccattccactcgggttcactccattccattccattccattccattccattccattccattccattccagttgattcaattccattctattacatgtcattccattctattccattactttccattacattccattccattctattccagattattcaattccatactattccattccattccattccagtccagtccattccattccatttcattccattgcaatggagttcctttcattccattctattccattccattgaattccatcccgtccatcctccattcgtttgtttctt

SEQ ID NO: 659590 - DNA, 146 bp, Homo sapiens
accactccaagcaacatttattgagggtggcgggagccgcgctggacaggggtcggggctgccctcggcgtccagacgcttgtctttatggaacacgtatgtacaggcacggggcgtgatggtttgagacgctagctggggactgc

SEQ ID NO: 659591 - DNA, 154 bp, Homo sapiens
gttttttttccctttttgttgggggggcccccccccacctcggggggtcccccccccccggttgttttttccccccccccccccccccccgggggggggggctttcttccttttttgcccggggggtcctttctttttttttgggggcccaaca

SEQ ID NO: 659592 - DNA, 119 bp, Homo sapiens
  misc_feature (1)..(1): n is a, c, g, or t
  misc_feature (111)..(111): n is a, c, g, or t
  misc_feature (117)..(117): n is a, c, g, or t
nttttaccctttggagccgaggtggtggccaagttcctccacaagcacgacttggacctcatctgccgagcacaccaggtagtagaagacggctacgagttctttgccaancggcanta

SEQ ID NO: 659593 - DNA, 858 bp, Homo sapiens
  misc_feature (220)..(220): n is a, c, g, or t
  misc_feature (415)..(415): n is a, c, g, or t
  misc_feature (459)..(459): n is a, c, g, or t
gctcctcctcctcctcctcctcctgggccgggctgatcccctccccgctgccgcctcctcctgtggctgggcccgcggttgtctcagtcccctccgcggagccgttcctgctcgccgccggcgcgcgcctcctacaatcatccgtcgtgcaccataaggcggcacaaggcaccaagatgtaccaacgcgagtggtcatgccgagaagccagtcacgccgnggagctgggtacacagcctcaggacacgcagctgaaatgcacagctagaagggtgggcttatcacaaagtacgagtctacaacaaagacctgctaagagccattatgtgccccccgatgcagagatataacgtacgtgtgggtcttagtgctgcccatgcttaataagacaagtggatcgcgtctaattacccgngagaaattttcaatccttgggccttctacatcaatgtgcccctnctctcgagtgtgcacttaccagtgtggatatatatacggacacctctgtatgaccttcgtattgaccaaaagatttacggagaactgtggaagacaaggaatgtttgaacgcatgtctctgcagacagcactgaagatgaacaccagtattgaaatgcattgtgccttatacagctaaagccatggaaagccataaggatgagttttaccattattcctgtacttggtttggagcctctgagtgagtcaaaagaacaggaaattcggaaaaactcttcagtaaatatctagcggatctagtaatctctttggggatcttctgatttctgcattggggtcaacggtccgttacagtactatgatgaatccagggggagattatagatccttgactctaca

SEQ ID NO: 659594 - DNA, 172 bp, Homo sapiens
gggttagctgtgggcgaagtgcgcgaagagctcttcgtcgcttagtccgagtccggggtgcggtgtgggcgggagggaagaggacgcgggtgagggcttggccgtcggcggctgtgaggagtgggcctgggtctgcgagtgagagcggtggtgttggtgctgatgctgggcg

SEQ ID NO: 659595 - DNA, 84 bp, Homo sapiens
agcggagttctgtgtcgctaggcttctgcccggccgccgccgcacataagctgcgaggaggagctttacgacttcccggtcttc

SEQ ID NO: 659596 - DNA, 1246 bp, Homo sapiens
  misc_feature (41)..(41): n is a, c, g, or t
  misc_feature (216)..(216): n is a, c, g, or t
  misc_feature (224)..(224): n is a, c, g, or t
  misc_feature (690)..(690): n is a, c, g, or t
  misc_feature (733)..(733): n is a, c, g, or t
  misc_feature (766)..(766): n is a, c, g, or t
  misc_feature (861)..(861): n is a, c, g, or t
  misc_feature (871)..(871): n is a, c, g, or t
cccatctcgacgaggccgatctcggtcgcccgtatccaccnccgcctccgcgccgtcgtcctccatcccgacgacgccgcgccgtgcgtctcaccgtaactctaaacccgcacagcgattcgtccggagcgaatttcatgtgtagccacatcagcccatccgtggtacacagccatgtatcgcagcatcacagactcggctacacaccctctcgcngcagtacngagagcacgcaccgcatactctatcccgtcctgatcaagcgcaccgcaagtacaagcacagcataggcaagcactgcgtcgccaccgtcacgcttgcacgccctacccgctcccaccgcaagcgccagcagcctcggcaagcaacacaggggctcacgctcgcacgcacgccgcgccgcagcagacgactgcgacgcagcacatgtaggcgtagccctcgccacatccatcttaggccatagcgcacctgccgcttccccagaactcgtccccaccgcccgccgtcgctgcgctcgtgactctaaaccctgcacctcccccgaacagcggcccacacctctctcggtccgcacactcggcaccaccgccaccggttactctccacgcacgctcctgtctccgtcccccgtcacctctcgtatgccacttctcatactccactacgcactgtcctgcggcgccgccnaccgccgtctcctctctccgacctctcccgcatgcatactccnagtaagcacacgcctcttttcactgcttccccncactcgcccagacgccttcccccgttgtccgatctattcgccccacatccgtccggcatctcgcgtatgcgccgcacccgtcctgcccggccagnacgccgccgncagtgacccgccaatacccacgtccgccatctccgctatccctccgcatcatataatatccgtcactccccgtcgtatcccgtcgcgacgtatcccgatgtcctattttcttccttcccgccgcgtccgctcacgggaccgccctacggtatccgcgctcccgtgttccgccatattgccctcctcccttatcctctatatccaatcacccaattgtcctcatgccgtccagtgtaggtacaccctccccgccccccactccgccccacgtatccccgctgtctccgccctcacctacttcccgcttgccctccctccaccataacccccgtcgcacccatccctccccgccacccagttccacggtgaccccat

SEQ ID NO: 659597 - DNA, 473 bp, Homo sapiens
cagagatatatcatgaatatccgggaagtcttaccatattttagccctaaaaccttttttgaataatttagtgctatccacacatctgacaaatgttccttgttctctatgggacacacgttgtgggtccatagtgtcaggggcttcctctatctcccccctgtgagagcatgcaccttagcccttggttcgtattttaaaactcaagggacttaggtcctatctccagcctagatttactacctcttctacctggactatgcacctcccactcacacctccatctgattatccctggacatctggaagaacccaagcaagttctttcctaactagcagggtcttggccaaagctgttttcaggaatgtgctgtccacacaacctgtacatgctcatccctcccaaaaggcaattcctagaacactttagttaaaactactaggacaagaccaaccttgaacctgagtctcaa

SEQ ID NO: 659598 - DNA, 158 bp, Homo sapiens
ttcaccctcaaccccaaatcttacatctcaattcccatcctacagaagcactcatacgtatatgcatccccgcagtacacacacaggacacacagcacacgcatgaacacagcacacacacgagcacagcacacacacgagcatacagcacacacacc

SEQ ID NO: 659599 - DNA, 1315 bp, Homo sapiens
  misc_feature (14)..(14): n is a, c, g, or t
  misc_feature (32)..(32): n is a, c, g, or t
  misc_feature (34)..(34): n is a, c, g, or t
  misc_feature (95)..(95): n is a, c, g, or t
  misc_feature (120)..(120): n is a, c, g, or t
  misc_feature (152)..(152): n is a, c, g, or t
  misc_feature (164)..(164): n is a, c, g, or t
  misc_feature (168)..(168): n is a, c, g, or t
  misc_feature (179)..(179): n is a, c, g, or t
  misc_feature (183)..(183): n is a, c, g, or t
  misc_feature (352)..(352): n is a, c, g, or t
  misc_feature (368)..(368): n is a, c, g, or t
  misc_feature (404)..(404): n is a, c, g, or t
  misc_feature (423)..(423): n is a, c, g, or t
  misc_feature (1192)..(1192): n is a, c, g, or t
  misc_feature (1199)..(1200): n is a, c, g, or t
tgcctgagctccgnatatttctcctgttctgnanacagtgagaagtgaaagagaaatggctgcccctgcaccacttaccgcgaaggaggctcaangctggggggcccctctgccttccantgaccgcccgtgtcacatcctgacccgctcancaggagaacacngcangtccctccgancgcngtcggcctctccagcctgccatgcctctggccatgaggcgacccgctggagtgatggattcccgtcactaccacccacagggcgagggggtgcattggtctgcttgggccgctgtaacaaaatgccacagcctggatgagtgactgacattgcttccccaccgttctgnaggctggaggcccganatcgaggtccctgacactatttcagtgatgccagancccaggaggagtcgaccangccccagcgtggccataagcaccttcgcaggaccacggagtcgctgcaggtgttcagccctgttgagagtgggagtcggtgtcgatggtcacagctcagtaactcatcgtcaccagcgagtaccacagagcagacacaactgcacttctctgtagagcctccagtcgatactgagagccactggggcgtctgacacccaagggtgcagacattcactccaagtccagagaccgcgccctttctaaggccctgtctcacagtcgccccgtgctcattgtgccggatgtttccacagccacagagacggtgcgtgaaggtgaggtgcagcctagtgcatatgactgacagaaacgtgaagccacagtgggacgcctggatgagacacagatcaccttccaaatctgagtgtggccttgggaccaaccaggcagccagggagaaggcagagaccagagggaacccaggtgccctcaatcccagcctcctctatcccagcctcccaatcccagcctccccaatcccagcctcctaatcccagcctcctccatcccaggacccccactcccagcctcccgatcccagcttctctgatcccagcctcccctaaaacccagactctatgaatcccagcctctgaggtgggaactgttagtaaccccactccatggacaagaaagctggggcctggcgaggctaacagactatcctgatggtgtgagggagggatcggcctctgagggctgcttccacccattcttcaccagtgggntgcaggnntccaggggccacttttccttgcagtctatgctcattccaagccatcctgcagctccagaagctccggagccgacagcactgacgagaagcgatggagcctgcaatgcagggtgag

SEQ ID NO: 659600 - DNA, 409 bp, Homo sapiens
aaaatcagttatttaattatatactgccttgatataccagagttcaaagtttgtaggactattgctaatcatctaaatcaggagtctggtaaactatggcccaaataattaaacttggccataaccatttaattatctttttttttttttttttgagatggagtcttgctctgttgcccaggctggagtgcagtggccctatctgggctcactgcaagctccgcctcccaggttcacaccattctcctgcctcagcctccagagtagctgggactacaggcgccgcaccatgcctggctaattcttttgtatttttagcagagacagtgtttcaccgtgttagccaggatggtctcgaactcctgacctcgtgatccacccacctcggcctcccaaagtgctgggatta

SEQ ID NO: 659601 - DNA, 935 bp, Homo sapiens
  misc_feature (1)..(1): n is a, c, g, or t
  misc_feature (42)..(42): n is a, c, g, or t
nactatcaatccacgcacaagcaatatctatatgtactcttnatcgctgctaaacactataataccatatgcactaataattcaagactccccctccatataccgctccctcatattaccaacttgcacaaccccctcttagccctgacattattacatttgggaagccaccccccttcttattaaaaactgcccgcccccctgggaaaattccaacccaatttgagcttcgcgaaaaaactaatttcaaacgttcctttccaccagagaactttttttgtcacccccctcagctaactgataggtttccaagagccaatacacccggtgtttctacgaggcgcctatccacctgttcaacttcaacccccatctgggagtgtcttcttcccccgacccgggtgtcgtcggatttcccccgggagcttccttctgcccacccttcccgcagttctcctccctttcttggcgccccttgggtctcggcgccccttttccagaaaaaggttctcacccctgtgtcactcgagccccccggggacgcattctctcccggcgggggtatatcccctctctttctgaaaacttctccccacaaggaactcttcgtgcctccaaaataacgtaagtatgttcaccacctccatgacatcacattattactccacttgtataaactccccacgcttcccccgcctctgaatgaaacatctccctcggcacgtgaccgcaaaataattctttttaagacgcggaatatattcttgagggccccgcccgcacaagcacaaacacactcgcatctggcccccttctgtcctcggattgaagaatacacacaccaccaaacggcttacacatgcttttttacaaacccgggcaatcctttaaaaaaggccctttcccccccggggcaaaaaacaaaaaacaaaaca

SEQ ID NO: 659602 - DNA, 684 bp, Homo sapiens
  misc_feature (78)..(78): n is a, c, g, or t
  misc_feature (455)..(455): n is a, c, g, or t
tatttttattatatcttatacaaacccactgaatcccacccccacgagcaagcttctgggaacatctaatctctgagnatgtagaaactaaacagtcagacctccaggactaagatgaagtgagcctagaggagatcgtatcataagaatgcttctgtcgttagccgggtgcagtgctgtgtgtatctagttccagctacttgagaggctgaggcaggaggattgcttgagtccagaaagtggcagttgcagtgagtggagatcgcgccactgctctccagcctggttgtgtagagcgagaccctgtctcaaaaaataaacaaaaaccaaaatgccttctggccagttaacaatctttattagaagggtttttagcttttttttcttcactggaaggtaaagtgggtggccaatgcaaaataaccgtctttattaatccttttttttttgaaaanaaaaaaacaaaggcctaatttggactggccgttgtggcctcgacggcggatgccttgagggcaggttccattatgaggcccaattactgatcctctgtcactggctccctgccttcggccagcgggcttaggtaagtggaaggaccgtcactcagaggtcggcataacgttgtgcacaaaattcgggggaaaacgcatgaaaaaaggttctgaccagggcgccaccacg

SEQ ID NO: 659603 - DNA, 787 bp, Homo sapiens
  misc_feature (362)..(362): n is a, c, g, or t
attctcgccgcatcgcaacgcacacattccaccgccaccacgtatgacatgctcggcatctaatcgattcactatagcactttgccctcaggtccagaattcggcatagggcggcagtagctgcaacaccccaaccaggcccagtaagtacacgagaagctccgagcatggctgaagtccaacgtctctgatgcggtggctcagagcacccgtatcatttatggaggctctgtgacttggccaacctgcaaggagctggccagccagcctaatgtggatggcttccttgtgggtggtgcttccctcaagcccgaattcgtggacatcatcaatgccaaacaatgagccccatccatcttccntacccttcctgccaagccagggactaagcagcccagaagcccagtaactgccctttccttgcatatggatatgatggtctcctctgctccctcctggggcatcatcctaactgattcttccttcactgtttatatcatcaccatgttatgatgggaacgaggtcgcaagcgtcagcacccagtcaaatggctgtgcccaaccgtcaccaaggtggcttctccttggctgagagatggaaggcgtggtgggatttgctcctgggttccctaggccctagtgagggcagaagagaaaccatcctctcccttcttacaccgtgaggccaagatcccctcagaaggcaggagtgctgccctctcccatggtgcccgtgcctctgtgctgtgtatgtgaaccacccatgtgagggaataaacctgcctac

SEQ ID NO: 659604 - DNA, 194 bp, Homo sapiens
atatctgggggttccattggtctcaaacctgaggtctttgtacatctgggagtctgtatagcttcattgttctctgtaagtcatatttctgctcagtgagagaatttcacttctaccaattttctggggtttagtgatcgatgaccagtatctgcatgtggctatgggcttaggaggaaccactcccgcggtat

SEQ ID NO: 659605 - DNA, 179 bp, Homo sapiens
accccccccccccgtttttgtaccgggtttttccagtgtttaacggacgtgttaatagtggttaatagttaaagcctgtccttcccttaatgttaaaccctttgtccggggtaagggcgcccccgtcacctgtccccctcgccccccttttattaatttggcttttgccttgcctccca

SEQ ID NO: 659606 - DNA, 691 bp, Homo sapiens
gaagaaatgaagaatcgagtgtatatagtatttgaagggagaagaagggcaggatgctggcgggctccttgcgggagtggtatatgatcatctctgcgagagatgtttaaccctagtgtatgccgttgttaccgtatcctcacctggtgatcgagtcacctacaccagtcaagtccagtcattcccactgcaaggcccaagccagcctcagtcgtagcgttcaaggtgttgtcggaacgcagttggtggaccaagagccgtgtatcatgacaatccggtcgtatctgggagatgcgtagctgttagcgtcggaatcgctgtatgtacagaatccagcatgctgtgggacataggtcaggtcgatgatatacgagaatagtagggaggagttgaaggagttaaccaattgtgctaccgaaggctcatgggtattatcgtgctgtgaaaaaggatggtgatgccaaaggcttagagcttagtgaacctcgagctatcagtcactagcaggatcgcaatgaagtcatggacgttctggtgaagttgcgtgacctcgagaacccaaatgggagccaacgtcgtgggtaaccacaggaggaataacgaaggcgtatgtacgaccgggtatgccacgatgacgacactgacgggagcccagcacgcaatgcagattggcggcactactgttagaagg

SEQ ID NO: 659607 - DNA, 336 bp, Homo sapiens
cagaggatcccccaacgctctcacaccagccagaatggctatattaagaagtcaaaatggccaggcacagtggctcatgcctataatctcagcaatttgggaggctgaggtgggcggatcacttgaggccaggagtttgagaccagcctggccaacatggtgaaaccccatctctactaaaaaataaaattagctgggcatggtagcacacacctgtaatcccagctactcaggaggctgaggcacgagaatcacttgaacctgggaggcagaggttgcagtgagccaaaagtgccactgccctccgggctgggcaacagaatgagactctgtccc

SEQ ID NO: 659608 - DNA, 235 bp, Homo sapiens
cttgccgcgtgtctatgtatggtcatgtcgtcctaatatgggatctctagagtcggacctggaggtgtgtgcagtgtggaaactggcggtctgtatgacactctcgagactggggagatggcagtagccaaggtcatgcagaaggacagtgagaaaaacatgtccctcaagaaacttactggacagtacgtggaccgccttggtgtgtactctctccaataacgctctgtgggcc

SEQ ID NO: 659609 - DNA, 717 bp, Homo sapiens
ccggcctttgatatctggacgatattgtgcccagaaaaactattcccatgagtactcccagggtccagccacgctgccaccaagccccagggacctgctacagtgccaccaggaccggaatgctcaacggcaggagggagcccacggaggctgcagcacctgccagaacagggctggaagaaaacccgctgggaaatctctggcctctgaagcgtccatcttcagacccagcctcaacggaggcagcccagagggtgaatggcagagcccagaatggcgtggacccaccattccgggcccatgtatagatgggagattcatggcccagcatagaagaatgccagttgggagtttctctccttccctctaattctccccagacaggctgcgggtccacccaaatagccgaggagcacgggctgaggcacgacagattccggggaagaggaagaggaggttcatcactgtgagacaagagggccccgcgaccccgagctagccctgggaccacccagcagggaccggtggcccagccccatctccagcccagtgcccccatacgccctgcgcagacagagcagcctcccagggagcagcgtggcccagaccagcctgatttgaggacgctgcacctggagagactgcagagggtcaggagcgccaggggcaacccgccagcaaggagcagcaggcctcagggcagcaggaacttccaga

SEQ ID NO: 659610 - DNA, 81 bp, Homo sapiens
ttcttatcccaatgggccgctagccaaactattgccagaggccctcttttaccaaaaacatcacctctcgcatcaccagta

SEQ ID NO: 659611 - DNA, 498 bp, Homo sapiens
gaccgaggtcgcacgcgtgagacttctccgccgcctccgccgcagacgctgctgcgatgcgctacgtcgcctcctacctgctggctgccctagggggcaagctcctcccccagacgccaaggacatcaatggaagatcttggacacgcgtgggtatcgaggcggacgacgacgcggctcaacaaggttatcagtgagctgaatggaaaaagacagttgaagacgtcatggcccatgggtattggcaagcttgccagtgtacctgctggtggggctgtagccgtctctgctgccccaggctctgcaggccctgactgcctggttctgcccctgtctgaagcagaggagaacgaaagatgagaacgaaggaggagtctgaaggagctcagatgatgcaccatgggacttccggcgcattcttggagtgtaaagttcctcgctctccctggcaaagtagacacggccttttctacacatctgatgagggacaagacagaac

SEQ ID NO: 659612 - DNA, 197 bp, Homo sapiens
  misc_feature (63)..(63): n is a, c, g, or t
ggggggggggcccccccccctttttttttttcaggggggcccccccccccctttggtgcgggngccccttttttccaggggggggccccccctttgggggggtgggggttttttttttcccccccccccccccccccccgggggttttttttgtttttttggggggggggggttttttttttggttttttttttcca

SEQ ID NO: 659613 - DNA, 423 bp, Homo sapiens
gcaagtttatgggctacccaacgaggacaaaaatgaaccaggctcctgaaagcaggaatctaacctgtgctacgtggccttcccagtcacgaggcgtgagagtacattacacattgccaggtggactccaagggttaaccaaggcaaaacctttggggaaacagggactccaggcccaaatccagcctgagaccctcaaagggcagatccgctaacctcaagttttcagaagatctgaacccactgggggctcctgctcctctgcctgccccatgccagactaggattccagtgacataagcgccctctacagactcagaaggacagagaaggttctgctggaagtgggctcctcagcaaaccagcagataggggttcctttgatatttataccccaggttttttcactctcacgtgacatct

SEQ ID NO: 659614 - DNA, 309 bp, Homo sapiens
ctcgaactatacggtttctctgtggcggtgacggggctgtgtgtgattgtgtgtctgtgtgtgtctgtgtatgtaatggtagtgtctctgtgtgcggagagggtgtgtgtgtgattttgtgtctgtgtgtgtcttactgtgagtgtctgtgtatgtaatggtgtgtctctgtggactgcgagggtctgctgtgtgattgtgtgtctgtgtgtgtctttctgtgtatgtgtgtgtaatggtgtgtttctgtggccggaagggcgtatctgcgattgcgtgtctgtgtatgtactggtgtgtctctgtggc

SEQ ID NO: 659615 - DNA, 313 bp, Homo sapiens
tcgtccgaagtgtctgacatgggagttaagaacacaataggccagggctgtaatcccagcactttgggaggcaaggcaggaggaaggcttgagctcaggtgttggagaccagcctggaagacatactgagatctcatctctactaggaaaaaaaaaaaattaacctggttgtgaaaatgctcgcttgtattcccaactactcggaaaactgaggtggaagaatttgtttgaccccgggagtttgaggctgcagtgacccattgatttgtgccagtgcactcaagcctgggttgacggaccaagacgctgtctc

SEQ ID NO: 659616 - DNA, 867 bp, Homo sapiens
gtccggaaatatgtaactgtacactgaaaatatttatacaatcgtaatgagcgtatcccaaatgactccatcctgtgaccattgctcactaccaatttctaatctggtacatatcaatagataaaacccatcataacccaaagagctctttgtcttcgctcaactaattttgtaagggatcgctcagggatcttgaggccacagaagttccgacggaactactgaattatgcaattacgctccgagtcaacgtgacatgctgagccatgtacaggcctctatcccccttcactcacgaatacgagagggaaccctctgggaatctggtggcttttcccccaggaataactatctcaagaggtcttatggtaggctacagcaaagtatggtaaggccaaaacagttgtgcagattgggtaccatgtcagctatcagctgtctctactttgcctgtggcacataacttctcgcgcaaatgtgcccaactgtctattgcatagcacctctgttcactaaatggccccactgtggcatgctagcagatgctctctgtgagggaaagggacgtgcttctctagtatcagcagtaagactctctcctttgagtgaccagtgactgactgatgttgtaactctgttgtgcctgaaacaggccctgctcctggtttgcctcctcaatactgcagggggctcacttctgtaccccgccacttcggaaggcgaggcggctgctggcctgacgtcgggaggcccacccgctcccaggtggtgaaccccgctccattccgtgcgacctgccgggtgggcggcccgtccccgctctggagcggggggcctgttgcccgggccggtggggggcccacgcct

SEQ ID NO: 659617 - DNA, 463 bp, Homo sapiens
  misc_feature (41)..(41): n is a, c, g, or t
  misc_feature (81)..(81): n is a, c, g, or t
  misc_feature (86)..(86): n is a, c, g, or t
tttttatttagccaggcttgttctgaataggaattaaaganagtaaagaatgtgtaacagaaactcagttctatgtagaanacccnacttcccccgaaagagctctttctctttaaatattaactgcctgtttttctgtggctagtgagccttatctctccctttcccaggcattgtaaagaccctgtttctttagctgtgcgctgcaaggtcactagacagataaactcaagccattaagacacgtttttccttgaaaagtaagaaatgatgtaatgcatgcctcaattaattaaataactgtctttgtttcttgcttctgtaacatgcttctccctgcacagatctcccccaaccccataaaatgcttaaaaggtaacttgactctttgttcggggctcagtcctttggatgttaatccgactgggccggtgcacctaaataataaatcctcctcaacctc

SEQ ID NO: 659618 - DNA, 368 bp, Homo sapiens
  misc_feature (82)..(82): n is a, c, g, or t
cagcaaaaaaggagaggaggtctggacccacctccagagcggcccaagaagctagtactcatcagccacctgaatccaagtnccaccctaaccccatccacctccctgaatccccacgggtttcactctgaggctccgcctccaggctcggtgacaatcgctatccccaggcaagcacctgatgaccgctgccacctgcgccagccagggcggctggaagagaagggtggggctggctggggtggggacctggccagtgcaaaccagcagggccggctggaggctgcggtgactcgcccgggcagattctgccgccggaggaatcacgggctgggggcgcgcctttgggcggcaggtgcgggcggccg

SEQ ID NO: 659619 - DNA, 1089 bp, Homo sapiens
tcaattccattgcgcatcatgtttttcattttcgtcaaatccaaatcatcatctcaattttggcaaccatgcagcatcattcatcaaactccaatgaggtttattcattttcaagcccaacagtcacaatcacatcacaacatttcagtccaacaaacatttccacgagtcaatttcacatttcatatatggaggccatttcagattccaatcacacacatcccatcacagctcatgcaacggcatgcgcttcagcaagtcccaattattccaagtgtattcatatataccttaatgatatcctatggtttcatcgcttgtgcctaaattaccgagctatctgaccaacgaacggtaacaactgtacttaactacgaacctggatatgtaacgacaccatcttactttcctactactgacttacttaaaagaaccaaaaacgaaacgttatgagaaacttttgtccacggacactgtctcacatcatatcagtcttgacacttcggttccccagtttcacaaacacggtaacaaaccccatttctattacatttggggcacagacaaacacatcagagaaaacaacttttactagtgggacatcataccacagggttcctcaaatatcaattttaagaaccaccaatattcacatttggtatgtccacacatattcaaaactaagacattcttacacaaaccttcaattataggtaagcagcgaccacatttcgggtaacaattggtatatttatagacacttggtttacgcagggttgttcacaccaagcatttcatagaccaaagcaggagacagaccttccaacctgtgccatttagacatacacagtacaacacctggccactgttggcacttccggaacagtggctaacttaaattcgatccactatctggtgaggcacttatattaaacgctatgtggcacctccatttaaaagaggtcttacatttcctaaaatccatatacattaggactgggtgaaagcaatagcaatacggtgccgggattctaaccatgacccacaatgtatatgcaaaatctcgccattgaaagtcccccggtaagg

SEQ ID NO: 659620 - DNA, 1337 bp, Homo sapiens
tacctgggactacaggtgtgcgccaccaggcccagctgatttctggtgtcttcggtgctacagatggggctttcaccaatagtctggcgcagtatggtctccgatctcttgcatctccgtgatccaaacacacctcgggctcccagaagctgctcgggtattgcagcgcgtgtagccatcacgccttggactccttattgtaacacttatttatcacttgaagatcctcaagtttatgccgcaggtcattttttctagaggcaccactggccttgactagccacacggcacagaaattctacaacacgcagtacacacgacacgaggcaaacacacagcactatttcatctacacgttcacaattaggttctcccttttcacaccaccaaaggcattactttttcaattccagggctggggcacgcacacctcattctcgaggcaccggttttctgagttcaccagtcctccgtgggtatatggcacctgccatggctgggaacttgtatacaccttaaccccttgctggcgctcccaccaaccacaccaagccgtttctgacacggcccacactccttgggacctcaggacccacaatgtttcacccaattgcttacatcttgcacacacgtcgcacaccacttctcttgccaccttacccgccttgctacactcactaacaacccacgacaccttttgcttgcccaccacggcaacacctctggagcaaacgcacaacaatttatcacttcctccgccattaaaacatctgcatctgccacattttcaatcttcaaatggccctggtattctttcaccacgacccccccccttctcaagtcacacaacacgccaaacttaatttcccccacgcaactttcttcttccggcaccacctttcttacactttcccacgtttccaaccatccccactttcccctttctcttcggaggcgcaacacttcatttccaccttcccccacagcaaaacgccacaaccacacatcatcaacgaaaccccttctatcacgtaaacccccccacgggacaaaagctaaatttcccaaacgtaatttttcccctttgccaaaattgccccttcgggaaaaacagacgtgccccaagcccttgggtctgggcctttacaccgttggggggcagtgctcaagttccctcaataccaaaatcgcgttacaccagctgctcttcaaaatcttcgtgcccaatccacagccgcccaaccctttcggcactgcgtgaatcagctgcaccccaccaaagctcctacaagtggaccgcattgatcccctactaccctgctcttctcacacagcca

SEQ ID NO: 659621 - DNA, 789 bp, Homo sapiens
gtggcccaaggagggagtggaatggtcgcggtgtggctcgatgcagaagaggcgacgctgagatggcgtgcagcttcagtcggacggcgatctcaggagctggtcgctgtcgggtaagcaagattggagctactcgtctgtccacctccagctcgcgtaagggtggctgtgcgacgtgcggcagttttgtggatggaacagcggtgaagcaagtgatcctccccctgttgtgcggggcatggacagctgctctctagagattgctaactgtgaggaaccaccaggagactctcaaataccagtttgatgccttctatgggggagaggagtactcagcatggacatctatgcaggttcagtgcaggcccatcctaatggcacttgctggaagggcagaatgccagtgtgtcttgcctatgggacccacagggagctgggaaagactgcacacaatgctgtggctagcccagagcacacctggggtgatcccggggggctctcatggaccttcctgtcagctccacaagggatggagggtgccgaggtccgtccatgggcccttttctgtcaccattgttttacctagagatctaccaggagaaaggtattaggacctcctggagccttgctttcgggacgaccctggtaatccgagaagactgccggggggaatagttctgataccggggtctctcccagaaaggcccatccggtagctttgctgcattttgagcgggagattcctgccagcaagtacgaaatcggacttgtaggaagccacccgggtca

SEQ ID NO: 659622 - DNA, 618 bp, Homo sapiens
  misc_feature (5)..(5): n is a, c, g, or t
  misc_feature (41)..(41): n is a, c, g, or t
  misc_feature (65)..(65): n is a, c, g, or t
  misc_feature (77)..(77): n is a, c, g, or t
  misc_feature (79)..(79): n is a, c, g, or t
  misc_feature (124)..(124): n is a, c, g, or t
  misc_feature (142)..(143): n is a, c, g, or t
  misc_feature (158)..(158): n is a, c, g, or t
  misc_feature (164)..(164): n is a, c, g, or t
  misc_feature (169)..(169): n is a, c, g, or t
  misc_feature (172)..(172): n is a, c, g, or t
  misc_feature (187)..(187): n is a, c, g, or t
  misc_feature (196)..(196): n is a, c, g, or t
  misc_feature (218)..(218): n is a, c, g, or t
  misc_feature (223)..(223): n is a, c, g, or t
  misc_feature (250)..(250): n is a, c, g, or t
  misc_feature (267)..(267): n is a, c, g, or t
  misc_feature (355)..(355): n is a, c, g, or t
  misc_feature (358)..(358): n is a, c, g, or t
  misc_feature (366)..(366): n is a, c, g, or t
  misc_feature (372)..(372): n is a, c, g, or t
  misc_feature (378)..(378): n is a, c, g, or t
  misc_feature (393)..(393): n is a, c, g, or t
  misc_feature (402)..(402): n is a, c, g, or t
  misc_feature (409)..(409): n is a, c, g, or t
  misc_feature (418)..(418): n is a, c, g, or t
  misc_feature (433)..(433): n is a, c, g, or t
  misc_feature (442)..(442): n is a, c, g, or t
  misc_feature (451)..(451): n is a, c, g, or t
  misc_feature (453)..(453): n is a, c, g, or t
  misc_feature (484)..(484): n is a, c, g, or t
  misc_feature (494)..(494): n is a, c, g, or t
  misc_feature (504)..(504): n is a, c, g, or t
  misc_feature (549)..(549): n is a, c, g, or t
  misc_feature (614)..(614): n is a, c, g, or t
taaanaagtaagcctttatttccttgttttgcaaaaaaaantggctaagttggttgctttttggngattagtcaaananaccaaatcccaaatcctcgtccgactcccccgactcttccttggnttcaaccttagctggggnngcagcagccgcgggngcagcngtggnggnagccgccacaggggnagcagccanaaaggcagaaggatcagccaanaaggncttgaccttttcagcaagtgggaaggngtaatccgtctccacanaaaaggccaggactcgtttgttcccgttgatgaaagaatggggtactgatgcaacagttgggtagccaatctgcagaaagaaactggnaanattgcggncacccnccaggnagcgagaattcagantttcctctnttaaaanaagcacttnagggttgtagatgcngccattttngaacacctncnggatgaccagcccaaaggagaagggggagangttgagcatnttcaacagcntggcttcgctggctcccactttgtctccagttttgatcagctgcncaacacttaggatttcaatggtgcccctggagaatttagtggtgaaacctaaagcctggaaaaangagg

SEQ ID NO: 659623 - DNA, 397 bp, Homo sapiens
aagttctgtttgtcctgcatcctcagcagcacttggtattgtcagtctttttgattttggccattctgttgcggatgtgttgatatcttctgtgaggttttaaaaatgctttttagggggctgggtgcggtggctcatgcctgtaatcccagcacttggggaggctgaggtgggtagatcacgacgtcaagagatcaagaccatcctggccaacatggtgaaaccccgtctctactaaaaatacaaaaattagccgggtgtggtggcacacacctgtaatcccagctactcaggaggccgaggcaggaaaatcgcttgaacctggcaggcagaggttgcagtgagccaagattgtgccactgcactccagcctgggcgacagagtgagactccatct

SEQ ID NO: 659624 - DNA, 150 bp, Homo sapiens
ggaagtagagccagtagaggcattagaggcagagacagccaaggcaggaacctgctgacttccctgttgagcaacctgaagaccattaaatataaggtattagatttcacaggagctttacatttcggttctcatgtcaaacagggtaag

SEQ ID NO: 659625 - DNA, 863 bp, Homo sapiens
gaaaaaatcgtagcctgtctccactttcatagtacaatcatagcgactcactaatatgattacaaatcggcgatctacatccatacccatcatcctagcattcctgcacatctgtacccacgccttcttcaaagccaatcactgatttatagtgcatccggcgatcccagtccactcccactacagcccttaaccacagtgcacacaatcatattcgaaccatatatgcatcgcactactctacaaccatacctctcacttcaatcctccctcaccattggacagcctagaccttagcaggaatacctttcctcccagcttactactccaaagacctatcattcatcgaaaccgaataacagtatcatacgacaaacgcctgagccctatctattatctctcactcgctacctccctgatcatagcgcctataatcactcgaataacttcttctcaccctaacaggtcaacctcttcttccccgatccttactatcatttcacgaagaataaccccaacgccttactcaaacgcccaattaaacgactctggtctagccggtaagccatattacgctaggatttctcatctatctaacaacatttcccccgatatcccccttccatacccaacaagtccccctactatccttaagactcaacaggccctcgactgctcagcttacctagtgagcttctgaacagtcctctagacctcaatgtacctaagcaaacaaactttacatatatcaatccccagtatgcagcatttggatttctccaacaatactccggattctaccctagcatctcaacaccggacaatcccctattctaggcctttcttacgagcaaaaactgtcc

SEQ ID NO: 659626 - DNA, 159 bp, Homo sapiens
gggaaagcttactagtgtaatagtgtaatcttacattaaagctatagaggccaggcgcagtggctcacgcctgtaatcccagcaattctctgcctcagcctcccaagcagatgggattacagatgcccaccaccacacctggctaattttttctatttt

SEQ ID NO: 659627 - DNA, 1488 bp, Homo sapiens
  misc_feature (531)..(531): n is a, c, g, or t
  misc_feature (541)..(541): n is a, c, g, or t
  misc_feature (646)..(646): n is a, c, g, or t
  misc_feature (649)..(649): n is a, c, g, or t
  misc_feature (722)..(722): n is a, c, g, or t
atagtggatcttaaaatatttaatagtctttctttaaaatccaaaaggtgattctttacaagtttagtgtgtgccacagtgaaagcgagggtgtttatttattggagaaaagtgcgagggtgataacgttgaaaacacatagcacgtggaggatatttttatattttataaaatgtgagaggaaaacaagagtcgtggcactcttaatttattttatcacatttctcacacaaaacagcgtggcctcagcgtggcgtgggcctctttgtgggcctatagagtttagagggtctcgtgacatcacctgtgacacaagagagagtcttgtgggaaaagagagcgagacaaataatgagtatacacacgcagagtgttatatacaacagctctagtgccaccattctaatacacctgtggggaattagagtggactataccacagagcaagagagagcgccgtgagagtgtggagaggtatgagcgctatatacaacacccacaatttgtggcgacatttctctctccccctcnaaaagagggnatatagctctttgtgacaaacacacgagggtgtgtgtctaccccatatgtgtgcgtttacccacccaaaattttaaagagtgggcgaatatattctacaactcgnggntacaccaaaaaacggatgctcccacacatttcttttattccaacacgttatctgtgcgtttttttctcccaanaaacctattataccattatgaggcgggttcaaggtggcagaaacatttcaagagaggaaacacctttatattttttttatggccacccgcgtgctgtgcacaaacccccaattcctcaattattaatttctccgttctacaagggggcggttgtattatgtgccccacaatttccacgaaaaaatttttccggcggccacgaacaaggcaaccaaccccatactgtggcgcgcacaaaagtggcgccttattacgcggggactcccttaattaaacaatcccactctctgggggcgcttctcccccaacttttacaaaaacttctttgtgggcgcctttgtaaggcaaacaagggggggtgaattctccttttaatattcctccaagaggaaactccacaatttaaaagcgcccggttgttttataagaggcctcacccacacgcgcgggtgtgcggggaacgcgctcaacaccagttgggctgggcgagcgactaccattttctaacccttcttctcacaattttctcaacaaaacccccagaagaaaccccaagcgtcaccattagaggggccacggcccattggtccagagaacatctatcccacttgtgggggaacaccacccggcagagatactttttctagcgagacaattgtggcgccgcggccgtcgttcacaacaaccttcaccacccgtgggcttccaacaccagttgggtgtatctacgcgacaaaccaagccacgggtctggcagacccacgga

SEQ ID NO: 659628 - DNA, 278 bp, Homo sapiens
gcgggggaatgagcctatcgggttcattcttgctaccatgtcgatggtaccataaagaagagctccttttcctgtatctctccccacagagccctccagaggattaaaggggacacagagaagctggtctgagactgctgaccgcactctacgtgcctcgtgtatgtggttggggtgctgtgcacccacattctgtctttgcaggaatctggatgtgggcagcgtgcaagtctgacgcagcccttggagaggctgcacctcatgacaggcggcctagg

SEQ ID NO: 659629 - DNA, 732 bp, Homo sapiens
  misc_feature (408)..(408): n is a, c, g, or t
tggcacttctgaggctaaatatgtctgggctgaaaatttggatgtgggtcccccccttaagctatgcgtccggttaataataggtactggtactggggctcggggtaaggtgtcgtgggggataggaccttaatattttaaatactgtggtcccataacattttcatttatactagcgagaaaactcttggtgatttcatttatattcgttgtggtaattctagaacactagaattgtggtagttatagccattaacgtgagtgtttttataaaaggggatattattttctctgtgggcacgagtgtgtgtctcaaacaaagaagacaagtttctcagtctccctcaagtgcgtggctccttgtggggtttatacagggtaacaagttttctcatagcctcagaacanacacttattgtaaaacagcgtggtagaacttattctctcagaggggtatataactctcgacagaacccctcggggggggctaaggggcgtggtaatccaataagttctacggggcagaagtgggggacgtgagaagtgggctacagtgtggtgccacagtacgggggttcacgggagccgtgaacagaaacgtggggcactcttccgtgggtacataaacagtggctcactttggggttctccaaaagtttaaacacagggcttatagttcacaacaaaattaagcgggtcaatttctggtcaaaaaacaaaaaaaaattccgg

SEQ ID NO: 659630 - DNA, 2044 bp, Homo sapiens
gactccgtctgtcggcctgacttcagttctgcaattgaatgacagcttgagattcatagctaggtctccatacgagcttgactcaacttgtgcgtagactatcatctgcacttcagtgatcgtgagcctatgcgtagccttcgtcgcgcaagtgtcgcagcccatatgagcactcgtagcggcagcgattaatcagtgaaggtccacatcgcgtgtcagagtaattgttagccaagtactactacggtctggggtgaggcgagagattcagtgtcgctactcgggatgtgaggtgagttgcaatgccgtaggcgtttgtcgaggtccgcccccctaggagttggttacccgtagggagagtttacagtgtctgtgccggtgtcctcgtatctcgctacattttcagtaagctcatgctttactgtgatgatcgcgcagatcgctcattcgagatacgcgcacggatatgctcgcagttgatggaaaaggctcgctgcggaaatgacacggataggcgaggccatttcgctggaaggattcctggaaggcgccgaaagaaggtcagagcggcggataaccatttggcatgagtattcggctgccgcgacgggacaccgttggtacacaccacactaagacgtacggagggcgcaatacttggcagtggggaccccggttttgcaataagagcgtgccgggcgataacccatatgctgtccaaatagagcgcttcctcattagtttggcggtatggccgcccccacctactgggtgactgcaaactaaggaactattgcgacgctctggccacgttgcattccggaacgatcgttggcccccacctgcgccaaactacagccagagttcccatgagttcaacccgacgaaaattttgcccaccgtgatttgcgcattgaatcaccttaactcacgtcatccgcttaagaaacgcggcgtgaactaaaaccccctagtcttataacggcaaaggccactctaggagggagtcggacactctgttctaactctgggtggggcggagctccgcagttaccactagggggggaggcgtccttgctccgaaggctgccgttatggtcgccgtggctttgaaccgggacggccaacctgaggtgaggcgaaccctgtgcgagattccgccaacagtgccataaggtcacatactggagatttcaggcgttcgggcaacgagatttccttgaaggcacatataggctttctccctaaacacgtgacatccccaattgggaccgcagatagtggcgccccaatttctttgtgagaagagactaccgctcggaaagtacgaggacccccaattaaagtcctaacagcccgtaacgcgaaaaagtgggccgccctcccacgtgatggcgacgggcgaacccccggagaccagcggctgcaccggggccactacccctggggggcaaccgcggaggggggacacacagcgaaccacgggcagcggagaccgagcaactacgatcccatcgagcggacagacgtccttagtactagcgcagacccaggcaacaacgcagcgctgacctacgcggagacgtgcaccaaagacacgctgccacaccactgaacgtggtgtggccaccaacactaggcagtcccacactccagccataaaacacctgtctgtacagagcgaacttcgtacctggccagcacaccagcataagagtagcagaaaccccgaactagaaagaaccagtgcgcccagcaaccagaacacagtagcccagcgcacgagagctagaccccaacctgggcggggacaagaaacgcgtcactaaccacctagctaccggggcaccttgtgcgcagcacacggtgctcacgctgagagtgagaacctagtaggaaagaaagtcaagctgataaccaccgcggcgacgaacaacagccacccaacgaacgactacaaagcggatcaaacaagacaccagcccacccacaagcgagacgcaacacacacacagcacacacagaccggtcgcacgaccaaccg

SEQ ID NO: 659631 - DNA, 432 bp, Homo sapiens
tgggaggatcacttgagtccgggagtttgaaaccagcctgggcacacagtgagacccatctccacaaaaaattttaaaaagtgggtgaatgtggtggtgttgtgcctacagtcctagctgcttgggaggctgaggcaggagaattgcttgaacccaggaagcggaagttgcagtgagccaagatcgtgcccattgcactccaacctgggcaacaagagcaatactccatgtcaaaaaaaaaacagggacctggtcgggccgtaaaaggaaaaggctcgggtttgggaatctgaagacctgaactcagtggcctcccccaagctctgagaatctccctaggttctttttaccccacttttaaaggggacacagtaatgcctacctcataagattcccgtgagaaataaactgcttaattaccattgtaagtgc

SEQ ID NO: 659632 - DNA, 282 bp, Homo sapiens
  misc_feature (119)..(119): n is a, c, g, or t
  misc_feature (206)..(206): n is a, c, g, or t
  misc_feature (248)..(248): n is a, c, g, or t
gggcagccaggcccatctgacggtgaaggatgagaaaaaccaccatgaactcgatcacagagagagagaatccagtgcgaataactctgtgtcaccctccgaaagcctccgggccagtnagaagcaccggggctctgcggactacagcatggaagccaagaagcggaaggcggaggagaaggacagcttgagccgatacgacagtnatggggacaagagtgatgatctggtggtggatgtttccaatnaggaccccgcaacgtcccgggtcagcccggcaca

SEQ ID NO: 659633 - DNA, 177 bp, Homo sapiens
tgggggggggggcccctttttccccccccgggggcccccgtttccccccccctgggggggggggtttttttttttcccggggggcccccctttcccaaaaaaaaagggcccccccccgttttttttagggggccggggggggctttttttttaaaaggggcccttttttctttttta

SEQ ID NO: 659634 - DNA, 463 bp, Homo sapiens
  misc_feature (229)..(229): n is a, c, g, or t
  misc_feature (257)..(257): n is a, c, g, or t
  misc_feature (428)..(428): n is a, c, g, or t
gcgttgtatggtggatggcaccaccttccctgtggccactacgtctctgggcagcgacgcagcctttaccagtgcgctggtggctgctgcaatggacttggcagcttctggtatctcgctcctcgaagttcaagggactcatctgcctccgttgggtttggccccggggcttcagctcgctctacgctttttcgcgctcgcagcctcaataggatggctgcagctccancagagagctcattctcagacaatgacantgtggtggtcctctggagtctacacacattctgttccctttcatgcgcttcagacagcctggactgagctcagtagacggaaccacgccacacgcatttgaatagctcctgtcaacatgctcgcttcaagttactgggctatggcttctcgcagggtcagcacgtacatgngtccacgcagttccaggtaagccattgcactccgg

SEQ ID NO: 659635 - DNA, 198 bp, Homo sapiens
agatgtactggataacggaaaaaaactataatagaaaactagctgttaaggatgagaatttgatgtactcttagttcaaaatgagtgccaagagcgctccaggtcacttatgttgtagattagatttttaaatgtgaaaactatctatactggagagatttataaccaactaacttttatttagtatacaaaatttaa

SEQ ID NO: 659636 - DNA, 822 bp, Homo sapiens
tattatcctgtgtgtccttacattgcttctgtgagatgtatgttcttatctgacgatgacctttcaggaccttatttgaagtccagactgtgtgctggggcaaacgagcgtattatgccaaatcgtgacttctatgcgaggtgaagagatgctactaaacgttctcacatttaggtgagacggctttctatgctattccaatacgagagttcttgtcttaatagggctatcgatattgacaccaaatggagtggcttctcagcctcttaatgtcttaagtacgtgctgaatatggaatagagaagacctgtatatttctagacacagataaaatattctttgtacgcactctgtaaattgctccgcattatacacagtgaacacgagctccaggtaagtaactgcataggcatgtcgaggttgcagtctgtatattggactacagtacgtatcagtgacatcaggtggatatagaagaagacccttgagatgagaactgccttagtcatgattcgttagtagacctatctatgattcatctgcaatttgcagatacggatggtgagcgtggacattgcttgacagatagtttaatttccttgtatccaaggtcgtatattcctgtgtggcagtgactatttcaacatcattttcatcaagacgcctttcttctaaattagccttggttacaactttggcaccgtatttgcctgcccaccttccggataagcggggtcgacaaaaagggggccccggttttaccccaatcacagcgggctcggaaaaaatgggcttagactgaaaagagttttcctcgcacat

SEQ ID NO: 659637 - DNA, 191 bp, Homo sapiens
aactggagtgtgcatcttgcttgtcacagggacccatactgtgggtggtgcgtgtccttggcaggtgcagtcgcgttctgagtgctcgaggggccaggcgccagagcagtggctatggagcttccagcatgagctggcgtgtctgcaagtgggcagcatgagtcctgccaacatcagagaagaggctgcgg

SEQ ID NO: 659638 - DNA, 282 bp, Homo sapiens
atgttgggctggaaagatcatggcagcatcagtccaggtgtgaggtcatcacgttcacacacatggctgtctccagcaatgactaggtgaaaagaggtttaaagtggagccaaacaggtggacattacagacatcccgcacacgcatgtgtgtgtgtaatgatatgtatgtgtttatttaaaggtgtattgttggtgtttacgtattctcgagaacattaaactcaagaaaaatgggctcctgatgcaatatgtatattgtggtcaaatataaaaaaaaaaa

SEQ ID NO: 659639 - DNA, 155 bp, Homo sapiens
gttgtatagccaaatcctaccaaacatatagtgtaactaataccaatcctcctgaaattgtgccaaaaaatggaggagtgagagaactctccctgactcattatacaatgccagatatatcaccctgtaaaaccaaaaccagacaaagggaaaca

SEQ ID NO: 659640 - DNA, 561 bp, Homo sapiens
aatatcgaggttctgcagaacctggtgtaactgcgggagctgtaccttatccacaatggcatcgagttcatcgaggtcctggagaacaatatcaaactcacgatgttggacattgcatcaaatagaatcaaaaagtttgaaaatatcagccatctaacagagctgcaagagttctggatgaacgacaatctccttgagagctgtagtgacctcgacgagtctgaagggagccaggagcttggagacagtttacctgttagcgtaacccctgctagaaggatccccagtactggctgaaggtcatgctcgccctcctcttccgttcgtcagatcgatgccagtttcgtcaggttctgagtctttcttggctcttcatgtggtccctctcctcggaagaactgcccagccacgggtttttaacccacctgttgctcctgaggtcttcactatatcatcagtcacaaacccaatggctataaaggcactgacgatatcttgctgcggatgccatacacctattttcagatgccgttgcaattaaatcttgccacactgtcaaaa

SEQ ID NO: 659641 - DNA, 388 bp, Homo sapiens
ctagtgtgattatgacgctgaggaagctgcagctgagaagctggggcctacagcgccgaggccacaccctcaccccacgcgagctcacaggtgcatgaagacgagcatctgaggtggcggctggagcgaggcctgcccttgccagccagactctgggtcgcccttgcctgcagaggaggagaagcggctgagtgccgagtctggcctgagtgaagactctcgcccatctgccagcacagtctctgaggctgagcccgagggcccgtcggctgaggcacagggtgggagccagcaggaaaccaagactgctggcgggaagggaggcgccgaagaggactaccaggagcccacggtgcctttcgcagacgtacgcactgctgccccgagg

SEQ ID NO: 659642 - DNA, 460 bp, Homo sapiens
  misc_feature (235)..(235): n is a, c, g, or t
atcactcccggaactgtcctgatcatcctcactgggcgccacaggggccaagagagtggttttcctgaagcagctggacagtggcttgctgcttgtgactgggcctcttgtcatcaacagagttcctctgcgcagaacacaccagaagtttgtcattgccacctctacaaaagttgatatcagcgatgttaaaatccccaaacacctgactgacgcttacttcaagaagaagcantgcgcaagcccaggcatcaggagggcgagatcttcgacacagagaaggagaaatacgagattacagagcagcgaaaggctgaccagaaagctgtggatttgcagattttgccaaagattaaagctgttcctcagctccagggctacctgcgctctcagttttccctgacaaacgggatgtatcctcacaaactggtcttctaaattgttaacctaattaaacagc

SEQ ID NO: 659643 - DNA, 249 bp, Homo sapiens
ttatataccacttaatgggcgaaacctgctagtgtaatggtttaaataactcgtgcctgccttcacccagtgcccgggtgtctcagacgatcatctccagctgccgggcatactcgatgacctgtttgggccagttctgtggagcggaatggtggtgtcttcctggcttcgtgctgctggctggcaacaacgtgtagtacgttgtcgcgggcccagtgacccaacccttcgctttctggcgcgtagctc

SEQ ID NO: 659644 - DNA, 486 bp, Homo sapiens
  misc_feature (46)..(46): n is a, c, g, or t
  misc_feature (66)..(66): n is a, c, g, or t
  misc_feature (92)..(92): n is a, c, g, or t
  misc_feature (269)..(269): n is a, c, g, or t
  misc_feature (320)..(320): n is a, c, g, or t
  misc_feature (447)..(447): n is a, c, g, or t
  misc_feature (469)..(469): n is a, c, g, or t
tggaccagcagctcctggaatgcgctcaaagcccctgggtttatcncttgggatagtttaagcccntgcacctggaactgttcattttttcngtaactgtttctgtacccatttatctttttaactttttgcctgttctgcttctgtaaaattgcttcagctaggctcccccctccccttgtagactgaggtataaaaggaaatctggccgggcgcggtggctcacatctgtaatcccagcactttgggaggccgaggtgggcgaatcncgaggtcgggagatcgagatcatcctggctaacatggtgaaaccccgtctntactaaaaatacaaaaaattagctgggcgtggtggcggcgtctgtagtcccagctacttgggaggctgaggcaggagaatggcgtgaccccgggacgcggaggttgcagtgagctgagatcgcgccnctgcactccagcctgggtgacncagcaagactctgtctc

SEQ ID NO: 659645 - DNA, 394 bp, Homo sapiens
agtcatgggacagccaggcccatggatcacgcacgaccccagccggccatatgctgagcagtaccgcatagatgcccggaagtatagcacaccttgcttcagctagtctcgccctggacctgcggggccaacacggagatcctcgccgaaaggacgtacaggctcttggatgacaacatggaccagctcatcgagttcaaagcgtttgtgagctgcctcgatatcatgtataatggagaaatgaatgagaagattaaactattatacaggcttcatatccctccagcactcactgataatgaccgagacagccagtcgccgttgaggaatcctctgttgtcaacatcgagacccctggtcttctgggaaacccaatggtgatgcagttgattat

SEQ ID NO: 659646 - DNA, 268 bp, Homo sapiens
tgtatccagcagtgacgaactgacacgacgcggattgacgaacgaacttgccttcgatttcacagttcttcgtgatgcgctcacgataggaaacctgaggcttaccgatgttggcttcgacgcttgagtcacggtcgcatcctggtcaaccaggatgtccaagctgcagctctgcccactgccggcagatgcatcgtttgaccagtctcattcatacagtcttgaccgcggaaagactggctctatcctgagacacagcttgcccaag

SEQ ID NO: 659647 - DNA, 913 bp, Homo sapiens
ggggcagagtgcctaccaataccctcctcctcctcgccctcctcctccttcacgtaaatgaaaccccttccagatctgatatgggactattaatttttatgctgtaatggtatacattcacgaatgcagttgaaagggggaaggctccaactggatgctggtggactaaggcctgaaatgcttgctcatctgtaagaatctattactcgaggttatgttgttccttttaaaattcttgaggagagagggatggtttctgaggggtgctgaaagtattattcaatgtgcagacatacaggtaggtcttcagcataagctgaaatatatgcgtgtagaaaactttgacatctttttgggtagtcttgccactttcttcttaactttactatctcattttggtgccccccccatcttacagaagttggaggtctatgggcacgaatggtaggcacagaacgtaacctatggaccaactgtctgtgctttcagaagccagatgtgtgccccccaatcgcgaaaatttgtctaagcgcggggccagtctgttgtgggcatggttttctacaccaaattctgggtttgctgctactttcttgtgacgtagagggtacacctgcaggatgcatatcctcgcagtctgaaagctcggtcggaggcaagtcctggaccacgtggttttgggttggtggtccttgtgcactggcactggtcctacattaccagattccagtctacattatatgcctggcaggaacaccagttaactctgccgagtcgggctacacggcggggggtcgccatagcagcaagcttcgttgtcgggaggaccgagggcggaaagggccacccaaggggtgaaaacggggggcagcctgggcaactaaataggcaacagcgttttacaagagccacg

SEQ ID NO: 659648 - DNA, 158 bp, Homo sapiens
ctggaaggactagagatggaatttatgctggcaaaccagttactcttcaacagggcttaatcaaggttatattaaaggtgcagaagtcattttaaactatggacgactccgaggaacattgagtgataagatctactggcgtcacctttataataata

SEQ ID NO: 659649 - DNA, 160 bp, Homo sapiens
taaggaacttacagtaaatcatgtaatgtggaccatagctccggatgacatctacactctgctcaagtagtgatggtccctggcttgcaaacatgtagctctaccagtgttccaaggaaggctgttgttcaacctggtatataccttatgtacgcaagtt

SEQ ID NO: 659650 - DNA, 1149 bp, Homo sapiens
tgaaaactccgcaaattccacgtctccaccgggcaaatagtaaaatttgacaacgggcaattggtgaaactgcctagggcttttcttcagagtggatccttgtgtagtgctacacaagtggaacaatgctgaaccagtcagatatgaaccagtctcgcctttcgggaaaggcgctaaaaactgctatcatcattggactaactggcttctacttcagaaatcattcgaatacggagaaattcaatgtattattataacctatcttaggtgtaatgggcacttagattgtgatcaagtcacgcactttggttctccttttcacaagttccaagaccttatacaagctttcacgctgaaagttgtatgctatagatggaatagagccaaaaatttggatcttgttagctaatttcatttgacatagctggatagatctagtgcaagtctgtagtccatgctgcattcctgtggtagcaaaagcattacacttcacaactgaggagatagctcaagtccgtagcagcatgatagacgcctgacttgtaccaaccaatagataatggtaatgatgtgtcgacagttcagataacatggatcataggcacttagatttgctaccacatttgttcccttcacttgaattgaaatctgtaagataatcataacaccttctaaggcagcctaagcataatacttttaatgaagccatgaaacggcaagattgccagagataaagtctgtatacttcagcctactttggagtaatctcgtgttttcgcacataatgtaaactcggagatgtcatttcgaaaaattttcttcacacgttaaaacatgctgtcgacaacagtggagttccgttctgcatggatgtctttgctagggctctatgaggagatgatagtggtgtgattgtgcctactaattcttgctgagaattcttattcagcgaattcaatagtgatttcagcaatatgtactaagtattccaaggcagttaatataatgtataaaggatttgagcctgtatgtgtaagaacgaaactctctcttcagtcatatttcctagaattcagagtaagtacctcgctgatttagcactggagttattcattgaatgtgtaaatattaatgctggggtctgacctt

SEQ ID NO: 659651 - DNA, 727 bp, Homo sapiens
  misc_feature (16)..(16): n is a, c, g, or t
  misc_feature (26)..(26): n is a, c, g, or t
  misc_feature (46)..(46): n is a, c, g, or t
aacgaagacctcaagnttgggtcaanaaacacgcagggcgtttatnaaacgacgcatatatacgtcctaggacagctggtgcgatcgacgaggggcatggctctgagtcacttgccctgtaggctctagcctggctgctccaaggccactagcagagcaagtgccctccgtcactacacccagtctcatgcctcgagggctggggaggaggggctcaagaaggggggttcatgtacatatttatcacccttcacatagcccaagactttgtacatgtttacagggtgccctcccaaagtccctcctggttattaaacctcagactggtgctgtgttcctagcctctggcctctctgtggggaaaggggactgcaggggaagagccgggaagggacagtcaggcttctccctgggaaggtggggccagcaggagatgaccaacagggggcaggacctggggacctgggctggagggaagggcagaagcttcctacttggctgacagcccggttcccccaacatgttcccgttcactctgccccacccccaaaggctcagctctaaatctcagagtccaccactcttaatggtcagtccccttcaccccatttccaagtgcccccaggactcctgggcccttgttcctgaaccctgttctccaaaaccctggccaggggctaaggggtgggcagaagaagggtcaccaatgttccacacacaaaagaag

SEQ ID NO: 659652 - DNA, 219 bp, Homo sapiens
ctttttttttttgggccccccaaaatagggaaaaaaaattgggccattttcctgttttaaccggaactattggcccccctggccccaaaaggaagggccgatttttttagttgattttttttttggaaattaatcccccccagttcttttttatttgggtgaaggtttttttttgtttaataatgttttaaaaataaaaaccgggggtttttggcttta

SEQ ID NO: 659653 - DNA, 375 bp, Homo sapiens
gtgcacaaagcagtctagtgttctcatgacacctgcaacccagatcttagtaagtcaccaaacttggactggccaagaggccccagcttccccttccttgcggcctgtgccaggagccacagtcccacagtccacgctaaggagacctaaagcctgtgcgtccctttggttatggctgcccctaaaagcaagaaccaaattcaatgccacgtgacatgggctgtctcacttcagcaggctgaacagtggatggcaatagtttgcttcaaactctatcatcaatgtgtttgttcatcgttataccatttcttaagtgagttccaatttacatgccaaacaaacccctgaggacgcagcaggagtgaaaaccacagg

SEQ ID NO: 659654 - DNA, 1143 bp, Homo sapiens
gcgcttgcgatacgggataatcctatttattacctcagaagtttttgtcttcgcaggatttttctggagccttttaccactccagcctagcccttagcccccaattaggagggcactgggcccgcagaaggcatcacccggataaatcccctagaagtcccactcctaaacacatccggtattactcgcatcaggagtatcaatcacctgagctcaccatagtctaatagaaaacaagcggaaacaaataattcaagcactggttattacaattttacggggtctctattttaccctcctacaagcctcagagtacttcggagtctcccttcaccatttccggagggcatcttaacgggctcaacatttattggtagccacaggcttcccaagggacttcacgtccattatgggctcacttttcctcactatctggttcaatccgcaagtaatatttcactttacatccaaacatcacttgggcttcgaagccgacgctggatactgggcattttggtacgatgtggttggactaatttctggtatgtctccaatctattggatgagggtccaaagaaattataaactaaaacaaaatttttgggcggtattggcacataagaattttatagcacaattgagtggggcacctggagcgacacagaagagtatagaacaatgtggacaacaggtggaccaaaagaggatcgggcatagaaagtgtcgtggatccaccataaacaaaacgccgggggaacccgcgtgtttggaaaatcccagaggggtcacggagcacaagggtcacaacaagggaagcacagggaggacaaaataaagcaggacggaccgcggggaggtgagtaccccactgaagcagacacagcaaacaagtacaaacagcacaagaacatggagatagcatacacagcagagacagcatacaagtaagcaacggctaaaaagagcgcagacaccagacgagcaacgcgcacgacggaacagaaggcgaagctaagcaggaaagcggcaagctagcacgagaccaaagccgcctgacagccgacacacagcactacgcgaactaactctacgaccgagcaaaggacaaaagacggacgcaagaaccacaacaaggagactaag

SEQ ID NO: 659655 - DNA, 482 bp, Homo sapiens
  misc_feature (276)..(276): n is a, c, g, or t
  misc_feature (295)..(295): n is a, c, g, or t
  misc_feature (415)..(415): n is a, c, g, or t
  misc_feature (423)..(423): n is a, c, g, or t
catccccaagcacctgacatccccgagcactcagcctgacatccccccagcaggcaacacaggcaggaggatgtcccatcccttcctgctccacccacccagctccatgttgtacaactcatctgaatgcggctgctggaccctgaaatgttcgcagaatcagcgccgtggacaatgaccaggggagggaagtggctaaatcagagtctcgctgtgtcgcccaggctggagggcggtggcatcatcttggctcactgccctcccgggttcaagtgnttcgcctgcctcagcctcncgagtagctgggattacaggtgcgcactactgcgcccagctagtttttgtattttgccatgttggccaggctggtcttgaactcctgacctcaggtgatccaccctccttggcctcccanagtgctgngattacagacgtaagccaccgtgctcaactaggttttggtgtttttatagagacagcat

SEQ ID NO: 659656 - DNA, 673 bp, Homo sapiens
atctcgccacctcttttttttagcgcgcgctttctcttttgtgttgtggggggcccctcttccccgcgcttctctctaagagccagcggaaaatagtgtgtgcccccccaacaagaaatgatagccgctaataagatgccccgggagatgcgcgatcacatcttcttagggctccccaacctcctctttttgtaaataagtgtgggaagagtacactccctcgggggggaacaacagcagaagctctctgtcaagaaagaggattcacgacaccaggggccacagagcgcgaaagagtggtgcactattcttcgcgctataacacaactcggcccccgcctcttgtgagggatatttttaataaggaggtacttatagcttatagtgtggcgtcaaaacataggggggtgccccataccacaaacacagaggcgcccataaatatatttgaacatggggccaccacaccaatcgcggaatatatactcacacaggagaggtgccaccacacggcgttatccatttgatacccccggggactctgaacacataccatttagaacctaccccaacaaaaggggtgaaaataaacaccttttcccccccaaattttcccccccaaccctttaaccccccaaattttccctttaaaaaaaattgtggttgtttttta

SEQ ID NO: 659657 - DNA, 219 bp, Homo sapiens
tagaggtcccagttcaggcaggaacgaggagcattcggtggagcggaggagcattggcggagacgaggagcatctgttggagaggaggagcatctcgtggagaggaggagcgtctcgggagcggaggagcatcgggcagaagacgaggagtagcgtctggcggagacgaggagtagtgtctggcagagacgaggagtagtgtctggcagagacgaggag

SEQ ID NO: 659658 - DNA, 285 bp, Homo sapiens
  misc_feature (84)..(84): n is a, c, g, or t
  misc_feature (86)..(86): n is a, c, g, or t
  misc_feature (102)..(102): n is a, c, g, or t
tgtactgtatcacaagcaacagatgctacactccattcccaaggacttcccgtctctgatcttagaagcattgtcaaatctgcntnccgagcctgccatggnagctgcttgcacttgggagtgaaaagcccttgtggagctttttcttattcggtgactgctcataaagtgccttcacctcgcttgccttattagccagtcctgcctccaaattaccaccacttgctcctttcaggagtctcttccccctaaagtccctattactccttctctctgctttcagat

SEQ ID NO: 659659 - DNA, 182 bp, Homo sapiens
  misc_feature (36)..(36): n is a, c, g, or t
  misc_feature (72)..(72): n is a, c, g, or t
gaatagtggtacccaggttgttgttttcttcctgcncatgccacagcgctcatcgacgcaatgcaccggttnggcatacaggcgccggaagtgattgcggatcaggttctgggcaatcccgcacatccaggtgctgagggtggcctggccgccgaagcggtcccggttacgccaggcctcca

SEQ ID NO: 659660 - DNA, 991 bp, Homo sapiens
agctaagattctaatttaacactattctctgttcttgcatgggcggaagcagatttgggtaccaaccaacgatattggactcacccattcaatcaaaccggcgtatgtatttcgtgacgattacgtgccaggcacaccagtgatagtattgtcatcgtgtaccatagaatactgtgaccacctgtagtacggtaagaaacctcaaccacagcattcaaaagcccccgtcccgcatgcttacgatacgcggagtacatgctaatcgataggccttgcatagtatctacacatcataactggctaatctccaaaggtgagccctcatcgcattaggatagccaataaaggctatccacgcacttaacagttacatagtacatgaggagtcattgtgccgtgacatggcaacatctaacaggtcaacatgtccctttcatcgatgacccaatggagtgaattccctacctcagtaatagggcggtctgcttttgtacgacaagaaaacacatatataatccaaaaggtgaaaaggacaatgaagctttgtgtgagtgggccaccaagttactcgttcgcagatagaacttctctcacgggggactcaccacttgaattggcaagcgcgtgcgtgcagagagcccaccacacacttgagacgcaagggtgggacaagacagagaggtgtccaccttaagggacagcatgtcgcccagagagaagaattaccaacgggtggtgggccagatcaccctaagagcgcggttcgtgccaatgtacaacttccggccatgtggtggaaaacaaaacgagctccccggacgactccgccatggtactatcccagcgtagacggttagagcatacacttgcgagaacaggcgatagactggacctggcctggacctcgcttacgcggcgaactatcaaaccataagggagagtcgcctcactgaagctggtctggggagtgttcaaacgatatgtacgaccc

SEQ ID NO: 659661 - DNA, 504 bp, Homo sapiens
tgggcggatcacctggggtcaggctggtctcgaactcctgaccttgtgagccgcctatctgggcctcccaaagcgctaggattacaagcatgagccactgcgcccaccttgtattttcatgaacatacttgccacgtgtgtgtatagcgttgcatcaggagacagcttcgctggagtgtgattataacttggaaactcagctccattgctgtttcttatagctcttcctcctcccagaaagacacgtgctgagctcatgaaggcaatcgattttgagtactatggttacctagatgaagatgatggtgttattgtgcctttggaacaggaatatgaaaagaaactcagagccgagttagtggaaaagtggaaagcagagagagaggctcggctggcaagaggagaaaaggaagaggaggaggaagaggaggaagagatcaacatctatgcagtcaccgaggaggagtcggacgaggaaggcagccaggagaaaggaggggacga

SEQ ID NO: 659662 - DNA, 696 bp, Homo sapiens
  misc_feature (316)..(316): n is a, c, g, or t
  misc_feature (318)..(318): n is a, c, g, or t
  misc_feature (383)..(383): n is a, c, g, or t
  misc_feature (447)..(447): n is a, c, g, or t
  misc_feature (511)..(511): n is a, c, g, or t
gtaactgattccaaactgtcagtaagaacataatttatatttttctccaattcaattaaaagaaaattgacaataaaaagctgatcaatacgtgtagctcaggaggtagagcctgctttgagatgcagaagtgtttttttttttttagatctatattcttgagtaaagaaaaaatccatctttctttcctagaggggaagagtttcagagctgggcttggcaacagcctgactatcagaggctgaattaaacaaatagatacctccctggagtgaatggtgcgtttctcctgtttggggaaccgtgcttttatggngnagtttgcgttctgtcttggtctccggatgtgtgtatctgtgggtggatgtctgcatgtaaatggnagtgtatacctgtgtgggtgtgtacaaaattcccatgtgaatctcagctttgtggggatctccngttcttgagcccagtagatgccatttgaagaaaaaaatcacttgaaaatgagacagaaagaatngaaactaaatcctagctctaaaggcaccaggctgattaaaaaaaaaaaaaaaactcaggttcttctttgttgtggactgtacctacctctaaatgacatttctgtttcctatgagatgattagaatgaaaaagatcctgagcccgaaagagcagatactgtgtgatagtgtgtatatcagggtgt

SEQ ID NO: 659663 - DNA, 397 bp, Homo sapiens
tgggcggatcacctggggtcaggctggtctcgaactcctgaccttgtgagccgcctatctgggcctcccaaagcgctaggattacaagcatgagccactgcgcccaccttgtattttcatgaacatacttgccacgtgtgtgtatagcgttgcatcaggagacagcttcgctggagtgtgattataacttggaaactcagctccattgctgtttcttatagctcttcctcctcccagaaagacacgtgctgagctcatgaaggcaatcgattttgagtactatggttacctagatgaagatgatggtgttattgtgcctttggaacaggaatatgaaaagaaacgtaggtctctgggcatttaatttcataataaatttagggttgatggggtaccg

SEQ ID NO: 659664 - DNA, 175 bp, Homo sapiens
  misc_feature (4)..(4): n is a, c, g, or t
gcanagtactggaaggcagaatgataactgtgtaaagatagccattgtggtcttaatttgcatttctctaatggctaaagatgtaggatatcttttccaagtgcttatttgctgtcagtatgatagagttagtttcttcagtccccatcttgacccttgctgtagcaaagtactg

SEQ ID NO: 659665 - DNA, 362 bp, Homo sapiens
aggctgaggtgcgaggatcgcttgagttaggagtagtgggaggattcttgagccaggagttacgagacagcctggcatcaaaaaaattatgtaaattgaaatgttaaagggtcttgtatattggtggagatggaggagatcgggggaggagatgagaaaggggcaagcataagtagggaacacattgcactatatgccccaagctgcgcagagggcaggaagcagtgaagaactaatacccaattaggaacaaccaggaggacaagatgaagtagatagcagacatctgacgggaaatgtgcacgccacatttctcagccaggcaggatcaagggtaggccaattactgagtgccctgggta

SEQ ID NO: 659666 - DNA, 846 bp, Homo sapiens
  misc_feature (117)..(117): n is a, c, g, or t
cgtggtggcgcatgcctgtagtcccagctactcgggaggctgaggcaggagaatcccttgaaccaggagtcagaggttggcagtgacgccgagatcacgccacagcactctagcctnggctgacagagcaaaaatctctggtctaaacaaaaaacaaaaggcaaggaaattggcaaaatatcacgttgggtggtgtgtggtgtgggccacacacgcttggtgattcccaagttactccaggaggctagaagccaagggagaaatcggttttgaccctggggaggggcggagtttgggcagtggagctgaagatgggttgccaatgcactcccagtgtgtgggccggccagaaggggaagaactccaattcctcaaaagggtacatcattacaatataactcttaaacaacttaacttgtggcccacgtggggtgtttttatttctcagaaatgtgccaactcccgggggaggaccccgaccagaaatattttaacccaccttcttaaagggaaactaattattgggcaggaaacccttctttgccaacctggcggcattataccattggcttctaaagttgcccattttccagtggtcctctacacttgtggcacaaaacctttatttttggggcgaaccccagacatattaaaagttttaaaaaccccacaaatttttgggtgcgaacacacttacttaccaacacttttttctttccaacttttgggaacgtgggggtgacacattcgcgcctagaaaaggaaccaaaagaggtcctaaatatttaaaccaattggttacattgggaccttcaataaaggttacacaatcacaacaacaaaaac

SEQ ID NO: 659667 - DNA, 160 bp, Homo sapiens
  misc_feature (53)..(53): n is a, c, g, or t
  misc_feature (114)..(114): n is a, c, g, or t
cggcacgaggggacatggttaagatgccactctgcaaggaggagaagataatnttacctttagacatttcaaaattaaaagaattttttttttctttgagacagagttcgctcntgtcgcccaggctggagtgcagtggcgtgatctcagctcactgcaa

SEQ ID NO: 659668 - DNA, 301 bp, Homo sapiens
tgcaagtgggagtctcatagttcagggtatagctctacggactccagagaccatgctgttatgtaactggctttgctaggctggggattgaactaagtaaatgaagccgaaggagtagagatctagatcgcagagaagtaagtctcattctaacacattgcaactactgctagagtccaccccatgaagctagtttcacattgtgtatcattcagaactgaattctatgacgtttatgttgttcagactaagacatatgtagctagctaggttggctgtgctagtctcagtaggacgttga

SEQ ID NO: 659669 - DNA, 142 bp, Homo sapiens
  misc_feature (32)..(32): n is a, c, g, or t
  misc_feature (49)..(49): n is a, c, g, or t
  misc_feature (64)..(64): n is a, c, g, or t
  misc_feature (79)..(79): n is a, c, g, or t
tgcatcatgggccaacatatacagccccacangatacgggtggggtgtncgcggcttcacatcnggctggtcaaagacnacaggttgcgtgacggggatcgaaaatgaggccttctcgttgatgcagcgccgctcaatttcg

SEQ ID NO: 659670 - DNA, 362 bp, Homo sapiens
gtacgccatgtatcccaaaatattttcttgtttttcttaaagaccatgtctgtactgtcaccaggctgagttcagttgctcagggatagctcactgtggcctcaaactcctgggctcaaaccatcctcctgcttcagtttcctgagtagctgggactgtgagcacatgccaccatgtttggttatttatttatttatttatttatatcttgaagaaatgagttgtttcctgtggcttgaagataggcatttgaggctggatacgtggctcaccatctgtaatcccagcactttgggaggccaaggcaggccagatcacttgaggctaggagctccagaccagcctgggacacatggcgaaaa

SEQ ID NO: 659671 - DNA, 338 bp, Homo sapiens
  misc_feature (157)..(157): n is a, c, g, or t
tggaatagaacttatatatttttatgggaataaaggagaagcatgaaatttcatttaataattaccttaactctcactctcaaacaggtaaaccttttcctcttctaatatttaagctttctacttcacatttgggtagttttgggactcaggtganactagttatgtactaaccctgttttctccaggtgcccaagcacacactaaatatgagaatgaagaagtagtgaggaccatggaccagcacaggggaccagaaactggcagcccaggggctacatctttgggtaacatattaaccgggggggtaccggaggcttcgaaattcgtaaatcatg

SEQ ID NO: 659672 - DNA, 401 bp, Homo sapiens
ataagcagcattacacaaacgcagctctatgttaaccatctaagcgctggctctttgacacagtatctacagcacagacacgtggggcacagaaagcacagaaagcccgcaatgtgtgcgcacagtgtgtgcactcaccaagcacgggccacttgtgtgcctatctccacaagacctccctccttgtgacagctgtgcacatcggggccccttgaccctgcggcacatggtccctccctgccctgtctggcacgcggtggacagatatgtccagccctctcttgtcttccggtcctgtcctccaggtactttcacactgttccgatatgggaaaagagaaggtgcagtctgctcacaaggcacaacagcaggtggcacatatcacagggtcccctcctccc

SEQ ID NO: 659673 - DNA, 409 bp, Homo sapiens
  misc_feature (58)..(58): n is a, c, g, or t
  misc_feature (63)..(63): n is a, c, g, or t
  misc_feature (232)..(232): n is a, c, g, or t
  misc_feature (344)..(344): n is a, c, g, or t
gtgatggtattagacggcctttgagaggtgataaggtcatgaggatgaccttcatgantaganttagtactcttataaaagagatctcagagagactcctcatcccttccaacagatgaagttacagtgagaagacagcatctacgatgaactgggccctcatcagaccccaaatttttcacgcccaaatcttggacttcacagcctccggaactatgagaaataatatttnttttgtttctaaaccactcagtctatcatattctattacagcaacctgaacaatataagacagaaaattgggacaggaagtagtgtgatgctgcaacaaatatctaaaaatntggaagtggtttgaggaacagggtggatgggtagactagaagaggtttgaggtgcatgctagaaa

SEQ ID NO: 659674 - DNA, 572 bp, Homo sapiens
  misc_feature (249)..(249): n is a, c, g, or t
ttgtggggagcccgggggggggggcccgagagcaacaaaattgtcttttggttcttcccgggcggggttcggggcaaaaacagtttgcacgagtggggcccttcaaggggcaaacaaaaagtggtcccccctggttggccctggggaaaaaagggggaaatggaggtgttcaccacgccaagtgtgggtgcccgcccccccgtgttccaaaaaaaggaaaaagacagcgtggggcaaccgggttttttngcccgtttaatccgtgggatttgaagggccccccgccggggcccccaatttaaggtttgtgagccccccccgtccatggtgttaagggggccggggtcccaaagggcaagcaccgttgttcattgggaaaacgcctggggctggcccttttccagttcttcccagggggtcccggaagcccgggcccccgcccagcccaagttttcccagggccctcggaaggtggccgggcctccctccccctgaacccatcccaaggttcttgaccaactgggcccctgagttttggagcaacccctgccccaaaaaaggttttgacccca

SEQ ID NO: 659675 - DNA, 703 bp, Homo sapiens
  misc_feature (8)..(8): n is a, c, g, or t
  misc_feature (15)..(15): n is a, c, g, or t
  misc_feature (17)..(18): n is a, c, g, or t
  misc_feature (20)..(20): n is a, c, g, or t
  misc_feature (47)..(47): n is a, c, g, or t
tccccgantggtccngnngntgtcgggtttgcaccaaatgaaagccnttcaacgactagcccgttagcgtagtgaaaatccatctacatcgactcgatcgaaaccacttccacaaatcggaattttttccgtaccaccctagtcgcttcttgctcagctaggaaggtgctcaacgtatcggcctcatgaatcatctcgtgcgtcttgccttcaaattcattacccacccgaagcgtgactttcagcctaggcgtaaatgctttcgcaatcttctttttctctgccaccttcgccgactgcgtgatcacgatatccgcgcgaggcttttgcacgggaggcgtaatgtcctgcgcaaccggctcgtcagcaccgaataacgcccggcgcatatcttcttcagttagttctaggttcatgccgattctcggagggatgttagcgtgcgagaacgattctatcagcatgatggatttcttcagtagcgagtctccttttgatcagctgtagcacctggcgaccgtgcctgaaggatttaggttcgctgtgtattgatgccgccactggagaccgaaccaaagctgactgaggcgacagcggcaatcggccgattctgttgaaaaagtcggccatggtttccacggcagaaaagtacgcgtttgagattgaaatctttacttgagcagggcaggacccattcggtccg

SEQ ID NO: 659676 - DNA, 271 bp, Homo sapiens
  misc_feature (174)..(174): n is a, c, g, or t
catgtggctgaagaggatatcagtaaagaattgcgtgatctatagcgcgatccacgctgctcactgttcagctggacctgtgcgagatgacttgtccaactggcaagccactattatgagggcctccgtgtatagcgcatatcaagggtggagtgcttcattattctcagctgntctcgattttgccgcagcagattatccgtttaaaccaccaaagacttgcgtttcacaacagaaacttgatcatccaaagataaacagtgatggaagt

SEQ ID NO: 659677 - DNA, 1291 bp, Homo sapiens
taaaggagggagaaaaaaatgcacacaaatgcagggaatagtaggtctaaactcatgggggggtaatttaccctatagaactctcctataacttttccaggcatagttgtgaggaaactataaggaatgtgccttcccaatatatttccaaccctctcaaagcctcacacgtgcccccgagaaaaaacaaaacacctcacccccaatctccaatgtggaatctcattctgtgcattagaaaaacacagagagccacagcgagggcctatgagggaaggaggcggaagtgttgtgtggtgccctctccttctatagccccacatatacatagttctcaggtgggatagtgtgtctcgtggccgaggccaggtggtgtggaaggccctctcagagaggcctctcacttgagggaaatatataaactcagcgtggaggtgtctcctccttctcccacaatctgctgcggtatatacattctttacacacacaattgtgcggtgtgtgtgtgggcacacaaggtgtctctcacaacttttatacccatctcgagggcacccattctcttatgaggctctccagaaaaagaaggcacgaaacatataaaggggcgtcaccttctatatacatagtgcgctctatacagggggtttggggcgtccccctgtgtggggccgatatttctcccccccccctttttctgtggcgcccaatctccatcgtctatctctttagagggggagtcatcgccattatttatcaacccctttcatcaggggaaagtggctctcctctcccctctttacacacacaccaaaccttccatatctaccacacgaggaaacacgacgccacttcacaatacgacggcaacttcacaggtgggcgcacttctctactcacttgaggccccaatttataaatttcccccacacatcaagacaaacaagcggcccactattaacgagagaaagcaccaacaacacgcggccacaaagaacaacacccctcggtggcccccaaacgcgatcggacaacgcccaacaacacacaacacggggggggccctacccaccaacgacacacccaatatttaacggcacatcgtgcgcgccataaacacaacggcgttggctggcaccacgcacggcggggaacaccctcgtgtggggctccagagaaagacgacacaaccccggtggcgtacaggaagggccacttataaacacgtccccccacataaaacacccccaagggtggcgaaccacgggggggggcgaccacacaccatctg

SEQ ID NO: 659678 - DNA, 1084 bp, Homo sapiens
  misc_feature (543)..(543): n is a, c, g, or t
  misc_feature (580)..(580): n is a, c, g, or t
  misc_feature (590)..(590): n is a, c, g, or t
  misc_feature (595)..(595): n is a, c, g, or t
  misc_feature (602)..(603): n is a, c, g, or t
  misc_feature (638)..(638): n is a, c, g, or t
agcgggccggcaagctctggagcttctatcatttaccttctgcggaggcagatccgctacggtaattcagtaccaaactgttcgatatgatatcctaccccttatctcctgtgtcccggaatcggttagcccaggtgaagaggaagatcctggtgctggatctggatgagacacttattcatctcccaccatgatggggtcctgaggacccacagtccggcctggatacgtcctcctgatcttcatcctcaaggtggttaataaacaaagcatcctgtccggttgtttgtacataagaggccccatgtggatttctgtcctggaatgtggtgagccagtggtacttgacgctggatggctgtttacaagcaatgcagtggagatctatggctctgctgtggcactataagacctggacaagtatgcatgaaccgcattctttatgatggtagatacttacaagacagcactgcagtttggaagttgggcagctacgagtcaagggagctctctgtggtccacagtagacacatcgtccagcanttgtgatcctggataactccccaggggcttacagganccatccaganaatgncatcccnnatcaaatcctggttcagtgaccccagcgacacagnccttctcaacctgctcccaatgctggatgccctcaggttcaccgctgatgttcgttccgtgctgagccgaaaccttcaccaacatcggctctggtgacagctgctccccctccacctgagttggggtgggggggaaaaagtatccgagacctagttgaggcagattctgaccagattcatctgaggactgcctgggcagggtctgccactcccacccataactgccctgggagccctacactccacttgggagtctggatatatatatgtgctagtattcaggcgtggaaatgttgtcacccctcgtgttcacactccatggaaaccccatactgggacacaggcggaactgagggagagccgaatcagtgtttgtgaagaggccagactggccagagtgacagacatacggtgatccaggaagctcaaagagaagccaagtcagc

SEQ ID NO: 659679 - DNA, 944 bp, Homo sapiens
  misc_feature (297)..(297): n is a, c, g, or t
  misc_feature (403)..(403): n is a, c, g, or t
  misc_feature (440)..(440): n is a, c, g, or t
  misc_feature (450)..(450): n is a, c, g, or t
  misc_feature (455)..(455): n is a, c, g, or t
  misc_feature (462)..(463): n is a, c, g, or t
  misc_feature (498)..(498): n is a, c, g, or t
ggagatcagcgagctggctggatcgccgatcgcgagtgagggagccgagcctgcccgccgccgcacgcctccgcctcccctccgcgtaacaggagcctcggtgccggggtccctgtgcgatcgcctgcccacagcccgttcgcctcgtgcgtcaggtccgcgatgggtaagcgcagcgcgagcgagcgagggggaggggagagcgagcgatgcgccagtggtagtgaggcgtgctggagccgagactgggacgcgccgcgactgtgtggacgtgaaggcgtgaacgcactgcgttgntacctgagcggagacatgcacatgcagcgtttgcgagctttgggcagcgtagcatcaacggagccatcagtctgatggatccaacatgtgaccactcgtccagcanttgtgatcctggataactccccaggggcttacagganccatccaganaatgncatcccnnatcaaatcctggttcagtgaccccagcgacacagnccttctcaacctgctcccaatgctggatgccctcaggttcaccgctgatgttcgttccgtgctgagccgaaaccttcaccaacatcggctctggtgacagctgctccccctccacctgagttggggtgggggggaaaaagtatccgagacctagttgaggcagattctgaccagattcatctgaggactgcctgggcagggtctgccactcccacccataactgccctgggagccctacactccacttgggagtctggatatatatatgtgctagtattcaggcgtggaaatgttgtcacccctcgtgttcacactccatggaaaccccatactgggacacaggcggaactgagggagagccgaatcagtgtttgtgaagaggccagactggccagagtgacagacatacggtgatccaggaagctcaaagagaagccaagtcagc

SEQ ID NO: 659680 - DNA, 865 bp, Homo sapiens
catctctgtcgcggcccacaaatcgcggttttcccttctgcccggcaaaagcttacatgtgcctgttctagcgcactgcttttctggttacaatgtctcataggtatctcccgattctgatactctgtgggccacgggagcccctctccgattgtcactaggacctattcccgggggcttctttctgagggactcccataatagtggcgtgctcccgactcaaagataatataactgcggtggtggacgacgatggctcgctattcagggtactacctccctggcagcgtctggcacaatgcagaggcatgcccacgcacggtcaccgcacgagcaggcagtaccccatgacaatcccggggaaccaacccgtcgcgcggagggtaaaccacggcggggtccacacaaggcacaggtcctacggaagcacagtcgcaccccgagggcacccccggggataaaaaacctccacggacacccagccctggtttctccgtggcataagtaacacagtgggatacgaaatacgtcaatttccgggtgtactccgggtgcatggcaaaaaacatgcatattcccagtggcggggagaccatcaaccccggtgtaaacgacccccgtaggggcgccaacaccgcataccctacccataaataggcggacagccggcacacgaagcgtggggggccccccccgataagcccccacacggggagcgagtggtccacagatgaatgtcgggaggacgtttccttgcgcctatgcgggcactcaccaataacgggacccgcccccccgcctcaatgactcccagaggagcccctgccaacccatgtcagcgttttttgcccccccacataacgaa

SEQ ID NO: 659681 - DNA, 2511 bp, Homo sapiens
ccgcttagcacagcagaatttggaaacacttaaaaaagcaaaagggtgtacaatcatatttacagaccgttctggcatgagtgcagtgggccatgtgatgctaggaacaatggatgtccatcaccactggacaaaactttttgaaagattgccaagttattttgaccttcagaggaggctgatgattttagaagaccaaataagctatcttttaggtggcatacaagttgtttatattgaagaattacagccagtattgacacttgaagaatattactctcttcttgatgtgttttataatagactgttgaaaagtagaatactatttcaccctcgaagtttgcgtggtttacaaatgatccttaacagtgacagatatgctccaagcttgcatgaactcgggcattttaatattccaacactctgtgatccagcaaatctccagtggtttattctcaccaaagctcagcaggcaagagagaacatgaaaagaaaggaagagttaaaggttattgaaaatgaattgatacaggcatcaacaaagaaattttctttggagaagttatataaagagcccagcatttctagtatacaaatggtggattgttgtaagagacttctagaacaatcactgccttacctacatgggatgcacctctgcatttcacatttttactctgttatgcaagatggagacctttgtattccttggaattggaagaatggagaagccattaagtaacacagaaatctgttttatttttttaagagataagaaaggaacttaaattaaaaatatttaaatccacaatttgatataacagtattatttacataagaacaaagtttctaactgctgtttaaaagtagacttttttaaaaaaattaatttctgctaggagaggttttatatgccaggcgtggtggtcatgcctgcggtccagtacttagggaggctaagataggaggatcacttgagccaggaggccaaggttgcagtgggcccagattgcaccattgccctccagcctgagcaacagaacaagaccttgtctcaaaaaataataatgataatttaaaataaataagtaactaataaaaagattttatatcccagtcttatgatgttggttggcaaggctagataaaaagatgttagaatgaaagaacatatttttagtgatatgtaaatgaaggattctacaatagtcatatatttttatatgaatgaatgttgggttgggctggagaggtatgtgtgtgtaaatataaaggtctcacattcagagtatagctctgaaataatggaactcatgtctacaattcaacatgcatctgtatagttacatctcatgtaaatatacacagacatattttgcagccagtaattgacagttaatgtccaaaacaggtgattgataggtaacagaaattagataaccaccaattttgcccaagagaaagactagaaggactaaaagcagttgaatgtatggtactgacattgtcataagcagtctgataaccagtttattgaaacgtgtgcattaacagagaatttaattttaaacccataatttctcctatccattaaaatattataattgttagtagtatgaaaccaacaggaaatgttttttaatcatttagtgaggtgattcatttgtttcatgggcaaacactatccaggaaaagccttgcttgcctgtttcccaaagagctctaagaaatagaatcaagtgtaaaatggttcagaccattcaggatttcttgtcactcttctcaaccccgatcttcctgttattactgatgtttgaaaccctgtcattagccccggcctggttaaagcccctcagagtcacctctcattcatagcaatagaattcaaccccaagtggttgatggtgtccccagcacagccgagagacctgatctctggattcagtgcttttagctcttcgagtttaccctaagataccttcgggcaatatttttaaccaacccaaaagctcttcaggtcatttctgaagaggacaaggtgaatcttggcttggaacaccatttttgggctcttgctactgaatgaatcagaaaggaattttttctgaagagcattagaaagtaaaggagatgttaaaataagttcttgaagtatgttttatatttatctaaaacactgattttaaaagtttacattcaaatgtgtattcaaaagaagtactgatttgtaattattatagtttgtgtgtatcatcccttttaaccgtgcctaacaactgtacttaaattttgttttctagtgtaacaaatgtttcccataagattttctagagccaaataatgggagtgaaaaattccttaagtgttatataagaaaatatattagaaaatcagctttggattatacgatttctaaaatatactaatacagaatcctcagtaatatgttttgaattggattttttctcagaactgttacataataaataatacatcaaccagaaaaaaaaa

SEQ ID NO: 659682 - DNA, 2344 bp, Homo sapiens
ccgcttagcacagcagaatttggaaacacttaaaaaagcaaaagggtgtacaatcatatttacagaccgttctggcatgagtgcagtgggccatgtgatgctaggaacaatggatgtccatcaccactggacaaaaactgttgaaaagtagaatactatttcaccctcgaagtttgcgtggtttacaaatgatccttaacagtgacagatatgctccaagcttgcatgaactcgggcattttaatattccaacactctgtgatccagcaaatctccagtggtttattctcaccaaagctcagcaggcaagagagaacatgaaaagaaaggaagagttaaaggttattgaaaatgaattgatacaggcatcaacaaagaaattttctttggagaagttatataaagagcccagcatttctagtatacaaatggtggattgttgtaagagacttctagaacaatcactgccttacctacatgggatgcacctctgcatttcacatttttactctgttatgcaagatggagacctttgtattccttggaattggaagaatggagaagccattaagtaacacagaaatctgttttatttttttaagagataagaaaggaacttaaattaaaaatatttaaatccacaatttgatataacagtattatttacataagaacaaagtttctaactgctgtttaaaagtagacttttttaaaaaaattaatttctgctaggagaggttttatatgccaggcgtggtggtcatgcctgcggtccagtacttagggaggctaagataggaggatcacttgagccaggaggccaaggttgcagtgggcccagattgcaccattgccctccagcctgagcaacagaacaagaccttgtctcaaaaaataataatgataatttaaaataaataagtaactaataaaaagattttatatcccagtcttatgatgttggttggcaaggctagataaaaagatgttagaatgaaagaacatatttttagtgatatgtaaatgaaggattctacaatagtcatatatttttatatgaatgaatgttgggttgggctggagaggtatgtgtgtgtaaatataaaggtctcacattcagagtatagctctgaaataatggaactcatgtctacaattcaacatgcatctgtatagttacatctcatgtaaatatacacagacatattttgcagccagtaattgacagttaatgtccaaaacaggtgattgataggtaacagaaattagataaccaccaattttgcccaagagaaagactagaaggactaaaagcagttgaatgtatggtactgacattgtcataagcagtctgataaccagtttattgaaacgtgtgcattaacagagaatttaattttaaacccataatttctcctatccattaaaatattataattgttagtagtatgaaaccaacaggaaatgttttttaatcatttagtgaggtgattcatttgtttcatgggcaaacactatccaggaaaagccttgcttgcctgtttcccaaagagctctaagaaatagaatcaagtgtaaaatggttcagaccattcaggatttcttgtcactcttctcaaccccgatcttcctgttattactgatgtttgaaaccctgtcattagccccggcctggttaaagcccctcagagtcacctctcattcatagcaatagaattcaaccccaagtggttgatggtgtccccagcacagccgagagacctgatctctggattcagtgcttttagctcttcgagtttaccctaagataccttcgggcaatatttttaaccaacccaaaagctcttcaggtcatttctgaagaggacaaggtgaatcttggcttggaacaccatttttgggctcttgctactgaatgaatcagaaaggaattttttctgaagagcattagaaagtaaaggagatgttaaaataagttcttgaagtatgttttatatttatctaaaacactgattttaaaagtttacattcaaatgtgtattcaaaagaagtactgatttgtaattattatagtttgtgtgtatcatcccttttaaccgtgcctaacaactgtacttaaattttgttttctagtgtaacaaatgtttcccataagattttctagagccaaataatgggagtgaaaaattccttaagtgttatataagaaaatatattagaaaatcagctttggattatacgatttctaaaatatactaatacagaatcctcagtaatatgttttgaattggattttttctcagaactgttacataataaataatacatcaaccagaaaaaaaaa

SEQ ID NO: 659683 - DNA, 154 bp, Homo sapiens
cgatctaatgcgtgactgacaagacctgaaattcgaggaggcacgagatgaaggcacacagttccggatctgtaacgaagctgcaactgttcctgattcacaggaattggcgcagactttacatctgatgcggcacgagactatcaaactgtac

SEQ ID NO: 659684 - DNA, 702 bp, Homo sapiens
aaaaaaaaataaaaaaaaaaaataaaaaaaaaaaaaaggaaaaaaaaaaaaaaaaaaaaaaaaaaaaaaaaaaaaaaaaaaaaaaaaaaaaaaaaaaaaaaaaaaaaaaaaaaaaggaaaaaaaaaaaaaaaaaaaaaaaaaaaaaaaaaaaaaaaaaaaagggggcccccctgggcccaagcgacttaaaacccgggaaagttaaacaaagggccccaaaatggggcaaaaggggcaaaaccccccaaagggggggggaaaaaaaaaaaaagggccggggttaaaaaaaggggggccgggaaaaacccgggggtccccaaaaaaaaagccctgggaaaaaaaccccctttgcccaaggggggaaaaaccaaaagggccccaaccaggggcccttccaaaaaagggccccacccaaagggcaaagggaaatgggaggcggaaaaattggggaaaaaagcgggaaaaaactggggaaaaaaaggcaaatttaaaaccaaagggcccaaatcggaaaaaacccctaaaaaccaaaagaaaccaccccgaaaagggctcgaatgttggccccaagtgggaacaaggggcccccttttaaaaaaaccgggccccaacacgcaaaaggggaaaaaaaccccttagggggacaggccccccaatcggggaacccatcccctcgagttctgggggcaccagggccccac

SEQ ID NO: 659685 - DNA, 135 bp, Homo sapiens
ccaaagtgctgggattacaggcgtgagccaccgcacccagctgaattttccattctttcattagttatatatgattatttttttcagaaattactttttctcgtgtgattattatattgtgactatgttccgtta

SEQ ID NO: 659686 - DNA, 743 bp, Homo sapiens
  misc_feature (5)..(5): n is a, c, g, or t
  misc_feature (123)..(123): n is a, c, g, or t
  misc_feature (134)..(134): n is a, c, g, or t
  misc_feature (171)..(171): n is a, c, g, or t
  misc_feature (201)..(201): n is a, c, g, or t
  misc_feature (204)..(204): n is a, c, g, or t
  misc_feature (230)..(230): n is a, c, g, or t
  misc_feature (234)..(234): n is a, c, g, or t
  misc_feature (258)..(258): n is a, c, g, or t
  misc_feature (275)..(275): n is a, c, g, or t
  misc_feature (289)..(289): n is a, c, g, or t
  misc_feature (300)..(300): n is a, c, g, or t
  misc_feature (325)..(325): n is a, c, g, or t
  misc_feature (390)..(390): n is a, c, g, or t
  misc_feature (449)..(449): n is a, c, g, or t
  misc_feature (470)..(470): n is a, c, g, or t
  misc_feature (474)..(474): n is a, c, g, or t
  misc_feature (482)..(482): n is a, c, g, or t
  misc_feature (498)..(498): n is a, c, g, or t
  misc_feature (500)..(500): n is a, c, g, or t
  misc_feature (512)..(512): n is a, c, g, or t
  misc_feature (518)..(519): n is a, c, g, or t
  misc_feature (524)..(524): n is a, c, g, or t
  misc_feature (529)..(529): n is a, c, g, or t
  misc_feature (560)..(561): n is a, c, g, or t
  misc_feature (571)..(571): n is a, c, g, or t
  misc_feature (651)..(651): n is a, c, g, or t
  misc_feature (659)..(659): n is a, c, g, or t
  misc_feature (706)..(706): n is a, c, g, or t
cagcntcaaccggccaaggaacgggattatgaagactatgcggacttctatatagtcttcatctcaatgtgtgtataaagtatttagtttcaataaagcatttgtaccaatggctctggagcntggaggaagantaaaggaatgtgtagtgattctgagtaagaagtaganctacgcagcagagcaatgggggagaagaanaanaaagtccttacttctaaaaacagganagtnatgagtagcagttccaaccaaaangtcaatagggctaaaangccccctgtgtttntgaacaatganaatcttgccccccccgggtggagcnaaggagcctgcaactgggagtttgcagtaaataagcaccatgacacagtcatttctgaaccctcnatccagccgtggttaaaagatgaagcaaaggaggcaagaaaatgcataaattagcaganaagagaatggacagtgttatncttntctgttcnagccattgggtgatgnancacttttcagcnccatgnngctanttgtntcccttcatatcccgtttccatttatgcccnncagttatggnctagaatcaaacaattctaaacctcagtgtcttatgaagctgacacttcaaaacctgcagaagcagggggcctttgaggnatttagtnacaccaagtacaactagagctgttatagacagtgtaggtttgcaganatccacctccttgcttactggcaattagggagtgaat

SEQ ID NO: 659687 - DNA, 313 bp, Homo sapiens
  misc_feature (50)..(50): n is a, c, g, or t
gagatccgtcgactcaggtattgtgactgagttggatatacacttctgtngtattcttaatgacaagatactagctacgaacttcctatgaactagggaacctatgtgttcctcagtgtggttcctgaagccagtgatatgggcgtagataggaagactttctcggtaatgataaggagaatctctttgttccctcccacctgtgttgtaaagataaactgacgatatacaggcacattatgtaaacatacacacgcaatgaaaccgaagcttggcgagcttgggcgttggtcttgcaaaagtgcttcccaaa

SEQ ID NO: 659688 - DNA, 174 bp, Homo sapiens
gtgagctggtccagtaacccccgacgtccacacttctcaaaagaagacatgctgccattcctgactctttacaatagcaattctgattggtgtgaagtggtatctcattgtgggttttcgatctgcacctccccggatgatcagtgatgctgacgtttttattcatagtgattg

SEQ ID NO: 659689 - DNA, 166 bp, Homo sapiens
cacgtctgtgggcattttttttttttccttttaaaattgaaaggcttttaagaaaaaggcaggttttccttgaataggtaagaaaagctccccatttgtcccgtccctttttgagggagcagcccctatggaaactcgttattggtgcccacagaaatcctctcgg

SEQ ID NO: 659690 - DNA, 213 bp, Homo sapiens
atccccggttctgggtaaggggaaggggcactccccaggcggcacccaccactgacttccacgtcaggagtcagaagtgccaggaggagacgctctgaaactttcttcccagagtgggtgctcatggagttaagccacaacttccataaaagatgagcactcagcaaaatgacaaggcagctggacgtggtggctcatgcctgtaatctcagc

SEQ ID NO: 659691 - DNA, 296 bp, Homo sapiens
ccgatgtgtctcacttcagtgggatagtatctatccacgaacacacggcgagtttctcacttcagtgggatgtatctatccacgaactcacggccgagtgtctcacttcagtgagatgtatctatccacggactcacggccaagttgctcacttcagtgggatgtatctatccacgaactcacggccgagtttctcacttcagtgggatgtatctatccacgaactcacggccgagtttctcacttcagtgggatgtatctttccacgaactcacggccgcggcctcgtgccgagt

SEQ ID NO: 659692 - DNA, 931 bp, Homo sapiens
agcgggttgaaggcgctgctgtgcgcggctggcgtgctggctgtgctggcgtgtgggtgcgtgggcctgtgtgcttgtcagcctgtgcctaggagtgcaggaaggagcctgctgggctgtgcagttgtgaggggctgggacccggtttgcctggctggtgggtctagcttgggtggagggtcgggccatgctggttggtgctcattggccggcttggtttgcccgccttgtgtggcccctgctgagctgctgtcaggccagcccagctgagtctgtcgttgcctagctttgcactgactgccggcaagttggtcgcgcccgcgcggctaccgggcttccgtgacggggaccatttccgtcgcggtcgcgcgcctcggcgcgttgtgctctctctcgtccaacggtcccggaaccgttcggcgaacgactcacacctttacctccttcttcacctcgcacgaattaacacggccttggttacataccaaacgaccattggggcaccttgtttgcacacagttaggccaaggaacacgaaacgtggttgcacccgttagattacaattgggtttcaccctttgtacttggagtcacccgttctgggctaagttgcaattacacgggggcgcgaattttctcaactgttcttggacatcggaacttttggacgccccattcaccaccccttaagagggggcttgacgaaagatttttaggaacgcccatgaagctgaaacccaggttgggtaagagacctccgcaagtggatttgagcaatttgcgagcacggttccacggttggaacgctatcgctggacagctacatagcatgaggagttgaggcgtagtactcatattcacaccacatttctggagtgcgtgtccacccttggtgagtatcatacttgatggcagaactggggcaaacggg

SEQ ID NO: 659693 - DNA, 145 bp, Homo sapiens
gacgtggataaaacctggacgatcgtacacttccactttccaccaatccttgcttggtgctgtatgagtaatgcgtacgaaatatctcccttctgtcatggtagacctctcggaggactctatctcctgcatttttattatttct

SEQ ID NO: 659694 - DNA, 841 bp, Homo sapiens
ggcctcgggccccgcatggacgccgcgtctcctcgtctcgggctgttggccagagcctctgcctgtctttgggggttctggatggaggaggccacaccctgtaccctggcgccgggtgctgcctgagccgggtgcggagggcctgggtcatccccccgatcaggtatccgagaaccacaagcgtctcccctaccccctggttcagatcaagtcggacaagcagcagctgggcagcgtcatctacagcatccaggacccggcgtggatgaggagccccggggcgtcttctctatcgacaagttcacaggggaaggtcttcctcaattggcatggtggaacgggaaaagaatggatggtcacgggttaaaaggtttggcctgtggaccgggggaggatccacctgttggaggaccccaggacctggagattgtagttgtggatcagaatgacaaagcggccagcttcctgcaggaggcgtccactggccgcgtgctggagggtgcagtccccaggcacctatgtgaccagggaagaggccacagatgccgacagaccccgagacggacaaacgcagcgctgcggtttctccaatcctgcagcagggcagccccgagctcttcagcaatcgaggagctcacaggagaatccgcaaaagtgcaaagtggggctggaccgcgggggtggtcgcggtgtacaatctgaccctgaggtggcggacatgtctggagacggctcacagccactgctcagcatcatcaccttgatgacatcaatgacattgccccgaggtcaccaggaatgagtcttcaggaggcctaaagccgcagggagtgaatgtggc

SEQ ID NO: 659695 - DNA, 1347 bp, Homo sapiens
gtaagaggaggatatggtggtggaggacctggatatggtgaccatgatggaggtgctactggaggctggttattgactaactatgggaggaggaagagtctgagtggaagtggcaaagttacgaatggattgtgggaaattgactaaccaggaagcttctaatcgtacggtcacaagttgaaagagtggaaactttggggtgcgttagcacggtaatcagtggaggagtgatccgatattgcgatgtgacgtgtacaattatggctccaggagcgtcagctcgcgcagagcaagatggtggcgtgtcatggcggtggagcgtagtccgtactatctgagcctttcttccatatttgggccactggtgcctttcatcttgttattacagagtaggcgatgagcgcatttgaagatgccctcaaggacgtgctagacctacgtaaaacgaagccttttgctagagttttcgtacagcacagaataaccggagtgctatgagcggagagaactcttgtattttcggggtatccaggtagcgaggtagatattatatgccaaggtgtagttatttgggtcagaagaggacgaactgatggatgtgagaactgtaaagtcagtgagctccaagtgttgtgtgtggattcatgggaatcgggtaatttaggtggtaaagctaaaacctagttaaccgttgtacatggttgtgcacgcgcacatggattctggccagagatagccaccacacagttggcccttttggggaggagacccacggctctgccatataagacttatctttttaaaatatgtggatttcggttgaccatctttctaaagggtcggggccctctttcggttcgagatagaagtgctgggtagtgaaaccggccaattttggcgggttcaatcttggggggtgacagtgggcttgtggcaaagtttaggggttaacagaatttggtcaagaggaggtagactgggtagttcgaaaaccccgcctttttagggggaaagggaaatcgtttaggtgttcccaaaaaaggtttggtgagggcaaaatgccgtaatttaaggcgctaaaggagatcagttggggggtgggtaaattaaagggcatcagtgacacgggggtgtgttctccccctttttaaatcgataaaagcagtttgtcccagtttgcaagccttttgtttcgaaacgctttacaacgaaaagccctagggtggttcccagatgtctccacgtgactctcatgatacacgagaatatatccgcgaaaaaaggcgcaacctataaaacgcatgggaacacccgagcacataataattacccagaaggatcccacat

SEQ ID NO: 659696 - DNA, 117 bp, Homo sapiens
gtatctagagatcctcttatccgggagtgataatggtgtcattggatgtagaaaactttaacgcagacaaagaggactgtcacacaagtggaccggcaacgctgggagtagagccac

SEQ ID NO: 659697 - DNA, 904 bp, Homo sapiens
agcggaagggcttgattagtttgagaatgatgcacatttcactgtattccagtatgttctattactctatctgtggtgcgttgcatcagaaatgtctggagaataattcttcgatcatgactgttctcaaactaggaagaatctggactgtttgattcatcatagaatgatgatttagaaagattgaggctatattgaatcgtatagggattttctacaaggtattgcctgcgcatttgcagaaacagatatcggtgaattagaatcatcgaatttctgagtaatctgatcgtatctgtacaagctagatggaaaatgatttgtcacctctgaggccaagtgttatgcttgagtgtgttaacgagtagaggtttgaatccgatagataggtctattgtgtctcctagatatagatcacataacatgaatgcaccagtcatcagctattcagatggtgaacgcttccatggtagacacaaggagcgaggctaagaacacgagtgttgaagagcctgtacaataggctcccagattttcaagtctatattcctgcttgctttgtttcaaactctatgtgggttaagagatacatacacaagagaacgtccttgagtggggtttttcaccatggcgacagcggagagagaattgagagctacgctacccctggtgcgttccagggtttcgtaaaagcagacgattggtagatggtcctcttttatcgctccgaataagtggggggtattgaaagataccataatgtttaggagcggatggacttcgttactagaaagccctcttgaggagaaaacaagacggttttcgaaataacgtttgttagtttcaagaaaccccattaatatacatagaagtaaatcctctccaagcgattgcaattacaagg

SEQ ID NO: 659698 - DNA, 150 bp, Homo sapiens
  misc_feature (39)..(39): n is a, c, g, or t
  misc_feature (113)..(113): n is a, c, g, or t
  misc_feature (146)..(146): n is a, c, g, or t
gtttatttaaatcagagagcctctgaaggcacctggttnctgtctatatttttaaggcagtaacgtggcaactgtacagggagcatgatgggtaagaactgggcatggggagntgggagggggacatggagagcacagaggacgangcgc

SEQ ID NO: 659699 - DNA, 797 bp, Homo sapiens
  misc_feature (24)..(24): n is a, c, g, or t
  misc_feature (174)..(174): n is a, c, g, or t
  misc_feature (180)..(180): n is a, c, g, or t
  misc_feature (182)..(182): n is a, c, g, or t
  misc_feature (184)..(184): n is a, c, g, or t
  misc_feature (199)..(200): n is a, c, g, or t
  misc_feature (207)..(207): n is a, c, g, or t
  misc_feature (213)..(213): n is a, c, g, or t
  misc_feature (225)..(225): n is a, c, g, or t
  misc_feature (228)..(229): n is a, c, g, or t
  misc_feature (231)..(231): n is a, c, g, or t
  misc_feature (236)..(236): n is a, c, g, or t
  misc_feature (240)..(242): n is a, c, g, or t
  misc_feature (244)..(244): n is a, c, g, or t
  misc_feature (248)..(248): n is a, c, g, or t
  misc_feature (257)..(257): n is a, c, g, or t
  misc_feature (259)..(259): n is a, c, g, or t
  misc_feature (269)..(269): n is a, c, g, or t
  misc_feature (286)..(286): n is a, c, g, or t
  misc_feature (327)..(327): n is a, c, g, or t
  misc_feature (334)..(334): n is a, c, g, or t
  misc_feature (341)..(341): n is a, c, g, or t
  misc_feature (349)..(349): n is a, c, g, or t
  misc_feature (352)..(353): n is a, c, g, or t
  misc_feature (355)..(356): n is a, c, g, or t
  misc_feature (361)..(361): n is a, c, g, or t
  misc_feature (387)..(387): n is a, c, g, or t
  misc_feature (423)..(423): n is a, c, g, or t
  misc_feature (486)..(486): n is a, c, g, or t
  misc_feature (497)..(497): n is a, c, g, or t
  misc_feature (503)..(505): n is a, c, g, or t
  misc_feature (507)..(508): n is a, c, g, or t
  misc_feature (510)..(510): n is a, c, g, or t
  misc_feature (536)..(536): n is a, c, g, or t
  misc_feature (540)..(540): n is a, c, g, or t
  misc_feature (547)..(548): n is a, c, g, or t
  misc_feature (552)..(552): n is a, c, g, or t
  misc_feature (559)..(559): n is a, c, g, or t
  misc_feature (564)..(564): n is a, c, g, or t
  misc_feature (568)..(568): n is a, c, g, or t
  misc_feature (595)..(595): n is a, c, g, or t
  misc_feature (613)..(613): n is a, c, g, or t
  misc_feature (621)..(621): n is a, c, g, or t
  misc_feature (623)..(623): n is a, c, g, or t
  misc_feature (628)..(629): n is a, c, g, or t
  misc_feature (631)..(631): n is a, c, g, or t
  misc_feature (646)..(646): n is a, c, g, or t
  misc_feature (671)..(671): n is a, c, g, or t
  misc_feature (678)..(678): n is a, c, g, or t
  misc_feature (686)..(686): n is a, c, g, or t
  misc_feature (695)..(695): n is a, c, g, or t
  misc_feature (697)..(697): n is a, c, g, or t
  misc_feature (704)..(704): n is a, c, g, or t
  misc_feature (715)..(716): n is a, c, g, or t
  misc_feature (727)..(727): n is a, c, g, or t
  misc_feature (730)..(731): n is a, c, g, or t
  misc_feature (734)..(734): n is a, c, g, or t
  misc_feature (742)..(742): n is a, c, g, or t
  misc_feature (746)..(747): n is a, c, g, or t
atctttgaaagcacacaaaaacanagttttacagggtacaatacaaagtgaactttgatgatgttcttacttgcatttactaaaaatctgagaaagactgtaatcagtctctaaataattatcttgcgtaaagagaaaagtagagcacaatatatatatatcacaaaccaaatnacactntntntaacattacaacatnnaatttanttaatnaaaaataaaagnaanntngttantaannntntatnatttttttntnaatattacgntaatttctatttttggnatgaattattaaccttttccattagtaggcaaatgtgctcngcaaatnctcgganggcaccanggnnannattanatttgcaaatgtatccaacagccttntgggcagtagaacaggcatcagcaggggcgccactnaggcccactctcttcaagcactcttcatcagacacttcatttccaagatatgccacttctttncagcacaggcncatttnnntnntncattcatctacaactgctagcttgtntganacactgnnttcnattttgnaatcnagtntttaagaagacagcgtctgctttgaanaggccctttctgagattngcctcacntnaatannanttttatttaataaanttatcccaatagcatcttttacatnataaganattatttntttttggtntnctgatanataaatgtggnnattggtgaganatnnatnaatattgnaaannaaaagttttatttccttaagcttctctttgccaaaatagccatatcttaa

SEQ ID NO: 659700 - DNA, 1097 bp, Homo sapiens
atttccagtgtgcctcaccccggctgcgtctcgttcccccgggtaccggctcctgtcatcctgggttcttcagagtcgactcgctcacatgctgtcatccgtgttgccttcaatgccatgggttctttcttttgtacaccctttgcttatccatatgtatcatgggtatgaggtcctgtttttcgtgtttacttgttttgatgtaggaacagaatgtatgatctgtgtgtcctatgagaggtaggcctaacggtgattctgccctgttgctattgcgtaaaaaccttcttaagcttcctgtcccacgtttctctgacaagcccaatgtagttccctccaagttcttcttggtgtgtaggccttgtaggcattattgaaagcttgctgcctcacgtctagtatcgtctggggcccagcacccaggcaataactcttataatgtttcttaatgcgttatagcctcctgagactttaaatggtaaaatcagaattattaggaaatcttgagagggtagtcctcaagtttgtattgctttgctgtcgctctttgggaagaagggtacgacctggaggacacaggctcctgtgtgggtcttcatcctgcctgtaccggcagatcttcctcgtacaccttgggcaaagtctatgcgaagatggtttcttagctctccatttgccatgatgttcctcccagtcatcatgagggagtctctcaaaccaggagtttatatttattttgtagaaaatacacacttttcaggagtaacctgagcatgattttggattctccacctcccccctagtctctgcacctgggattcagctcaaggattcagtgtcttcagtgcttacaaaagttcccccaagaaatcagcaaccagcctctgtttcatctgggagcccctcctttggcccctgggtttgggggtgactgcccatacatgggaacagcgggggtctgtcaccacgtctgatgcctgcaccacacatgatatggatgatcaagaagagcatcccatgagcgtcgtgtcgtgcctatcgtataaataacaagtttcagaaagtaatattatctttcctggtgacctgtaacactt

SEQ ID NO: 659701 - DNA, 946 bp, Homo sapiens
tttcgccaaaaccaacgggttgcttgctgtcccagtggggccccctcatcatcgtcgctcatgccagggagatctgtcctcgaggaagctgtggctcccactctttcgaagtgacccaatacgcaccgtcgggccgcaaggtccggttcccgaccgcaatttcctggagtaggactcatgggggcattctctgctcctcccactcatcgggaaccttttaccccgaggtgtgcaacctacagaatgcattgggcaagagcttggcaaaggttgggcaccaagaaatttgcccaaggaggcaatgtcagtttggatggccctttcaaattagcccagctgttggagggacccaatctttgcccttgggaggcagggatagtcacgtggctttacaaactgtgtggaatgatgcccacaggaaaaatgttcacccctttttcccccatttcattccgatgactacggaaattcggggacgctttgcacatccttgtgggggcattttcggggtctcccaaggcaaacaagacgggattgaacaggggcattgctttgtgacagctcgtggtggggggctcgggattggggtcctgattaagaaggctggacggctgtctaatcttttacccagggtacccagtgccacgcaccttcggatgcagattctccagggtagtcatcctcctctccaagcttggacaggctcgacaacacaatggtttgcacccccagtttgatgggccacggatgggcgatacgtgtgatggtccttccaacattccttgatgaagagcaaaaaatttcccgaaaggagtcttcacaaagaggtcccattttggaggaatatctccgttaacacccagcatagtctgtggactgtgtgtccagagtttgtgccatggttctcgcatccatcattcggccagcagtttgggcacaggctacg

SEQ ID NO: 659702 - DNA, 201 bp, Homo sapiens
tttaaacggagtgactgacgaagaggacctccgttatcccggaggtggtctattcctgagatcacacttctctctttcttgttgatcagactgcctctcactgtgactaaaggtcaggaaggtgggtgggccacagaagcaaagggagacagaaacggaggcctttcctcactacagaaatcttattgctggcgtctcact

SEQ ID NO: 659703 - DNA, 828 bp, Homo sapiens
caaagtgcctggtttgtgcaaaggtggctctgtagcataatttagggcatcgcaggagctggtggttgtgacactctacaagatgggttttccggaagccgcgagttcctgttagacctcatcatatagaagctgttccaaactagctcttgcaagttgatggatcttaaggtgaatctttgtcttaaagggagatggagaagaaactttgaaggagtgaaggggaactagtttgtgaagaaaatcgggggtattatggctgcaaggtgaaatgattggtccgtggtgggctaacatgaggcggcagctgtatggagaatgtgacaggaatggtgaaaggatcagtggtttctaactcagataagagggatgatgcagccaatcacaagtggtgactcaagatatcctggttgaatgactgggtaaaatgaatcctcagtggggcttcgttcaaggtcgaattgagaaatcatggcagcatgggtctcgctaatagaagttaacaaaatcttgcagggttgagccagggaacgggaagtgctgaagagatgcctttggtacttgtgccatcgagatcgaagcaatcttcgatatctatccagacctccatgtgcagaattgagactgaaactactccttgggaagtagggggggcaaggatgtgttcttactgggggtgaccgcccgggatgcaaatgcgctggtgcaaaagagccgagggtaccaggtcggggaatggtcacggccttacacgccatgggatttgggtggggaacaagggaccacaaaagggggaccccgaatgttcaaaacgggggcaggttaagc

SEQ ID NO: 659704 - DNA, 586 bp, Homo sapiens
  misc_feature (17)..(17): n is a, c, g, or t
  misc_feature (110)..(110): n is a, c, g, or t
  misc_feature (113)..(113): n is a, c, g, or t
  misc_feature (116)..(116): n is a, c, g, or t
  misc_feature (134)..(134): n is a, c, g, or t
  misc_feature (136)..(136): n is a, c, g, or t
  misc_feature (155)..(156): n is a, c, g, or t
  misc_feature (158)..(161): n is a, c, g, or t
  misc_feature (163)..(165): n is a, c, g, or t
  misc_feature (188)..(189): n is a, c, g, or t
  misc_feature (244)..(245): n is a, c, g, or t
  misc_feature (247)..(247): n is a, c, g, or t
  misc_feature (253)..(253): n is a, c, g, or t
  misc_feature (255)..(255): n is a, c, g, or t
  misc_feature (274)..(274): n is a, c, g, or t
  misc_feature (292)..(292): n is a, c, g, or t
  misc_feature (298)..(298): n is a, c, g, or t
  misc_feature (308)..(308): n is a, c, g, or t
  misc_feature (320)..(321): n is a, c, g, or t
  misc_feature (329)..(329): n is a, c, g, or t
  misc_feature (334)..(334): n is a, c, g, or t
  misc_feature (336)..(336): n is a, c, g, or t
  misc_feature (338)..(338): n is a, c, g, or t
  misc_feature (350)..(351): n is a, c, g, or t
  misc_feature (355)..(355): n is a, c, g, or t
  misc_feature (374)..(375): n is a, c, g, or t
  misc_feature (377)..(378): n is a, c, g, or t
  misc_feature (398)..(398): n is a, c, g, or t
  misc_feature (577)..(577): n is a, c, g, or t
acgtgccccccaggttngaggggagctaagagatgagagaaggggacagaggaaagaaaagatgttgcatcagagaaagcatgagagagccagggagtgagggactgaanganaancaaagaaaaaatacaagnanaaaaaaaaaaaaaaaaaannannnnannngaaagagagaaaaaaaaaaaaannaaaaaaaaaaaaaaaaaaaaaaaaaaaaaaaaaaaaataaaaaaaaaaaaaaaannanaaaatntnaaaaaaaaaattatttggngcggaaaagctctgcggnaggagngctcaggccntcagtccgaggnntggtaggnagggntntntagagggttgtnntttntttgtttggggatattttnntnnttattttcctctttgttttntttatttttcttattttcatctttgtcctcatcatcctccttgtcctctgcctcctcctcctctttgcgtttcttgtcttcttcctcctccttaagcctctgctcctcgtcctgtttgtccttcatttgtttctctgctgcctttgttacgccccacgtctcgttgccaaactcctcancgtatgcct

SEQ ID NO: 659705 - DNA, 664 bp, Homo sapiens
aggcaggattgctcggtggtgagaaggttaggtccggctcagactgaataacgcaagagataaaatttgccttaaaacttacctggcagtggctttgctgcacggtctgaaaccacctgttcccaccctcttgaccgaaatttccttgtgacacatgagaagggcaatacggtctgatgacccagcagtttgacggatgggagttatctcagggttcagcttcatgggctcccaaagcgacatatcgtcagggatgagatggcccagggtgcggcgactgggcaactttaaggagagctgggatacggagtcccttagggttcaggaacgcttctgtgcaagctgtcgaggactggcttgggcccgaagggttgctctgccccgcctgcgctagctgtgagctgatgcaaagccctgggcgtcatcatgcaccctcagatgcctgtggcttcaggtcctgcgtcgtgtgccacacattcgaaaggatcgctcagtgatggcttttaacggaaaggtgacattggcttggattcttcatgagcacatctgatatagctctttttccgttatccttgctcattgcgtcggcggaagcaactctgtctgtattgggatctgtcgaacatctctgcgctcagacagttacgaaataaatgtctgcggg

SEQ ID NO: 659706 - DNA, 587 bp, Homo sapiens
tttaccgcgggcataggcgacctcccgctccataatcatagctatcctcaccgactgtgcagtgctctgagccctaggattcatctttgtttccaccgaatgaggtctgtctggcgtggaattagcctacccgtcactagacatggaactacacgactcgacctacgtcgacgctaactgcccctatgtgctatcaattggagctgtgttcgacataataggagggtttattcactgattggccgtattatcaggctacaccctataccatacctacgccaaataccatttcactatgatatacatcggcgcactactatctttattgccacaacactatctcggtctatacaggacgccctggcgctactcggactgccccgacgcatacaccacaagaaacatgctatcatctgatggctcattcattcatctaacagcagattcattaatattacacatgatttgagaagccttcgcttggaagcgaaaggctctaataggagaagaaccgtccatatacctggagagcctatctggatgccgcagagactatcagacattcgaagaacctgcatcatataata

SEQ ID NO: 659707 - DNA, 693 bp, Homo sapiens
  misc_feature (386)..(386): n is a, c, g, or t
cccaaaaagcccaataaaacatggtccccaaggttggtcgccccttaaaaccgcacttaggtgggtaacccaataaataaattttttatattttttaaaaaaaagaaagcttgtgaaatttatgtttttaagcctaataaaccccctggtaatacggggaatcaatatttgatccccaaaaccacagggggaaaggagggccaccgtggttttacaaccctgttttaaactctccattccttaaataataacctttgtttcaacgtaaatgactctccttaggctaagagcgcaaatggactcatcgtggctctttcactgcaagccgcttcctcaaggacttacctgtgcaagtggattccaagcacatccaagaatgcaattanttgataagatactgtggcaagctatatcggcagttccaaggaattcgtccaattgattacaccccaaagccccgcgtctatcaccttgtaataattttaaagcccctgcacctggaactattaacgttcctgtaaccattattccttttaacttttttgcctactttatttctgtaaaattgttttaactagaccccccctctcctttctaaaccaaagtataaaagaagatctagccccttcttcaggccgagagaatttcgagcgttagccgtctcttggccaccagctaaataaacggattctt

SEQ ID NO: 659708 - DNA, 543 bp, Homo sapiens
caattgcaggctggtcctgccctgggatttatgggatggctggaggctgctccctgtgaccggtgacgcatagtcttgcggaccctggtccgcctgagtgcgtgcaccgcgagaccgcctggctgcgcactgctccggcctgcgcagcccggccctggccatggctgtgccccccgcccgtctcccgcgatctccgtttcgtgtctcgtgctccggctttattacgcccctgcagaagaagttctggccctgtggtggccccaaatgcccaaatgtgaatcccttcctggcccggtggacagctgagcctccccctgtgcaccctgtgtggcccatgctgctgcacagatgggccgggtgggctgagattccccctgtaaggagcacacctggtacaaggaagataaataccaccatgacacatcaccagacaataacaccttataccatgactaaaatggcaacacagaaagcacacaaggtgagctgacacataagaagaagaaatagaactataacagaatggcaaacaaaacaacaaag

SEQ ID NO: 659709 - DNA, 346 bp, Homo sapiens
cggctgagtcatactataggaccccaactgtcagtgctgcctgcaggacctctggtatgggttcaccattccagaataaagctgtgtctgccagccagccagcctgatctctcctcttcctcctggaaatcgcaagtactctcccctgcttcccttaaactcacttgcatttctgaagaacagtaataacccttatgagcctaatatatcccttcattctattaggtctattcatccttaccctactttttgcaacagggctttacacagtcacccccactacttggactgtgccccaaaaacttgtcatccctactatcttctgtctagtcatactcctattcac

SEQ ID NO: 659710 - DNA, 457 bp, Homo sapiens
gatcatcctaggcgaaagttttttttgtttgtttgcttttaaattaggttatttctaaatcttagtcttccacatttttagaggccccctgacacaagtccctgtatttgaagtctagcatctcaaggctgatctggaagtgtgctagtatgctccctagtggataacttaatcttttaaaacaggtccgtcattcccctcttgttttcagaaaagaaggtggctacagccaggcataacatatcccctgtgtgcatagagggtctcttcccgttgatgcttggccttccctcagctttctttaagtctttgctcaagttccaccttaaaatgatgttaggccacaggtccccgtcagttccctctattttccccccttttgctccccagccatattgggccgattagtgggactgtttgactcccgtgtgtgatccaaataaaggtagctgctgga

SEQ ID NO: 659711 - DNA, 305 bp, Homo sapiens
aacaatatgtctgagttatccagaaaactagaataagctgagagagactgtttttaggaaacggtttctttctttttttttgagacagagtctcgctctgtcgccaggctggagtgcactggcgcgatctcagctcactgcaacctctgcctcctgagttcaagcgattctcccgcctcagcctcctgagtagctgggattacagccatgcgccacccacgcccagctaatttttgtatttttagtagagatggggtttcaccatgttggccagtctagtctcaaactcctaaccttgtgatcca

SEQ ID NO: 659712 - DNA, 1048 bp, Homo sapiens
ggcagttcggaggtccctccgacatgcctccttgctcatcagggtgtaggacagaccagcagatccgcgggactctcattccaacctccgaccgatcctccgatttcctctccgtttgcatatcttccggggaccattctttctcggccatctcacttgccttctgggaccatgccagactcccggtatgttgttggtttagctccttcttgccagcccaatcagtgatgctcccattagttcaatctcagaatttatgaccacccgatcgtgggagagcatgcgcgtcaaacaagcgcatggatctaatgtcgtgaccgtgcatggcgcttctcttacatactagcttctctctggttcgttcgtatttctcagaacaccggcgaatcgcattgtgggcgtcttgagaagggcagtgatgccgaactttgttcgccgcagcacattgggccgtagtgatgaagcgcagtagatcttggaagaatccggtcttccttgtcgagaatgtctaaagacccagactggtagtgttggatcgccgacatcatcctgaccaagagacatgctggggaaatgccgcaggcttgacagtattgactgtgagggaatccaaaaacccgctgacgcctttggtagaagcatggcaacatgcgtcccttggtgcgaaaggatatctcggtgacaaagggccgttgatgggaattcttcgattgacgcctgggctttctggcaccgctatcgttaaaacctccgcatgtcttgtgtgatcttaaccgtgatgatttcactattcgcgtacgattagtaggcaagtgtacagcgttattctaagaaagataggggtgtagcaaaccttgtacaaagttctgctacaggctggggaaggcaccctcatggctagtgctaggttcgagaacactacacagttacaaaagggctcacattcttcacatgcacgaactcactaagccttctggaggctcagacggaattctgaacagggcccttgccaaaagaatacgggttgttgctgaagccttctcacatc

SEQ ID NO: 659713 - DNA, 203 bp, Homo sapiens
ctaccctaggcgcacttctggcgtttgattactttctagcagcagttcacacaactcagcgcaaacatcttatacgttacatttatagtgtttcaactctaaaatcccctgtgcagaaaggcttagctcgcgcctgcagcactgaaacagaacccatttagtgtgaggatgccgtcgaaggggcatgtagaccaggaccaaat

SEQ ID NO: 659714 - DNA, 877 bp, Homo sapiens
  misc_feature (126)..(126): n is a, c, g, or t
aactcgtgtaacgtcgatatcatctgttggcacctatgttatgctaccagcggccatattcatagttgccgtgatgcgaggaatcctgtcgggtcgaagtgaaaagctctctatactagtacaaantaccttatcaggagtagatccctggagtgacgtatagtgcttctgtacggcgcaactctaccacataatttcgatacaggcaagtttacactaacattcatagatgaaactggggaaatggtccctcgtcacggcgccaaagggtggctttgaagccgtgcccatcgcctgccaatgacgtttccccaaggaattatgacattgctacttgagtgtgaagcagtgacctggacaatactgatgataagcatatctactcttaattgtgagacagacgtttccctttattgaggtaccacgccatgtaatgggtaacctgtggactttacctacacagggaacatgcgttggagtcaacaaaaaataaaagagcgcccgggtcagaaacccgttcgtccggcgcgaccacactcccagaagaagtcttgtaagcgaccacaacgggtatggacacaccgacacacttcacggaaatgcaccatgttccaatttgttgcccccaaggaaggaatcgggcaaatgaatgacgcgctcggagacttcccccaaagaacacagacgcgggaaaccacgcgcttctgaacccaaccccgacagggaatacgaaggccacgcgagcacttacaacagaacacaggaggagaaataacaaagccccccggggaagatgccaaacaaacgtacaagccaagccaccaaggatactacaaacgacagagtataaaaacaccgagacacaccgcttcgtacc

SEQ ID NO: 659715 - DNA, 210 bp, Homo sapiens
tagtaggcttaattccactttatttatttagagatagagtcttgcagtgtcacttgtgctggagtgcaatggcatgatctcagctcattgcaaccttggcctcccaggttcacacgattatcctgcctcagcctcctgagtagccacgcgagctaattttttatatttttagtagagacgggatttcaccatgttggccagactagctgc

SEQ ID NO: 659716 - DNA, 147 bp, Homo sapiens
atgtttaaagggggggggtttcccccccccccccccgccccccccttgggcccccccaagggttttttccaggggttaaaaattgaatttaaaaaaaaaaattttgaaccccaaaaggggttttaaataaaaaaattttttttttta

SEQ ID NO: 659717 - DNA, 193 bp, Homo sapiens
  misc_feature (173)..(173): n is a, c, g, or t
cattcaggtgattcggctcaagtatgacctggccgcaccgaagcgaagatcaggtgatggttgaccacgccaataacggcgagcactacgaccagttgatcgccgccgacaatgaaaagggcaaccagatcgtgcgtgactctgattgcgcgctctgtgtacaagcgagaccngtgctcgatcgagggctgct

SEQ ID NO: 659718 - DNA, 377 bp, Homo sapiens
acgactctctactgcggtccatgtacacaaggaactgggtgtacatgctgattattgtaaaagcagtcgatagtcatgcttgcctcgctgcaccacatgcagaaacagctacagcctcctcaacctggcagaagttcgcagccaatactgcgaaagccaaggagatgccaatccccaatcttcctcccttggatcctccatctccgagaacttcctcattatggagctctctgcaggcatattctgcacacggatttatgaataattaaaatggaaggccacagaaaaggggaaaagaggaaataatacagtcactcgttaatccagcaaaaagaaatgagaagggaaaaccacatagaagggtaatcccggaaatg

SEQ ID NO: 659719 - DNA, 154 bp, Homo sapiens
ctctagacgatcgcttactaaatggctgtcacagtttactggcatcagttcagatgaagctcctgcagttcgtccctgtgatccttttccaatctgatccttctattacccttctttcttacccccgtgtaagtaaggaaacgttactacggcc

SEQ ID NO: 659720 - DNA, 203 bp, Homo sapiens
ggcctcgagatctggcggactttttctctgctgtaggcaaggttcgcgatgtacgtatcatctcagatcggaactcacgtcgtactaagggcatttgctacgtggaattctgtgaaatccagtctgtgccactggacatagggctgactgggcagcgtttgctgagagtgcctatcattgtacaggctacagtgccctggggt

SEQ ID NO: 659721 - DNA, 336 bp, Homo sapiens
gggggggcccttttttgtttacctttttttaggtattgtttagggggggggtttccctttgtttatccccccccctgggctaaaggtggtttttttccgtttcctttggggggccccacccccccttacctttttgcccgccccttttaaacctttttttttccaaaaattttattgggttcctttttttttaagggttttttaaaggggggggttcggggttttggtttttcccctttttttggggaaaattcccgttaaaaggtttatttgggggtttttttttcctatttttccttttttttttcgggttcccgtttttttaaaattttttta

SEQ ID NO: 659722 - DNA, 311 bp, Homo sapiens
acgaccaccttcacctgaacgccgccggttacctcttgacggccttcgtcgtgttctgtctcgtatttgccgctccaaatgtgatcgcgcccccgaccctgaggatcgatgatcgcgggatgacctggaaatcctggcgacgttcggcgacgtatttgtggtcagatatagataaattcttggttggacgcgcagtgcgtggcggaaaaccaaaaattgcgttcgattttcttcctgggaaaaccccatctcaagtgaatgcgacggcgttaaaccgatcagttaacggctatgatcgttccatggccaat

SEQ ID NO: 659723 - DNA, 115 bp, Homo sapiens
gctcatgtctaggcaacatagtgaaaccccgcctctactaagaagtacaaaaaaagttagggaggcatggtggtccatgccgtgtgatcccagctcttattgcccaggctggagt

SEQ ID NO: 659724 - DNA, 133 bp, Homo sapiens
actcacctcggacctgatagtgagattaaatgttcctgattgttgaatcttaaaagtgccataatggacattgatgtcccagatgtggaggcttcaacggcccagactggcacctgaagatgccctttctggt

SEQ ID NO: 659725 - DNA, 259 bp, Homo sapiens
ttaaaaaaattagcatttatcactacttgacattatagcacatctatttgataatgtgttcattctcttctctacctactctagaatgcaatagaatgataataatcacaataataatatctgaggcaatcattaaatgattgctaagaaaccagagaagtcctctagaacacttatacaggccttaatatcattacaatcttcatagacaactaaaatatactttaggtagctattagaagacttctaacaactagag

SEQ ID NO: 659726 - DNA, 346 bp, Homo sapiens
tagcaggacccgcccatttatttaatcataatacatgaattaaattaatcaaataaaggaacagcaatttagaaagaaacacactttaaaaaatcaaaattctcaattcaggcagtctgttcctatcattgggtatcctactcctttaaaaatctcatatggcccaacaaaaagtggttatttttactggttttgggagatgactgaacagatgaaggcatcagatgcctccatcagctggtatttggcctaagatctatttaagataaccttttcttatatttttaacttaatattgggcataatcgtatcattcaagataaagtctgggtcatttctttgataa

SEQ ID NO: 659727 - DNA, 1059 bp, Homo sapiens
gggatacacatagcgagttatcatccgcacgtggactcttgccggtgcatagaaccgactcacatgatatgtggttgtcttgtgtgtgatgtctagtgtgtgtctgcggtgcataggcgagaccgagtatagtcagtggttccctaaggtctgttggtgtttgggacagacgcgcaatcggtccgcgaggtgcgacatgaggtgatgttgtgatggcctgctggctccgctgaacacgactatgataacctccgttctgatctggtgctgccaattgccctacgaggagcaggacccactgcacacatcttttgtgagcatacttccctggtgacaccacgacagcggagagtcctgttggacggcgtattggaaagaggtggcatgcggctgttgagacgttggttgcagttgacgtctggcatggtgacctctgcgcgtcccttgtgaagcagacttccctgtggtctaccttattcgcaccgtgcatgcaagcgtgaaggtctgaggaatcaaggtcggcagatcatgtgcagaggactacttgcatacgcgcaggcgtcgccagaaattctaccttgagaaatcggccatccgggggttctattctgttccctaggtggcatttcatagcggagttgtccatctgcacggtgcctctacaaaggatgctgcgctggtgcgtcctctgggccaggaggtccgactacctggccgctctaaggaaagtaatcgcgctttggtcgtgtgctgacgagtcgacgtctaccgtggatagggggctgtaccattcgcaagctgggagaggagagagatcacgctaagcagcgtgatcctgtgctggacagatgattctccgatgtggagggagaactgggcggcatagagcaggggcgcttgtcggtggcgcgctctggttgctgtggaccggggcctgcccaagcttcctttttctgagggggcccccttcgcttggtcgggcagcagcggggggccgttgtgcgcgcagtgccgggtgccccccttgtgggcaccccgttttcccagattttccaccgc

SEQ ID NO: 659728 - DNA, 239 bp, Homo sapiens
ttgatttggggtttgtctttgatggtttctatctgcaattatcgtcatggatatttaagggtctgttataaaaaaccccccccccctgtcctgtaaacttttttcagtgtccagactttttgtaatcacattttaattgccccctcgtatttcccctctacatttgaaatctggggtctgtttcaaaccagtgtgtttttttttcgttttgtaataaacagcccggagaaaaaaaaaaa

SEQ ID NO: 659729 - DNA, 320 bp, Homo sapiens
ataaatccatgtggcggcgaggttgaaagggacagcaggactgtatcgtatgtgcgttatagccacattcagagtgggctgtgaaagacagtggttagggactattcacccagtgggtagagctgagtgatgatgcttgtcactacactgttgctcagaaagaaaagtggcccatagctgggtgcagtggcgtcgtgtctgtaatcccagcactttgggaggccgatgtggtggatcacttgaggtcaggagtttgagaccagcctggccaacatggtgaaaacccgtctctgctaaaaatacaaaaattagctgggcgt

SEQ ID NO: 659730 - DNA, 444 bp, Homo sapiens
tataatagtagagcacaggattttgacaagttggccaagcttgtctcctgggctcaagtgactccacccaccttggtctcccaaagtgctaggattacgggcctgaaccaccccacccggcccaatcttattattactggaagtcgccttgattacaaacaaacattctacagtgcctcctggaccactccttctggacttttctttcctagcccaggatcaaagtgggccttcgagaagaaccctggaggagcacccccctcctcttcaattccacccttctctcttccaacccctggaaatcagctttctgacctcagaatcccagctgtcttctggactcaggtgacaagtcaactaaagtacagatccaacatgaacttaatgaccaatcactctgctcctcctggctacgcgcccaaaccaacaaagccgaacaggctg

SEQ ID NO: 659731 - DNA, 558 bp, Homo sapiens
  misc_feature (128)..(128): n is a, c, g, or t
  misc_feature (460)..(460): n is a, c, g, or t
gacatgatacaatcgagtcggtaccattcggccggggaatgtgggtcttttgggtgtccagtatgaagcttgaagtagtttaattgcaattgctggtgaagaagacgttggtagcttgatgggaatgngattgaatccataaattaccttgggcagtatgggcattttcacgatattggttcttcctatccataagcatggaatgttcttccatttgtttgggtcctcctttatttccttgagcagtggttggtagttctctttgaagaggtccctcacatcccttgtaagtgggattcctaggtattttattctctttgaagcaattgtgaatgggagttcactcatgattggggtctctgtttgtctgttatgggggtataagaatgttggtgattttggcatattgattttgtatcctgagactttgctgaattgcctatcaggttaaggagatttngggcggagatgatggggttttctaaatatacagtcatgtcatctgcaaacagggacaatttgacttcctcttttcctaattgaataccctttatttat

SEQ ID NO: 659732 - DNA, 443 bp, Homo sapiens
tctagtagtggagcgaacatctgtctgctcatgctatggagagactgagtacaagcagacttcccaatactcttccttcagttcccacgactacagtctgtattcctgtgattgtggaattcatcaatgagatcctcaacatacgtaccaagggccggacatggtacattctttcactgaccctctgccgtttcctggcctggaattattttgcacaccttcgtttggaggttttacagctgacccgccaccctgagaactggaccctgcaagcccggtggcggcttgtggggctgcccgtccacttgctctttttgcggttctacaagcgtgacaaagacgagcattaccggacctatgatgcctactccactttctacctgaattccagtggcctcatttgtcgccatcgtctagataaactgatgccttcacactcacct

SEQ ID NO: 659733 - DNA, 431 bp, Homo sapiens
ggcatccctggtttggggagtcggaattattggtgatggccctgggactacggttgttgtattgaattgataacaactagactgtgacatagcgagtaacggaaaaataaaggtataataggtctaagaattgggacgactcaggacatctgattagagagtggctaaggacattcagcatagccctgccaggtaagattattcatctcacttcaagagttcaagaatggcagtttggggatagcatgaggcaagcgtgatcagggtgaggaacaggaaagaaggaaatatggggaaatggggtgaatatcaggtggatcagagagatacagtcatgagggtcaggtgtggtatccggaataatgtgggaggccggattgaagtccgggccaggaacaatggtaattgtgggagactcaacaaagagtgag

SEQ ID NO: 659734 - DNA, 294 bp, Homo sapiens
  misc_feature (4)..(4): n is a, c, g, or t
  misc_feature (12)..(12): n is a, c, g, or t
  misc_feature (109)..(109): n is a, c, g, or t
  misc_feature (111)..(111): n is a, c, g, or t
  misc_feature (167)..(167): n is a, c, g, or t
  misc_feature (189)..(189): n is a, c, g, or t
  misc_feature (213)..(213): n is a, c, g, or t
  misc_feature (274)..(274): n is a, c, g, or t
catnggggcttncttggggatttcaccacatggctgagctgagggacgacagagaggaaagccattcagctccagggtcctgacaaaaagttggttgaccctgtagatntnagcagaactctcaaagtcacatcacccaagaggaaaactagtgtttctgctactgnttcagtgagcgcaactaatctnatcagcatggtccagggacagttnagagttcttgggcaagaggggaatctgctgctgcatcgggcagcccatccagtatgctcgntccacctgcgaggccggcgt

SEQ ID NO: 659735 - DNA, 315 bp, Homo sapiens
  misc_feature (293)..(293): n is a, c, g, or t
ccagcagcgagaggctttgctctttggccagcatttcctctttatcgctccattcggcggccagctcatttttttcttctacctggatgaaaatgttccggtcgcgcaactgcatgaggcaatgattcctggcaaccatgtagagccagcttttgatgtataccactttgtattttgccagttcggtaatggctttcaggaatatttgctgcaccgcgtctttggctgcttcttcatttttgaggtatttcatacaaacacccagcaataaaaatgtgaccgctggggaaatncaaaaggaccgagctgaattga

SEQ ID NO: 659736 - DNA, 195 bp, Homo sapiens
gctgaagatcctggtgtcgccatgggccgccgcccgcccgttgttaccggtattgtaagaacaagtccgtacccaaagtctcgcttctttgccgaggtgtccctgatgccaagattggcatttttgacctggggccggaaaagggcaaaagtggatgagtttcccattttgggcccatgggtttcaatgaatatg

SEQ ID NO: 659737 - DNA, 224 bp, Homo sapiens
gaggaccccaacgctatatacttctcaagcttatacttcctcaacgcttatacttctcaacgcttatacttcttaacgctttatacttcctcaacgctttatacttctcaacgctttatacttcctccaacgcctttatactctctcaagcgctttatactctctcaacgcctttatacattctcacagcgctttatacattcgtgcgcgcgtttcgcctcgca

SEQ ID NO: 659738 - DNA, 139 bp, Homo sapiens
cacttgagtgcaatagtccccagttctcaagggcacatctgtgtgggaggtacggtagagcccttgagcgctcatggaaagcacatctctcctctagcgggttcctgctctttgtactaccagggagcgccccgggaga

SEQ ID NO: 659739 - DNA, 342 bp, Homo sapiens
  misc_feature (239)..(239): n is a, c, g, or t
  misc_feature (250)..(250): n is a, c, g, or t
  misc_feature (330)..(330): n is a, c, g, or t
  misc_feature (340)..(340): n is a, c, g, or t
tgatagatacaacattttatttttcacagccataaaaaagaaagaaatcatgtcctttgcagcaacatggatgcagctggaggccattatcctaagcaaattaacacaggaacagaaaaccaaatattgcatattctgacttacaagcgggagctaaacactgggtactcgtggacataaagttggcaacaatagacagtggggactactaaagggaagaggcggaaggagggaaaggnagactaactgnagggtactatgctcagtaccaggatgatagatcattcgtacttcaaacctcggcatcatgcaatacacccatgtcccagnacgtgtcctngt

SEQ ID NO: 659740 - DNA, 180 bp, Homo sapiens
  misc_feature (36)..(36): n is a, c, g, or t
  misc_feature (40)..(40): n is a, c, g, or t
  misc_feature (122)..(122): n is a, c, g, or t
tggtgttcgtgaaggtccaaagaagtaaagccagtnaggngaaggtagagccaggcaccgaagagagccgcgggccttgtcacagagtttggttggtgcttgagagctaagcataggctctnaggagccataagtagcccagggcaggcccaggctgcattctgcagctgccagcgcatt

SEQ ID NO: 659741 - DNA, 139 bp, Homo sapiens
ccactccataaggaaccttcactaccatgccgatgcgtggaataacctgctcctgaatgatcactgggtcaaagataaatcgagatggaaatgtaaaagttcctcaaactgaatgacaattatgatacaacctatcaac

SEQ ID NO: 659742 - DNA, 1150 bp, Homo sapiens
gcatggaccgaggtggcttcggtggacggaagacgatggtggccctgcgtgggtgccccccttgtgtaacctttgatgtgaccagtactggccaggaagtaaggaggaggaccgtgggagcgacctggcaagaacactggcatagaaggctgatgcactgtcgtgggagacgccagatgatcgggcctacctagatgcatagaccccgcaagagatgcacttgacttaccagattaatccttcttaataccatgacaccctgtgttacaattggtatagatttccgtagttttataattgtgggccacaaagtcatgattattcctgtgtgctggaactttgagaattctttcaccaattttgtgaggaaaaccttgaaacactcatgtgtaaagtggccagctgtgcgggacgtcaatattgctacctactttcctaggaattggttggtgccaagaactttaaccgatgggaacccccgttgtggaggcatgctccaggtaatcagtggctggagacccgaagaggggccctcttagctggtaacgcaagtgttgcacagggggtgggtcgactggtttggacaggggcgtctaattgaaagagagacaagggtcccagacttggttgttgatcctatgcaactaattgacggcaaggaccagcttaccacgacccaccaattattgggctacctcaattatgacactgggatcgagcagagacaccacgaatggaaccaaagacacgcattgtccttcggggcgtcgcccgcacagagtagtaaataaaaacagtggcttagaagaggcgggccagcaatgataagagagagctcagcaatatcagccggtgaaggcacgtagacaggtagctgggtgactcacacaaaaaacgcgcgggcgcgcggctgaaaaaccaagcgtggggaaaggtaccagcgacttaaccgaccggcggcgtggagctacagttagctcagccgcacgacgatacgcatcgcgcggctagcaaagacagcagtaggcccaacgcacgcgtaccaagacaccacaaaggcaacagacgaaacacaacaaggcaagaggcagtcgcaacgccaagccggcagcacacagcgagcagacagtcaagacgaggaacggaccaa

SEQ ID NO: 659743 - DNA, 661 bp, Homo sapiens
gtgggtggccaccctgtcctttgttgttgctggggggttccaattgggttgtgagtccttcctcgcaagtgtgggcggacgttctcttgccgcccctctctggtgtttgcatgggggaggccctggggccccccttcttggaggaattggttgtccctctgtgcggcctcccgcgacaccttccttctcgggggtgacgtacacaagcatggggtccgactcatccaccggtgactcagcgaggtgtgggccactcccctcgtgcgtcctctcctcgcgcccccctcgggcgcacccctcaccgctgggactcgccttcccccaaggggcccccctcatgtgagtacacggcgtggccgccctccaatgtgagccgcgcctccgctccccgccccgtgcgtgtgcgtcccttctatgggagcagctttcggccgcgtgcacagtgttgcacgaactcttctctccccgcctctcagcgttctttctccggccgcacgcagccacagagatcatgtcggtcattgcaggggtcacctacttgtcaccttgtcagaagtgaggtgaggtggacattatgtgttgtcagtgaacacaccccggtgcttttatctgacacacgacttggggggagcaccaacaggcccatcaatagatacgagaa

SEQ ID NO: 659744 - DNA, 959 bp, Homo sapiens
gggcaacccgctccggtgtccttccatgctgtggaggctctgtgtttcgctctttctactgcttactcttcgggtccacactgcttttatgagctgtaacactcaccctgaaggtttgcaacttgactcctgaagccagcaagaccacgagccccaggaggaacgaacaactccagacgcgctgcttaagagctgtaacactcaccgagaaggtctgcagcttcactcctgagccagcgaggccagaacccaccagaaggaagaaatctgaaacacatccgaacatcagaaggaacaaatccagacgtgccaccttaagagctgttaacactcaccgcgagggtccgcggtttcattttgaagctccggtgagaccaagaaccaaccaattcgggacacaataccaactctttcatgccaggagaagcctcctttaaaaaatttcggtgataacaagcagccacatggtcaaaatctcctgaaagttgagccaggggagctgtaggaagaatcctcctttctcgcagatgaaatctttttgatatagcaggggtactggccaagaaggaaccacagaggagacccaccgaacattcaaggacttaaattccctttccacttagccacaggttgttcttccatcaataatgtactggatcaaagccgccctcagaggttgaggaagtgccgtccaccctagaagatgttgccctctcccttgcagatgggactctcagcggaacaattggaccaaggctactctcactggaccagagggcaaacttctcgtggggcacggaaacacacacgcgacacggccaggacgagtgcattttgtccgaggagacctccttgtggtccgcacacacgtactcgcgagagagagagccatatagtggagcggactagctttctgtcgcatttcgttgtatttattctctcttctcccgttgtttgga

SEQ ID NO: 659745 - DNA, 1229 bp, Homo sapiens
  misc_feature (324)..(324): n is a, c, g, or t
  misc_feature (402)..(402): n is a, c, g, or t
agcgggtgtcccgcctgcccgcttccgtgtctccccgtatttgctgcgttcgccgcgtaaccctggttgtgtttgtcctgctcctgtcgttggtcgagtcgtgcgtgttcccgccgagtgaaacgagttctagtactagttcataacatcaccaggcctctgttcgttcttccgaactggactttggcctataccaagagagtcgtatcccctacaatgtctgtattgtcccatggtgcttctcctggtgacacgtaggactcctttcttgtgccatggaactcgacagttggcgctaatcctgtgtgtcaatcgtccatacgngagctagcctgttcattgcgttgactgtgtagatagtggacgttgatactagaaactgtgcctcttactcgcgcacangtgccatggtaggttcactctattcggctggcacgcatttcagtgcaagcacaattgtcgatggtctgcctttatgcacgatccgtgtagaacgacgttgttgtcgtcactagttccccactttcaccttctcatttagttctctccgttgagggagatagcgtctcgtggttagcttctttgagcagagtttcgcgtgcttccactacgcgtgaaagcgtgagaggagcagcatgtctaatagagtgggcttacgcggggcacaagcgggcccaagaaccgttgccagggtgatgttcttggagaggggaaccgccgtgttattccagcgattctacccctttgttacggctcccaagggcccttcgccgcgcattataaattcgggccccttgacttttttccgaaaaagggaaaaagagtagctctgcaacttggtattgccatccaaggttttccctaggttgccgccccttcggcgtatcccattaatttatccctccatttagcaagggtcttaatggcgggaacagcccgaatggtggaaaacgcggatattagggaatcgcacgtgggccccgttccttattgtcacttcttctccccttggatagaagcgcgttgggcaagatgggcgtgggcgtttaaccacatttggcaattcacttccttccggagaggggcccattattggcccagtggattacctttccgcgttcccacccttgaaaaggtcccacacttcctttagatgcgcccacacaggggcgaaacttccatagttgtaccactccccccttgggaaattttggcgacattcacgtttt

SEQ ID NO: 659746 - DNA, 251 bp, Homo sapiens
acctatatacagcgaattttgttcttcaccaatgaaggagaaataaagtatttcccagacaatcaaatgccgagaaaattcattactactaaactcaagggagtcctacaactggtggtgaaatgatgatagttactatcatgaaaacacatgaaactataaaactcgcaagtaaagcaaacacacaaaggaggaggagaaaggactcaaatgattctactacagaaacccaccaaaacatggtaacaaat

SEQ ID NO: 659747 - DNA, 216 bp, Homo sapiens
cgctcgcttcgatcgcgtggatacccggtaggagcgggtcgttgtacagatcgaacggcgcagcctgcatcacggtttcacccccattcgtcccgtttcgcttggaaccgagttggcttcggcgctaccggagagcgggatgacttggcttttctgtgcccaaaattcgagccgtggtagcaataacgcgtagctctcttccaatagcgcatagag

SEQ ID NO: 659748 - DNA, 726 bp, Homo sapiens
  misc_feature (156)..(156): n is a, c, g, or t
gaagtggctggaacccgggggccgagggttccctgggcccaaggtgcgcccatgcaaatccacccggggcacaagagccaaaccggttccaaaaaaaaaaaaaaaaaagaaagaaaaataaataacaaggagctacctgggaacgtagagccgagncctggggccagctcctccacctcgcagtgatttctgacagttctctaggaacccaggttggggtgtggccctgtgggctggggcctttgctgtggttacctcttctggctcataagagggctctgctgaagaattgctttggagctctttgtgcagagagaccctgtcagtgccctttgctgtgacacctgcgagtggggacctaggatgtcacacctgaattagtgggggtgtgcttctgatacccactaaggtaccatggagcccagagatgcatctgccagcatccttagttttttattgttgtttgttcatttgtttgagacagggtcttgctctgtactcaggctggagtgcggtggcaccattacagctcactgtagcctcaacctcccgggctcaggcagtcctctcacttcagcctcctgagtagctgggaccacaggcatgcaccaccatgcccagccaacagccttagttttggctttttaccaataagactttttttttccttataactttgaacaagtggactccagaagttcggggttccagtacttaatgtgtcct

SEQ ID NO: 659749 - DNA, 1388 bp, Homo sapiens
gaggcgatcggaagccgcgttggggctgctgagaggctcttcctcgctctagggcagattcttcaagcaagtcactatgtcacacagacacaggtgtgtcccgttccttcatatgaggacagatcagggatcaaaactcattcgagaaggctaaaggaggcaccatttcgtagcccgttggaagtagcggggtttggcgagcaattgttgcactagtggacttactagtaaagctgcaggagcaggggaagattactaaaatgtcgcactgcatcgtgagtcctacagtgcgatgttgcgcagctcgcaagggctatgggttaggtacggacgcaagtgacttggtcaggaagtggagcgtattccaatgtagtcggagcaattctgggctatagaacgctaagacgctttagaagaacgacgatgcctgtcgtgtgggcctgtggtttggaggacgcttgtgcttttaggtttaggactgtcttactttagttaatagtgtagcctagtgactgggtctggaacggtaacactaagtttggtaatgggggtagtagactgggtaagcatgggacactttggcgacactacttgagagagtttcccttttcttggcaagggctttgattttggactgaggttgacccggaatttacgtaagtggactagtttggacttaaccctaagggttcacttcaaaggcaagtccagagtttaaacttgagactcctggtcaagcctaaaattggcacttggactggttgtttgcacatgtgtcccacctttccttacaacgtctctgaacgaatcggaactttaagtgtttcaacacagaaagataaactagcggccgaaatccctggaacgggtacaccccctgggtttcgcctggcagcaactgtgcaccacacaatcagggggccgcatggcagcaaacggaagggccccaatattgtggcccgccggctataatatcacaaccccttgttggtatgaaccagcgtattcttgtggtgaactagcgaccatggtccatccgtttgttaacacatcttgtctcacacacagcgtagcggtgaagtaaatacacagcgtgatgtgcttgcccgacaggagagaaccaaatttcgctaggttggtagacgacaccatcaccaaggtatagcaaatcgacagctggcagttattagcagaaccaacaccacagctgtcgcacgcataacatcgataatctagcatagtcagtcaacgcagctatgcagatgtacacataaacgtcaaatacagctaagtcgccgcagcactacaggttaagatcataggatacactagttggtatctatttatagttattaagttcatatatcattagatcaagagcagagaga

SEQ ID NO: 659750 - DNA, 541 bp, Homo sapiens
taggtggtgagtagataagtagatagcaggaataaaatagataagcctttgctttcaagacaacactcagttgctaaacccatttccttttttttaggatattttcattgtctccgaattttagagctgaaaagtgccttagagatcatctagttcaacctctccgttcaaatggagaacctgagccactaagattcacaggagagtaagataattgagcaaacaactccaagtaatgacagaaaattataggagaatcagtacaaattgtgagaatttactatgttgttagcatcctaagtatgagtttagaaaaggtagaagttataagaaaagttaaattgttttaatatgaatggattccactgttaccttcaagataaaatgaagacatacttttttctttagtattatagttaaacgaatattgtatcctgtagtgactaaattcataaatattttttctgcttatagacttgagtttcaaaagcagctgtacagatgatgctgttaatgagtgtttaggtagtgttgattaaaa

SEQ ID NO: 659751 - DNA, 364 bp, Homo sapiens
tcacgtctcccatacgggattgtcacgctcccggaggggacgtcagctcccagtacgggctgtcgccctgagtcgtctcgcagcttccgctaggagctcgacatcttccgtctgatcgtaccttctgctcccggtggacacagtcagctcccggaagggacagtccgctcccggagggcaaagtcagctcccggaggggacagtcaactcacagaggagacagccagctcccagcagaggggacagtcagctcctggcagaggggaccagtcagctcccggaggaaacactcagctgccagaggggacagtcagctcccggaggggacagtcagctcccagaggggatagtcagctcatagagg

SEQ ID NO: 659752 - DNA, 1330 bp, Homo sapiens
ggcacgaaatatcaaggtctcagatccaaagctttttgaaatgattaagtattaggatattttcattgtctccgaattttagagctgaaaagtgccttagagatcatctagttcaacctctccgttcaaatggagaacctgagccactaagattcacaggagagtattgtcttctaagaactctgaagcaatgtcagacattgagggaagctctcattgctgcaggaaaagagattatatggcatgggcggacaaaagaagaaccagctcattactgtagcatttgtgaagtggaggtttttgatctgctttttgtcactaatgagagtaattcacgaaagacctacatagtacattgccaagattgtgcacgaaaaacaagcggaaacttggaaaactttgtggtgctagaacagtacaaaatggaggacctgatgcaagtctatgaccaatttacattagctcctccattaccatccgcctcatcttgatattgttccatggacattaaatgagaccttttctgctattcaggaaataacccagttctgcaccactggtttttgtagctatctcgtaaggctgctggctgaaaactgtgtctatgcaaccttccaagtgcggagtgtcaaccaactggacgggagagagtactgctcctactccaggactctcacaaagctgatgagctgtacttcagaaaaaaataataatttccatgttttgtatatatctgacaaaactggcaacatcttacagactactgacttgaagacaacctcttttatatttctctatttctgggctgatgaatttgttttcatctgtcttttcccccttcagaattttccttggaaaaaaaatactagcctagctggtcatttctttgtaaggtagttagcaattttaagtctttctttggtcaacttttttttaatgtgaaaagttaggtaagacacttttttactgcttttatgtttttctgtcttgttttgagaccatgatggttacacttttggttcctaaataaaatttaaaaaattaacagccaagtcacaaaggtaatggattgcacatagactaaggaataaacttcagatttgtgatttttgtttctaatcttgatgtaaatttacactatttataaatacatatttattgcttgaaaatatttgtgaatggaatgctgttattttttccagatttacctgccattgaaattttaaggagttctgtaatttcaaacactactcctattacattttctatgtgtaaataaaactgcttagcattgtacagaaacttttattaaaattgtttaatgtttaaa

SEQ ID NO: 659753 - DNA, 123 bp, Homo sapiens
tccaccccactgtgtagaaagcatgtacctacatcagatctaaccttggacccagcaatgtggattccctcttctacgctggcccaggccagccaggccctctcaggatagggaggtgttgga

SEQ ID NO: 659754 - DNA, 249 bp, Homo sapiens
  misc_feature (157)..(157): n is a, c, g, or t
  misc_feature (231)..(231): n is a, c, g, or t
gactagaggatctcttcccttttggcatctggcttgcctccagtcttaggtcctttagttgttctgtaagcacgggaacactgctgagggggctcttccctcatgtatacttcaagtaacgatcagaatctttgtgaattatagaaattactatgtnatgcttgatggaattttttctgctagtgtagcttctgaaaggtgctttctccatttatctaaaactacccatgncattaaaaggtcgtctca

SEQ ID NO: 659755 - DNA, 1215 bp, Homo sapiens
ggcacgaaatatcaaggtctcagatccaaagctttttgaaatgattaagtattgtcttctaagaactctgaagcaatgtcagacattgagggaagctctcattgctgcaggaaaagagattatatggcatgggcggacaaaagaagaaccagctcattactgtagcatttgtgaagtggaggtttttgatctgctttttgtcactaatgagagtaattcacgaaagacctacatagtacattgccaagattgtgcacgaaaaacaagcggaaacttggaaaactttgtggtgctagaacagtacaaaatggaggacctgatgcaagtctatgaccaatttacattagctcctccattaccatccgcctcatcttgatattgttccatggacattaaatgagaccttttctgctattcaggaaataacccagttctgcaccactggtttttgtagctatctcgtaaggctgctggctgaaaactgtgtctatgcaaccttccaagtgcggagtgtcaaccaactggacgggagagagtactgctcctactccaggactctcacaaagctgatgagctgtacttcagaaaaaaataataatttccatgttttgtatatatctgacaaaactggcaacatcttacagactactgacttgaagacaacctcttttatatttctctatttctgggctgatgaatttgttttcatctgtcttttcccccttcagaattttccttggaaaaaaaatactagcctagctggtcatttctttgtaaggtagttagcaattttaagtctttctttggtcaacttttttttaatgtgaaaagttaggtaagacacttttttactgcttttatgtttttctgtcttgttttgagaccatgatggttacacttttggttcctaaataaaatttaaaaaattaacagccaagtcacaaaggtaatggattgcacatagactaaggaataaacttcagatttgtgatttttgtttctaatcttgatgtaaatttacactatttataaatacatatttattgcttgaaaatatttgtgaatggaatgctgttattttttccagatttacctgccattgaaattttaaggagttctgtaatttcaaacactactcctattacattttctatgtgtaaataaaactgcttagcattgtacagaaacttttattaaaattgtttaatgtttaaa

SEQ ID NO: 659756 - DNA, 1387 bp, Homo sapiens
  misc_feature (60)..(60): n is a, c, g, or t
  misc_feature (214)..(214): n is a, c, g, or t
cttttctcaactttaaatgttttaatattgtcttcatcaggcctgctgagcattgtcatnttaaaatctgagaatatttgataaattgatgaaagaaaaattatgaagtcatagacattagaatcaagtctcttggcattatttctagttggtatatcttttatgctaaaaatattcaatattcagttgctggtcacaaataatttctcccccncaataggtattgtcttctaagaactctgaagcaatgtcagacattgagggaagctctcattgctgcaggaaaagagattatatggcatgggcggacaaaagaagaaccagctcattactgtagcatttgtgaagtggaggtttttgatctgctttttgtcactaatgagagtaattcacgaaagacctacatagtacattgccaagattgtgcacgaaaaacaagcggaaacttggaaaactttgtggtgctagaacagtacaaaatggaggacctgatgcaagtctatgaccaatttacattagctcctccattaccatccgcctcatcttgatattgttccatggacattaaatgagaccttttctgctattcaggaaataacccagttctgcaccactggtttttgtagctatctcgtaaggctgctggctgaaaactgtgtctatgcaaccttccaagtgcggagtgtcaaccaactggacgggagagagtactgctcctactccaggactctcacaaagctgatgagctgtacttcagaaaaaaataataatttccatgttttgtatatatctgacaaaactggcaacatcttacagactactgacttgaagacaacctcttttatatttctctatttctgggctgatgaatttgttttcatctgtcttttcccccttcagaattttccttggaaaaaaaatactagcctagctggtcatttctttgtaaggtagttagcaattttaagtctttctttggtcaacttttttttaatgtgaaaagttaggtaagacacttttttactgcttttatgtttttctgtcttgttttgagaccatgatggttacacttttggttcctaaataaaatttaaaaaattaacagccaagtcacaaaggtaatggattgcacatagactaaggaataaacttcagatttgtgatttttgtttctaatcttgatgtaaatttacactatttataaatacatatttattgcttgaaaatatttgtgaatggaatgctgttattttttccagatttacctgccattgaaattttaaggagttctgtaatttcaaacactactcctattacattttctatgtgtaaataaaactgcttagcattgtacagaaacttttattaaaattgtttaatgtttaaa

SEQ ID NO: 659757 - DNA, 1164 bp, Homo sapiens
tttttttaagcaatcttaaaaaatggtaaacgtaataacattccaagagtttttgactaattggtgaagaagtatagaaaattgcaagtacactgagtaggataatggtcttagattcttaggaagattggctgaatgggagatagtaaggtaggctgtacttttatgttgcatagcaggctgttgaactttttgagagttatttcccctaacttcacaagcagactatatgtttgtagccatgagctattaacaatttgtatatcaaaataacctaccttacttttattttcaggctcctccattaccatccgcctcatcttgatattgttccatggacattaaatgagaccttttctgctattcaggaaataacccagttctgcaccactggtttttgtagctatctcgtaaggctgctggctgaaaactgtgtctatgcaaccttccaagtgcggagtgtcaaccaactggacgggagagagtactgctcctactccaggactctcacaaagctgatgagctgtacttcagaaaaaaataataatttccatgttttgtatatatctgacaaaactggcaacatcttacagactactgacttgaagacaacctcttttatatttctctatttctgggctgatgaatttgttttcatctgtcttttcccccttcagaattttccttggaaaaaaaatactagcctagctggtcatttctttgtaaggtagttagcaattttaagtctttctttggtcaacttttttttaatgtgaaaagttaggtaagacacttttttactgcttttatgtttttctgtcttgttttgagaccatgatggttacacttttggttcctaaataaaatttaaaaaattaacagccaagtcacaaaggtaatggattgcacatagactaaggaataaacttcagatttgtgatttttgtttctaatcttgatgtaaatttacactatttataaatacatatttattgcttgaaaatatttgtgaatggaatgctgttattttttccagatttacctgccattgaaattttaaggagttctgtaatttcaaacactactcctattacattttctatgtgtaaataaaactgcttagcattgtacagaaacttttattaaaattgtttaatgtttaaa

SEQ ID NO: 659758 - DNA, 1693 bp, Homo sapiens
ggcacgaaatatcaaggtctcagatccaaagctttttgaaatgattaagtattaggatattttcattgtctccgaattttagagctgaaaagtgccttagagatcatctagttcaacctctccgttcaaatggagaacctgagccactaagattcacaggagagtattgtcttctaagaactctgaagcaatgtcagacattgagggaagctctcattgctgcaggaaaagagattatatggcatgggcggacaaaagaagaaccagctcattactgtagcatttgtgaagtggaggtttttgatctgctttttgtcactaatgagagtaattcacgaaagacctacatagtacattgccaagattgtgcacgaaaaacaagcggaaacttggaaaactttgtggtgctagaacagtacaaaatggaggacctgatgcaagtctatgaccaatttacattagctcctccattaccatccgcctcatcttgatattgttccatggacattaaatgagaccttttctgctattcaggaaataacccagttctgcaccactggtttttgtagctatctcgtaaggctgctggctgaaaactgtgtctatgcaaccttccaagtgcggagtgtcaaccaactggacgggagagagtactgctcctactccaggactctcacaaagctgatgagctgtacttcagaaaaaaataataatttccatgttttgtatatatctgacaaaactggcaacatcttacagactactgacttgaagacaacctcttttatatttctctatttctgggctgatgaatttgttttcatctgtcttttcccccttcagaattttccttggaaaaaaaatactagcctagctggtcatttctttgtaaggtagttagcaattttaagtctttctttggtcaacttttttttaatgtgaaaagttaggtaagacacttttttactgcttttatgtttttctgtcttgttttgagaccatgatggttacacttttggttcctaaataaaatttaaaaaattaacagccaagtcacaaaggtaatggattgcacatagactaaggaataaacttcagatttgtgatttttgtttctaatcttgatgtaaatttacactatttataaatacatatttattgcttgaaaatatttgtgaatggaatgctgttattttttccagatttacctgccattgaaattttaaggagttctgtaatttcaaacactactcctattacattttctatgtgtaaataaaactgcttagcattgtacagaaacttttattaaaattgtttaatgtttaaagagttttctattgtttgagttttaaaaaagactttatgtacagtgcccagtttttgttcatttttgaaatctgattatatatattttatatatacttatgtatgtatatataatatatatagaaatctggatatatatgtataaatctttagaacttaaatttttctcgttttaagtttcacatctatggtagatttttgaggtgtctactgtaaagtattgcttacaaaaagtatgattatttttaaagaaatatatatggtatgtatcctcaagacctaaaatgtcagactggtttattgttaagttgcaattactgcaatgacagaccaataaacaattgctgccaaaatgtagtataaa

SEQ ID NO: 659759 - DNA, 602 bp, Homo sapiens
tagcaggctacctagagacccaccctaaaagtccacggtcccaaacaaacactctaaatcactgtagtctggatgttgggtgtattgtcatgtacacaactttagaaagttggcttccggaacaaaaaggctcaccaaaaccccctggctctcaataccctcaagtgaatggcagaggctctggttgaaagtgggagccaggtgcagcttcccagtccactctttgctgaagatcatccatgaggaaagagaaaaatccatgagttagaccttggcaacaggggaagagaaggtgggaaacagggaaaaattctaaagaaaacaaaaacaaaaacaaaaacaaaaaacagccacaacttgaaagctagaagttcaggaggtacaacccacctccaaaaatcatgatgggttaccctgaccccgggaggggcagctctccagcttacaatagacagtgttggagttcttacatctgcaccctgggcgatggatccagtcataacacctcctgcacagcttcaggcatcctttagcaggaggatcacagagtaagccaggtacaatcaagacatggctcccatacacaggtttctagagccgcg

SEQ ID NO: 659760 - DNA, 1941 bp, Homo sapiens
ggcacgaaatatcaaggtctcagatccaaagctttttgaaatgattaagtattaggatattttcattgtctccgaattttagagctgaaaagtgccttagagatcatctagttcaacctctccgttcaaatggagaacctgagccactaagattcacaggagagtattgtcttctaagaactctgaagcaatgtcagacattgagggaagctctcattgctgcaggaaaagagattatatggcatgggcggacaaaagaagaaccagctcattactgtagcatttgtgaagtggaggtttttgatctgctttttgtcactaatgagagtaattcacgaaagacctacatagtacattgccaagattgtgcacgaaaaacaagcggaaacttggaaaactttgtggtgctagaacagtacaaaatggaggacctgatgcaagtctatgaccaatttacattagctcctccattaccatccgcctcatcttgatattgttccatggacattaaatgagaccttttctgctattcaggaaataacccagttctgcaccactggtttttgtagctatctcgtaaggctgctggctgaaaactgtgtctatgcaaccttccaagtgcggagtgtcaaccaactggacgggagagagtactgctcctactccaggactctcacaaagctgatgagctgtacttcagaaaaaaataataatttccatgttttgtatatatctgacaaaactggcaacatcttacagactactgacttgaagacaacctcttttatatttctctatttctgggctgatgaatttgttttcatctgtcttttcccccttcagaattttccttggaaaaaaaatactagcctagctggtcatttctttgtaaggtagttagcaattttaagtctttctttggtcaacttttttttaatgtgaaaagttaggtaagacacttttttactgcttttatgtttttctgtcttgttttgagaccatgatggttacacttttggttcctaaataaaatttaaaaaattaacagccaagtcacaaaggtaatggattgcacatagactaaggaataaacttcagatttgtgatttttgtttctaatcttgatgtaaatttacactatttataaatacatatttattgcttgaaaatatttgtgaatggaatgctgttattttttccagatttacctgccattgaaattttaaggagttctgtaatttcaaacactactcctattacattttctatgtgtaaataaaactgcttagcattgtacagaaacttttattaaaattgtttaatgtttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaaaaaaaaaaaaaaattttggggccttttggccaaattaatttttaaattgaaaaaattttttaatggggcccaaatttgggcttatttggcaaaatccccctaaaggggggggtttaaaaaataaatgggcgggttttaaaaaagttgaaattggaaaaaacctggggtttcccaaattaaaaccctttgaaaaaaaacccttttttccaaagtggggaaaatccaaaaaggcccaaacaaaaggccttttaaaaaaatttggcaaccttaaaggcaaagggaaattgtaaacgttaaatttttggaaaaaaattgggtaaaattttgtaaaaaaagcttttttttaaacaaagggccaaaaatgggaaaaacctttaaaactaaaaaaaatcccccaaaaagggttaaatgttttccacatttgaaaaaaaggcccttttttaaaaaaagggggctctaaatgtaagggggccttttttaagggggaagggccacttctggt

SEQ ID NO: 659761 - DNA, 1228 bp, Homo sapiens
ggcacgaaatatcaaggtctcagatccaaagctttttgaaatgattaagtattaggatattttcattgtctccgaattttagagctgaaaagtgccttagagatcatctagttcaacctctccgttcaaatggagaacctgagccactaagattcacaggagagtattgtcttctaagaactctgaagcaatgtcagacattgagggaagctctcattgctgcaggaaaagagattatatggcatgggcggacaaaagaagaaccagctcattactgtagcatttgtgaagtggaggtttttgatctgctttttgtcactaatgagagtaattcacgaaagacctacatagtacattgccaagattgtgcacgaaaaacaagcggaaacttggaaaactttgtggtgctagaacagtacaaaatggaggacctgatgcaagtctatgaccaatttacattagctcctccattaccatccgcctcatcttgatattgttccatggacattaaatgagaccttttctgctattcaggaaataacccagttctgcaccactggtttttgtagctatctcgtaaggctgctggctgaaaactgtgtctatgcaaccttccaagtgcggagtgtcaaccaactggacgggagagagtactgctcctactccaggactctcacaaagctgatgagctgtacttcagaaaaaaataataatttccatgttttgtatatatctgacaaaactggcaacatcttacagactactgacttgaagacaacctcttttatatttctctatttctgggctgatgaatttgttttcatctgtcttttcccccttcagaattttccttggaaaaaaaatactagcctagctggtcatttctttgtaaggtagttagcaattttaagtctttctttggtcaacttttttttaatgtgaaaagttaggtaagacacttttttactgcttttatgtttttctgtcttgttttgagaccatgatggttacacttttggttcctaaataaaatttaaaaaattaacagcccacatcactaagctcaatcgcgagccatcagtagaccgacggacagacctccagacttgcagagtcctgcagtgtcgaactctagatgatcaccctagtctaatgacacaacgaaggtatacgtaggtcatatctgtgaattcgagactacctgttatacattcccagcacgacctag

SEQ ID NO: 659762 - DNA, 428 bp, Homo sapiens
  misc_feature (57)..(57): n is a, c, g, or t
ctcacaatttgctcagaaggaaattcctagtgaatagatgacagacagaactcaagnttatctctctgaggctcacctgagacaaatgcagatctgtttgtttcctctgccctattgttaattttaaaatgcagattcactgagccaggctaaattgtgtattcagtgggagacttatcaaggactcaaataaatttattattttttctcttatctacttatgacgtggaagccccaacctcaagttttcctgtcttacctgaccacaccaatgtacatcttaaacatgttattgatgtctcttgactttctaaaatgtattagaagactgtaccccaaccaccttgggcacctgtcatcaggacctcctgaggctgtgtcacaggctcctacttaaccttggcagaataaactttccaaatttattg

SEQ ID NO: 659763 - DNA, 327 bp, Homo sapiens
agtcgcaatccgaagcttatctgtcagatatgcatactgaggctaggaacctttctcaagagcaagtgggcttccaaagcgtggaaatggacttgtgcctggagattggaggggtgtggtgattctccggccgggtatagtccagccggacagtcactgcaccagaagatggattccagcccccttgcaaatgtaagaggtgcagcgggccacccccctccgcgccttggggggcagaaacccaaagcggttcaggtttgcgggaccctagagttagagcgatggagacgtgagcgccggaatttagtagtagtagtagtaggcggc

SEQ ID NO: 659764 - DNA, 208 bp, Homo sapiens
gttggtgaaatcgcctttgcatgacaattgatgattcctcatccactgatgaaattacatttccactgaactccccagtccctcaggcaatggccagcagagtgtcagagggcacaactgaatgtgcgagagtcagcatagtgcatttgctgcagggtggaagcttgccacgaggaaggctggcaataaatgtacattattatgtctc

SEQ ID NO: 659765 - DNA, 464 bp, Homo sapiens
ctccaagaggtcttagaggtggaagaggaggaagtggaggaaccagtggacctccctcacggggaggacacatggatgacggtggatattccatgaattttaacatgagttcttccaggggaccactcccagtaaaaagaggaccaccaccaagaagtgggggtcctcctcctaagagatctgcaccttcaggaccagttcgcagtagcagtggaatgggaggaagagctcctgtatcacgtggaagagatagttatggaggtccacctcgaagggaacccgcttgccccctcctcggttaagaaggaattgtttattttgtccccagagagatgcatggcgtaattctaactaaaaggacagcttattcaacgcacgagattacccaagttctcgtgatactaagagattatgcaccaacaccacgagattatacttaccgtgattatggtcattccagttca

SEQ ID NO: 659766 - DNA, 187 bp, Homo sapiens
tacgagatcccccctggtcgctctggtctgtgcccggtcagcctgttccagagtgagctggtacagagatgccaactactgctgctctgcgcttatccactctctccgattcgacaatcgacacagagttaagaagaccattggagggccaccctgcgattccagtccagtgacacttgtgcactgt

SEQ ID NO: 659767 - DNA, 294 bp, Homo sapiens
  misc_feature (30)..(30): n is a, c, g, or t
  misc_feature (39)..(39): n is a, c, g, or t
  misc_feature (59)..(59): n is a, c, g, or t
  misc_feature (77)..(77): n is a, c, g, or t
  misc_feature (261)..(261): n is a, c, g, or t
ccagtctagcttttttggtcttgttttttngtttctganacaggattttgtgtttttcntctgtctcagacagctcngttgcccagactggagtgccagtggcatgatcacagctccactgcagccttgacttgttgggctcaagtgatcctcccacctcagtcttctgagtagctaggaccccatgcatgcaccaccatgcctagctaacattttcgaagagacgggggtctccctttgttgttcaggctggtctcagtnaaactcctgggctcaagcgatccctggtctttg

SEQ ID NO: 659768 - DNA, 209 bp, Homo sapiens
gactctgatgcagtggtccgcgatggacttgagattctagatttcaagcatgctgcaggagatgcaatcctgaggttctataagacactctgaggctggcacggtggctcatgccttatatcccagcactttgggagaccgaggcaggcagatcacctgaggtcaggagttcgagactggcctggccaacattgcaacacggtctctca

SEQ ID NO: 659769 - DNA, 249 bp, Homo sapiens
  misc_feature (161)..(161): n is a, c, g, or t
acctaaacacacaacagtgcagaatccactacacgactacattcagtcttcaaaacaaccaccaccatcaattaggctgccttcagctcaaacacctaatggcacagattatgtagcctcaggaaaatccatccagtaccccgacagtcacataggcactnctgacacgctgacattatggtgataacaatggtggcccccaccagtctgtgttgacatgatatctctaaaggggtacccgagctcgaa

SEQ ID NO: 659770 - DNA, 82 bp, Homo sapiens
ctagaagattcagcaaagtacttttgtgctcttggggatcccacctctggtatactgggggagcttgacagcacaactcttc

SEQ ID NO: 659771 - DNA, 1315 bp, Homo sapiens
ggagagaactagtctcggtttatgattttatatttggcatacaaaaagctttatttccatttggtccaaggctgtgtcaggatagttaagaaagctgcctattggctaggagggagaggcttaggcatgaagccctataactattgcaaggggccttcagaaagtcgctagggctcagaaggctctaaagtacgtagctatgaacagtgagccttatcgaagagatactcgcccaagcccagcctacgcgggaccaacccagaccgtgtgtggaggtttggctccaggtgtggtccacacacaatctctcgtggacataaagctctctcacatctacctcaatactaggaagagtgtgcagttactaccacaggagaagctccacgagaagaaaatgggggggactcacgactgaccgtgacacaaatcaaaccgcgagtggccaattggaaagtaacttccaaaagagggggccccgtggattacaaggacttcttatatacctccagagggggacccaattgtgcacagacaattaacaagtggcacgatcatgggagggtttataaaacccccaaactttccaatttcttctcaggctgtgggacattcacgtgaggacaaggtcacgtgggagaaaaaaagtggcgagcccagcacaacggcgtgggattaagcgacgaacacatacaacggggaagcaccgcgtacgaaaagccccatcgggagcaacaccgactgcggccacaaatgacgagggggcaaaaaaagggtgggctacacaggcctattcacgagaagacccaagtatctactcgagagggtgcgaaacaataggagagcccaagaaagagaagggaagcgtagaaagagaacgagcccatgcagggataccacaacttgggacccaagggacatcgtaacgaacccagactgccccccccacacggatgccggacgcgaacatataacgtacgtggcagagaaactccgtggggagacagcaccaaaggcaagcgagcatgcagcacagaaagtgagcgcgtaaacaccacacaaataaaaaaccgagtctacgtgagaagagttcccccaagacaacgcagaggagaacatgtggcccgaaaacaaagaaatgtgtcccacggagaggagtactgacaacagcgcggaccagaagaacaaactacggagaaggggacggccagccagaaagcgcaccggcaaacaaacaaacgtcccccgcggatatcttgttcccagtccgcacgaaccgcgttcgggtgcacgaccaggaggacagcgaaacccgggg

SEQ ID NO: 659772 - DNA, 726 bp, Homo sapiens
tggtaaaaccccgtctttactcaaagtacaaaaattagccgggtgtggtggtggctgcctgtagtcccagctacttgggaggctgaggcaagagaatcacttgaacccgagaggtggaggttgcgggagccaagattgcgccactgcactccacgcctgggtgacagcgcaagactccatctccaaaaaaaagatgaataacttggcgtaaagacacacaaattagtaagtgtagagtctggtaatggaacatctcagcccatgatcttgactgctttcctgaccatgcgtccagaaacatgtgcccagcaagaagatatcggtctctctggaccctttccaagatgtaacgttctaactaccttggcacagttctgaaattctgcattctggagtaagttggataggaccagcgtacacagccttctctggagccaaccagaacaccagaccaatgcaacataccgctcattctgtgagacaggatagctaaaccttacgatcacaatgggattccagatacacccagtgtgacctgcacaacgccaatcccaacctagccacgaacacagtactacggcggacattgggaaacaaggaagacacccagatcccacaccaaaaaggaccaacccggaatcaagcaatgccggaacacacatagaacgacccgagaagaaaagggggacaggacagcggcaagaggcgcccagagaggccaagagg

SEQ ID NO: 659773 - DNA, 136 bp, Homo sapiens
tataatctgggtcctcaccccttactggaacataagagaattcataccagagagaaaacctacaaaggtgaagaaggtggcaaagcatatagccaggccttcaaaccttactacccatcaagggggtatcgaggta

SEQ ID NO: 659774 - DNA, 459 bp, Homo sapiens
  misc_feature (2)..(2): n is a, c, g, or t
  misc_feature (18)..(20): n is a, c, g, or t
  misc_feature (48)..(48): n is a, c, g, or t
  misc_feature (95)..(95): n is a, c, g, or t
  misc_feature (160)..(160): n is a, c, g, or t
  misc_feature (230)..(230): n is a, c, g, or t
  misc_feature (236)..(236): n is a, c, g, or t
  misc_feature (251)..(251): n is a, c, g, or t
  misc_feature (254)..(256): n is a, c, g, or t
  misc_feature (258)..(258): n is a, c, g, or t
  misc_feature (263)..(264): n is a, c, g, or t
  misc_feature (274)..(274): n is a, c, g, or t
  misc_feature (358)..(358): n is a, c, g, or t
  misc_feature (402)..(402): n is a, c, g, or t
  misc_feature (405)..(405): n is a, c, g, or t
  misc_feature (422)..(422): n is a, c, g, or t
  misc_feature (424)..(424): n is a, c, g, or t
  misc_feature (455)..(456): n is a, c, g, or t
gnctgctctgtatatttnnncccttttataatgtgctttttcacactnctgcaaaccttagttacatcctaggaaaaaatacttcctaaaataanactaaggtatcatccttacccttctctttgtctcacccagaaatatgatgggggggaattacctnccctaacccctccctcaataaatacattactgtactctgggaatttaggcaaaaccttaaatctccaggntttttnaagcacaaaatatanatnnngntgggnnagtaaaccanaattcttcagattgttcctcatgaatatcccccttcctctgaattctccagagtggtacagatgggtagaggcagctcaggtgnattacccagcttgctctcaattcattcctcctcttcctctcaanggntgagggagggcctttcnancctcacaacctgtccttcactagtcctcctnncca

SEQ ID NO: 659775 - DNA, 204 bp, Homo sapiens
  misc_feature (198)..(198): n is a, c, g, or t
atctgaagtgggagaatcgattgaacccgggaagcggaggttacagtgaacggagatagcactactgcactccagcctgggtgacagagtgggaccctgtctcaaaaaaaaattatggcagaggcaaagggagagcagcactttctcttttttattcttttctctcttttttgccacactaaattgtaatgtgttttnacaaac

SEQ ID NO: 659776 - DNA, 166 bp, Homo sapiens
ggccctggatgaggaatgtgaatgtgtatgccatgtctaatggtcatagcagaatggggataataccagtgcagagggagatgcagctttaatttcatggattggatgagtctacatacatgcgcatgcaaaacacacacagtgctgacaaccccgaacacggata

SEQ ID NO: 659777 - DNA, 133 bp, Homo sapiens
tgggctgggatgcagggtgagaaccaggacggagaactggggtcccatgagcccacagagagtaggggacgggctggggctaccagtgcaaaaacctgggtgaggggctctcagcagacacagtctctcccca

SEQ ID NO: 659778 - DNA, 103 bp, Homo sapiens
gctgaagctgccgccgttgcctccgccgccaagagtgagcgagcggacccgcgatggatacatactgaaatgtggatgaagtgttaggtcatgtaatttgctt

SEQ ID NO: 659779 - DNA, 246 bp, Homo sapiens
caggtgtgcgtgattgtgctggtagtccaagctactcaggaggctgaggtgggaggatcgcttgagcctgggaggcataggtgcagtgagccaagattgcgccgttgtactccagcctgggtgacatagtaagaccctgtctcacaatgaaaataaaactaaaaataaaaagaaatacacttaacttttactcttttctttgaattttcatttcgttttatatgtgttctagaatattcattcata

SEQ ID NO: 659780 - DNA, 544 bp, Homo sapiens
tatcccctttcctagtgaagtacctgtgctttctccgacaagcggatgaacacaacccttcacacgaggccctaacgagttccgggcccccagccgcatattctggcggaccgtgctgaggtatgctagccccacaaaaccaagcgaggccaggacgctctggaccgtctcaaggtgtaagacggcatcccaccgacctacgacaaggtgagctatgccaaaccccacaggctgcggccttacctgtggcgtccatgatgtaccgcaacatacctacattgttagatcctcatgaaagcacgcactggctgagccgccaagtccagacgacctccttccctgtctgtccctcccgggctcttacagcccctctctttctctaacagaacaagcggatggtggttcctgatgccctcaaggtcgtgcgtctgacgcctacaagaaaggtgagtcccagcttacgctgcaacatctacttgggagatcacaggactgctgacggacctggggacatggagcctggcagctgatgtacttatctcag

SEQ ID NO: 659781 - DNA, 375 bp, Homo sapiens
  misc_feature (277)..(277): n is a, c, g, or t
  misc_feature (374)..(374): n is a, c, g, or t
tttcgagcccgggctgagcgcggttccttgcgaaatgcgcgacaactgcacgtagcggaagccatcggtactgggaccattcggccatcagcgcctcggtgccatcggtgctgccgtcatcggcgacgatgatctcccagccggtgcacaacgccgacagccggctgcgcagcagtggcagcagcacgcgcaggttctcgcattcattcaggcacggaatgacgcaggtgacgcaggcgtcgtagggcacgttggcggcggccgtcccccagaccgnttccacgggaaacgctttggtcaggacttgctgcccctggggctccggacccggaattggatatgcatggtgctctgaaattggaatgcgggacgtna

SEQ ID NO: 659782 - DNA, 819 bp, Homo sapiens
tggtcaaatgatcctttattgaaatgtttccctttgtgctaaactgggctgggcttcccacagccccactgtggattgtcatcgatgatgtcatgaggatgggggccatcaacattacatgcccactggactggggcagtccccaggatctctttaatgggtcaccaagagagttctcgggctaaggtgatctggtgccgcatctagtcgagcaatggtttgacaatctcatcaaaaggtagatatctcccactggtgtaaatggttttctctggtttcttatcgtggtctactagggtgggttccctatgaagagcgctctatggtgacttggatcacggggcaggatgtgcatagatacgtgcgccccaccctgcaatcgtgggggcctagttacttgtatcatagaatggtgtcaatgtatctcacttgcgtaaatgcctacagggctctcttccaatgtccaccctgttttgctcttgtggtcaatgtgctcatacacccaaacactattctcttgtggggacagaacaggaaacccaggggagcgccagaatcttaggaggggcgcccagggtggcagagcacatgtgagggaccgctggactttacacctctcgcggtgtgtggcaaccccttacaagtgtatataccggacttttgtggaattctacgatgtggcggtgctccagacacttatcgggacgcgctataggcgttcgcaacggctgctgatctggatatgtcgggtatagaaaaccctcgggaattatcctggagacagcgaaccccggaaaggagatatgtctcgcccacttg

SEQ ID NO: 659783 - DNA, 320 bp, Homo sapiens
gtgatcgtgtcaccatgatcgacctcatcgaacgtcgtccgtgcatgctcctggactcgagttagatacatgctcgggtgtcactctggaagctcaacggtcttctcatcacttatcacctgggaacaaccactccctccccactttgtagccagcagcctttggggaaggtgggcactcgtgattactgtgcctggaagaatgtcctataatcctggcgtctggctgctcaaaaaacagtgtccccttcccatctaagctgccgcagccttgagaccttggtttacccagtgcaaaaccgcccatgatgatccagttga

SEQ ID NO: 659784 - DNA, 214 bp, Homo sapiens
taaacgaggtggcggtcatgctttggctctcctagaaaagttatatctctcgatatcccataatgtcagatggaataggggttatgaatcctgtatactatcacgatcggtcatatgcttatacaaatatctcagccgtaggtactcaatcatctatcgggcacaggctataaatcacctaattgaaatcattccatcacacctgacatacaaa

SEQ ID NO: 659785 - DNA, 209 bp, Homo sapiens
cagcgctaatgtgaagcatgcattttctcagaaataaaagacatcttcctaaacaaacacaaaaccattatcacaactggagaagttaacagttctctaacatcatctaatatctacccatattcaaattttctcaaatgtccccaagatgtctcatgctttctaaaatcaggatccaaagattatacattgcatttgatttgttgcta

SEQ ID NO: 659786 - DNA, 207 bp, Homo sapiens
gaccgggaggtgacccctgaccagaactgctgtccaggcgactcctgaccaagacacaggatgccacggttgggccgagcgactatttcctgccaatgttgctaactcggtgtacgtcctggaggactctatttgtggacccacagattcagaccatgactacctacacctggaacataacccacgcccgcctgatggtggtggagg

SEQ ID NO: 659787 - DNA, 166 bp, Homo sapiens
tatgcgttctatggtgctgctgatcaggcttgatctcgcttatgggttctagatatttcttgttcatcagaactctctgccctgtgtcagattcactacaaagacatcaggcatgatgtcatggatccttgcttgaagaaacttcaggaaataaaagcccatgggc

SEQ ID NO: 659788 - DNA, 1763 bp, Homo sapiens
gtgggggtgtgcagtacagaccatcgtgggtttcgtggtctgtgtcgcgctcgagcatgctgtcgtagtgggctcgtgggtgtcccgcgtgctctgttgtgtgccgcaccacagtggggggcctccccttcgcagcgcagccggcggtgttcgtcccttcgaggaggtagtctcgtgttgggggctcggcgcccccttctgctgtggtttggttggtcccctccttcctctgagttggtggtgttctctccccccgcccccagccgccaacatttgggggggggggctatcatatctctatggggggggttctaccctcacggggggtgttccctccctcggtggggtcccccagcccgattttgtgggcccccgcctcgtaggtgggtctgtggtgctgccgtgtgtgtggcccacccggcgtcgtcctccctcccccgggtggacacgggggggcttctcttttttcgtggggtggcccattgggggtgtctctttcctccccccggggagtggtgtgcctccttggggggttgttggtggggtctccccaccgacgggcggttgtgtcaccggcgccattttgctagtggcgccgaccacatttgggtggggctctacctgccgtgcttcctgctggagggggggcgcaatgtagtacacacctggggcgggccacgcggtgttggtccgacacgcgtcgtcttttcgcggcgcccgttgcttgcacacacgcgggggcgtcctcccgcgcgacgacacactgggctctttgtgagggcgcgcgccccctctttctctcgcgcgccccgcgcgcgcgccccccagagtgaccccctctcggggcgacactcctcctcgctctctgtgggagatatgctcgccccatccacggaggggtttttccaaacggaggcgggggcgcgtctctcccctctgttccagcacacgctctgctctctccctctgtgtgtgtgtccctctctgcgaggcggggacacgcacgggtgcgccccgcgcgtgcgcagcacagcgcacacgcgcgcgtgtgggctactcctcgtgtgtgtgtcgctacgctacccgcgccccacacacagcacgtcttgtgtgtgtggctgcgctgcggggcgtctgctccctgctgatgagcccccacccccgccgcgtgttgtgctgctccgcagcagcagcagtgttgagtactacccctctgcgcacgctgtgctctatactcggctggtgctactctgctgcgcgtgagcgcgcgcggggggcagagagagggctccagcgaggagacacgcgcgccgcgagtgtgtgccacccacggtgctctgcccgcagagacacagagagttgcgcgagagcacgctctctctagagaagagacacgattctcgcgcgcagcgcgcgcgcgaggctcttgggagtgtatctaattggtagaggagagagagaggcgtggtaagagaagagaaagacacagagaggattataagtctctatacacacacacccacacactgtgtgacaccgccaccctctctttcttctgcgaggccacagggactttgtggtggggcgccagacaccacccaccgcgcactctcctttgagcgctttgtggcacaccatacatggttgtgatccctggagcacacctagctttgcaccaagggaacccagttattttttccccctgactggccccataggacgccaccacccacacactctctaaaaccaaaaccaccaggacc

SEQ ID NO: 659789 - DNA, 345 bp, Homo sapiens
tggatttcgcgtacaggcgacaagagaaaacatagataagtaaacttcatcaaactttaaaacttttagctaggaatggtgatgtgcacctgtagttccagcaatgcgggaggctgaggcaggaggatcgcttgagcccaggagtttgggactagcctgggcgacacagcaaaaccccatctctaaaaaatgagagtggcaaaggccttgagatgtttccctaaagaaggtgtacatgtggccagcaagcacctgaaaagatgctcaccatcactatcgttacggaaatgcaaatcaaaactacagtgagggcaggcacagtggctcatgcctataatcctagca

SEQ ID NO: 659790 - DNA, 203 bp, Homo sapiens
gggatcttatcgatccgctgatccagcacctacctggtcctgggctctgtcaggcgcccagctacggcgcccggccggtcagcagcgcggccagcgtctatgcatggcgctgggggctctggttccctggatctccgtgtcccggctccaccatgcttcagggtgcggcatggtggtccggggggcctggccaccgtggatag

SEQ ID NO: 659791 - DNA, 144 bp, Homo sapiens
ctgaggatcccgccacctacacacatttcaccactatccctgacttcaatggcccgcccagccactaaggttcggcttttctgcccagctgtccgtctcttccttggtctgggtgtcccaggcaccgccacggtataaggtggg

SEQ ID NO: 659792 - DNA, 139 bp, Homo sapiens
gggggggggaacccccccccccccccccttttttttaaaaaaaaagggccttgggatgggtgggggggttcccccccccaaaaagggggtttaaaaattttttcccctgggcctcccaaaaaaaaaacccctgggttta

SEQ ID NO: 659793 - DNA, 521 bp, Homo sapiens
ctttttgtggtgtgaataaatcttttatcttgaatgtaaaaaaaaaaaaaaaaaaaaaaaaaaaaaaaaaaaaaaaaagggggggccccccaaaatttccccccgggggccccaatttccctacccctttttttgtttcaagggggcccctataggagagctccgttatttaaagcctaggcaccggagccgccgcgttttaaccaagcttccgtgattgtggggaaaacagcggctcaacactgggagaattcttgggagaagggaaccacttatcttgcgtgggggggtgcaccatatttgggaacacaaatctaccctagcagagagattttataaggccgctaaagggggaaaatatttaacaattttttaaaggtgtgattatggtgtgtgtgttaaaaacaatagcggtgacaatattgcctggcggtcttgagaaaatttgtggcttatagcggggtatttagattatttgaaaatattttttattacacaggagactagtgataaaaagaagt

SEQ ID NO: 659794 - DNA, 871 bp, Homo sapiens
gggatggaaatgtcacccgtaggtatggcaatgccagtggaacatgctgttgaggctctggaatgatcctaccaccaattcgtccaagtgacaatgcccttgggcttgcctctccaggatgtctacaaaatgtgggtggtattggaactgtcctgttgccgatgtggaagactggtgtctcaaaaccggggtatggtgggtcaccttttgctcacagtcaactgtttacaacggggacgttaacacaaatcttgtcggaaatgcacccattgaaagctttggagtgaagctcttcccgggggacaaattgtgggggctccactggtcaaggaattgtgtcttgtgcaagggaattggtccggtccggtggggcaaagcgttgggctcgggttgcacagggcaagaaaaatggaccccacccaagttgggaaaggccagctggccttccaaactggctacagcgtgatatatccttgaaaccaataccaggccaaaataaagcggccgggtaattccccttgttatttgggatttgcgccacgagggggttcaacatttgtccttggcacgtttggcgtgggcgtggacgggcaaaaaaggtatggatcggcgcgtcctggtaacaacacgcttggagaattgggccctagaattctttgacagttctggtgtatgcctgcaattggttggatatgggttcccttggcacagcccatggtgtgttgagagcttctcaggactatccaaccttggggtcgcttggcggtcgtgatatgacaccgacagtggcggtggggtgtcatccaaggctgggccacaacaggctgttggcactgggacgtccaccaagttttgccaaaagcagaaggta

SEQ ID NO: 659795 - DNA, 1548 bp, Homo sapiens
  misc_feature (990)..(990): n is a, c, g, or t
  misc_feature (1055)..(1055): n is a, c, g, or t
  misc_feature (1059)..(1059): n is a, c, g, or t
  misc_feature (1064)..(1064): n is a, c, g, or t
  misc_feature (1068)..(1068): n is a, c, g, or t
  misc_feature (1080)..(1081): n is a, c, g, or t
  misc_feature (1087)..(1087): n is a, c, g, or t
  misc_feature (1089)..(1089): n is a, c, g, or t
  misc_feature (1099)..(1100): n is a, c, g, or t
  misc_feature (1102)..(1102): n is a, c, g, or t
  misc_feature (1114)..(1115): n is a, c, g, or t
  misc_feature (1121)..(1121): n is a, c, g, or t
  misc_feature (1135)..(1135): n is a, c, g, or t
ctgcctcgacccatcaattacttagctcgcgtctcatcttatatttggcgttactacacgaggagagtaattttattaagagaaccaacagtgcagaaaaaacagtcgtggtgtgtagcttatattttaatcgccgcctttatatgcaccacagaagtggggctttgtttgtctattatcccctactaaggaggtgttctctgttggtggttcgctcccgctccgatgaagccccccccgcttggggtgttacatgaagggcggcgattatattcctccttgggttaaaaggcggtgttgttttcgatacgaccgcaagaccacacgcttccccccgggggttgtcttctcgggtagtgagggagccccctcgtctctcctaattttgtggtcgccagatagcgtggcttcttttttgtggtgtgtggtttggggtcattccctctttggaacctctgcgcttttgggccccacggtgtctacttagggagaaaccaccaggggccttgggtttgaaaacgtgtgttgctcgccttataacaaatgtttgcccgaccccagagtggtgtccacgattgtgcccacattgcaccttgtgagccggggaaccaggaagtgtctttggccttttgggggtgaaacaacagagaattttgtgtgcctaaccacacaagggttatgttctccgcccctgggcaacagtgttatagacgcttttgtggtgccttcgctcgctgtgatatccttcggcttgttctgggagttctcgcgcctgtccccacagaacacacagggcgccattatatgtagatagccacggcgttatatccacggcgtatccccacttgagagggctcgggagattttggggtccacagtactttcgtttgagaggtttcgctgagactattttgggcaccacagttatcagagtgttcctagagacctctcgatatagccttggcccacacttcacaacacaactctttncgagagttcgcttgggcgctgtgcagtgttatgaacctggagagttctgccttgagacacccacnaagngagcnacgntatatttcttcnncacatngngctatattgnnangagacacacacnngtgggncgtgtatatatatnatatagcggggtgttataaggggggagatatattctctgagatataacactggaggccccacgcacaagagttatcacaaaggtttgaggaaatgcctttctcttgtcttcacatgttctgtcaagccacgcacccacaagtcccttgtttgtggcacactatatcacgggctgaatggagaaagagatctcacagagacacatcacgatgccaagctgagaaagaggagttgtaaccaaattttcttggctggagatttgaaagcttaaaactcctgtggagttcaccactcacaaataccacgttcacgttttgtcacttgttttagtaaattagttccatttgtaaaagggttactttcatactccttatgtacagaaatcacatgaaaaataaaggttccataaagcca

SEQ ID NO: 659796 - DNA, 124 bp, Homo sapiens
acgggggggaatttaaagggggaggtttaagggggatttttttcaaaggccagatttcctcgggttggggtatatttccggttcccccccgggggggtttttgttaggccctcccctcccccca

SEQ ID NO: 659797 - DNA, 657 bp, Homo sapiens
  misc_feature (334)..(334): n is a, c, g, or t
aagcatggtatcaacccagagtgccattactggcggggttcattgggacattggaaagttcacaattaatgcaaaattttcgttggaaggccggttaaagaaaccgtttttaaagtttaacttttatttcgcttaaatttgttccaaaaatttaccattaaccaaattttctttttgaacggaacattaaaagttgtgtgggaacacctttgtggccacgaaccaccgttggcgttttgtgtagactcccacacaaacaaccccaaggtcgcactaaagggtcggacaacttttgtggagcctttgggaggggttaccccacacgggtcccccnttttttttcaaaccacagggggcttttgggccccacaaaggattttcacattttttcgttaatttttgacagcaacattttgaactttaaaaacgggcgggacaacaacaaacctttaagggcaaacacaacagaagggaacaactttacaccgacggggtttttctcaacaaacgccccccccttttttgtgggtctgcttctcaaacaaacagaggtggggagttccccaagaagcaaacaactttgcggggctttcggtcaacaacagccacgtgggacaacctacaagggggacgacaacggcgtctttacacattctt

SEQ ID NO: 659798 - DNA, 811 bp, Homo sapiens
ggctcagcatttggggacgctctcagactctcggagcacggtccagcttccttgcaaaatgtctactgtacacgaaatcctgtgcaagctcagtgttggagggtgatcactctacacccccaagtgcttatggcgtctgtcaaagcctatactaactttgaactgctgagtcgggaatgctgtgaatcggttgataacagccatcgagaagaccagaacagtgtgtgtaatgaggtcaccgattgtacaactacttgtgtagccacaaccgtcagcacatgcacaagagacagggatatagccttcgcctagcaaagtaagaggacctccatagcaggcaacttgcaatctagctactgacagtcaagccttatcatggctcgaccatgagtagcacggagtgaatcttggggacctattggaacgtacaccattgcgtcaagtgtatgaacgcgttcgtgaagtcctacaagcttccaatggaagggggcttggggatcccgaatgagtgactctctcatttgagatcactctgctccagaaaataaccaggagtctgccaggaaaacttaaccagagttcgtacctaaggacatatgtgaccaatgacctgctcctggggggacagtgaccatttaattttcgtgacactagtctggttgaacttccagtaaagcctagatggttctggccctgggcgaagcggtacaagatgagtccagagggatggggtctagacattctgacttactcgaactggattgaccaaagatgcttcggagatcttcttatgaccgcttgggaagtgaaa

SEQ ID NO: 659799 - DNA, 1433 bp, Homo sapiens
agggaggaagaggagggcatctcgacatggagtcctcgagaggagcgagcagtgaccccatgcgtgccgccttgctcctcactggaggaagaagattcacttcgtgggactggacatggctttgctccagatcaacagctggacaaaagaagaaattaactcaaaagagaagaaagacaactaaagaacacgaacagacaggatacagatgaagtacccaagtaaatcaatagaaagagaagaagaagagagaaggtagaagtaggagagagaagtacaaacaaagaagaaagatagagaaaaggcataagaaggaggaggagacaacgaaatagacagtaatggagatatatgcatagtcaaagaaagaagtaatacagcagaatagtgagcaaagatagaattagaccaaaaataatcgctgctagatagagaaaaaaaagaaaaaaaagaaaagtagaaaaaaaaaataagaaaatgtaagaaataaaaacaaaagggaaaaacaaatattaaaacaacaaaaaagagaagaaataaaaaggaaagaggaaatgaagtagtaaataaaagagaaaaaacacaaaaaggaagaagtaagaagtaaaagaggtaaaaaaaacaaaaataaggaaggaagaggtgagccgagaggaagcgaagaagaacgaaccaagcaagaggagggggcacacaaaaagacacgagatgggggaagaaacaaacgacagagacgagacagaagaaaacagaacatgaaacaaaacagcagacagcgaagagaacaggggagacgacaaaaatgactgaacagcgaagatggcaaacaaacacaaaaagagagcaggacaggagacaaaaacaagaagaaagacacaaaaagagagacagaacgagacgacgaggacagggcaaagcaagagacagagaaacagagaaacaacaaacacaagacacgtaagacaagcaatcgtagaaggagaggaaagaggagacaaggaggagaggaagaggagaagaggagaaacagaaacaaagagagaagaggacaaagcaacgagcacgagacgcacaccaaacaggtacaaaaaacaagagcagagaggcgaggaagacaagacagaagacagagcgcagcagaaagataggagacacgaaagagcagagaaggcggcaaggcagcggtagagtagaaagagagagcaggaacaagacagtcgcgcgaactacacggaaaaaacagcaacaagacaaggcacaaggagagaagaagagaacgcgaaaagcagcgaagagagagcagcgccgagaggaggcccgaagcaaacacccagccacgacgcagacaaacaagcaagaaacagaagacagccacagagggcagagagaaactagaagaaaggacaaagaagaaacacaatcacagaagcaga

SEQ ID NO: 659800 - DNA, 210 bp, Homo sapiens
aaactattttatgtttgacgcataaaacttcaaagtattttgtaagtatcactcccgaaattttctttctcttatatactttatgctcttactatactactgatgtaattaaaagagcagggttaaaaataattagtatatgtattcattgtgaatcctgtagcttttctagttcacaaaaaatctctttctaaaataactcttaatccc

SEQ ID NO: 659801 - DNA, 312 bp, Homo sapiens
tctggcatatttatcaacgatggcaaaaatcacacaacttctaaacagcgcacaaaaatatttacatttgagccatttacccactttttaatgaccatcaccatgaagaacagaaccctcagactgaattaaaatcgactttttttttatctatttagatctatagcgatctttggtgagtgctggtcctaccaaatcttggccagatttgcaaaggctttcccttaggaacccatccttactccagctaatcttccaggcaaggcaaggatttccaaaggccttcataaaagtttggcctcctggaatatt

SEQ ID NO: 659802 - DNA, 287 bp, Homo sapiens
cggaccggatgtgtgtatggccagctgtcgtgaattcgatgccatttcctgtatttctgttactgatgcggtaggtacatcaatgctaatcacccatgctttcctttgatgaaaaaccattcccttcagtttggaatcaagtctcctcggcccagctgctcttgagtgttctttccaagcataagctaatatttggcatttcaatttgagcacttgcaagatcatggtcacaaatacccacgagtttgacttgatcaaggagctctggcctacatcacatgccgtgt

SEQ ID NO: 659803 - DNA, 438 bp, Homo sapiens
cggctcgatcacagagaaggtataatcatcagttactacctaatatcctgtagaatcagcagcactaggagtctccagatctgtttctcagctctgtgtagcaagccaggctggctctcgtgcattactgtctatgggtgtggaatgtacgtcatagcttgttcctggtgttaaaacagatgggctaactcctcatgtctagtcatgctggcagggctttccccacatccatgcttttgaaattagtgtgagtgtacaggtttgtgtgtgcatgtatacgtgtgtgtgcacaggaagcatttccacttgagggaaatcctgccccatcatgcctacctccacaatgaaatcactcgttttttggtgtttgctcgcctaactgacttgaaccccattttatttatttagtttttttctcatggcaaagtagaatacgta

SEQ ID NO: 659804 - DNA, 596 bp, Homo sapiens
cctcttcatcgccttgccctcgcctgctccgacgcactagtgttaaagtgagcgcaagaaggcagccaacttccgccacgagacttttacgtttccacgcgctaccgctctggctggcattggcgtagtgtaccacgtagcctaccgctcggcctgcacagctggcttgccatcagtccctgtcgccacctggtccttcatgaagaagcacgacacttagaggctggtcgggaatagtgggagagtcgccacctgaggaggagcaggccgttgagttccaagccagagttcccgtccctggcgcctggagtgcacaacacgcccagtctggcaccataggttgcgactgagaaatgccaaccctgtcttatagatcatctcgggtccccaccttagaagggtccccgccttagatcaatcagcgtggacactaacggcacgttttagagtctcttgtcttaatgattatgtccatccgtccgtccgtccatttgtgttttctgcgtcgtgtcattggatataatcctcagaaataatgcacactagcctctgactagccatgaaggctaaaattccgttacatgtgggttacgtgg

SEQ ID NO: 659805 - DNA, 678 bp, Homo sapiens
ggaggcaaggccgaggataaggagtggatgcccgtcaccaagtggggccgtcttggtcaaggacatgaagatcaagtccctggaggagatctatcgtctatctaccctgcccagttaatggaatcagagatcattgatttcttcctggtgggcctctctccgaaggatcggaggtttatgaagattatgccaggtgcagaagcgaggacccgatgccggaccatgcgcaccaggtgcaaggcggtatgttgctatcggggactacaatggccacgtcggtctgggtgtaagtgctccaaggaggtgggccatggtccatccgggggggccatcatcctgggccaagctctctcatctgtgacccggtgcgcagagagctacttgggggaacaacgatcggccaatgccccatatcttgtcgccttgcaagggtgacgtggccgtaagagggctctgtgcttggtactggcctcatccctgcacccagggtgcgcatggtcatcgtctgcgaacctgtgcctaagaagctgctcaaagatggctgggatcgaggactgtacaccatcaagcccggggctgtatgcaacctgggcaaatacgcaaggcaccttagatgccatttctaagactaaaggtactgacccgactctgggaggagatgtatcacaagttccttta

SEQ ID NO: 659806 - DNA, 337 bp, Homo sapiens
cgactaccttcctctactacccgttctgtatttccttcaccttcagccagcacctcagcaggtcttggctcttttcctggaggattgacccataccttcattcctgatgggtctgcgtcctttgtcatcctgcttggattaggctgttgtagtttcccattgactttaatcacaggacatggtagtactaagagacgccctaagggatctcctgcactccagacataatcttgcttaccaccattgtgaagaggtaatccaatttccccatggtaatctggatctatcacccctcctaacactgttattccttttttagcctgttggttgtcgacgc

SEQ ID NO: 659807 - DNA, 541 bp, Homo sapiens
aggagcagagtcttgcccagtctcatccctctgagacatctcggacattgggacgtggactgtcgtatcgtcactggaaagagctcagacatggccgacgctgcgggaagagtcatacacctcgagagctcgaggacatcgagcggagaccagcgaacggtagcggacccacacacacagggatccagaggatcctctcgagagctctcgacaggcccagagccgctaccgaggatcgaagagacgtcacgtctcccctatcatagtacaacttccagagagagaccctttcaggctggggagacatgatattagctgagactggcggagggagcacacgcgaactctaagaaagtcatacagcgctgaacaaccttcgaactactcgaggtacgtaccacgggggagcgcaccgaccggcaagacgggggggcacagatcccccggcaagacactgaagaggtccaccgcgcagcagacactgccgcaggagccagccaaggagaccacgagcacgaaagcacacaagggacgcacacaa

SEQ ID NO: 659808 - DNA, 975 bp, Homo sapiens
gggctgcacgggccagtttccttcaaaagtgtctacgtgtgtcacgaaatcctgtgcaagctcagcttggagggtgatcactctacacgcctccaagtgcatatgggtctgtcaaagcctatagctaactttgatgctgagcgggatgctctgaacatcgaaagcagccatcaagaccaaaggtgtggcatgaggtcaccagttgtcgaacatgttgaccgaaccgcaggaagtgcacagagacaggatattgccgttcgcctaccagagaaggaccaggaaggaacttgcagtcaagcacgtgaagtcagccttatctggccagctggagcacggggattctgggcctattgaagacacctgctcagatatgacgcttctgcagctcaaaagcttccatgaaggggctgggcaaccgcacgaggacctctctcattgagatcatctgctccagaagacaagcaggagctgcaggaaacttaacagagtctacaacggacactgtccaagactgatctggagacggaccattattatacggacacatctgggtgactttccgcaagactgactggttgccctggcaaacgggggtagaagagccagaggatcggctctgtcatttgatgatgaacgtgattgcaccaaggcatgctcgggatctctatgacgctgggagtgacgccggaaaggcactgctgttcccaaagtgggcatcagcatcatcgcacgagcggagcgtgcccacctccagaaaaggacaagacaagggtcacagaggagtcacaagggccgtcgatgcacagtggacgggaaacagccttacaggacaacgaggttagaacggaagcacctggaaaacaggcatacccgtaacaccggggcacaactgaggaacaagaacaagacccgggattaagcggaacgaatgcatacagccatgaagcgcaagggagaggaaatacggacagaccc

SEQ ID NO: 659809 - DNA, 483 bp, Homo sapiens
gaacatttttgccggtcatggtagctcacacctgtaatctcagtgctttgagaggctgaggtgggaggattgcttgaggccgggagttcaagatcagcctgggcaatgtggcgagaccctgtctccacaaaaaataatcagaaaaattagccaggcattggggtgcatgcctgtagtcccagctgctaagaaagctgaggcaggaggatcacttgaggccagaagttggagggtagagtgagttaggatggtgccactgcacggcagcctgggtgacagaaccactgtgtctggcccaactggattgcatcctccacctcccgagttcaagcggttctctgcctcagcctcccgagtagctgggattacaggcgcccaccaccacacccagctatttgtttttttatttttatttttagtggagacagggtttcgccatcatggccgggctgatcttgaactcccgatctcgtgatccacctg

SEQ ID NO: 659810 - DNA, 374 bp, Homo sapiens
  misc_feature (44)..(44): n is a, c, g, or t
  misc_feature (50)..(50): n is a, c, g, or t
  misc_feature (210)..(210): n is a, c, g, or t
  misc_feature (264)..(265): n is a, c, g, or t
taagtttcccccgggtggcaggacgtccagcatattttgctctngctaantgggagcaaaagcgacgggcagggagatagcgtcagtgagtttgtcatttttatagtcggaccatactgttgatttcagcgcagagtcatattttcctgtctgcaacatatcctggtaaacaataatcgctttctgatgtccttttgcagccacaaaacnagtgcctgcatccagttcatattctcagcactggcaacatcctcgttctcattnntatctttgtttttgttacaagtcagaggcttttgcctgtccgggataccagagaatgtggaaacagtataatattttcgcatctcctcctgcataatggtttccggtgc

SEQ ID NO: 659811 - DNA, 413 bp, Homo sapiens
cgtcgacaggatattgactgtgccatgggatagctctaagattgctaccatcattcactgtgaggaaaatttctgaggtagtgaagaaggcttcctcggtggcagtttcctctttaaagtagggactgtgggagagaaaatgtcataggcatatttctttgtccaacattttaatgtgattgtgtagaaaacgaacgtattaagatctcctctgctccatcagtaagtataaaggtgtgaagtgtgaggttaaggtacaagggttgcagcatagttaatgggcactatagagtaagacacatgtgagttgagatcccagcctagtcatctcttaggcggcccaaggcaaaaacaaaaacaaaaacaaaaacaaagcaacaatatcgatgtcgagcgatcgcgcgcgtcgacgc

SEQ ID NO: 659812 - DNA, 740 bp, Homo sapiens
  misc_feature (18)..(18): n is a, c, g, or t
  misc_feature (97)..(97): n is a, c, g, or t
  misc_feature (102)..(102): n is a, c, g, or t
  misc_feature (104)..(104): n is a, c, g, or t
  misc_feature (124)..(125): n is a, c, g, or t
  misc_feature (149)..(149): n is a, c, g, or t
  misc_feature (210)..(210): n is a, c, g, or t
  misc_feature (264)..(264): n is a, c, g, or t
  misc_feature (273)..(273): n is a, c, g, or t
  misc_feature (300)..(300): n is a, c, g, or t
  misc_feature (303)..(303): n is a, c, g, or t
  misc_feature (369)..(369): n is a, c, g, or t
  misc_feature (393)..(393): n is a, c, g, or t
  misc_feature (564)..(564): n is a, c, g, or t
  misc_feature (566)..(566): n is a, c, g, or t
  misc_feature (591)..(591): n is a, c, g, or t
  misc_feature (609)..(609): n is a, c, g, or t
  misc_feature (620)..(620): n is a, c, g, or t
  misc_feature (650)..(650): n is a, c, g, or t
  misc_feature (656)..(656): n is a, c, g, or t
  misc_feature (666)..(666): n is a, c, g, or t
  misc_feature (704)..(704): n is a, c, g, or t
gggggcacgaaggcgcancattcaaaaaaaaacaaaataaaaaagtatgaaggcgaagattaaaaaaattttgcataacataatttacacgaaagcnatgcnancacctcccctgtgtggactnnggagaggactgggccattctcctnagagagaagtggggtggctttgaggatggcaagggactccctgtgacaatgcatctcaaanttggaatgactatcaaaaaaacaacaatgtgcaaccaaagtcctcggccacatngtgaacctngggggatgcccgccccaaccgactccngtnaccttcaccgtcccagtttttaaatcctgagttaagccaaaaaaaaaaaaaaaaccaaaacaaaanaaaaaaaacaaataaagccatgcnaatctcacctggtttcctgcgcaagtaaggttttgtcaagaaagggtgtaacgcaactaagtaaaagtccgcctagaagcatttgcgggggacgagggaggggccggactcgtcaaactcctgcttgcggacccacacctgcgggaagtgtggacagcgaggccaggttgnanctgccgatccacacggtgtactctncgcccaggtggagcaatnttcttgatctncattgtccggggtgctagggcagttatctncttctngcatcctgtnggcaatcccagggtacatggtggtgccgccagaaagcncttttttggcgtacaggtctttgcggatgtccacgt

SEQ ID NO: 659813 - DNA, 165 bp, Homo sapiens
caataatgtgcaacacatgatccatctgatttggtcacaaactctgctaaacacaattctctacgttcactgttcccaagggtcattctaaacagtggtggcaccaccccttcagaagcaagagaaaaagaaaaaaggcaaataacatgcagaaggccagccagg

SEQ ID NO: 659814 - DNA, 92 bp, Homo sapiens
ggcttttttaaaaaaaaatttggtttctattttaaaaacctgggttaggccaaggtttggggttcgcccttttttgaccccttggcccttca

SEQ ID NO: 659815 - DNA, 135 bp, Homo sapiens
ggatgggcccctggggggttttggtttttacttttttaaggtaagtcccagtctttgtaattaattattgaattgtgagaacatttttgaccaatttccctgtcaataaagcagaagacggcagttttaaagtta

SEQ ID NO: 659816 - DNA, 559 bp, Homo sapiens
  misc_feature (10)..(10): n is a, c, g, or t
  misc_feature (24)..(24): n is a, c, g, or t
  misc_feature (491)..(491): n is a, c, g, or t
  misc_feature (505)..(505): n is a, c, g, or t
  misc_feature (518)..(518): n is a, c, g, or t
cccctgcccnaatgattgaagtcnaaccccaggcccaatgtaaatcaaaaaccccccagatgtggaagccccccaggtgaaacttcccccggtcggtgaataacacatcaaatgtgcctgaaaaggatggtgccgccctgaagggacacagaagtgtcatctgtgggacgctcctcagagtttcccactatgcgtctctgcttttgtcccggtccttaacttttgtcagtgtttttccttatgtaaaactgtagtgaaagtatcatgcttggtcgagaacagtggctcatgctggtaatcccagcacttgggagaccgaggtgggaagatcacctgaggtcgagggttcgatgccagcctggccaatatggtaaaaccccctgtgtctactaaaaatacagaaattagctgggggtgatcacttgtaatcccagctactcgggaggctgaggcaagagaatcgcttgaatccgggaggcagaggttgcacntgagccgagatcantgccacctgcacntccatcctgggcgacagagcgagactccacaaataaaaaaa

SEQ ID NO: 659817 - DNA, 434 bp, Homo sapiens
  misc_feature (28)..(28): n is a, c, g, or t
  misc_feature (63)..(64): n is a, c, g, or t
  misc_feature (289)..(289): n is a, c, g, or t
  misc_feature (371)..(371): n is a, c, g, or t
gaagaatggagagctaaagagccttcgnagaaggtcaagccgatctgacagccaggtgcgcanntgcgggagaagctggacgagctgaggagagcgagtctcccctacctcccctacctaagtggcctgctgccccccagccacgagcctcccaagctgaatccagtggtggagccgttgtcctggatgctgggtacctggctgtcagacccgccagaagttggtacctttacgacactgcagcccttccaagtacctggaaggaaggtgcacatctcccacgtgggtnagcctatgctcaacttctcgttcaactccttccatccagaaacacacaagccaatgcacagagagtgtggcttcatccgcanaaagcctgacaccaacaaaatggcctttgtcagtgcccagaacacaggggattgtggaagtaa

SEQ ID NO: 659818 - DNA, 475 bp, Homo sapiens
tctcgcctgtagtcccaacactttgggaggccaaggtgggaggattgcttgaggccgggagtttgacaccagcctgggcaacatcatgagacctccatgtctacaaaaataaaaaataaagagggaaactggctcctgattctaagaggaatttatcatgtggacagtatctatgtacaatccgtgaacagagcattgagtctgtaggggctggaccacctgcaattcaagagtcctcctcatgctgattcctttgggtctgacctcctgccacatcacaccctcctgcttgttgccctcctcctggactgcccttccttctctgcccattgcctcctacattccaaagaccagctgggacctgtcattccttcttcaaagcctttaattcccaagcagaattacctgctttctccctgaactcccagatcactgttatcaaagacataacattgtattattcaaaaaaaaaaaa

SEQ ID NO: 659819 - DNA, 110 bp, Homo sapiens
gcatgggccgcgcagattcagccatcataaaggtgggccataacggcaaaagctcaccttcaggagaaaaacgatgacgatcaaagttcggtgacaacgctgcgcgggac

SEQ ID NO: 659820 - DNA, 495 bp, Homo sapiens
gattttctcactaagcacactctggtctcttctccacccctgaaacagtccctgcaaaggtagagtgacgaatctgatctgtaaattcagggagaataattgggcatgcttagctcagcccatacggtccacttgacgacaggccatgaagatactgagttcttttctactcttccatgtatggtttctcacttgggaagccaccttgcccagtgactgctggtgattctgcctcattctggggtttggttgacagctccacacaccttcactctaagttaccacctccaacctggcctctatcagtaattaacatggcatttgagttctctattggccacatgatgaatgccccttgagcacactttgtttcatacttgttcagaatccagccagcaaagggggaagctgttttgggagaccttctcagaaatccccaacattaccgaccgagagaaaaacatagggtagagagaattcctgtgtattttaaat

SEQ ID NO: 659821 - DNA, 448 bp, Homo sapiens
gtcctccaggtttatatgggaatcgaaacagtttgttaatctgattgggagagttccatgggcagatttcccttcctgaaggccaagacggagaactgctctctttgattattgcaagagtcaagaccaagagggtgctcagcatcacactacatctcaaaattaatggtgccgacggaattttgtgcatttgtgtcagaatgtttagtgtacaaggtggggggcgggctttgcgtcgagaaggaaacgtgagaccatttttttattgtttaaagctgcggtgagcgtcaaaattaccttggtaacttttgatgacttacgtgtgtggacagagcgaatagtggttttttaaacagcaccttgggtgaacatgactttaaagagattaatatattgaaaacgtggttgaacccttatttgaattgcaccattaaaacatttgacttag

SEQ ID NO: 659822 - DNA, 383 bp, Homo sapiens
gggcccaaacaaaagggtattttaaaaaaattttttttggggttatggagggggggaaaaaaaaaaggtttttttttaaacaagggattttttaaattcccaaaaaccaaaattataaaatgtttaaaatttgggccggtttttaaaaacaggggggcctttaaaaggggaaaaaaaagtttttttaaaaaaagccggaaaaataaaccccccttttaaaagttttttttaagaaaagtttttttaaaaatttggaaattattttgccttccccaaaggttaaggttattggattttaaaagaatccccacaaaaaaaaatgggggtttttttttggggggcccccttaaccaaaaaggttttttattaaaaattggaatgga

SEQ ID NO: 659823 - DNA, 321 bp, Homo sapiens
gcgatgctgtgactttggggctgaaggatgaatagagcggtctgtgaggcagtggcgggaacaggcttagatacgtcctgatcttgctaagactccaggtgtgctctgtggaccagtggcttgggcactccgcgggagggtgcttgttatgaaatgcagatgctctgttcacaacccagagccagagaatcaggacgaacattaccatgatccccaggagttcagtgcatacgtctttgggaagcagcacgctaaccaactcctttgtcccagtcagggaagtcaggtgtgcaaggaattgcgcggggcccctatcccctc

SEQ ID NO: 659824 - DNA, 163 bp, Homo sapiens
cgctatgctgtaagtcatagtacaaggatgttccacctgtatacttaaaaaaaaatagagacgggatctcagtatatcgcccaggctggtcttgaactcccggtgctcacagtgatcctcccacctcagcctcctgagttagctgggattgcagggttgagcc

SEQ ID NO: 659825 - DNA, 100 bp, Homo sapiens
aatcagaggtcccttcgctctcccatctcaggcagatcttcgtgagactgacgggtaagacatcactctcgagttggagccgagtgacaccattgagaat

SEQ ID NO: 659826 - DNA, 238 bp, Homo sapiens
ccgtgctcccccaaaacctatttgaaataaattagtttaaaaaaaagaagaagaaaagggggaaagaaaaaaaagcaaggttttttatggtggacttatttaattttttatcccgggttgataaatcaagaggggtttttcaaatttattattatgtttattcatttttcaaatcctgggtttttttttgcaaaaaaaaaagtagtgaaattttactgggtaaaaaggcccccgtcca

SEQ ID NO: 659827 - DNA, 356 bp, Homo sapiens
  misc_feature (257)..(257): n is a, c, g, or t
  misc_feature (287)..(287): n is a, c, g, or t
  misc_feature (341)..(341): n is a, c, g, or t
cttccggcattcgatgtcactgaacttgccggtgatgctggcccggtcagccagataatgcagtcggttgccttcctgcaccagacgggctcccaggcgcagtgtaatctcccgctgcaggcccctggtagggttgctcattacagttctccactattgtcagttcagggtgatgctcatcaggcaggtatagggcccattgcggtcctggcggcgttcggcgtataccgcgagactccggcgatatccggaacgtncctgccggtgtaatgacagacgctaccgtnccactggtatttgccggtgcagttagcgaaagattcgggacttcagggatgctnggcggtatatcgtac

SEQ ID NO: 659828 - DNA, 164 bp, Homo sapiens
gccgccttgagctcctctgtctcccatctcagcgtctgagtagctgggccccaggcatcaccagtcacacccgcgggcttaatctttttttttttcacaagacataattctcactcttttgcccaggctgatcttcaacttctgggctagaagaaatcctccca

SEQ ID NO: 659829 - DNA, 406 bp, Homo sapiens
cctggaccctctctcacagccacagtcaaagccatgcgggatccgagcttcgtctgcgacctacaccacagctcacggcaacgccagaatcttaacccactgagcgaggccagggatcgaacccacatcctcatggatcctagttgggttcgttaacccctgagccgtgacgggaactcccaagacaagcatttaagtgaggttagggcaggtaagactggaaagggaaggcaaccagtacagggtgtattctcacatcagctaccacttgcatatcttatctttaaagctggtgattcttgcttctgcgggtgggtggggctgtgatctgataaccagcaattcaggaacctctttttggaatgtctattctttattctcccctactttgtagagagggtccagg

SEQ ID NO: 659830 - DNA, 525 bp, Homo sapiens
  misc_feature (17)..(17): n is a, c, g, or t
tgttatcgatgccaccngcactgtaccaggctggagtgcggtggcatgatctcagctcactgcaacctctgccccctgggttcaagcgattctcctgcctagcctcctgagtagctgggacaacaggtgcacgccaccacgcctggctaatttttttgtattttttagtagagacggggtttcaccatgttggccaggctggtcttaaactcctgacctcgtgatttgcttgcctcgggctcctaaagtgctgggattacaggcatgagccactgcacccggcccaaagtaaattttaatggtatctcgcaaacatatgtgtgaagatagtagtatttaatgtatactagccatgttagcttggggaattagtatttatgcatgcccttactaagctttcttagcaggtgtcttcatgcttagaaaagtcaacttgcaacccgtgtgtaagacaaaacatttgtcacgagttcagtacttgtcaagtgggatgtacattctcagaggtcaatagtggcatcgata

SEQ ID NO: 659831 - DNA, 128 bp, Homo sapiens
cgtcggtaccaacgctgactctcccctatagcactcattccttctcaggtggctggtgaaatgacacctcagaaggaatgagtgctatagggcaggcaggtcagcgttgtggaagaggggagcgttgt

SEQ ID NO: 659832 - DNA, 563 bp, Homo sapiens
gtgacatcagactatatatgctatttatacaagtcacactttaggtataaaaactgagaaagcttgaaagtaagatgattaaaaatatatgccaggtaaacactaaccagaagaatcagaagtatctcaattgcgtgaaaagttaaaaaattaatttataaatacacaaaggataaaaaagacgtaaaatggacatttaaaaatattttacattaaataaaaataaagcaaacataagaatgcttataagttggaatttattcagtgcttacagaggaatttgcagccttaaaaccataaattagaaaaccatacaggctgaaaagtcaatgaattaaactttagcttaagaaaatacaaaacgaccaggaggatctaacctacagtaggtagaaggaaggaatattaactgggaacagttataacgtaaattacataattgtgtgacaggaatcacaagctctaagttggtcttgtaagatataaattgttatgcctagcaaactcattagatagggggtaaagccaagttcagaaagaattgggcagtctcaggctttttt

SEQ ID NO: 659833 - DNA, 786 bp, Homo sapiens
atgacccaccaattcacatgcctatcatatagtaaaaccgcagcccatgacccctaaccaggggccctctcagccctcctaatgacctcctggcctagccatgtgatttcacttccacctccataacgctcctcatactagggcctacgtaagccaacacagctaaccatatagccaatgatggcgcgatgtaacacgagaaagcactatgccaagggccgatcacacaccacgctgtccagaaaggccttcgatacgggataatcctatttattacctcagaaatgattgcttcgcggattctgctgagccttttaccagctccagcctagctctctatccctcgccagattgagggaagaggaccacttgagcacgcgccagtcgaggggcattcaccaccggctaaaagtctccccttagtagagtacccgactctctaaagcaactttccgtattactcgcgatcaggagtatcgaatcagcctggaagctcgagacataagtgctaatacgaaaaactgccgtacaaccaaataattcaaagcaactgcttatgaccgaccatttatcctgggatctcatatttatatcgcgtccatacaaagggcctcaaagataaccttcgaagtgtccctatcaccagttatcgaagggacaatctacctggctcaaaaattgtgtttgtagccgacggccattccaacggacagttcacgtcagtaattgggctcaacttgacctcactaatctggttatgtcggcacatattattacgtttacatc

SEQ ID NO: 659834 - DNA, 230 bp, Homo sapiens
attggcttcctgcgtctgactactctgttgtggatactggtacagtggcagtggactgcagatacatgctcagatgtctagatccaggatgattgggatgttgagtctttcagcagaccgatgtctactccatggctctggtgctctgggaaatgacatctcgctgtaatgcagtgggagaagtaaaagattattgagcctccatttggttccaggtgcgggacccccct

SEQ ID NO: 659835 - DNA, 714 bp, Homo sapiens
gcactttaggaggacaaggctggcggatcacgcctgtaatcccagcactttaggaggacaaggctggcggatcacgaggtcaggagatcgagaccatcctggctatcacggtgaaactgtctctactaaaaatagaaaaaattagccaggcgtggtggcggacgcctgtagtcccagctacttgggaggctgaggcaggagaatggcgtgtacctgggaggcggagcttccagtgagccaagatcgtgccactgcactccagtctgggagacaaagcgagactctgtctcaaaaaaaaaaaaaaaaaaagggaaaaaaaaaccagagggaaagggaaaataggggctcaggaaaaccaaattctagaattggccatattgagtaaattcgagaaacaaattacaaattgggggcccgggtgtgcagtgtggctcattaccgtgttaattcccagacatcttgggagaaggctgagaagtgggggttattccccgtagaggcctcaggaagttccgaagcccgtggccaagaaatatagcgaaagacacccccaaagtctttatagcgtggagacaaatcgaccagaaaaattatagccccagaggggtgtgtgttgcggggggacatttggctttcaagaacatcttcccctatagaatcagccgtgggagcatttacgagcaaatgtgggagaggctcggcccccgtggacct

SEQ ID NO: 659836 - DNA, 414 bp, Homo sapiens
ccagaagcgtaaacctcacagccactctgaagatgcactcatcttggtatagtgtatgagcacagcaacccaagagctattccatagactcgatggtttatctcgaaatccacacacaatctgccggttgtcagatgataacgccacacttcagcacatcctctctctggcccacaaatctgcctcctcgtgtcgctgcccgttgtcgcgatcccagaggcgccgggttccctcccaggagcctgtgcacgggcaatctggccatcttaggcgattcccccgtcactcgcaaagtgggagtgacctcgcagagctacgctgtgtcaatccattgttggtctcatccctggtcagtttccccatcatgatggtcttctctcgagaggcggatcggatcatctccgggcactgcgg

SEQ ID NO: 659837 - DNA, 148 bp, Homo sapiens
gagtgtctcgcatgctgatcacaattctgggcacggtgaagcccaatgcaaacagaatagctttagatttccaaagagggaatgatgtagccttccactttaacccacgcttcaatgagaacaacaggagagcctaaggggggacact

SEQ ID NO: 659838 - DNA, 253 bp, Homo sapiens
  misc_feature (215)..(215): n is a, c, g, or t
  misc_feature (228)..(228): n is a, c, g, or t
ggcttgctgctgctggtcgtctctgaggttcccccgcgagccgcccggtctgcagttacatgcggctgtgcaggctctggccccggcttgtagggacatgtttgccacacgtagccagcagccaggtatggtggctcacaccttgtcctcccaagcactttggtgaggccgagcaaaggtggatggctacgagcccagcgagttccacgacccantctgggactatantagtcagaagccctgatctgctagc

SEQ ID NO: 659839 - DNA, 188 bp, Homo sapiens
gtcggttagttgtagggagagtggagctggttataattatgcgtcatagggatagtacaaggaaggggtaggctagtgtgttttgtcatggggttgagaatgatgtgtgaggcgtattataccatagccggctagtgtgaagagtactgcggcaagtactatcgacccagcgatgggggcttcgacat

SEQ ID NO: 659840 - DNA, 109 bp, Homo sapiens
tgtatgcgaaacctcataccggatcgacctgctcaaagatgctgccgatcaccaccgtgctgcgttctacgaccgagtacctgggtctatcacgtgctttgttgttgat

SEQ ID NO: 659841 - DNA, 168 bp, Homo sapiens
ataccaggtagtactccacggtgctgttcatctaccatgatgggagcctcctactgggggaacgtactttctggctgggttgacggttgtgattcttaaggcactccttcagcaggccacgctcggacagggtgcgcctcaaggacttctttctgatggagaccggct

SEQ ID NO: 659842 - DNA, 376 bp, Homo sapiens
cctatcccaatacaaatacaaaaattaactggacgttgtggcactcacccagctactcagtgaggctgaggcaggagaatgtcctgaactgaggagatggaggttgcagtgagccgagatcacgccactgcactccaacctgggcgacagagcaatgcccgttaccaatgcgcgagagagcatgcaagcaggcggatgactggctgggcatcccccagggtgatcatccccgattaagattgtggaccccaacgtggacagagcactctgtcatgacctacctgatcccagttccccaaggccaagcttgaagccagggtgttcccttgcggcccaaaactgaccccgaagaaagccacgatgctacgaggcccag

SEQ ID NO: 659843 - DNA, 341 bp, Homo sapiens
gttctagtgatctagagatccccacgcgacgcggtcaaactggctccccatcttaccttgtccctgcagtgcgaaaatacggcaccgcaacttccttatgcgtgcaacgaaacaaaaagaaaagccattgtgcagaggatcccagcctagatttccgaaataatcctaccatggaagacttgggaaagctgcaaccattgttggcatctaatctctgctcttgatgtaccatcttgtccctcaaaggagtctttgaggttgcaaggggtcttcagcaaggcagacagtccttaaatctcatcctctctaatctcagtcctataaactccgagctgagttgt

SEQ ID NO: 659844 - DNA, 636 bp, Homo sapiens
ggctcggtaccgattacgctcctagacggcataacagacaaacagagacaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcatgaaaatggccatactgcccaaggtaatttatagattcaatgccatccccatcaagctaccaatgactttcttcacagaattggaaaaaaccactttaaagttcatatggaaccaaaaaagagcccgcatcgccaagtcaatcctaagccaaaagaacaaagctggaggcatcacgctacctgacttcaaactatactacaaggctacagtaaccaaaaaggcatggtactggcaccaaaacagagatatagaccaatggaacagaacagaggcctcagaaataacgccacatatctacaactatctgatctttgacaaacctgagaaaaacagcatggggaaggttccccgtctagagcttatcgggatctctaggtcgactgtagctgcagctggatgccgc

SEQ ID NO: 659845 - DNA, 787 bp, Homo sapiens
gagattgtgccactgcattccagcctgggtgacagggtgagactccatctcaaaaaaaataaaataaagataaaatcataaacactcaaaaaaaaaaaaaaaaaaaaaaaaaaaaaccgtgtgtgtgggcgcgcgcccggggccccgcgggagaaggctttccggagacaccacgcgcggagtggcggccgcgggggccaccagagaggaggctaacgagggaacacagggggccaaaaagcgtgtggtctcaccaagagaggagaacacgcgggggcacaagtgagaaagagagggcgagggaattctccaccacacaatatacaaaaaaaagcgccgcgcgggggaaaaagcgcggaggcgtctgtcgtgagaacaaaaaatctcccagagagagagagagtatcccgagagaggcactacatataagggggggagaactctaatatctaacagacgaggggagggccgctcaccaaaaagagggagaagcgccgcgcgagagtaaattacacaaaacaatattatagcgagccgccccaggaagaccccgcggggggggccagacgcacaaaagagaccagagaagacagcaaacaccacaagaaagagcagaagaacacaaaacgcaaacaacgacgcaagaaaaagcaaagacaccacacaaacagccaatcaaagacaacaccagcgagacagaaaagaacgagaaaccagacaagagaagacagcagaaaccaaagaagagacacacgcacaagcgagcgaaagacaaccacacaagaac

SEQ ID NO: 659846 - DNA, 105 bp, Homo sapiens
ggtgtctagaggttcccgagatacacgcattatcgcctgatctactcaggagggctgaggcaggaggatagttggggtccagagttcaatgctgcagtgagctgt

SEQ ID NO: 659847 - DNA, 146 bp, Homo sapiens
gatgtcccccaagtatactatttcacagcctccagcttcagctgtttatcaaatatacaaaagaaaaaagtagaggttgtctttcgcgatggcaatctcggacccgttgcaggctgagtggagagaaagctatatcacacacagga

SEQ ID NO: 659848 - DNA, 185 bp, Homo sapiens
ctgtgccaggacaggagatgcaaatctaatttatctcactgagggcctttgagaaaaacgcttctgggccaggctcagtggctcatgcctatatatcccagtactttgagaagctgaggcggcagatcacttgaggccaggagttcgagaccagtctcgtcaacatggcgaaaccctgtctctac

SEQ ID NO: 659849 - DNA, 118 bp, Homo sapiens
  misc_feature (1)..(1): n is a, c, g, or t
ntggagcaggaactagagctggtctgatgtggtcagtgacgtgaagtgactagacatgctgtagggggacagctcacagtagcgatacattcacaggaactgttggtgtcagaaaagg

SEQ ID NO: 659850 - DNA, 1001 bp, Homo sapiens
  misc_feature (94)..(94): n is a, c, g, or t
  misc_feature (108)..(108): n is a, c, g, or t
  misc_feature (232)..(232): n is a, c, g, or t
  misc_feature (249)..(249): n is a, c, g, or t
  misc_feature (251)..(251): n is a, c, g, or t
  misc_feature (255)..(256): n is a, c, g, or t
  misc_feature (258)..(258): n is a, c, g, or t
  misc_feature (275)..(275): n is a, c, g, or t
  misc_feature (304)..(305): n is a, c, g, or t
  misc_feature (311)..(311): n is a, c, g, or t
  misc_feature (313)..(313): n is a, c, g, or t
  misc_feature (316)..(316): n is a, c, g, or t
  misc_feature (319)..(319): n is a, c, g, or t
  misc_feature (321)..(321): n is a, c, g, or t
  misc_feature (331)..(331): n is a, c, g, or t
  misc_feature (335)..(335): n is a, c, g, or t
  misc_feature (337)..(337): n is a, c, g, or t
  misc_feature (340)..(340): n is a, c, g, or t
  misc_feature (348)..(348): n is a, c, g, or t
  misc_feature (351)..(351): n is a, c, g, or t
  misc_feature (365)..(365): n is a, c, g, or t
  misc_feature (374)..(375): n is a, c, g, or t
  misc_feature (378)..(378): n is a, c, g, or t
  misc_feature (384)..(384): n is a, c, g, or t
  misc_feature (400)..(400): n is a, c, g, or t
  misc_feature (408)..(408): n is a, c, g, or t
  misc_feature (412)..(412): n is a, c, g, or t
  misc_feature (416)..(416): n is a, c, g, or t
  misc_feature (418)..(418): n is a, c, g, or t
  misc_feature (421)..(421): n is a, c, g, or t
  misc_feature (427)..(427): n is a, c, g, or t
  misc_feature (431)..(433): n is a, c, g, or t
  misc_feature (435)..(435): n is a, c, g, or t
  misc_feature (465)..(465): n is a, c, g, or t
  misc_feature (483)..(483): n is a, c, g, or t
  misc_feature (489)..(489): n is a, c, g, or t
  misc_feature (552)..(552): n is a, c, g, or t
  misc_feature (591)..(591): n is a, c, g, or t
  misc_feature (715)..(715): n is a, c, g, or t
  misc_feature (790)..(790): n is a, c, g, or t
  misc_feature (819)..(819): n is a, c, g, or t
  misc_feature (896)..(896): n is a, c, g, or t
  misc_feature (969)..(969): n is a, c, g, or t
agtgccagccgccagtggtcgcacttggagggtctcgccgccagtggaaggagccaccgcccccgcccgaccatggccgaggagctggtcttanagaggtgtgatctngagctggagaccaatggccgagaccaccacacggccgacctgtgccgggagaagctggtggtgcgacggggccagcccttctggctgaccctgcactttgagggccgcaactacgaggccagtntagacagtctcaccttnantttnntnaccggcccagcccctanccaggaggccgggaccaaggcccgttttnnactaananatnctntngaggagggtnactngncanccaccgtngtngaccagcaagactncaccctctnnctncagctnaccaccccggccaacncccccatnggcntttntntcntcatcntttnnncntccactggctaccagggatccagctttgtnctgggccacttcattttnctcttnaacgcctggtgcccagcggatgctgtgtacctggactcggaagaggagcggcaggagtatgtnctcacccagcagggctttatctaccagggctcggccaanttcatcaagaacataccttggaattttgggcagtttgaagatgggatctagacatctgcctgatccttctagatgtcaaccccaagttcctgaagaacgccggccgtgactgctcccgccgcancagccccgtctacgtgggccgggtggtgagtggcatggtcaactgcaacgatgaccagggtgtgctgctgggacnctgggacaacaactacgggggacggcgtnaccccatgtcctggatcggcagcgtggacatcctgcggcgctggaagaaccacggctgccagcgcgtcaagtatggncagtgctgggtcttcgccgccgtggctgcacagtgctgaggtgcctgggcatccctacccgcgtcgtgaccantacaactgcggccatgaccagaacagcaactt

SEQ ID NO: 659851 - DNA, 139 bp, Homo sapiens
gcgctcatgacataaaggcagatatatagagcaatggaggccgggtgtggtggctcacgcctgtaatcccatcactgggggaggtcaaggtgggcagatcattaggtcaggagttcaagaccagcctggcctcatgagg

SEQ ID NO: 659852 - DNA, 868 bp, Homo sapiens
  misc_feature (94)..(94): n is a, c, g, or t
  misc_feature (108)..(108): n is a, c, g, or t
  misc_feature (332)..(332): n is a, c, g, or t
  misc_feature (350)..(350): n is a, c, g, or t
  misc_feature (356)..(356): n is a, c, g, or t
  misc_feature (419)..(419): n is a, c, g, or t
  misc_feature (458)..(458): n is a, c, g, or t
  misc_feature (582)..(582): n is a, c, g, or t
  misc_feature (657)..(657): n is a, c, g, or t
  misc_feature (686)..(686): n is a, c, g, or t
  misc_feature (763)..(763): n is a, c, g, or t
  misc_feature (836)..(836): n is a, c, g, or t
agtgccagccgccagtggtcgcacttggagggtctcgccgccagtggaaggagccaccgcccccgcccgaccatggccgaggagctggtcttanagaggtgtgatctngagctggagaccaatggccgagaccaccacacggccgacctgtgccgggagaagctggtggtgcgacggggccagcccttctggctgaccctgcactttgagggccggcctaactgaggagcagaagacggtggagatcccagaccccgtggaggcaggggaggaagttaaggtgagaatggacctgctgccgctccactggctaccagggatccagctttgtnctgggccacttcattttnctcttnaacgcctggtgcccagcggatgctgtgtacctggactcggaagaggagcggcaggagtatgtnctcacccagcagggctttatctaccagggctcggccaanttcatcaagaacataccttggaattttgggcagtttgaagatgggatctagacatctgcctgatccttctagatgtcaaccccaagttcctgaagaacgccggccgtgactgctcccgccgcancagccccgtctacgtgggccgggtggtgagtggcatggtcaactgcaacgatgaccagggtgtgctgctgggacnctgggacaacaactacgggggacggcgtnaccccatgtcctggatcggcagcgtggacatcctgcggcgctggaagaaccacggctgccagcgcgtcaagtatggncagtgctgggtcttcgccgccgtggctgcacagtgctgaggtgcctgggcatccctacccgcgtcgtgaccantacaactgcggccatgaccagaacagcaactt

SEQ ID NO: 659853 - DNA, 153 bp, Homo sapiens
tgtacatgcagttcctggaccccatcgctgggggagagaaatacttgctgctgtcttccagcctccccatcagatgtttgagatgccatatcctctagtgtccatataggaggtgatagacatcgctgtcctgatgtgtgtcatatcaccagt

SEQ ID NO: 659854 - DNA, 132 bp, Homo sapiens
acccccgccgcctagcaacttccatgtgaatctgtgctcctatcatgatgctataatgaccttctgaaacttacaagggtgccaaagctgcagatattttcagctgtatcagccctggttggaagttgctag

SEQ ID NO: 659855 - DNA, 321 bp, Homo sapiens
  misc_feature (96)..(96): n is a, c, g, or t
taagtccacagaattattatcaaaactaaaacaaacgtcagtgtacataaagtaataaactttacaacagctgttagagaaagtcgtgatgtacgntatacatattaccgaaggcagagaggacaagcaaaggagagctcccgttggaatgttgattacattcatgcagcttcctcttgatttaaacactcatgacacattgaatgaaatcatcatatgggaaattcacaacaccttgctgagcagtatccagtcttcgaaagctgtctgtaagagccctcagtttgacgcagcaggcgatgtagtcgtcgaaggagatct

SEQ ID NO: 659856 - DNA, 318 bp, Homo sapiens
  misc_feature (20)..(20): n is a, c, g, or t
  misc_feature (143)..(143): n is a, c, g, or t
tcgtagacatgattgctccnaaaaaatagtgtaacgttaaacgttctacttaagtttaacaacataaaatccgaatttaaactaaaaatacggaaaaaatggacaaaaagacgattatttgacgaatagaaagcatgaagcgntttataaacgaatgaggtttcgctaatgttcgtgtttttcctgtgaggcggctgccaactcatgtgcaggatgataggggcgtaccgacattagccccagattgccgttagatggttgcattacgggttaaatatgctatatagagcatcattaatttaggagtcagcatggtag

SEQ ID NO: 659857 - DNA, 320 bp, Homo sapiens
catacagactctcagacagcggacccccaactctgccagatgtataatttcagcagtttcacgtgatagcctcaacgagactgcgagacaggcatggagaacgaccctgccagccacggactgccgcctgcctcctgaccatccgctgcatggagaatggcaacatggaatgtgtgcccggtccttcacagaagccacattggcagttacccgggaagttccaggctaaagggagctcgtctttgggagatgggctctgagttgcacagatctggccagccgggagaaggagcggctggagcagaagcagagagaagcac

SEQ ID NO: 659858 - DNA, 518 bp, Homo sapiens
  misc_feature (93)..(93): n is a, c, g, or t
  misc_feature (105)..(105): n is a, c, g, or t
  misc_feature (273)..(273): n is a, c, g, or t
ctgcgcctactactaccagtcgggcaattcccctgcctcggctcccgggtggctgggattgcaggcatgtgccagcacacccagctgattttngtatttttggtnggagagggggtttcgccatgtttgccaggctggtctcaaacctctgggctcaggcaatccacctgtctccacctccaaaagtgctggaattacaggcctgaaccactgcacctggcctagtgcaatgttgagtagtagtcggcggcaggcgtaatgtgggcttattgncaactcccactctcaggttcgggcaattcccctgcctcggcctcccgggtggctgggattgcaggcatgtgccagcacacccagctgatttttgtatttttggtggagagggggtttcgccatgtttgccaggctggtctcaaacctctgggctcaggcaatccacctgtctccacctccaaaagtgctggaattacaggcctgaaccactgcacctggcctagtgcaatgttgagtagtagtag

SEQ ID NO: 659859 - DNA, 130 bp, Homo sapiens
atatcgagctcgccctcttatataatctagtattatttacttgtataagtttgcaaaggcccataactttcaaatgttgtttcctcaacaaaattagaagctacttaagaataaaatctgtgtgttctaa

SEQ ID NO: 659860 - DNA, 916 bp, Homo sapiens
gtgcccgtcattaacatagaatgtattacaacactgttgaccatcatctgtgcataggcaatagagagatgagtagtctgctcggcatcgcatagatctgcctgaattctgcctagtgcgggcataaattttgactcgagttttgacagtagaatagacgtctgtcatccaataacactcgctagccactcacgtaccctcgttagtccatctctagattggcatagtagccagtacgtaactctatgccgccggtacaagaaagcgccatggtgcagtgagcctaaaatactcacattgctggaaagcgtatgggctgattcacaatctatggtaaagaactaaactcttagtccaatggctagttcacagtccgttgcccacccttattttgtatcccagatcatggcaccattgaactgtggcccagcatatactgaacaagaaagaagcagattccctgagggctgtgtgcagaacggacatatgaagacaaaaaatcagtgttttagagaagaaaacttacctgaaaaaagaaaagctattgcagagggttagggcacggaaaaccacacggagaccagtttcttctccattttgaaaatgcgatgccaaataccaggaggcgcttactagagctagaagcatgctgaggcaaaagcaacattgagagatcacaggtatgatacggtccatctgcaggaggagcctgaagaacaaaacagaatctccttgggtggttggcccagctgtgcacacaagacggcggtacactacatacggccaagcaagacctctgacctggtgttggcgacgtcagaaaaccctcaggagaaggactaacctgttgattggggcacagataagagcggatccggttagaggccgaccacgtcttcgttacggccgctgcctc

SEQ ID NO: 659861 - DNA, 439 bp, Homo sapiens
tgcgcgacatcagcagcaggcggtcacgcacggcgccctcttccggcccgagcatggccagattgacgaagaggcgcggcagatagaacaggccggcgaaccagctggtgacgaaaacgatgtgcagggccttggcccagaggtaactgctttgcatggtcgacagggtcaggaggtcgtggaaggagaattcagtgcggcggcgagcacggcgtcgacatcgggccgcgacagccggacgcgcagttcgcgcttcatgcggcggttgtcgagcacgcgcgactcacccatgaaggaaagcgtcatcggcgacagcttctgcgccgcctctgcacgtgcgacgcgcggcgggcgcggcagcgcgaaggcatcggcgacgcggtcgaaatagtcggccatcttgagccgggtgtcgtcgctggcgttgtaggtgcggccg

SEQ ID NO: 659862 - DNA, 165 bp, Homo sapiens
acacgatagaccatgaccgcaggtgctcctgattacttgcgaatatgatattgaatggctcactaattctcagggctacggatgatcttattaatgtgactgggacgcctgtggaatatgccagaaaataatggcctgcatgcaaggtgggattatagtgcaaca

SEQ ID NO: 659863 - DNA, 110 bp, Homo sapiens
  misc_feature (83)..(83): n is a, c, g, or t
tggaagaggataatcacaaaggtctgcatcctcatcatcttccacattgagtgggttgaggaggaggagtagaggagaggttngtcttgctgtctcaggggtggcagagg

SEQ ID NO: 659864 - DNA, 173 bp, Homo sapiens
  misc_feature (72)..(73): n is a, c, g, or t
gctccaccttaccaccagacaaccttaggcaaaccatttacccaaataaagtataggcgatagaaaattccnncctgagcggccatagatataggtacccccaaggggaaagatgtaaaatatgtatatacctagcgatatatatagcgaagggcctataccccctataccct

SEQ ID NO: 659865 - DNA, 225 bp, Homo sapiens
  misc_feature (10)..(10): n is a, c, g, or t
  misc_feature (25)..(25): n is a, c, g, or t
  misc_feature (213)..(213): n is a, c, g, or t
accggcgctnactgggaattccggnccttttctgtctataaaaccaacctcctctgctcagctcattgggacacttgtgctattttgaggaatgaagtcttgcccgattctagaatcatgaatgaagccaattaagatgtttaagtttgttgtaattttgtcttttgacatttacggtcacctcggaggtgtgttgaatattgcaggttcctngacccatcgcca

SEQ ID NO: 659866 - DNA, 216 bp, Homo sapiens
taggaggtggagcgttgcagtgagacaagatcatgccactgaacttccagcctgagtgacagagtgagaccctgtctccataaatcaatagaatgaatgaatgaatgaagaattcagtggttattagtatgttcacagtgttttgcaaccatctccactgtctaattccaaaacatttctgtccccccaaaaagaaactccccacagagagagcgt

SEQ ID NO: 659867 - DNA, 869 bp, Homo sapiens
  misc_feature (408)..(408): n is a, c, g, or t
  misc_feature (412)..(412): n is a, c, g, or t
  misc_feature (567)..(567): n is a, c, g, or t
  misc_feature (594)..(594): n is a, c, g, or t
  misc_feature (603)..(603): n is a, c, g, or t
  misc_feature (606)..(606): n is a, c, g, or t
atgcagatgctgaacgctggacaaggagaacgccatcgagcgcgccgagcatggccgaagccgacaagaagcaagactgtggaccgttgcaatgcagctgtgaggatggagctatgcaggctcctccagaacgaagctgtaatggtgacagaggatgaggtggaaaagtattctgaagtccgtgaaggtaggcccaggagaatactggagcaggccgagaagaaggccactgatgctgaggcatgatgtggcctccctgtaaccgctgcattcagctggttgaggaggagctggacctgggtcccaggagcgcctggctacttagccctgcagaagctggaggaggccgagaaggcggctgagtgagagcgagagacggaatgacggtcatcgaataccgggccatgnaggntgaggagaagatggaactgctggagatgcagctgaaggaggccaagcacatcgctgaggattcagaccgcaaatatgaagaggtggccaggaagctggtgatcctggaaggagagctggagcgctcggaggagagggctgaggtggccgagagtntggggacctagaggaggagtgaaaatngttaccaanaanttgaaatccctggaggcccaggcggacaagtattccaccaaagaagataaatatgaagaggagatcaaactgttggaggagaagctgaaggaggctgagacccgagcagagtttgccgagaggtctgtggcaaagttggagaaacacatcgatgacctagaagagcacttgggccgtgccacaggaggagaacgtcgagattcaccagaccttggaccagtacctgctggaactcaacaacctgttgagggcagccccacccc

SEQ ID NO: 659868 - DNA, 873 bp, Homo sapiens
  misc_feature (408)..(408): n is a, c, g, or t
  misc_feature (412)..(412): n is a, c, g, or t
  misc_feature (609)..(609): n is a, c, g, or t
  misc_feature (627)..(627): n is a, c, g, or t
  misc_feature (637)..(637): n is a, c, g, or t
atgcagatgctgaacgctggacaaggagaacgccatcgagcgcgccgagcatggccgaagccgacaagaagcaagactgtggaccgttgcaatgcagctgtgaggatggagctatgcaggctcctccagaacgaagctgtaatggtgacagaggatgaggtggaaaagtattctgaagtccgtgaaggtaggcccaggagaatactggagcaggccgagaagaaggccactgatgctgaggcatgatgtggcctccctgtaaccgctgcattcagctggttgaggaggagctggacctgggtcccaggagcgcctggctacttagccctgcagaagctggaggaggccgagaaggcggctgagtgagagcgagagacggaatgacggtcatcgaataccgggccatgnaggntgaggagaagatggaactgctggagatgcagctgaaggaggccaagcacatcgctgaggattcagaccgcaaatatgaagaggtggccaggaagctggtgatcctggaaggagagctggagcgctcggaggagagggctgaggtggccgagagcgagccagacagctggaggaggaacttcgaaccatggaccaggncctcaagttcctgatggnctcagaggangagtattccaccaaagaagataaatatgaagaggagatcaaactgttggaggagaagctgaaggaggctgagacccgagcagagtttgccgagaggtctgtggcaaagttggagaaacacatcgatgacctagaagagcacttgggccgtgccacaggaggagaacgtcgagattcaccagaccttggaccagtacctgctggaactcaacaacctgttgagggcagccccacccc

SEQ ID NO: 659869 - DNA, 197 bp, Homo sapiens
tccccgcgtacaattgggcctgtaggcgaagattaggttgtaaaggaaaccaagccacaaacttcccttggtttttgttcagcgttagctggacaggaagagtctaggatttttgctctgactagttggtagaaacgtgtcttcttcttctgtgctgtgtttttaccaatgttgatagtgttctccacagacacagc

SEQ ID NO: 659870 - DNA, 430 bp, Homo sapiens
caacgatggtctcagcttaccgacgtagctaaggactgcaggtgtgtgccatcacacccagcgagtttttgatgtttggggtagaaggagggaaccttgtttcgtagtccaagctggtcttgaattcttgatgtcaagcaagcctctggtctcaggctcccagtgttgggataacgggtgtgagacatcacttggagctctatttactggtctactatgaataataatgtcttgatgacacacgttctctctctgtcacccaggctcgagctccagaggtcctagtctcagctcacgggaatctcatgctcctcgggatcaggcgatcctcgtggctcatgacctctcgtacgtagctgaggaccagcgtagagctgaggaccatcgtggagctgaggaccatcgttgagctgaggaccatcgttgagct

SEQ ID NO: 659871 - DNA, 205 bp, Homo sapiens
ctgggtaagcattgtataccattgatcaagttcgggggaataaagaacagaccacacctaaaactgcctttctgcttctcttcagggagaagtagctctgaacattgtctgaattacatatatttgaatctttcttactattggtaataaaccttaatggcattgggcaaacagtagacttatagtagtgttgggcaatacatca

SEQ ID NO: 659872 - DNA, 366 bp, Homo sapiens
ggatttttgtacattgattttctttctaaaactttgctgaagttttttttattagcagaaggagctttggggctgagactattgggttttctagatatagaatcatgtcagcttcaaatagggataatttacttcctctcttcctatttggatgccctttatttctttctcttgcctgattactctggctgggatttctatgttgaataggagtcatgagagagggcatcaaatctacacatatcaaatactaacctcgaatgtaagtgggctaaatgcccacttaaaaggtaaaggggggcaagctgataaaaagcagctcaatggtatctgtctttgagaccatctcacatgtgatgccaccct

SEQ ID NO: 659873 - DNA, 121 bp, Homo sapiens
aggactgtagcccttatctgctgtaatagaaccttctgctcacatatacaccacttccaccaccagatacataaccaccaccatagggactgcccgaggcttcttaccaccaaaactgccc

SEQ ID NO: 659874 - DNA, 780 bp, Homo sapiens
ggcggcggcggctcggcaggcgggttcaggcttcgggggccagccgccgccatgatcctgctgcgaggtgaacaaccgcatcatcgaggacgacgctcgcgctcaaggttcgagaacgcggccgccggaaacaaaccggaagcagtagaagtaacgatttgcagatttcgatggggtcctctatcatatttcacagtcctaagtggagcacaaatacataaagtgatggtcagtatttctttgaaattctacatacggaacttcaggcacatggtgctgatcgagttattaaagacgggtgtaccgcggacgtttcttggtaaagtccaggaatcaggagtacatagtgtctcttgtgctatatgaccttgaagaatcttatcggcatccgaggattccattgtgcatctaagctggcatgttgatgcgacaatcgttctgcctctgtctttgaacatatacgttccaattccaagaagagggcactgacaggagagtaccagggtcagattatcctattatcgggatgagtgcgaccatgctatgtggaggtctgaataacggacatgcacgtcacaggtagatcttcagcgacaatgtctacaggatgacgacgatgtggtccattggataagcgtgttccaatgcgaggacgtttcacgcgtacaggcacgcagagacctaccagaacagaccccagtagtgtcctcctgttaacctaaagccgaaccttcctcttggactctgcacggtaaccagagagccgctgttgggttgaca

SEQ ID NO: 659875 - DNA, 327 bp, Homo sapiens
aatactgagaaacttctttgtgatgtgtgctttcatctcacagagttaaaactttttttttgattgagcagttttgaagctctctttttgtagaatctgcaagtgaaaatttggagcgcttttaggcctatggtggaaaaggaaatatcttcccataaaaactagatagaagaattctgagaaacttctttgtgacgtgtgcgttcatctcacagagttgaaacttccttttgattgagcagtttggaaacactctttttgtaaaatctacaagtggacacttggagtgctttggggcctaaggtagaaaaggaaatatcttcacat

SEQ ID NO: 659876 - DNA, 208 bp, Homo sapiens
gtgagatgtaatgtcacataagtatacagtctacttactgttgtctacttacactgtggtcattttgaaaagatcatatttatccagcatgaaccttaagtctactaaagaacaaaaggcatgcaatatatgtccatttattttatttaaattatacttaatcatatgaagcctccatccttttcgaaagatgagacagctatttagt

SEQ ID NO: 659877 - DNA, 137 bp, Homo sapiens
gatccgaggatctccaatctccgcttactcggctcagatgttccccactgccaacacgcccatgccccgttcgcaagcagtctaagcgccggtccaacctgttcacttactcgtgaacagggagcgaccctagtaca

SEQ ID NO: 659878 - DNA, 184 bp, Homo sapiens
acgtgcggactcactacggggtgcagacactcctgtagcaatgcaagatacatctcagaccatgtctaaccagatcattgggagaatgatgatatgagtagtcgcattgatgatctggaaaagaatatcgacggactcatgacacaggctgaggtggaagaactggaaagtgaaaacaagatac

SEQ ID NO: 659879 - DNA, 1313 bp, Homo sapiens
  misc_feature (273)..(273): n is a, c, g, or t
ggcgatatactcatacccgggtaaagaggaaggtgttgtctctagcatagtgaagtgcatctcaaacggcttgacgcatgacgtagaggtcttccttcaacatacctcgagtaggactagagtttagtaagaatagtgtcaatcatcgtcctgtgagtatggaagagttggacagtagatttcaccttaccaagaactcgaagtgaagcgaagttagatatttcattgatggttgatactgacacaggagaggactaagaactgatgctaagngtcgaggaaacgggtcccggcggagtagtgtcgggaaacatagatgtgcgtggtgaatgtcaaggaatgagagtttgcggcttgcactagaagtgagtgatagctgaaagctggtgtatttgcgtgcagatagggtggcgcactagaggggtcatgctgtgcacgatattgcgcgcgagagcaagaagtcgtacattgcagttactaaacatcgcatagggaaggtgcatttgctttgtcgcagtgaggaggccgtagcataataggtggttgcctggcgggtatcatcgataggagatgttgggggcgcaagaaggcgtatgggaaggttgtagggaagtcttgggaaaactcacgaggggacgagaaggggctaagtcaccagtgagaaagttttgatcggcatgagcctttgatttggatcccaaacgaaggggggactgagccccttgggtataaaactaccttacaggtttgaaacaccttggcattgatggcgccgaaccggattgtttgcgttcaagaacaacggggatggattgacttgggagacaactctagaatggttgaacaggaatctaatatgctttgcgcccttgggagaaccccacaaacgtgggagtaaaggagttgtggacacacctaaaaggaaaaggcgccgcgttggacgttgaaacctaacggtggagggcatttggtaggggaaagcgcccaaacaaggactgaagaataaacgtgggaccaacgcaatacaccacgagtcattcaagaaatcaaaggaaaggagtcgggaaaacgcccaagaagggacggccacattggcacaataggccgccatggggcaggtacccccaaccgaggagtttaaacaagggatcttcccgttggagcagggtagtatacttaggaggttatgggaatgtttgggtactacttaaagagaccagtttagatagagagtttatggaggaaaacgaacaagaaaacaaaaacacagaagagcagcagagaagacaaaaaaatattgcggaggtgagagg

SEQ ID NO: 659880 - DNA, 688 bp, Homo sapiens
agcggaagagccaaaagcagatcaaagtggtgggactcgacgtctgctggccgcggagacgtgaagctctcgagtgctcctcccgcctgctggtgtcggtcgctcgcccttgcgctctccttcgcggctccagccccgtggcccgcgccccggcgcccgaccatggcagaagactgagcttgatccagaaaggccaagctggctcgagcaggccgagcgtctacgactgatcatggtccagcctgcaatgaacggcatgtgaccgatgcatgggcgccggatgctgtccaacgaggagcagcaatctgctctccgtggacctacaagaacgtggtcgggggccgcaggtccgcctggagggtcatctctagcatcgagtcagaagaccgacgcctccgacaagtaagtttgcagcgtgattgaatggactatcgggatgcacaagctggagtccgaggctgagatccatctgcaccacggtgctggaatggtcgggtcactatttactagccaatgcaactaatccagagcagtaccggtcttcgtatctgaaacctgaagggtgattacttccggtaccttgctgaagttgccgtgtggtgctgatcgaattcaaccgactagctcattcccgaggagcttaccaagaggcattcgatataagcaagaaagagatgcaacccaaaca

SEQ ID NO: 659881 - DNA, 912 bp, Homo sapiens
gatcgcggagtggcggcgcctgcgtcgccggtctccgtgggccgttacacggctgctggatcggtgcccgccggggtcagcgattgccggtctccgtttcctctccggtgttccccgcgcgagaattggcaaatccgagggttggtctgcacggatgaacgagacgctggcgtcggctagaaagaagcgatggctggagatcactaaatggtgcaacacttggtacggtagtgagtcggaagccaagtgcttgcctgtattgttgctagcttagcacctagggtgctgtcacctgttgggaggcccccttgggggcacgtattaggtcatgaaaggaccaagtaatcggacccccttctaaagacgtgcccaagggcggaaacaacacaccacgttccgtttgttcgccttttgggatcccttggtttgcaagatgaatcaagagaaagggaagacatatccgaaagaaaggcttcgttccaccatgcgtgttggcagaacagcgtccagaatcgcggtgttgggagcaattcccgtttccagtggagaaaaaataaggggaagccaacggtgggtatcacaacctatttggccctttggagggattgaaagatttaatttggcaccattggtttgtgctttttatgtgccccccaaaattgggcggaacttgcttgcccacatcgtctatgggtaggggccgtaccatgtgggccataacactagacagtgctaccttggtgatacaccccccgtttggagcggtttttagtactaacacatttgtaacaactacctgttgcggttgagcccaaaaaaaaaaaggttcaggtaagccatattgcaacagccaatgataactttgtcggcctgtgtcattttcaacaaattgttgacatttcagtatcgaga

SEQ ID NO: 659882 - DNA, 320 bp, Homo sapiens
  misc_feature (40)..(40): n is a, c, g, or t
ctctaagatccttcgattggtgcatgactagccgcagaanactgctgaaccctttcttgcctctcagctctacagtggattataatgctgtttttccacttatttatatcaaaagagatgttgtcagcgatgtgtctctagcacatacttaatgtttctcagtctattactcagttatcatgaagcaagggtcattttcccattgtagaggcagctctaagacttccaagaatatcagcttctttctgcttaagtgtgtgaatgcttagtttgttcttaccatgtggcccactttcaaaagtgacatggcacgcgacatc

SEQ ID NO: 659883 - DNA, 236 bp, Homo sapiens
ggggggggggaacccaaaaaaaccccggggcccggggggggggtccccccccccccggccctggggggggggggggggggggggggtttttccccttaaaaaaacccccctttttgttttgggggggtggggggggggcccccccccccgggggggggggggttttttttacccccccccccttttttttttttttcccccccctttttggggtataaaaaaatttttttttttta

SEQ ID NO: 659884 - DNA, 312 bp, Homo sapiens
agaaaaaacatacaaatttacttaacgggtttacacaggaagaatcacagggggattacccacccctcagagggcttcaaaagcttggggatacaatcccagcgacacaggttttgattgggggaagaggaattttggtgggggattacaaaggagaatgaatgtcttagggacccattaatttgtacaacatcttgtgaaagggtctgctcaagtgtgattactacattcttgggcttacagggaggggacaaaaacaattttgttccttgggatggggttaaaatttatcctttggtttggcagaaaagg

SEQ ID NO: 659885 - DNA, 867 bp, Homo sapiens
agacagtgggtctgtgagagaccgaatagaggggctggggccacgagcgccattggacaagcaagtggggaagaaacgagaataaacgaagagcgcaagacagctaccaagggatgactattgatcgttgatgccttggtctgcagcaaatagcaaggagctggctgctgcctaaagaaacagggagccatcgaaacagtcgaaagagggcaaaaagcaaacaaagagacaaacaaaaggcaggcactttgcatgcaagatgcatatccgtgcaaaggaacgtgggaagcacattgtctcttggaaacgctccaagggcatcgaagagctggactagaagaaacgtgtgtgcagtgcaagcccaacagcaaaagcaagtgaagcaggaattcgagcatcaaacagcataaaacacaagagacacaggacagcaacgggcataaaacacaggagtctacgcatgcataagtgattaggcgaagcacatgggaagatcaaagacttcagaacatcaaacaagagactggcaaacgccgacaagctggaaactggtactctggggacgtgcatgcatgatcgatgatgtattaaccagaacttgcctgaaaacaagctcaaagggaacagctcaaataatcaacatacagaagtcgggatggagtcagacggaggactgagggattaccagtaacaagccttaagagagcgttcaccgaactacaatccttctggtgaacagtgagtgatgacatcagatgaatcgtggcaagtctagaaaaaggacgagaacaataaatcagaaaaagcaagcaggttctaagcatagaaagtggggactgaagatgatgacagtatccttcacaaagc

SEQ ID NO: 659886 - DNA, 698 bp, Homo sapiens
  misc_feature (24)..(24): n is a, c, g, or t
  misc_feature (44)..(44): n is a, c, g, or t
  misc_feature (50)..(50): n is a, c, g, or t
  misc_feature (104)..(104): n is a, c, g, or t
  misc_feature (118)..(118): n is a, c, g, or t
  misc_feature (155)..(155): n is a, c, g, or t
  misc_feature (210)..(210): n is a, c, g, or t
  misc_feature (224)..(224): n is a, c, g, or t
  misc_feature (285)..(285): n is a, c, g, or t
  misc_feature (302)..(302): n is a, c, g, or t
  misc_feature (307)..(308): n is a, c, g, or t
  misc_feature (321)..(321): n is a, c, g, or t
  misc_feature (335)..(335): n is a, c, g, or t
  misc_feature (342)..(342): n is a, c, g, or t
  misc_feature (353)..(353): n is a, c, g, or t
  misc_feature (374)..(374): n is a, c, g, or t
  misc_feature (422)..(422): n is a, c, g, or t
  misc_feature (425)..(425): n is a, c, g, or t
  misc_feature (431)..(431): n is a, c, g, or t
  misc_feature (440)..(440): n is a, c, g, or t
  misc_feature (454)..(454): n is a, c, g, or t
  misc_feature (498)..(498): n is a, c, g, or t
  misc_feature (502)..(502): n is a, c, g, or t
  misc_feature (521)..(521): n is a, c, g, or t
  misc_feature (546)..(546): n is a, c, g, or t
  misc_feature (548)..(548): n is a, c, g, or t
  misc_feature (606)..(606): n is a, c, g, or t
  misc_feature (613)..(613): n is a, c, g, or t
  misc_feature (618)..(618): n is a, c, g, or t
  misc_feature (621)..(621): n is a, c, g, or t
  misc_feature (667)..(667): n is a, c, g, or t
cccggtgaccccgcagtgggtgtntaaagggaggacggacaganccaaangccgccggaacaagaggaagctgacaaagcaccatgcgtaaaatcatgcacatncaggcgggccaatncggcaaccagatcagcgccaaattttggaaagtcatnaataatgaacatgggattaaacccactggcagttaccatggaaaaaataatttanaactggaaaaaatnaatatttaataaaataaaaccactggtaaaaaatatattcctcgggccatcctcgtggatntagagccaagcacaatngattnngttaagtctggancattcggccaaatnttaaaancaaaaaatttnatttttagccaaaatggagcngggaataaataggccaaaggccactacacaaaaggaaccgaactggtngantcggtnctggatgtngtgaagaaggaatnaaaaaactgtaactgtatccagggcttccaactgaaccactctntagngggaggcacggggtccggnatgggcacctgctcatcaacaagancngggaagaatacacaaaccgcatcatgaacaccttcagcgtcatgccctcacccaaggngtcaganacggnggnggagccctacaacgccaccctctcggtccaccagctggtggaaaanacagatgaaacctactgcattgacaacgagg

SEQ ID NO: 659887 - DNA, 185 bp, Homo sapiens
  misc_feature (8)..(8): n is a, c, g, or t
  misc_feature (17)..(17): n is a, c, g, or t
accgctcnttcttctcnttctccttctcctccttcttcttcttctcctcctcctctaccaccatctttttctcctcctcctcctccctttccttctctcctcctcctcctgcttcttctccttctctttcttcttgcttattcttcataacatgctggtaccttacagatcttaagattcaatga

SEQ ID NO: 659888 - DNA, 604 bp, Homo sapiens
caatggcgggctcccctcccccagcctcgctgctgccttgcagtttgatctcagactgctgtgctagcaatcagcgagactccgtgggcgtaggaccctccgagccaggtgtgggatatagtctcgtggtgcgccgttttttaagcccgtcggaaaagcgcagtattcgggtgggagtgacccgattttccaggtgcgtccgtcacccctttctttgactcggaaagggaactccctgaccccttgcgcttcccaagtgaggcaatgcctcgccctgcttcggctcgcgcacggtgcgcgcatccactgacctgcgcccactgtctggcactccctagagagatgaacccggtacctcagatggaaatgcagaaatcaccgtcttctgcgtcgctcacgctgggagctgtagaccagagctgttcctattcggccatcttggctccttattctcattacccttcttgagttgtgggctcagacactacaacagagctccgtcacctctttctaaaaagctgggaaattgttattgtcaacgccagccccattttgtagggcacctggtgcaggggaccaacagttagtggggtgcggggcttca

SEQ ID NO: 659889 - DNA, 330 bp, Homo sapiens
cggtaaggtgcagtgcattccagcctgtgctacagagtggactctgtctccaataaaaacaaaaaacaaaacaaataaaaaaaacaggctgggcacagtggctcatgcctgtaaacccagagctttggaaggccaaggcgggtggatcgcttgaggccaggagttcaagatcagcctagccaaaatggtgaaaccccctctccactacaaatacaaaaattagctgggtgtggtggcatgcacctgtggtcccagctactcgggaggctgaggcaggagaattgcttgaatctgggagatggaggttgcagggagccgagattgcgccac

SEQ ID NO: 659890 - DNA, 119 bp, Homo sapiens
  misc_feature (1)..(1): n is a, c, g, or t
ngcccccagattacgatgtcaccagtccttcttttcttcttcctcatcagaaccaacatcttcaatttcaggttatgtctatccgactctttctcttctttttcttttactacttctta

SEQ ID NO: 659891 - DNA, 185 bp, Homo sapiens
gaatgcacgggagacgtgctgatcagctctgggagacgtcaagggcaatggcaaagggggtttagtgctcgctggatggggagccgttcgaggtgaaggggacatgggcgaagacctgggggtgctgtcaccgttgaggctcatgaccttctggctaccagacctcgcacacaatagtcactgat

SEQ ID NO: 659892 - DNA, 709 bp, Homo sapiens
tccccccccaaaatttttttttaaaaaaaaaccctttggtaaaaaaacagcaaaaaaaaaaaaaaaaaaaaaaagagagggtggtggggaaaaccacaacacccacccctaacgatgaggggcggggggaggagaagaaagagatagtggctgcgcaagcaggaggaaggagagggagggggtgcataacaaaaaaagaagaaagaaaaaaaaaaagaggggggggggcgaaataatatcacaccgcgcggggggcgcccccaataggcacccgcaccccacattgttgtttgagaagaaagagggggccgcccccacaaaaggagggggaggcttctaaaataaaaacagcggaccggaggggcggcgcgcgcgctataaaatccaaagaacgaccccggcggaggagagcgagagagaaaacagctgctgatcgcggagagtgacgatagtgggggagaagacacacaccactcacgctgggggggggggggggacaagatgaggcgggcacacacacctcaccgaagagaagatgataaccccgccgcgggggggggaatcaaaacacaacaagagggggagagggtaagggcgtggaccacacaaaacataataagcagccgggggcgaagaagaacgatgcgcccccgcgagaggtaggccgacagaaacaatcatcgagggggcgtaggaagaaaaaaaacat

SEQ ID NO: 659893 - DNA, 541 bp, Homo sapiens
caaagctaatagtgagatgtttacattaatttgactttaatttctccatccgtatgtccatcactgacatctcaaaagtagggatatttggtatatgacagtacgagcaaaccaaaaaccattttctttctttctgtctttctttttgaaatggtcttgctctggagtgcagtggcacgatctcagctcactgcaacctgtctcccaggttcaagtgattctcctccctcagtcatcctagtagctagaactacaggcacgtgccaccacaaccggctaagttttgtatttttggtagagacgtggtttcgccatgttggtcaggctggtctcgaacgcctaacttcacgtgaccacctgcctcatcttcccaaagtgctgagattacatgcttcagccaccctgtccagcctcttagagaaaattttaagaattttttaaaaagaagaaataaaatcagccataaaattgctctacattttaatggttttgttttcagcttttctttaacatccttgagttacactataagctttcggta

SEQ ID NO: 659894 - DNA, 2458 bp, Homo sapiens
  misc_feature (1277)..(1277): n is a, c, g, or t
  misc_feature (1365)..(1365): n is a, c, g, or t
  misc_feature (1398)..(1398): n is a, c, g, or t
  misc_feature (1416)..(1416): n is a, c, g, or t
  misc_feature (1458)..(1458): n is a, c, g, or t
  misc_feature (1496)..(1496): n is a, c, g, or t
  misc_feature (1498)..(1498): n is a, c, g, or t
  misc_feature (1504)..(1504): n is a, c, g, or t
  misc_feature (1577)..(1577): n is a, c, g, or t
  misc_feature (1642)..(1642): n is a, c, g, or t
  misc_feature (1655)..(1655): n is a, c, g, or t
  misc_feature (1765)..(1765): n is a, c, g, or t
  misc_feature (1833)..(1833): n is a, c, g, or t
  misc_feature (2001)..(2001): n is a, c, g, or t
  misc_feature (2165)..(2165): n is a, c, g, or t
ggacttagtgcaacaggttgcaggctaaaacaaagtctcagaacaggtctgaaagtacctcttgcctggcatacctcgtggctccttcagacagctagaagctcagctatactagatgcccctaatctctagctagcagcatttcactagccctactttagcacgcatactttatccaatctttaacggaaaaccccgaacaaacactatctcctggccaagtgctcattgcgttagggaagtgcccacaagtgcactaccgtgtagtgtcaaaagaacaatagttccgttagacaagcactttcgttgtaccgcgttcctttgcgcggcaacttgcccaacggtgcatccagggaccccctggccattgtgaatgcccacttggacggccatcccctggcttggcttggataacccccgtacgggacaccccttgacgaacgaggctagacactgcgcttatcgccctcaccccacttcttcgagcttccaaaccagatgcctgaaacttggtggcctaccctttaacccaagccgatggaccgaatcgcccctcggcggtctccaacgaccccaacaccgcaaaggcttcacaccaccttaacttctcggctcaccaagctgaagatgcactcatcgactttgggtaagcaacccgcacgattccccgtgggcggcccccgtatttacaccccaaggactgccgaaagcgcacctttaagtttgtccccgaacgagcgcaagtgccgttgggccgatcaggccccagagctttcacgacaccccgctgtggcggttcaacaagacgaccaaaacctctgaccgtttgacagctttgggccacatgcacatactccgcgacgtcgcacccactttatctcacccccatttgcgggagggaccgggctaaaaccctccacttagtctgtgtgcacaaaccacaccactatcgtttcccctaatcaagcacgaccgtctggtgcacttactactatcaatacgagggtgccacgccgaaaacaacctccacttggcgcgccgagccctgtgggttcccgcatcacgcgccatcatctgcgttggcggcccgaccagacagtcgcagtgtgagccatcagaatgacataacctgccactagttgccaaccatccagcccgaagcaccgatgtctactatggctcgtgacgcctgacacgggcggcacaaaccatcgtacggaggagctactgctacttgagtcacaagcaagatactgaccatctgggcctcgtgagtnagtactgcgacctgctcggccgctcggcttgtatacgacgccttgctcatacgacacgtctctgctgacgacctattactgaacgatngctcgcagcgcaacgagacagatatctatgtgntccgacgccgcccagcanctgtcgtaatgtagttgagcggccaccccgcgacgtagtctngactgtacgttatcgttacggataggacagcatagctncncatccnccggctgtcaggagacgccgacgttttatcaagcgagccgagctggctacccttctgtcagcctagcaacagngactgcttcatggcatacgaactgctgacgagctgcctcgtgtggcgccatgcgcacacatacgngatgccacgtcantcgacactctgtagttgacggacacagacacagctcaatcactacgcacgcagaggcgtcgacgtctcgttagcacagacgacccaccgaacaggctgcatacttcagtnggcgggcgcgcgccttcacttgttactgtgaccacccgatctcttatataagtgcgctagaatacagngacgagcgacaccgcgcgcttgctggtgcgactaactcacgcagcgtacgtcggtgtgctcaatccgcagatctcaatgacgcactcgtaacgtattctgctcgcacttcctacagcacgacgccacgtatgctagtctagactagcgtgtaggagatcgcatcacgncgcacacagaagacgtcactgcgctccagtcgtctagtaacccggccgccgcgaccacagattgctgagtcgtgtcgaacacgatacacataacgagcaactcgccccgcgcgataagcagtgcgtgcatacagaccacccatctgcgacgcgacgagacacgntacatgtacagtaccgtcgtgcgggcacgacagcccgctcccgattgtcgcaaccgcccgacgagcaggccggtcgcacatacggacacaacaaggccgccgacactcaggacgcaccactaggcaggatcacacgctggcgcccgcacgtagccggacaacaacaccatcagcgccacgcaccaggcacccacacagtatgttccccgcaatgctgacgcgcagctctgtacagcacagcgcacaaaccagacagcgagcacgacattcggcggacaagcgacggggtctaa

SEQ ID NO: 659895 - DNA, 106 bp, Homo sapiens
ctatactttgtacagtggtctcccgatgtctatggaaaagatgcacagagcaaggctttgtggtggtggagaaggaagaactgaacatgattgacaacttcttcag

SEQ ID NO: 659896 - DNA, 322 bp, Homo sapiens
  misc_feature (213)..(213): n is a, c, g, or t
  misc_feature (234)..(234): n is a, c, g, or t
  misc_feature (295)..(295): n is a, c, g, or t
  misc_feature (310)..(310): n is a, c, g, or t
tctgcctcagcctctggagtatctgagaccacaggtgcacgccaccatgcctggctaatttttaaattttttgtacagacagggtctcactatgttgcccagcctggtcttgacctcttgggttcaagcgatctgtctacctcagccttccaaagtgttgagattataggtatgagctaaatttgccaaactcttgcaagaccactataaggnctttgcattggctgttttctncaactctgactttttggttgagtccttcgtttatcccttataatctccagttcttaatcanctacttagaggctanccctatctaaag

SEQ ID NO: 659897 - DNA, 331 bp, Homo sapiens
  misc_feature (245)..(246): n is a, c, g, or t
ggccacacctttatccggatccattcaagggacgggcagattagggttgctggtttaaaagtgattaaaaggccgggcgcagtggctcacacctgtaatcccagcactttgggaggccgaggcaggcaggttgcttgagctcaggagttcgagaccagcctgcctctaaaaaaaatgtttttaattagttgggcataatggagctgtctgtggtcccagctactcaggaggccaagcagagaggnntgcttgaacccaggatacagagattgcatgagccaagatcgtgccactgtactccagcctgggtgatagagcaagaccctgtctc

SEQ ID NO: 659898 - DNA, 205 bp, Homo sapiens
gagagagaccctcacgtgctggggagtccctgccacactaagtacccgcactcatcgactgatatctgccccatcctcagcagtttccatgtagaccccgttgaagaggggaggggcctagggagccagcaccttgtcatgtaccatcgaataagagtacccctgttgcgtcaacccaattaaaatacaagagaaaaaaatgggg

SEQ ID NO: 659899 - DNA, 120 bp, Homo sapiens
cggttactctatgaggactcccggtgctgagtctggggtactggcagagttagtggctcgaatacccagagttctgaggtggtgggactcaccggtctggacatgggtgctatttggaaa

SEQ ID NO: 659900 - DNA, 336 bp, Homo sapiens
  misc_feature (299)..(299): n is a, c, g, or t
tggtagacagaaaaaatggcttctcaaaaacatcctaggctggacacagtgctcatgcctgtaatcccaggactttgggaggccgaggtgggcagatcacttgagtttaggagttcaagaccagcctgggcaatatggcaaaacccttgtctctactaaaaatataaaaattagccaggtgtggtagcacatgcctgtagtcacactacgcaggaggctgaggtgggaggatcacctgaacccaggaggcaaaggctgcattgagccattgatcatgccactatactccagccttgggngacagaatgaaacccttgtcttcaaaaagaaaaaaaa

SEQ ID NO: 659901 - DNA, 110 bp, Homo sapiens
aaaatttaattttatcatagccctctcacaggtatgtgttattatttaagcccatttacttatgtagtagtttgtctcttggtgacataatacaagttatagtttctgtt

SEQ ID NO: 659902 - DNA, 136 bp, Homo sapiens
gccccttcccggagtttggtttagggctgcgtgctcaaaagtctggtttggggctgggttttcccatcgccctggaggaggcttttgtctcatttcatgattcccattaaactctgtgccatgaagcttagcctga

SEQ ID NO: 659903 - DNA, 152 bp, Homo sapiens
ctggattctgtgagcaccgtgctgacctccaaataccgttaagctggaggctcggtagccgttcctcctggccgctggggctcccaacgggtcctcctcccctccttggaccggcccttcctggtctttgaataaagtctgagtgggcggca

SEQ ID NO: 659904 - DNA, 728 bp, Homo sapiens
gggtgggcatggacaatacagttgacaaaggttgcgcaccggattgtgtttttttgtgttgtgtgtgtgtgctgtaatgtatatatattaaatgttccaatatgccgtgacagtgttaatccagatagactgtgatctgcacaattaattatgtggttattcgagcacttaatccactcaagggttcagtggctctgctctcctccctgccatacgggagctgtggacagagctccctcacttcaagattcctagtgtttggcacaacagggttgtccaagtgagaaagactgagttgcgtgtctgtaaatgtctgcgcagggtgcacatgctgcgaggtctccatcctccgggtctgtccctcccagatgggctgggtctgttgggccctcctcagagtatgcctgggtacaaattctcactgtacagatgggctgtaagttctcacttcagagctatggaatggatttagcacctttaaaaagaaaaaaaaaatctttgacttcaaatttatagtagtgatatgctgacgggctgacacgcagaatggttgggcccctgttcttctgcgctccagctgtagaggcggctgctcacaagaggcacttggcttgtgtatataaagacacgtcgggttgttgtagaaccgctcttctttctaagtgggtgctacaaacgctcgcgaggtttctctgcaaaaaagggggggcacaccaagtgggcacccc

SEQ ID NO: 659905 - DNA, 153 bp, Homo sapiens
cgcagcgcactaggcgcctaccaatgaaccaggtcagccatgcgatatcaacatttatttacaacacggacttactaggcacgtacagaccatggaggaggggatgatgacaagaacttcatccttttccggcaggtggcgtcgatgcatgat

SEQ ID NO: 659906 - DNA, 335 bp, Homo sapiens
atactgatgagggggtgttgttaacataactggaccactatcaaagaatggtgtgtgctgtgtgaaatacaaagactaatgaatgaggaaacacaacgtgattgcctggccattgactgtcatatataccttctcttatttgagctatgcttgaacagacgtgacctagaaaaaactgacgctaaagagaagggggtggcggggctagttttcaagttggggaacctgatagtgaaaagtcacagatggagaaaattgctctcagaacagctgtgtggattgctttcctcttgtcgcacatgtaccatgcatttctcagcttggggtactacatg

SEQ ID NO: 659907 - DNA, 244 bp, Homo sapiens
ccccaagtggcaccccctggcggccaggggcccagcctggtggtggtggcaataaaactgtgcccctcctcagctcctcgcttcccctcccccagccccagccttactcccccatgcggacaatcattttgtacggatcccgggagcaatgctgtacggttttgtaccctggtggtttgtttcctaaaaaaccccttgtgtttttggatttttagcccattactaaaaaagcctttgctttgta

SEQ ID NO: 659908 - DNA, 699 bp, Homo sapiens
  misc_feature (1)..(1): n is a, c, g, or t
ncaaaatattctaaatgccggtattgagccatccttcaagggcatatgttaattcttggggtcctcttgtattaaaatttaatatcccatcttccattgatttaaaccagtattctgcgcatttcacaaatttaattaaatttgggacttgttcatccaatttcataattgctgccagaaaactcataaggagcatataggcctaattgtaaacccaaagcctgccttaagaattaaataattggcttattaaaaatggtaacctatgaggttaatttcatatttgagttaattatgattcaaatacttctttgtttagtgtacctaagtaaatttttctttaagtcagaagcccattaaaattagttacaagcattgaacttctgaagtattatattaatataaaaacatttttgtatgttttattgtaatcataaatactgctgtataaggtaataaaactctgcacctaatccccataacttccagtatcattttccaattaattatcaagtctgttttgggaaacgctttgaggacatttatgatgcagcagatgttgactaaaggcttggttggtagatattcaggaaatgttcactgaataaataagtaaatacattattgaaaagcaaatctgtataaatgtgaaatttttatttgtattagtaataaaacattagtagtttaaacaaaaaa

SEQ ID NO: 659909 - DNA, 766 bp, Homo sapiens
cacgcgctggcctgttggcctgggctggaacctgagaacgcctgggacctgcgctgcgacgctgccggcctgcattgagcctgcctgccgtgtttcctgtctccgcacctacctcaaaggccgcttgttgggcaatggtgggggcttcgccctgctgctacgagtgccactgacacagagactggcagcgcctacgctgtcaaagtcatccctgcagagccgcgtcgccaagcctgcatcagcgcgagaagatcctaaatgagattgagcttgcaccgagacctgaagcaccgacacatcgtgcgtttttcgcaccactttgaggacgctgacaacatctacattatctattggagctctgacatgaccgaaagtccctggcccacatcttggaagtgccctggcacaccctgttggagccagaagtgcgctacatacctgcggcagatcctttctggcctcaagtacttgaaccagcgcggcatcttgccaccgggacctcaagttgggaaaatttttttcatcacttgagaacatggaactgacaggtgggggattatgggctggcagaccggttggaggcctccgggagcagcaggaagaagaccatcttgtgggcaccccaaatatgtggctccagaagtgctgctgagaccagggccccggcctgaggcggtgtatggtcactgggctttgtctgtcaaggctgctctggggagcctcctttgagaggtgactgaaggagtacgtgcgtcagcagtcaacg

SEQ ID NO: 659910 - DNA, 407 bp, Homo sapiens
  misc_feature (8)..(8): n is a, c, g, or t
  misc_feature (167)..(167): n is a, c, g, or t
  misc_feature (309)..(309): n is a, c, g, or t
aatacccngacaaaattatcattcatctgtagtgatgcaagaaaaatttaaataatatacatttttaaaaacctaaatctatccaatttatgagtccatgccttattttgagatcacatccttcctacatttggctattaaagatcctctctttataaaatgatgangacagcagagagtaatgttcttaactggaaaaattaaaacttgacacactgttggtctccccatcactttcgcccaggctggagtgcagtggcgtgatggtggctcactgcaagctccgcctcccgggttcacgccattctnctggcctcggcctcccaagtaggctggggactacaggcgcccgttcaccacacccgggctaatttttgtcattttttagtaggagacgggggtttcca

SEQ ID NO: 659911 - DNA, 299 bp, Homo sapiens
gcttaggaaaaaacctggtagagagagttatactatgtgaacacccactagtaggcctgaataagcagctaccaacttcagaaagcgttcaagctcagacacccactacctaaaaaattccaaacatataactgaactcctcacaccctattggaccattctatcaccctatagaacaactagtgttagtctaatgtaccatgagaacattcttcgccgcataagtctgcgttaggatgataacactgaactgacaattaacagccctatatctactatcaagcaacaagtcattatta

SEQ ID NO: 659912 - DNA, 529 bp, Homo sapiens
  misc_feature (262)..(263): n is a, c, g, or t
gcagtgctcatcagagggctatccacgtagcatgctctgtcacctcctttaagtctttgctcatgttatcatatcggtaaagtgtcttgacaaccctgtttaaatctgtagcatccccaataccagcattccttatccattatttctgaaagcaggaattttttaatgctttttatttaatgcggaatccccgtgcctagaacagtctaggacactgcatgccctcagtaaatattggttgaattaataaaaatagctaganngccactgggctttgtgatgtgtgcgttacgcgcattatctcactggatgcgcacagccatcctgggaggcagcaccgtggcctttcctatttcatagatggggaactgaggctcacagagggagcagcctgtggagacccaggtctctggctccggggcctgccgctaagggctgacctatccccctctccccgcaggtcccgggcgaggcgcccgcgccgtccgccgacccggcgcgtccccacgcgtgccccgagtgcggccgc

SEQ ID NO: 659913 - DNA, 185 bp, Homo sapiens
cttgcctgcacgctggctaaaacggcttttgatgaggccattcctgaacttgatacactgaatgaagactcatacaaagacagccaccctcatcatgcagttgcttagagcaacctaacactttgggcatcagccagtcaggggaaggatgttatgcggccaaagggccttaaacttaatccttc

SEQ ID NO: 659914 - DNA, 122 bp, Homo sapiens
gggcaggtccaaaaaaacctttaatacttttatagtgataggcaactaatgctttctggccagatgcctttggagcaggtgctttctgggctggagctttttgacccttctgtcgtcttctc

SEQ ID NO: 659915 - DNA, 258 bp, Homo sapiens
agctgcgctgaactctacgctctacgctcgatgttgaagaaggcgtcgaacaagacgctggccagcttgcagcgcttcaggacctgcagtgcgatcttcccttcagccctcggcttgaccaggtccagcatctggcagaggcagacctggtagggcagggccttgatggccatgctgtccagcctttggcactgctactcgtagaagtactcgagctcgaacatggacagggcgccgtccccgtcgaggtcaacgcag

SEQ ID NO: 659916 - DNA, 171 bp, Homo sapiens
aaagtcaatcgcgccagacggggcgttgtcgatctgcaggacaatcctggagtctcaatggtggcccaagaatttggtccgcaggtcctggatggtcgtgtagtaagtggctgtagtcgcgggaggggccaggccccttcttctggtaccagtcgcggatcttcacctcta

SEQ ID NO: 659917 - DNA, 958 bp, Homo sapiens
  misc_feature (22)..(23): n is a, c, g, or t
  misc_feature (26)..(28): n is a, c, g, or t
  misc_feature (31)..(31): n is a, c, g, or t
  misc_feature (787)..(788): n is a, c, g, or t
  misc_feature (791)..(791): n is a, c, g, or t
  misc_feature (809)..(810): n is a, c, g, or t
atccgaggccctcactaaaccnnccnnncgntagaaccaggaaggcgctgagcttaaactgaagcaagttcggtggacgccggcggcgccctgatctaaagaaacgactcagggactgcggcgcttgcacgtcaacgggaggtgtgagcccaaagaaatgggacgtcggtcatcagatactgaagaagaaagcagaagcaagagaaaaaagaaacaccgtagacggtcctcctcgagcagttcttcagatagtagaacatacagccgaaagaaaggaggaaggaaatcaagatcaaagtcaagatcttggtccagagatcttcagcctcgttcacattcttatgatagaagacgcaggcatcgatcaagcagtagctcttcttatggctccagaaggaaacgaagtcgaagtcgttcaaggggtcgagggaaatcctatagagttcagaggtctaggtcaaaaagcagaacaagaaggtccaggtcaagacctcgtctccgttctcatagtcgtagcagtgaaaggtccagtcacagaagaacgcgtagtcggtctcgggatagagaacgacgtaagggcaggagaataacgagaacacgagaccaggagaaggatacagggaaggacacggaattacataacatcaaacgtggggaatctgggaaacatcaaagctggattagaacatcttgccaccagttgaacaggccaaagccagactacagctggttcttgaagctgctgcaaaagctgatgaagcattgaaagcaagaaagaaatggggannaangcaagagaagaacggggnnagaccaggccacccggttgcacacggttcacagagttcacacaattggagcttgaacgtgaatccttggtcagagacattcgattcagtagaagtcccagtcgggactttgcggtaacacgcacttccttgggcgcttcgtgtgttac

SEQ ID NO: 659918 - DNA, 111 bp, Homo sapiens
gcggagttgggctgggtagagagtagggggcgttagtcggggctacgtggagaaggagcaggcggcgattcacttattaaattggcgccgaagcaggacccgaagcttaaa

SEQ ID NO: 659919 - DNA, 971 bp, Homo sapiens
  misc_feature (800)..(801): n is a, c, g, or t
  misc_feature (804)..(804): n is a, c, g, or t
  misc_feature (822)..(823): n is a, c, g, or t
ccggacagggcttgctgtgagaagtgtggctatgcaaatacatactcacaaaagaatatttacatatgatgttatatttaagtgtgtaaacaaatatacctctaagtgtggcttaggggacattttcaagtactctgaatattaatgcagactttctggaagttaaagaaatgggacgtcggtcatcagatactgaagaagaaagcagaagcaagagaaaaaagaaacaccgtagacggtcctcctcgagcagttcttcagatagtagaacatacagccgaaagaaaggaggaaggaaatcaagatcaaagtcaagatcttggtccagagatcttcagcctcgttcacattcttatgatagaagacgcaggcatcgatcaagcagtagctcttcttatggctccagaaggaaacgaagtcgaagtcgttcaaggggtcgagggaaatcctatagagttcagaggtctaggtcaaaaagcagaacaagaaggtccaggtcaagacctcgtctccgttctcatagtcgtagcagtgaaaggtccagtcacagaagaacgcgtagtcggtctcgggatagagaacgacgtaagggcaggagaataacgagaacacgagaccaggagaaggatacagggaaggacacggaattacataacatcaaacgtggggaatctgggaaacatcaaagctggattagaacatcttgccaccagttgaacaggccaaagccagactacagctggttcttgaagctgctgcaaaagctgatgaagcattgaaagcaagaaagaaatggggannaangcaagagaagaacggggnnagaccaggccacccggttgcacacggttcacagagttcacacaattggagcttgaacgtgaatccttggtcagagacattcgattcagtagaagtcccagtcgggactttgcggtaacacgcacttccttgggcgcttcgtgtgttac

SEQ ID NO: 659920 - DNA, 244 bp, Homo sapiens
caaaaaaaaaaaccccccccataaaaaccctgggccccctggtccattgggggaatttaaaggttttcctttttccctgggaaaccccgggccctttttttacctttttggggggggggggttccaggaggggcccctgttttttaagagggggtaatttcctttaaaccaaaaaaaaaccctaataggtttcccctccaagccaggggtttgggggtttaaaaaaactttttgtttaaattga

SEQ ID NO: 659921 - DNA, 981 bp, Homo sapiens
  misc_feature (22)..(23): n is a, c, g, or t
  misc_feature (26)..(28): n is a, c, g, or t
  misc_feature (31)..(31): n is a, c, g, or t
  misc_feature (810)..(811): n is a, c, g, or t
  misc_feature (814)..(814): n is a, c, g, or t
  misc_feature (832)..(833): n is a, c, g, or t
atccgaggccctcactaaaccnnccnnncgntagaaccaggaaggcgctgagcttaaactgaagcaagttcggtggacgccggcggcgccctgatctaaagaaacgactcagggactgcggcgcttgcacgtcaacgggaggtgtgagcccaaagaggggtactgggaacccccaaagaaatgggacgtcggtcatcagatactgaagaagaaagcagaagcaagagaaaaaagaaacaccgtagacggtcctcctcgagcagttcttcagatagtagaacatacagccgaaagaaaggaggaaggaaatcaagatcaaagtcaagatcttggtccagagatcttcagcctcgttcacattcttatgatagaagacgcaggcatcgatcaagcagtagctcttcttatggctccagaaggaaacgaagtcgaagtcgttcaaggggtcgagggaaatcctatagagttcagaggtctaggtcaaaaagcagaacaagaaggtccaggtcaagacctcgtctccgttctcatagtcgtagcagtgaaaggtccagtcacagaagaacgcgtagtcggtctcgggatagagaacgacgtaagggcaggagaataacgagaacacgagaccaggagaaggatacagggaaggacacggaattacataacatcaaacgtggggaatctgggaaacatcaaagctggattagaacatcttgccaccagttgaacaggccaaagccagactacagctggttcttgaagctgctgcaaaagctgatgaagcattgaaagcaagaaagaaatggggannaangcaagagaagaacggggnnagaccaggccacccggttgcacacggttcacagagttcacacaattggagcttgaacgtgaatccttggtcagagacattcgattcagtagaagtcccagtcgggactttgcggtaacacgcacttccttgggcgcttcgtgtgttac

SEQ ID NO: 659922 - DNA, 590 bp, Homo sapiens
  misc_feature (22)..(23): n is a, c, g, or t
  misc_feature (26)..(28): n is a, c, g, or t
  misc_feature (31)..(31): n is a, c, g, or t
atccgaggccctcactaaaccnnccnnncgntagaaccaggaaggcgctgagcttaaactgaagcaagttcggtggacgccggcggcgccctgatctaaagaaacgactcagggactgcggcgcttgcacgtcaacgggaggtgtgagcccaaagaaatgggacgtcggtcatcagatactgaagaagaaagcagaagcaagagaaaaaagaaaagccacacctctatttgatagccgccttcttcaccacagcccagaggtggaagccaccccgtgtcccccatggatgaatggataagccaaacgtgtcatgtacataccgtggcatgttactcagccttaaaaaagaagaaaactctggggtgggcaccgtggctcatgtctgtaatctcagcactttgggaggcccaggcgggtggatcacctgaggtcaggagctcgagacccgtctggcccacctggccaaaccccatctctaataaaaataccaaaattagactctacctccaaaaaaaaaagaagtataaagcgttgaggaagtataaagcgttgagaaagtaaagccgttgaggaatgtataaagcgttga

SEQ ID NO: 659923 - DNA, 658 bp, Homo sapiens
gagagagtgaaaagaccgcttacccaatttgaaattggtgagatgttccttgggctggttggtctgaggacctgaggtcataggtggatctcttcacggagtgaagaacaggtggagaggtatgaagaacgaggaacactgcccggggagtttcttcctctgcaaaataagggagtgtgtactgaattaccgtttccagctccaacatccaggatttcagcactacctgcagagtagtgggaggagagatagaggaagaagtgaagataagaaaccactcgaagccggtgtctggtgctgggaccgtggtggctgggacggcagcagtcgtgctgtccatctgctcttccgaggggtggcacatcctagcctctatcttttccccagagaagatccccctcgtctgctcttcccccgtctcagccttttagtgtgtgaacagttctggtgttactcagcaacgcttttgttagcgcctttaccagcaagtacttgttaaacacttaaatcttacaagtggaaagaaaattccgtggtaaatttaagtacaaaagtcaaccaaaattctgagtctcggacaagactggttaaaaatcgttctacaatgaaactaataaattaaatcatataaaactttaaaaaaaaagaataaaaaaaa

SEQ ID NO: 659924 - DNA, 931 bp, Homo sapiens
atacgtatgaacccggagacgcgttgatcgggcgatggcctggccgcatccagctttatttctattcttattttcaaggtagtattaagtgtccatatttctcaagccacattcaaggaaatcatgtcttaactattttggatgttgcctctccttcatcttgtacatgaaactccagcagatttaatattggcatccatcatctagtcaaacctctcacatgttcttcaaatcaatcaaatttgggattctcaacattttctgtgtgaataaaaggtgtggaattagtagattcgatgaagacctgtttttgcttgccacattggacttccacactccatttggattgtgtttagaagatggggaaatttataacactcgtcttgggctgagtctctgacgactggatatgcatatgggagagttaaacctccgcgagactggctgttaactgcagggcacccccacccgggtgggtgggtgcctcgagtcagattagagggacgacgcaaaggcataaagaccgcagggaagagcttcctggaaattccaaggtagttgtccaggtctagtaagggatccctatcgttaggaatagtaatacgtcgatgggggggtggatggcggatcgttagtagcatgaggatgcagttatggtctacgttgaatacagcgcgctatgcgggcagacaacctgagcactagggggatgctgtagtcggtatgcaggtggtaacccaaagacgtcgggatggtgataccaaccgcccggacaggcggtcggaggctggggtggtgggcgacggggatccggaagatcttagcgcttcgtatacgctgtatgttcgatttggttcatcctgacggaggggcaagggcgtgtcggtggttatacaccccggcgctgcccggtagagtggagggaagcgcg

SEQ ID NO: 659925 - DNA, 464 bp, Homo sapiens
gcagttggctggcgttgctgttggcaggtggcatacacaagattgggctgccagaatgaggaagaagtgaagataagaaaccactcgaagccggtgtctggtgctgggaccgtggtggctgggacggcagcagtcgtgctgtccatctgctcttccgaggggtggcacatcctagcctctatcttttccccagagaagatccccctcgtctgctcttcccccgtctcagccttttagtgtgtgaacagttctggtgttactcagcaacgcttttgttagcgcctttaccagcaagtacttgttaaacacttaaatcttacaagtggaaagaaaattccgtggtaaatttaagtacaaaagtcaaccaaaattctgagtctcggacaagactggttaaaaatcgttctacaatgaaactaataaattaaatcatataaaactttaaaaaaaaagaataaaaaaaa

SEQ ID NO: 659926 - DNA, 964 bp, Homo sapiens
tcttaccagatcctagctgctggtcatcacctatactactaacagaccgcaaccatcaacaccaccttcttcgacccgaacggaggaggagaccccattctataccaccaactattctgatttttatcggatcacccatgaagttcatatgcttatcctaccaggtcttcggaatactctcccatattgtaaacttactactccggaagaataagaaccatgtggataccatagtgtagtggtctgaggcatatgatctcacagtggcttcctagaggtattatcgtgtgagcacccaccactactatttcacagataggaatagacgtaaaaaaaacgagacaatattgtccacctcacgataccatcaatcatcgctatgcccaccgaggtcaaggtattaaaggatgacctcgccacacatacccacggtaagcgatataacaatgatcttgctgacaccagaatctgagaccaataaggattcaatccttcacttagtcaccgtagtgtgtgacctgactggcgattgtatttagcaaagtcatcactaagacatccgttacataacacgacatgtacatacgttgaggcccacattgcagtgatgtcctaatcaagtaggagctgtaataggccatagtctaggaaggctaattcatgatttcgcctaatgcacagggatacagccgtagaaccaagctcggcaagacacatgtcactgatcaacgtcaatcgaggaaaatctaagatcatacgaacaacagcggcaaacggagccggaggtagtgaggaccgaagcaacaccaataacacacaacgcggcccataacgaacgagaacaaaaggcgaggaacaaggaggaagcaagaaccccaaggagaatgagcacacaaggagcgaaacgaaagaagcaagaaacgcggaaaaaaggcagacgggaatcacagcgccagctaagaaa

SEQ ID NO: 659927 - DNA, 1026 bp, Homo sapiens
  misc_feature (45)..(45): n is a, c, g, or t
  misc_feature (77)..(77): n is a, c, g, or t
  misc_feature (304)..(304): n is a, c, g, or t
  misc_feature (321)..(321): n is a, c, g, or t
  misc_feature (324)..(325): n is a, c, g, or t
  misc_feature (328)..(328): n is a, c, g, or t
  misc_feature (331)..(331): n is a, c, g, or t
  misc_feature (333)..(333): n is a, c, g, or t
  misc_feature (343)..(343): n is a, c, g, or t
  misc_feature (350)..(351): n is a, c, g, or t
  misc_feature (354)..(354): n is a, c, g, or t
  misc_feature (358)..(359): n is a, c, g, or t
  misc_feature (368)..(368): n is a, c, g, or t
  misc_feature (373)..(373): n is a, c, g, or t
  misc_feature (377)..(377): n is a, c, g, or t
  misc_feature (379)..(379): n is a, c, g, or t
  misc_feature (382)..(382): n is a, c, g, or t
  misc_feature (387)..(388): n is a, c, g, or t
  misc_feature (393)..(393): n is a, c, g, or t
  misc_feature (406)..(406): n is a, c, g, or t
  misc_feature (411)..(411): n is a, c, g, or t
  misc_feature (436)..(436): n is a, c, g, or t
  misc_feature (460)..(460): n is a, c, g, or t
  misc_feature (475)..(479): n is a, c, g, or t
  misc_feature (518)..(518): n is a, c, g, or t
  misc_feature (529)..(529): n is a, c, g, or t
  misc_feature (537)..(537): n is a, c, g, or t
  misc_feature (542)..(542): n is a, c, g, or t
  misc_feature (558)..(558): n is a, c, g, or t
  misc_feature (570)..(570): n is a, c, g, or t
  misc_feature (600)..(600): n is a, c, g, or t
  misc_feature (614)..(614): n is a, c, g, or t
  misc_feature (619)..(619): n is a, c, g, or t
  misc_feature (624)..(625): n is a, c, g, or t
  misc_feature (628)..(628): n is a, c, g, or t
  misc_feature (631)..(631): n is a, c, g, or t
  misc_feature (635)..(635): n is a, c, g, or t
  misc_feature (649)..(649): n is a, c, g, or t
  misc_feature (681)..(681): n is a, c, g, or t
  misc_feature (686)..(686): n is a, c, g, or t
  misc_feature (717)..(717): n is a, c, g, or t
  misc_feature (729)..(729): n is a, c, g, or t
  misc_feature (741)..(741): n is a, c, g, or t
  misc_feature (955)..(955): n is a, c, g, or t
  misc_feature (996)..(996): n is a, c, g, or t
cttaattttattttctttaattttataaaatacactttgtaaganaagtttctaaaagtttatcctttatgtgtgtnaaaattgcaattctatatcagaaatgaaggaaacactttcagttgattaactctctttgtgtgtgtatatatgtgtatgtatgcatgtgaggttttcagggaagggttggttatttgttatgttattaaatcaaaacaaaacacaaggtacggattacttcactgtcctttatcttgattggtttcttacaaaacattttccctctcctccttctatgcagcctggnagcttatcttgtatacnggnntgngancnagtatcaagngtctttnngtnaagnncttacatcnccttnaatntngcnggggnngcttnggggggggggggnagggnagctctttacaacaaaagagctgtngtacaaatctttccttcaattaanaccaatcagactttnnnnntttttaacccaaagttaacaaaaacaggaaaaggctganatcggggggcnattcaggnctcanactctttctgcctgtnctttttcctggnagcttaccaactgaatagctgatgactggngcattctgttatgngatcnatatnnggnganaatnacctttatgttaancctaactcttaacacaccaagataacattgcnaagtnaaatcattttccattagctagagagagcgancagattactcanattgagattcanattcaccaaatctgtttctgcaaaggcagaatacttgtagaaaatcccaatagattcaactagccaatttttaatatcatttgtgatgcttaatgtccaattttcctagtttaaaaaacagtcataatcaaagaattattctccagacatttctgatgcaaccccaaataagtaataaacaaactggaatacatgaaatgtgcatcattctaanacaaatcaagaccttcaaatcacctacgatgactgaatggntaatacccatgaaatgagcaccattgtgag

SEQ ID NO: 659928 - DNA, 906 bp, Homo sapiens
attacttattcggggttgcatcagaaatgtctggagaataattcttcgattatgactgttttttaaactaggaaaatcggacattaagcatcacaaatgatattacaaatgggctagcttgactctatcgggatcttctacaagtattctggccattggaccgaccacagcactcggagcacatctggacattctcaagtctggagcttaatctggaatcgactcccctccctaggcttacctgggaaccacctgacctttcccaccttttagcccccgtggggtacatctcggcgctggctggtttcaacacaccttccaggcgcctcccaaccacttccacacggcgttccctgtctccctcccctccgcccacctccgcatcccacccgttcacccacgccagtcggcaaccacagtccccttcaacaccatctccccacccggtcggcggcaacagccctcccccacggggcccacaacccggcgcgcaagggcgccaacacacaacccaactcaggagcaaaccccctgggacaccaaggcctctccccaagaaatagcccaccagccccaacccccccccggcggcaacagggggaaaaaacacacaaagagaaggcatcaaccgcacaacaccaaccacagcagcacagcccgcagcaaacgggacaaggagaaagacagagatgacaacgctggacaaaaaacaacaaccagagcgctacacaccacgagacagaacgacggggagaggcagaccaaaagagcaatggagggtggaggggagcagccccacgcccccccgcacaaacaagggtgggttcagcgccaaaaaccataaacgccggagcggctgcacatcgagtctacgagagcggccgacaccacacaccaggcagcacg

SEQ ID NO: 659929 - DNA, 1102 bp, Homo sapiens
gagagagtgaaaagaccgcttacccaatttgaaattggtgagatgttccttgggctggttggtctgaggacctgaggtcataggtggatctcttcacggagtgaagaacaggtggagaggtatgaagaacgaggaacactgcccggggagtttcttcctctgcaaaataagggagtgtgtactgaattaccgtttccagctccaacatccaggatttcagcactacctgcagagtagtgggaggagagatagaggaagaagtgaagataagaaaccactcgaagccggtgtctggtgctgggaccgtggtggctgggacggcagcagtcgtgctgtccatctgctcttccgaggggtggcacatcctagcctctatcttttccccagagaagatccccctcgtctgctcttcccccgtctcagccttttagtgtgtgaacagttctggtgttactcagcaacgcttttgttagcgcctttaccagcaagtacttgttaaacacctcaactctaccaggggaactcaccaatcacggataacctaatctaccaacccccacccccttctagctcctcgcacaatgatgacagatcctcgtctctctacgaactactaaatttacttaaatccgacccccccctcacaccacccatctatcactcatgctcattaaataaactcccctacccatcgctatactaagaacccacccctctacccagtcactctctcacccctagtactccaaatcactccaccgcatccggacacaaaagccgccccacgttcagcggtctaccatacacctgctacctatcaccgcccactatacccccccacacaccatctgcgtcatcaccccatatgcctctcggaccgcctataaccatccccacctacacccatatcccctaaactcccacccacaccatacccacatattccccaaccccacaccccagcccaacaaaaattaccacccaccccctaatcattaatcctactatcacagaacaaatctgtaaataaaccagccttcatcaaaccccgagaaatccatagtccccgcataatttctcacccctcaaaccccaccacaag

SEQ ID NO: 659930 - DNA, 472 bp, Homo sapiens
  misc_feature (42)..(42): n is a, c, g, or t
  misc_feature (48)..(48): n is a, c, g, or t
  misc_feature (90)..(90): n is a, c, g, or t
  misc_feature (158)..(158): n is a, c, g, or t
  misc_feature (199)..(199): n is a, c, g, or t
ccccactttaaagtctgtgaagtaaaaaatctgatcaccctnaagganggtgaaaacccgaagttccttcctggaagaaacataattggnaaaataaataaagttaatgtgccctgaatcaagttgtttcggttaactctgtctttttccgttgttgntgttgaagatggagtttcgttcttgttccccaagctggaangcaatggcaccatctcggtcaccgcaacctccgcctcctgggttcaagtgattctcctgcctcagcctcccaagtagctgggattacaggcacatgccaccacgcctggctagttttttgtatttttagtagaaaccggggtttcaccatgttagccaggctggtctcgaactcctgacttcaggtgatcttcccgtctcggcctcccaaattgctgggattacaggtgtgagccaccgtgcctggcctattttgtcttttaaaagctattta

SEQ ID NO: 659931 - DNA, 438 bp, Homo sapiens
  misc_feature (210)..(210): n is a, c, g, or t
ctgtgtgacttgggcagcagcttgcagtctctgagctcttagatccctgatggacgaaggagaaaatgacccccttcccaggctgtggtgaagaagagggaattggatcttggatattaaaatgctgccctggcacagaggtaggagctgagcaacactgctggatgaacaaacacatgtaatgcagggtgaacagaacatttcatctgncacagctgaaggcacagcttacctatgcccatggaaagaactgcgtggaaaattcatttgttgcatttttggcaggttgatgtttgcaaagcagggcactcttctccacattttccccaaaaccaatcagagggagactccacatttgtttcatctcctcccctcaaacaattatcaaaggcctgttgaacaaacgggtgtctgccaactgggaaaggcaaagagcca

SEQ ID NO: 659932 - DNA, 999 bp, Homo sapiens
  misc_feature (505)..(506): n is a, c, g, or t
cttaaggtggttctcccctcaccccattgaacctggtgacttacactctgcccctggtcacctgaaggcacccagcctggccgtggaagggggaacaagatgactgccttggctctggctctccaaggatcagagaacacagagaaacctagagaggccacccacatggagaaggaggaggaagggagatacaaatcccccgtttcccacccaaaagcacagggagggaaggcagggtttgggaaccaaggctgggccacattaggtatttaaagtccaggctgaccagctcttcatccctaggaggcttcactttgagggttggggaaaggacttgggatctgaatgaaccccatctttctacacacaaaaagatacagcaggcacaactctcactttaacacagctccccatgggccaagcaggcagcccaatcagcccagggcaagtgccacatggctcgtggagggtgggtaggagggactgtcacgggacgggaggaagnngaggagtaggcaggatggcacacattttaatgggaaatcagctgtccagggattcagcttctggagccgccagccattgctcacttcctccttctcagtctctgccatgtggttgtgcttgctgggctttccttgtcctactaggagacctggtgtggatgttttcactcctacttctaattggctgggaagcagcatttgccacaggcactgtttaatttcgtttccatcccctgcatctcacaggaaagcaaatggtcaatagttcagattaaaagaatcatcctggtcagctccaaaatatggctacttgcatggtaatcacagcaaagtctgtcaaatcagtgattctttattcctaagaggaagggatttttcctaagcattatggttctaccaaccaagggagcaggcctactcttcaaaagtggctgcaaaggctggcaaaccgagaggcctgctttgggctcagaaactcctgttggtcctgcca

SEQ ID NO: 659933 - DNA, 931 bp, Homo sapiens
  misc_feature (372)..(372): n is a, c, g, or t
taagatcaaattatattttattctattaaaaaaggttttggaaaaaagatacttaaattttaaaagataactataattcctaagtgattaaaaataactccaagcagagagtgaaagagcaaagtgcaaagtgcattaaaaagaccccagagcatggttagcaaaaaggcaaatataatagttaggccaaggcattatatattattcaataaaaggcaaataaagaagggcattaaaggcaaggttgggggaagacgcttattttaaaactggtaaaaattcattgtgaattttataaagagacatttcaaaaccaatatctgtgggtttctaattaaacaaaaaaaaacattttattctggaaagaacggnggtctctgggttgcgtggtccaccccaaagcttgtggagtgcgagggggtggtgaacactgtgggtctccatgtgggcaagccttgggaaaccctcgtgggggttctcaaggcaaatcccctcaccaaactttcaaaccttccccaaaaggtgcgggggacatcttataagaacatttggagcccaaccaatacagttgggtcttacacatttatcctaaatttcgtttaaaaatggtgggctagcgtggtgcgaaatttaaagcttttgtggaaaagagaatatacaagggtaaaaatagaaaattattaaacggtgtgggctttaatagttgggaatagcataaccaaattgtagaaatttataaagccccatctaatattacataagcagaggacttgggaacaatgatcagggaaatacaatggccaccaggcaacaacacattcccaaaggccataagccttagacaaaagggaaacccgggacaccggcggaaaaaatccccaatttaaaccgtcaaattcctccacacacggcgcaaaccacctaacaacgc

SEQ ID NO: 659934 - DNA, 447 bp, Homo sapiens
gggcggggactctctcttcctgacaccactgcaatgtgtccacttctatcgtctgccagcaccttaactcagatcggtagcatctgctgcctgtcctgtgcatctcatggcattattcctgctgtcctgcagaccagtgcggttttgctagcttaggaacatgactgtgtcacccctacagttccgacaacccttcatttcaagcccatctgccttgctgtggttactcaggctctttggactgggcctggcttcctgcctctcttctcctcccctcttgccccagtgtactcctcagcttggccaccctgagctgctttccacttttcacacaaaccaaatcatctttttcctctgcgctgactgctccttcttcctcggtgcctgactagccctcacgcatccttccgtgactcagcttacactcttttctttcagaaacctctg

SEQ ID NO: 659935 - DNA, 119 bp, Homo sapiens
cgtgatgttattgcccaacacagcttctttcacttagtgaacactagtcagcacttcatcactacacttaggtgcttttaatagtgaaatcaccaacaacaaaaaaaatacaaaaatgc

SEQ ID NO: 659936 - DNA, 288 bp, Homo sapiens
  misc_feature (6)..(6): n is a, c, g, or t
  misc_feature (10)..(10): n is a, c, g, or t
  misc_feature (212)..(212): n is a, c, g, or t
ctcgtncgtnttttttctaaaaagaaaaacaaaaacaacaacaaaaaaaaaaatcacaccaattctgtgagcaatggtgtgatttttgggacctcccatctttctgttttgaaaagtgtacagtagtgcagtgttcctgatgtaactttatggcttacaatgttgacatgtctcaggttcatgtgtttcgattggtgttttccgtctcaggncagattgcaaagtgtaggccccacacattggaaaaaataataataaaacaaagcaaaaacaggaaattatggattt

SEQ ID NO: 659937 - DNA, 110 bp, Homo sapiens
ctctctaggatccccttattaaagttgattaagcctattagtgaaagattgcaggccaggcacaatggcttgctcctgtaatgccaattctctgggaggtcaaggcagga

SEQ ID NO: 659938 - DNA, 207 bp, Homo sapiens
  misc_feature (101)..(101): n is a, c, g, or t
  misc_feature (193)..(193): n is a, c, g, or t
gttgatggacaattacataactattgttgacgtgatggcacgccgctatgtcctgaaaggagaatacggaacgaatcctgaagacatctaccccgaggaanccctactgatgatgacgtgagcagcggctcctccagtgaagaggagcagcactttcaggcggttacagtcttttacagccgttttctactgngtcctgatctcgtg

SEQ ID NO: 659939 - DNA, 522 bp, Homo sapiens
ggacaactatcttggccaagaatggataagggtggtccttccctactcaggctactagctcaaagtgctaatctcttcggaaacaccctcactgacacagtcagaaataatatcttagcaagatctgggtatcctgtggcccagtcatgcttacaacataaaatgtaagccatcagagatcctcaaacagcactatctgggtatatccttagaagagagaaaccaagggttcagacgagttacctacgtgtcacaaaagtaagtaaggcaggtaaagcgaaaaatcagtctcgtgtctatctaactcacgagatctaagagcataatgccaagctaagattctgtggaggagataatagtacaaggttaggcccttgctccaagaaagttcctgcagacggagatcagatatatacacatcaaagaatacaaaacctgtattattctatattgactacaacttataaacgaagaagcctagaggaaagacagattcagaattaaacagattccttcattcag

SEQ ID NO: 659940 - DNA, 213 bp, Homo sapiens
  misc_feature (110)..(110): n is a, c, g, or t
  misc_feature (144)..(144): n is a, c, g, or t
atcggcggcgctccaaagtgtggatacaggtgtgagcacatgctaaatactcattttttctaatatttcttattttcttctgagacagtgtttgtcttgtcgccaggtgnagtgagtgcacaatctcagctcactaaacctttngctccatggttcaagcaattctccatgtgcacaggctactctaccttttctaccacccggcagtatctg

SEQ ID NO: 659941 - DNA, 144 bp, Homo sapiens
gtcatgcagcgaccggaacgtgacctgtccggtgcgctgccggaactggctggcggctgattgccggtttctgccactttcgccgatctatcgcctgaagaactcgacctgaatcgccgacgtcctggtcagcgccggcggtgg

SEQ ID NO: 659942 - DNA, 1168 bp, Homo sapiens
gtatctcatgctgataccaagttcagtgatcgatggctttcttgttgcgcctctgtgcccacatgtgtatctggagagatgaatctcaggtctcatatcacaaatgtcctacctgaaatcctcttcgagacttgagattgcaatgatctgtgagtctgcatgaatatagcgagtgcagcaagttcgaaagagcatcacacgggattccgttaggctaggagagaccggataagtcgagaattgaacgagttgtctgactagagacgcttgtgtaagtctctcatagcgttttccgagagattctataacagcgacatttgggatagacttgtcgattgtgaggaggatcgataggacttgccaccacatggctaaggtccaggaaagggtaggctcgtcatccagatattcacgtgcgcacggtcttgtgtgtatattccctgtggcgtctaggaattctagcgattgctgatacatcgcatgagtgtgcttccactgagctgccttgggcgacaggtcatccatgtggtctcgtttggtgcatcatcgtctccgagtgcagggacctcggtttaggaacctcgtcggcgtccacgaagtgcgtctatcacaggaactcgacgtggaccctccgtacagtgtgcgtttgagcgagactttgctgcgacgatgttcgtccgacactcgaagaagcagatctccgatgaaggtagggtgcacaccgtcgaatgcgtgttgtaccgtgtggcggtgcccgtggtggtgcctgggcatagacccttcggtctgtcgtcgcgtcgccttggttcgtagtagccgagcgaaccgtattgcgttcgcgtagctcgtgatctggcatacaccgactggcgcattgattgtcattatgtcagctggtatgaccgagtctctctagatagaccagcgcgttccgtgacgcttcgcttcaacaacattgagtagcggccgtatggacaccgcacttggcttgcccgccaaagcgcatggcgttgacgggtggcttggacctctctgcccgagtcttttgactctggacctaacaggggactgggctggcatggcttcctgggctggactccccttcgtgtggccacaacacggccgcgccggtcctccctcgtcttgggcttcatcccttgttgccagg

SEQ ID NO: 659943 - DNA, 231 bp, Homo sapiens
atatcagtacattaaaagttatactgtctgtatcatattggaagtgaattctttcttatgtgccgctggtgaaagacatctgcgcagttcacgttcctgtagtataggcatatcttggtctgtttctagaccactgcgatacaatgagtcacacaaattggttacccagtgcttataaaagttaggtttacactatcgtaagtgtgcattaacatgtctaaagtgcaatca

SEQ ID NO: 659944 - DNA, 176 bp, Homo sapiens
tacctgatcgtctaaagtcacaggctccagcttaacgatatttggaggtcagcacggtgctcacgtgtcgacggaactatgtacagggaggcatagcacctgcagtggtagaatacacgtctgaccatggctccatctttaacgatatatatggaggtcatgcacgtgttgctcac

SEQ ID NO: 659945 - DNA, 460 bp, Homo sapiens
gaagcagacagaaagttcggagttgaatcaaccttccactgaaagacttcctgagatcattctaatccccttcttcaggtttaatctccagttaaaactcacagaaggaacttcatgaagatgtttacagacttaagtgtttgattagggaaagagggaaaggaggaagaataatttaccattcttaatacaacggaatgatagtagatacaatttgctgtagaccagaaaacagtgtgaaagtaacaaactgtcagaaccatataaggggttgttagactttttcgttattctgttccccttggcaacaaggtcagagctatgacaaaacaatagattgggtgcctactatatacaatacctaggaacacccagttcttatccacatgcagcccacagcctgttgcggaagcacaagaaatgctataatgcagaataaagtgtagatcccaacaaaaaa

SEQ ID NO: 659946 - DNA, 521 bp, Homo sapiens
cagctcggtacccccactttatacctgtgtgagtgaatgaagaggggaaaggaagtggtcctgccacacacggaccatgcagtgcgaggaaacccacaggacgggggcgcagccttcaaggatagcccaatcaataagaacggggatgtgtgtttgggccgaatggggcgagtaccagagagggctgctccaagcttgggggctccgtgatgtgtgagcttggatgttggactggagcggaggccccgtcagtatttctcatcttctgggggtgggcgtgggctgaacaggaaaagtattttgagcgttccctgtagccggcgatgttcaccagcccactggactctcttagcccactcgctggcatgcatccgtcatccctcacctttgggtcccagtagtctggaggatccagacagtccctccatctctgctctctctccgtcgccccacatttgagcctgagagattccctggtttcttcggtcaccgcacatctatccctgagagatcccctgctc

SEQ ID NO: 659947 - DNA, 210 bp, Homo sapiens
gagacagactggccacatggggaaaccccattctacataaaaatacacaaaaattagctggacgtggtggcaggcgctatatgccagataccggcgggctgaggcgggagaatatgcttgaacctaggaggcggaggttgcagtgagctgagatcgcgccattgcactccagcctgggcaacaagagtgaaactctgtctcagaaaaaaa

SEQ ID NO: 659948 - DNA, 173 bp, Homo sapiens
  misc_feature (139)..(139): n is a, c, g, or t
agcagaattcggtacatgactcaggatatgaagttcatcatcaaaaattggtgtctttgcagaagatgtgggttcaaacaaaggtgcaatcacttggactcatggatgggcggtgtagtcatacgcgacagtgatcgtncatcaccattggtgatcgctgaagcaagaaacag

SEQ ID NO: 659949 - DNA, 196 bp, Homo sapiens
ataaaaagatgaaacaaacagttctggcaagctggagagaaaaagaacatgtttacactgttggagggaatgtgaataagttaagccactgtggaaagtagttaaaagatttctcaaagaactgaaaacagaactgccattagacccagcagtcccattaccggatatacacccaaaagaaaaaaaatcattctac

SEQ ID NO: 659950 - DNA, 134 bp, Homo sapiens
ccggtccgccgtaggatccccctactgagtagctctcagatcattgaactagtctgttccattgtatgggatggcggatagtaagtttgtaaattactgtggcccctcataatgatatttgtgcctcacgggag

SEQ ID NO: 659951 - DNA, 170 bp, Homo sapiens
tgagtggccagctgaaagggaagtacatttttatgtaataagtcacagttatttggggtctgtattactaatagttgaaattcatcctatttcattcatctcacagcagaaaactaaattccaggcctagtctaggaaagaaacagcttctaatggattagctttgcaat

SEQ ID NO: 659952 - DNA, 294 bp, Homo sapiens
aggccgaggagggtggatcacctgaggtcacgagttccagaccaggctggccaacatggtgaaaccgtatctctactaaaaatacgggtgtggtggagggcacctgtaatcccagctactagggaggctgaggcagaattgcttggacacaggaggcagaggatgcagtgagccgagatcgcactattgcactccagcctgggcaacaagagcaagactccatctcaaacaacaacaaaaacccaaaaggggacagcagtaaccggagaggccagcatctggacaccccatcag

SEQ ID NO: 659953 - DNA, 102 bp, Homo sapiens
gtagggatgcaggtatagattaccttggagctacataactttagcttttccctaaaaatatatgtcgtatgctagataaaaactattacatttatgggcata

SEQ ID NO: 659954 - DNA, 800 bp, Homo sapiens
gccgggaggcggaggttgcagtgagccgagatcgcaccattgcactccagtctgggcaacagagtgagattccgtctcaaaaaaaaaaagaaaggaaaaaaaaatagcattatacctcttccttgtctcaaccggccatgaaaattctggaacactccaaattcagtgggataatccaaaacaaattttataaggtataaaatatttttacttcttatagtaatagtatactttaaaaagcctcagggtatattatcttctaaacagctacaattcagttgcagcctactttaaccaattatgttctctagttggagaacaattagggcctatttcactggctggtgtagcctcagtggcctaacatggggtgccaaattaaatatcggtagaattacacctggatttgtaaaaaccattcggtttttggtttacaattggccaaaattcctcaaaagcgccggtatttatgtaattctttggaaatcattatttatttggatttctacagtgtatgactggctgggtgtgacttagtcacattaagtactcaagtatttataaaaactccaaataatttgatggattttaacacaaacatccttccctttttctacaaggtcattttttttacaaaatcatgtggggtaatctcctaaataggggaatattttatggggttctaggaaccattgtttcaaatattctgtgggtttattcaggaataaattggttaaatattttccaacaacagattttcataatttccaaagagcattttggacgggggacattggcgg

SEQ ID NO: 659955 - DNA, 169 bp, Homo sapiens
ataaaagggggatcatcgttgagtctagcctggaggactctcagataggtgatgggtgcagtccatatacttgtgggatcgagctggactccatgagaaatctgaaggccagcttggagaacagccctgagggagtgtggagtgcccgctacgccctacagattgagca

SEQ ID NO: 659956 - DNA, 451 bp, Homo sapiens
cgcagcaatataagtcaccatactagaaatagcagacccacttccaaccttcgcacagtccataaacccaggcatacgaaatgattatcaaaagcaattacatacatatctacctacttgtatgtagagaattatttatagtctatctggcgcgttcatgtacaaaattagtctctaaatcatgtacaaaaagctgtaatatcgaaaaagtcaccacatactgtacaagtttacaaggaagagatcccgttattttctctagcatttttggccttgctaggcattgcgtcacattatgagaataattgtgtcaaccttatactcttaaaaaaaaaaggaacaaaataaaacccaacacataaaaatctttccaacttcctctaaatttgctccctatttgaagtcaggaacatcatagctttacttcaatttgaaatacctgtggtaaaaa

SEQ ID NO: 659957 - DNA, 337 bp, Homo sapiens
ggtgaatgggcgtggtgctttactacatgtgtgatcgaacctgctggtctgagcgcgtctattgaattggtaaagtaataccaatggctttatcatttccttcttcccttcaagtttcacttgaatttaaaaatcatggttatttttatcgtttgaggcatcatttctgtcttctgggtccattttttaaatgtttaaaaatatgttgacatggtagttcagttcttaaccaatgacttggggatgatgcaaacaattactgtcgttgggatttaagtgtattagtcacgcatgtatggggaagtagtctcgggtatgctgttgtgtaaacgtgatt

SEQ ID NO: 659958 - DNA, 268 bp, Homo sapiens
  misc_feature (235)..(235): n is a, c, g, or t
aaatgggattccttcgctaggaagagcactcggaataacctgctggaaatgagattccttcgctaggaagagcactcggaataacctgctggaaatgggattccttcgctaggaagagcactcggaataacctgctggaaatgggattccttccctaggaagagcactcggaataacctgctggaaatgagattccttccctaggaagagcactcggaataacctgctggaaatnggattccttcgctaggaagagcacctcagaaca

SEQ ID NO: 659959 - DNA, 203 bp, Homo sapiens
  misc_feature (13)..(13): n is a, c, g, or t
ctaggcgctcagnatgcgtctggcttaccagagggactgcctgaaggaatcacctgagcctgtccgtccctaggagtggggagaaaccccatccagtcctggaggacccgctgctcctgctgctcccggggatggagcaaggccaaggctgcgggaggctgggagccctgccctgaccatccctcccgcaccagcgctgaacc

SEQ ID NO: 659960 - DNA, 505 bp, Homo sapiens
aacacaaatatgcgcaggagcacttcttgggaacacctcgaccactggccccggatacaacggagatcatggagggggcgcagcggatgccccacaatattacctacgaggggatgaccgccctcgccccacttgggcgcatacgcgtgtgaaaacaccgcccacccctggggggccatagcaccccggcagtgcccccacctgtagggacgcggagacactgacaccacgcgacgctttgccaacacaacgcagggaaccaccacggcgtgttgcaccgacgaaaaaagctccgcaaaattgaccctgcccagctctgtggggatgccgcccccagggggcgcaccgcgcacacttaggagaggcgcagagaggggagggaaaccccctcgtagcccgggagaacacaaggggccctctcccaggaagccagtagggactgatggtaagaacacccaagagggggcaaaaaaagaagggaaacccttttcgcccaaaaaaaaca

SEQ ID NO: 659961 - DNA, 183 bp, Homo sapiens
gtccttggtcttctcttctgatccctcttagaactgtctcttagtgctcagttcatgggaatacaggccttttctctcctgtatctccataatctcccagcctctgccagttacctagttccaaacgccacttatataatatcctcagttatctgttatagcaacaatcccacttcgtgagcc

SEQ ID NO: 659962 - DNA, 373 bp, Homo sapiens
  misc_feature (304)..(304): n is a, c, g, or t
gcccgttgtgtgccctgaacaaggcacacagtggtgttgctccagccccctcgccactttcagggccacacctgctccagggcagtgggaggcgcaggtatcagggaaatgtggatgtggaaatggacaggtcaggggttggggcaactatggggctgcccacgctgaccccttaaggctgggccctgtgtccaacacgccagctgaggtggcccacgggggacccagacctggttctgccctcgagggctctgggattggagagggcagctgggcagagagtcccacaagttctcaaaaaacngaagaggcttcccagggcccacgagaagccagcacagtcagggagggcttccaggaggcggtatggcct

SEQ ID NO: 659963 - DNA, 154 bp, Homo sapiens
  misc_feature (119)..(119): n is a, c, g, or t
aattaaaaatattaaacaaaactaccactcctccttattaaagcccataaaaataaaaaacgaaacccgagaaccaaaatgaacgaaaatctttcgcttcattcatcgtccccacaatnccaggcctaccccccatactgatcattcattgttt

SEQ ID NO: 659964 - DNA, 171 bp, Homo sapiens
agcagcctttctataggcaaattcaggtcatttccaggcctgcccagagttattatggggcaaggtgttcgggatagagcgagagggaggcaaattccaactcagacccagggatcatctaggttggtagccaaagccaggttcagtgctatggaaacttctaaaactagg

SEQ ID NO: 659965 - DNA, 200 bp, Homo sapiens
  misc_feature (64)..(64): n is a, c, g, or t
  misc_feature (67)..(67): n is a, c, g, or t
cggcacgaggatgagaatctaatgcctgatgaatctaatgcctcatgatctgaggttgaatagnttngtgccgaaaccatcccccacccccatcccgttaccccgagtccgtgaaaaaattgtcttccatgaaaccggtccctggtaccagaaaggttggggaccactggcttaaaataccaataaatttttggccctta

SEQ ID NO: 659966 - DNA, 114 bp, Homo sapiens
ggaggagggaagcttaactcaagttttggttagtgagttagcaagctctttgttcagtgggaatgtgggaactttttaaaggtaaaattaccctcttccaaattttaaacccag

SEQ ID NO: 659967 - DNA, 448 bp, Homo sapiens
attgggacccccagatcagaccatccaccaataagtggccatcatttgtggtacatgagacagaaaactcacccagatgaactcaacatgaactcatgtcttggggtaatttgttacataatagtagatgacccagaaaattcttcagtcttccccggagcccactgagaacaacgtatcgatggctgaatagaaactgggcttacgaaggctcacatcctgcttaactccatatgttagattcctgcagtattattttagctttcctcaccttttgctggaggaaattgtgtggacgtactgaattctcccagagaattagcttgtttttagaaacatgcttacaattatgagttgtgcaattggctgtgagagtgtccacataaaattattgatttttgagcacgtccatgttttcaactctgggtttagtcatatatatcattca

SEQ ID NO: 659968 - DNA, 154 bp, Homo sapiens
  misc_feature (37)..(38): n is a, c, g, or t
tataatggtccaaggtcaaacttttggagttgcagannagcactcaaaggatattctcacaggagcattgtgggctttcagattagggataagaactgctaagtatacaattgattataggttttggaactgggggccgggcacagtggctcat

SEQ ID NO: 659969 - DNA, 152 bp, Homo sapiens
gagtaagctcgttctgtattttattgatttaatttgtgtatcatcaataacttgtatgttaatgctggaaagaaaaaagaggaagaagaaccatccctgtcctcagtctataatctagtggagagataagaaacgtacaaccaaagctacag

SEQ ID NO: 659970 - DNA, 177 bp, Homo sapiens
tataccgtataattgagttttcagtggggcagtcattatccaggtaatccagatattttaaaatctgtcacgtaggacttggatgtacctgcccccaatccatgaaccaaggccattgaattcttgggtgagggacaacatgacctaaatcttgactcagtcagggaagggatcatt

SEQ ID NO: 659971 - DNA, 129 bp, Homo sapiens
  misc_feature (95)..(95): n is a, c, g, or t
tcagaatctaagctaagattgtgtgaggaaggtaggtttcccacaaggcccacattgtcttatttcacactttcccacagatgctgacttagctntaggatcatcatgcgccgggtgtaccagagctcg

SEQ ID NO: 659972 - DNA, 412 bp, Homo sapiens
tgcatgagtgacatcagttctgatatgacgatgggaacagcccaggagcaatttacatcacaggtacgagaagacacagaagtttcagggatgctatactgagaattgtgggtgaacttgagcagatggtttctgaggacgtcccgctggaccaccgcgttcacgcctgcatcattgtgtgccgcggcgaagccattcgcaaaatcatggacgaattcaaggtggacattcgcttcccacagagcggagccccagaccccaactgcgtcactgtgacggggctcccagagaatgtggaggaagccatcgaccacatcctcaatctggaggaggaatacctagctgacgtggtggacagtgaggcgctgcaggtatacatgaaaaccccagcacacgaagagtgcaaggcacc

SEQ ID NO: 659973 - DNA, 317 bp, Homo sapiens
ccgattctttgcccactttttaacggggttacttgttttttgcttgttgaattaacttcttcacaggttctggatattagacctttgtcagatgcacagtttgtgaatattttcttctactctgtagggtgtctgtttgctctgttgatagtttcttttgctgtgcagaagctctttagtttaattagatctcatttgtcaattttggcttttgttgccattgcttttggtgtttagacatgaagtccttgcccaaaatctccttaagctgataagcacttcagcaaagtctcaggatacaaaatccatgtgcaaag

SEQ ID NO: 659974 - DNA, 151 bp, Homo sapiens
tcctgtactgcctgacctccctgggaaggacaacacggggctatgacctgaagcagctgtatcatcggctcggagggcactttggggatcatcaccacggtgtccatctatgtgtacacccaagcccagggctgtgaaccgtggctttcct

SEQ ID NO: 659975 - DNA, 340 bp, Homo sapiens
cggatatcctctatgttttagttttcctttttttaatatgcttcttaaaattcactaagttgggctaggtgtggctcatgcctgtagtcccagcactatgggaggcttaggtgagaggatcacttgagcccataaggttaaaaccagcctgggcaacatagtgagaccccatctctacaaacagttttgaatccaggtatggtggtgccctcctgtggtcccagctactcgggagttttaggtgggaggtccgcctgagcccaggagactgaggctgcagtaaggtgtgattgcactattgctctctagcctggaaaacagagtgagaccctatctcaaa

SEQ ID NO: 659976 - DNA, 132 bp, Homo sapiens
gacgtagccactgctggagcaaagtgaatgagtgtggttccatgcggtgttggatgtgattataaaataaagcatatcatcagcccgcaacccacacgtgagggcaagcagccttgatcgtggctcctattc

SEQ ID NO: 659977 - DNA, 1632 bp, Homo sapiens
  misc_feature (1136)..(1136): n is a, c, g, or t
cacagccgctgacgcgcgtggtcgtgagcactccctatacaccatatacccatacgtcgttcacgcgccgcctacatatgtctgtctacgatgatgggctctattctgctggagcaactaaactactcatgtttgcggggtgttccccacatagacagtgcacggatccactggcgcggcgggccatcctcaatattaggcgttagcatgtggtgaaatctgcgtccgggtatgaccccgcgcatgttgtgtgcccgcattcaacgcacggcaataaaactgcgtggcaggcacgggcactacgatagtcacaaaagccgccggaagaggtttttgtcccgcaaagacatctcgctcctctggggctgcttgtggtaaacctctccatagcatgtactggtgtacacaaatccaggctacgcgtggtacccaatttgtgttctcagccacgccctaagtgtggtgcgcacattgatctgttgccacgcgctataatagtatttgactacggccactgctacccacctaggtttgtgacacataaactgcgtgaccacgatttgtccgcattatctcgctaataccgccctgttgtcggaaaattactctccgccctacttcgcgtcggggcactcgtcggtgttttctccaccaatacggagcaggcaacacttttgtccgggttgcgacaggaggcctacttcaaacacttgttgttcgcactagtatcttcctgttgggcaaacgttggtggccgagcacttaatccccccgggatattctctagtaatatgccggctcgccctatatgtgtaccccaaatcggtgctcttatagtggtgcgtgctgttttgccgcacaaattttcgggctttctccgccacttttgggtcccttcccattcgcggaaatcattttgcaggccgggtattattacttccgcggacatacaaagtccttccctaaattcgcgcctaatgggacatctcctgcagtggtgcgcaggtcttcggtgccactcctatttcctccaacgggaggaacatttctcctggtcacccaccggtatggcggcaacgataatgggggaaacgcctaacgaaattgtgggtgttccaacaccacctttggctctnaacccattgtggggaaacccactccaaggcccggggaacaagtccagtcaaagggcaactcgtgcacacccactggttggccacctttatggggggaataaagttcgacttcgggttgacatttcacgacggtacatataggacagacatgtccagtgtttcgtagctgattcgctagctagctggcctgcctatttgttgattaatgtgacttgatctttcgtactgattccgttgatctgctcaagaagtgcaacgatgtagcatgacagagggttcccagagactcgaggacgccatgcaaggatcctggatcatacacccctagttgtggacgagtgactcacatgggatgccacactagctctggatttcagcctcagatgccagatcttgggtccactggctccactgagggcagctatagactctacagccagagcggctggaattgaattcctgcctggatctacaataactctccgtcttgtgcctc

SEQ ID NO: 659978 - DNA, 771 bp, Homo sapiens
caccaatggcggggtacttgaagctggctgtgtgtgtccttgtcaggcgtcaagggttccacactgtagggagtcgctgcaagaatcggacaggcgctgagcacctgtggctgacccgacatctcagggacccatttgtgaaggctgcgaaggtggagaggttaccggatgtcgaagcgcctacaagctccggaggtgaacgagaggcaccagattctgcggcccgggcttcgggtgttagactgtggggcagactccgggggcctggagatcaggctggcggtgcagaaggtcaacgccgcaggcacagatcccaggtctcctggttggcgttcgatgctatggggtacgatcttcattgacgatattccccgctgggaaggagcgaacgtttgctgtgccctgctgacgtgactgagccgagaacgcgtcacggagaatcctcgaggtgcttcctggcaggagagcagatgtgattctgagcgacatggtgcgctaatgccgacagggttcctgggaccttcgatctatgacaggctcagtcatgctgtgccttgacccgtgtcttcagttgtgaccccaaggactagtcctgcgaagctggggggacattcctttgtaaaacctgggctggaagtcagagccgtcggttacacgaggagactgacagaggaattccaggacggtaaggactcatcagaagctgaacgccagcaggaaagagtcatcagaagtgtacgtgctcggccacagcagtagcacggaaggacg

SEQ ID NO: 659979 - DNA, 529 bp, Homo sapiens
gtgtcgcgatggtgttgtcccgtaagcatgcaatacgtgcagagcaagttaaacttatcgtgtgaacagctgccggctgtattctgctcccagatgaaatgaagcaactcttctgataacgaagagatacctgtctgaggcaaacgaaacatgggcacacagcacagcctcctcaatccactagatcccaactcatctctcatttatttcggcttctttaatgccaggataaatgtagtgtaacatttgcatgtcttttcgctttgattctgctttagtaaagagcagtatattgagatggacatggcctcttcattgtatttctcatcaagtcattattttgggggttatagcttgacaagcaatgaactttagaatggtagattccgtaactttaactgggtagctttcagtttgcttagaaatatttgtgggcatatgcagataatgttctcatcagtagtaagaatctcagggttctgcttatgccccaatggaggtatgacatagtaatcttttctgcctttac

SEQ ID NO: 659980 - DNA, 983 bp, Homo sapiens
agcgggatgaggcgactgcgcatactgccggagcggggtggttatggcggctccatattaacagacctcctcctcctccgccgccgccgccgtctcctcctcctcctccatatcccatcccaggcagaagacacataaggccaatcgtccgacatacacccgaatgacgccatgccatctgccccatcacagcaaaacacacccatacacacctggtacaaccacagacccggcaatgataggagaaagggcacagagagacatggagaagaaccagaacgagccaaacggacaaacgcccaaaaagccacgaccagagaccggcaggcaggcagccaggaggcaatcgaatacagccaaccgagccggaacctagcacctaaatcagcagcccccggagccagcggcctgcgggaacggacgcacgagcacccatgaagggcgaccaaagaatcggaggacggaaatagagaaagaggcgcgacataccagcgaaagggagtccagaggcgtgcgaaaagcggaggaacaccagcgtggaagaccacaagggaaggagcaggcaaagaagagggaagccccacaactccaccaggggacacgcccagaaggccaaccgaagcacacgccctccggtcggccaataccggcacgaacagccgaatgcaacgcaccacacgaggaagccagggacaaccacggcccgtggcaaaacgccacgacactaccacacaccgagcacaggaagacagaaacacgagaaggatcagcagccgcgaacgacacccaacaggcgccagacatacaacatgaacaccaacgcacaagacgccagcgcccacactgcggcacagccccacgacaccacgacgagcaacacgcgccacaacccgaaaaagaccagacccaaccgacacagaaacaacacaaaccagaaaacgcccagcgaaccaataagcaacaaccaaagcgaagaaaaacaa

SEQ ID NO: 659981 - DNA, 263 bp, Homo sapiens
  misc_feature (55)..(55): n is a, c, g, or t
aatttcttccggcacctgctgaaaaagcagtaggtgttctttgcgatccttgcgngcccccacgcctatctgcaagtgaaaggcctgtccctgcgccagggcaccatcgtcgatgccaccatcattcatgcccccagtttgaccaagaacgaggaaggaaagcgtgatcccgagatgcatcagacgaagaaaggtaaccaatactacttcggcatgaaggcgcatatttgcgccgatgcggagtcggtactgggtcattatgt

SEQ ID NO: 659982 - DNA, 207 bp, Homo sapiens
ctcaaatgtagcaccgtcgtctgcgtgatctgcttggagaaggccaaataccgctgtccagcctgccgcgtgccctaaacagtgcaaccctgaaactcgtcctgttgagaaaaaataagatcagctcttctaccaaaccgtaaagcctgtggaaaacacagatgatgatgactctatagctgaattttctcaatagtgatgaggaga

SEQ ID NO: 659983 - DNA, 1325 bp, Homo sapiens
  misc_feature (240)..(240): n is a, c, g, or t
  misc_feature (1306)..(1306): n is a, c, g, or t
gacaggcctgcttcttgtgacctcgatcctggacctcctagaccgggggctgctggtccatgttgctggtgtacgctctgttccttacgctcgcaggtgggaccggcctgcgtggcgtctggccccgtgatgcagcacaggcacgctgtgcttgcctgttgctcatcgcaacctaggcgtaacgtggctcgatatcctgtcgagcccttgtcggagtcagtactcgcgccgatctcgaanccccccgagggattcagaagggaagagtgccgacgtagatacttgcactctacaaggtacgaccccggcactccgatggagccaagccgtggagcttgagtggggactctcttgtgccaagagggcctagagatctcacctgcgctcgcaattggaactacgcaaggcctgtgcgctctgaggtgggaacgacgcagcacactacctgatgcaaaccacgagcagcgctgcacgttggtaaaccgcccggtttgcctgccatgtaccacgtggtgatcgcacaacgacgtggaatgccgactgccaattcagggaggtgtccaagtcccccccttttgctagtggagggagcggcgctcagagggctagcgataggcgtttgcgcctagattttgggagccatgtcctcgttttctccccgccgaaagttgccttcaatatgatcgcaccatcgcttcgggggaagctttgggggtggcgagttccattggggtattgaccgcacctgggtgcttgtttgtgagtcgcccggggcgtgggttccaaggggggccacccggaagagatggcaaccgttatgcagctaagggcgaaccggcggcgaaacaggggggctgaagcgagggtgagagcgcacatgggaacgttggatgccaggcacttgtggtggcgccgaagaaacagcggaggcaatacggggacggagaatgaaccatgcacctttattagtgcctagaggtttggcgggataggaagatgccttggaaaacgaacttctgggggcggacaacaaaaaaacacccaccctctgttgagagggcgcacattccgactaccacttccgcaatgtgtggcaaacgaactgtgaccaacagtgtgtattacttgggggacccagggctcaaaatggccgaaagataattgtggggcccaggcgacgcaaaggcgcgcatttggttggcgcgccacacagcgcgagagggcccttgtaaaaattcctgcccattactcgtgtggatacccaggtaactgtgaaaaacgctaggccaaacaatggtggagccgncagcagggtactagtgaag

SEQ ID NO: 659984 - DNA, 717 bp, Homo sapiens
  misc_feature (564)..(564): n is a, c, g, or t
  misc_feature (641)..(641): n is a, c, g, or t
aagcctcagtatgtgagagaggcagagagcctccctctgtgactcaccattctattggagatccaagcaacccaggcctagggatagcactttgtttctcccaagcccttgaggtaatttggggagagtcttggagatgctgtgagggaaagacaccgggaaaagctgcaggcattttcccagaactgggaccaagaacatcatgccagttttaatctgggtgcatataaagtcagtcattctttgatgacccagaagtgtggctctgcaggcattttattctcaagccaaagactagagggcttgctcttgaggagagtagggacctccaaagccataattgtggaaagcaccttagcagtatggctggaattgcacactctccctaattgcaagcctgggacaggaggagagctgctacagctgtggtttcttctggctgaggagacttgcagccggggccagcttgacaacctggcactgttctgcatgtgtcattgctgggtgccccagcctgctcccctgaaattgtggtgcaggggggcctctctgatccactcctangcagaactccagggaatttagagtacatactttcctgggaccaagaagcctcagtcaccccaaccctttctgtgaanagatcggggtaaagcaagccctctccactctatgcctaaggcagaactcatgacattcagagcaactgctcaacca

SEQ ID NO: 659985 - DNA, 820 bp, Homo sapiens
  misc_feature (110)..(110): n is a, c, g, or t
taggtcagcgtgtgaagtaggcgctggcaacgcgggttccccgctgttattgaggagtaactggcccagcggaccaacccaggcttgaggcagcggggaaccactcggtntgctgcgataccatggaaggaggccggggaagcggaacaaaaccacaggggattggcggctttttcggagccggcgagcaggttactcgcacgccggatttggggtggcgtcccgctaactggtatgaaccctctgtctccttatttaaatgtggatcaacgatacctcgtgcaggatacagatgagtttattttacctaccggagcctaataaaacccggggcaaatttggacgctgccttccttttaacgacttggcagcgaatgttgcatgacaggggctgacgtttggggcaaatgaatggtcctcggcttaggacttgcaaggaaaccccagaacattggctggtccaaaccaagaaggtgtccagattctgaaatatggtgacctaggcaaggggcccttagtgcataaataacttctaaggtttccccctggcttaggatcccaataagtgcaattgggggtggttcatcactctgggaaaaacaccgaggggtgcagaagattgcccttacaaaccaggacagcagcttgtgaagccaattgaacacggccagtgttggcaatacagtcgtaccaggagtgggactccgagagataagcccagaggtgggtctgacaaggagcctacagcacttacgcagcctcttatggctaatacatagtcggcagcaacgtaaactgcgccttgcccacaggactccta

SEQ ID NO: 659986 - DNA, 442 bp, Homo sapiens
atcagctcggtccagatgtcggcttcgtctgggtggatcgggctcatggtctgcggctggtgtccaggtgtccactagggctgcagtcgtctgatggctgtgctgtggctactggggttttctttccgcagctcactcacatggctgttgtcgagaagacctagttcctagttttttcccctggtgcgactctcctcatgacttggtagctggttctccccacagccatgtgatccatgagagagattgaccgatgatgaaaggtgctaagcttttgattatctaggtgccaaattcatacacgatcatttccgctttatttgttacaagtcctgttactaattccagctccacagtaaagagaagggaaattttgcaccatttcttgaacggagaagtacaagagaatctgtggtctatgttttgtagcatccagaccatg

SEQ ID NO: 659987 - DNA, 582 bp, Homo sapiens
agggtgttaaccaagaacccctggaagtcctagcctttcacatgaagaagcgccgtgaagatgaggggctcaagggaaagatcagcgaggccgacaagaagaaggtgctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcgggtctcaggttccaaaggaaggttttggtccggccccaccaattaagaagtaaaataagggcctttcccaaaatgctgtttttggtttggagcttcaagactttgcatttcctaggaattctggttggcagttctcaatttcctgtgttgccaaagttggaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattca

SEQ ID NO: 659988 - DNA, 135 bp, Homo sapiens
atttatttttcatattctatagttggtatgtcttaaattcattcctggagtgggtagtgagtgtacttaaagtgtttcaattcctgttatattttttattaagtttttaaaaacttatattggctattcacctgt

SEQ ID NO: 659989 - DNA, 1310 bp, Homo sapiens
gtcgtgtcggcgcgtgggggttggtgggtcggtgtggatgtgttggcgtgatggtggtgtcgtgtggtgctgttcggcgtgtttggcgtgcgtgtgctgcggtggtggcgtgcgtgggagccgcctgttggcgggctgtcgccgtgctgtccgctgggtctcgtgctccgctgctggggcccggccgctatgttgtatcggcggtaggccatcccgtggtgcgcgctagggcccggtgttaggtacatgtgccttgtggagtgcaggggcgtgggactatgcggaacctgccgggcgtatcggcgctgagtcggggcgccaggtgcgagtcaggtagccgcggagcggagtgtcatgatggaaggtcaccccagagccgatcaagtggaggtatcaacaggtgtgcctgaataaatgggcttccggtgtaacctgttccgcccgtgtaggcaacgagcacgagtacaacctctgagttacgcactggccatcattgaccctgtggcacaataatatgatttatctctcacaagctagcaagagaccaagagccggacgccgccgttccgaccttggccgagaggggagtccggaactagtcatcaggcattcaaacatctgaataccgcccagcagggccactcttcagccgcgtattgtttcatagccgaatacacaacattattataataaacaccctcacacagtacaatagtcgctaggaacaacatatgacgcagctctccccctgaactctaccacacacatattttgtcagcgcaagaccctactgctaacctccgctgttcttatgaattcgaacagcataccgccgattccgtacgaccaactcatacacctcctatgacaaacttcctaccactcaccctagcattacttatatgatatgtctccatacccattacaatctccagcattccggctcaaacctaaaaaaaaaaaaaaaaaaaaaaaaaaaaaaaccaaaaaaaaaaaaaaaaaaaaaaaaaaaaaaacaggtgggccgcctgggccaagtggactttagactggagcaggctaaggcaggcggccgaaattggggctaactgggccaattggcccaatagggagccgaataacaattaacgggccgcggtttaacaaggtcgggacgggaaaaacccgggggtaaccaaactaaatggcctggaagaaaatccccttttggcaagtgggggtaaaagcgaaaaggcccgaaccgatggcctttccaaaaagtggcgcagccggaagggcgaagggaaatggaaagggtaaaaatttgggaa

SEQ ID NO: 659990 - DNA, 286 bp, Homo sapiens
cgagataacaagcacacgagctcacagcacacacaccgcgacacagcacacacatgcacaaacagcacacacacgcgaacacagcccacacgacacacagcacacactcgcacgccacacaaaaacagcacaaacatgcacacagcacatgcacacacagcacacacatgaacacagcacaccgcacacacatgcacacagacaacacgcaatgcacagcacacatgaacacagcacacacaaactcacagcacacacttgcacaaacaggacacacactcatgcg

SEQ ID NO: 659991 - DNA, 923 bp, Homo sapiens
  misc_feature (205)..(205): n is a, c, g, or t
  misc_feature (556)..(556): n is a, c, g, or t
gaaaatgtaccaagaattaaaaaataaaaaaaaaaagcattatgaaggggccaccagagactcccagagaaggaaagggactaggggctggatgcgggagactcagcacctataatcccagcacttggggaaggccgaggaagggtgtggatcacgaaggttcaggaagtttcaagaaccagacctaggcaacatgtgggtaaanaccccgcggtttctacgtaagaaatacatacaaaattcagcgtgggcatgtggcagccatgtgtgtgccgtggtaactcccgaggctgtacttgcgggaagagctgaacggccaggagagaagtgtgtgcgctagaaaaccccgagggaggccacgaaggtgtgtggcaaggtgaagccccggagaattgtggagccccactatagtgctctccagaggcttgtggggccgacacagagagacgcaagagaaactctcccggggtctctcttaagagacaacaagagacacacacacaaagagcgcccaagacagtgacagcgtgtgggctctcacagtggccgtggggtnaaatccccagaggacactcctcttatcggggagaaaaggcgcacagagagggtgggagggtggggactcacacaccagaaaggggtcaccagggagaaaagaatctcagagcagacacccagtgctctggggggctctaaaaccaatgggtgtgcagaaacaccttggcacaagtgcgtgcataacctctatgacacacatagtaacaaacaaaaagaaatatgtagagcaccgcgagtgcgccgtgtgagagatggcgcggggtgtacaaccccgtgggttaaggattccccccagggcctaaccctgtgcgagaaaaagggacgtgagagggcccacgggagcaacaaaagtggggcgatgacaa

SEQ ID NO: 659992 - DNA, 154 bp, Homo sapiens
aattttgaagccagcttggtctggatcaaagctgtgcttgaggctgggcacagtggctcacacctgtaatccccaacactttaggaggccgaggtgggaagattgcttgagcccacgagttttacacctgggaggcttagggggaagattgctt

SEQ ID NO: 659993 - DNA, 682 bp, Homo sapiens
gagagtgagtgctgcaatgccgagcggaggaggcaggaaccggagcgcgagcagtagctggtgtgggcaccatggctgggatcaccaccatcgatggcggtgaagctgcaagatccagtgttctgcatgcagcagtgcagatgatgcagaggagctgagctgagctgcctccagctgagaagttgagggagaaatgtgcgggccctgtgggaaacaatggctgaggctgagtgtggcctccttgaaccgtaggatccagctggttgaagaagagctggacctgtgctcaggagcgcctggccactgccctgcaaaagctggaagaagctgaaaaagctgctgatgagagtgagagaggtatgaaggttattgaaaaccgggccttaaaagatgaggaaaagatggaactccaggaaatccaactcagagaagctaagcacatttgcagaagagtgcagataggaaggtattgaagagggtggctcgtaaggtttggttgatcatttgaagggagactttgtgaacgcacagaggaacggagctgagctggcagagtcccgttgccgaggagattggtgagcagattagactgatggacagaacctgagtgtctgagtgtgctgaagaacagtactctcaaaagaagatcaatatgaggagaatcagatctactgataatcag

SEQ ID NO: 659994 - DNA, 80 bp, Homo sapiens
agtaatggactaattgtagacaatgtggagtgtgtgctgggcgaggatggtgaatgtgtgtgtttctgtgatgacgtctt

SEQ ID NO: 659995 - DNA, 385 bp, Homo sapiens
  misc_feature (299)..(299): n is a, c, g, or t
  misc_feature (338)..(338): n is a, c, g, or t
cacgaggagcatcctgaacggcctgcgcaaggcggccgagttcacgtcatggcgggaagtgccgaacaaccgcttctatgaggacgagcgtctgttctcgccggtgctgcgcgtcatgcctgcgcccttcgcggtgctgttcgccctcggtctgccgggcctgatcctgctcctgcgtcggccgggaagcggctggctgctgtggctgccgacgctcaccggcgtggcgaccgtggtcgtcttcttcgcggaggatcgcttccggctggtcgtggtgccgatgttcgcgtttggagcancgctatggctggcgtggctggtccacgcctggagagcangcaatcgggcgttggcaaccggtggactgatggtgtcggttgcgcta

SEQ ID NO: 659996 - DNA, 105 bp, Homo sapiens
tctagccgcgcagtgctgggggttggtctgtgttatctgccacctcaccgtctacactggcgaggctaggacactggcgaggctaggacactggcgaggctagga

SEQ ID NO: 659997 - DNA, 542 bp, Homo sapiens
taaattcgcggccgctcgacggcaagtgcagtcctacctgctgcttactgtaaatgttcatcgccctcagacagcacgctgaggaagtgctccctcccgaatgctcgcctagacccctctggccaccgaccccttcctcctgagctgctgttttctagtttgttttggcgcttgaaatgctctagttttgccaagccagaaggaactcctagatcctcccatgctaccaaggaagaaactgaggccctgggagaagagacttgtcctaacgtctggagcttccggtggctcttgttactgacgccatggccttgaggaggagtcgggatttaggcccacgtgggcacttcccaaacctgtgcttaatgcagcccctcagcccgggcaatatagtgagacctcgtctctatcattagttgtgacagggactcactgtatcggccagtctgcagatgagtgacatgatctcggattactgtaaccttcgccttctgggatacagcgatctccggcatccctttcccagtatgtgtgattacagt

SEQ ID NO: 659998 - DNA, 353 bp, Homo sapiens
ccatccaccatctcagtctggccagtgcaaatgaaaacctgggacccatttgtgttgggtccagcatttgccatgcacaagatgccaggaccggtatgctttagaatagagttctcatcttcaaatttctccccatagatgcacttgcccacagtgccattatggcgtgtgaagtcaccaccttgacccataaccctgtggaataatcctgtaaacgcactccgtgtctttggcaccgtgtctgcaaacgagctcaaaggacacgcggccaagggtctcgctgtccgcgacaatgtcaaagcacgcggtggggttgcccatggctaagagcacgcggttttccgcggctcgtg

SEQ ID NO: 659999 - DNA, 1066 bp, Homo sapiens
  misc_feature (438)..(438): n is a, c, g, or t
gagcagtgatgtcagataccggagtggaccaatgatggggcggtaccttactatgtgtattcttggagtcgggtgtgcatcgaatatgtaggctgtaggctgtctgtccaatctgagcaccatcgagaagtactcatgtggagaatctagcatactcatcgcacagttgaccttgtatgtactagagggaccgatgagtatatgtaggtcttcatgtcccccaatagatcattgttgtccctacatctctcgatcaaatgaactgacaaatatactggctattcacagatcagttattgtcatcgcatgtgcggctactaggacgtctaggtgctgtgatacctctatgcgtctagttagtgtgactgtgtagtggacctacccacgattcgggctttccagattattcttaaagatagagggtagacgcccgtccantatagggatcacacacatcgaggacatgctcacagttgtctctcttagacgcgcagagatagtcgtgatcaccgagtacctcttagagaaaggatctcatagaccatgcgctgggagaaattctagatctatctcagcgatgccacctcgaggaatctcattcggaaatccgagaggagtgcacaggtagtactacttctgtgtcgcatactgtgggaggctccttattgcgattagggcatgcccctttttgcccttttgaatagtcctcctctggagagcatccgtttgtatgctaactggggttacttttcgaatgccttagccctatccagtggacacagcactgtaccataggctagggagcgtggactttgcaatatcatctggacctaatcgtgtacgtcgctttgcggtgtccgatggtgcccacggtgattgtctccagctggaagaaggtagtggattctgtccttgacttgcaatttgctcaatctacgcggagtaaattcatgcccattggtccttttgggaagaaccaagatttccccctacatttccgcggtggcctctttgtgaacaacccggctgaatttcgtggcgattctagtattgcaaaaaaaaatgc

SEQ ID NO: 660000 - DNA, 463 bp, Homo sapiens
cggatcgggtcaggatcacccaactgtagatagaaaatatgcggaaaaagaaatgcacctgtactgagcgtgtacagatcttttttctggtcattattccctaaacgaaaacaatacaacaactatttatacaacatttacattgtatgacggtattataagacaatctagaagatgatttaaagacgtacaggcatgactgtacgcaaggtttactggaacatactaacagtttttatttttttatttttatttgtgagacgacagtgtcacccacgtctcccaggtctggagtgcagtggcacgctcatcggcgcactgaaaacctccaccatcccaggttcaagcaatctcttcgtgcctcacgcctccgtgagtagctcgagattattaggtgcccgctcaccatgcccagcatattttggtagttttaagtaaagacatggtttcaccatcattggcc

SEQ ID NO: 660001 - DNA, 427 bp, Homo sapiens
  misc_feature (268)..(268): n is a, c, g, or t
  misc_feature (331)..(331): n is a, c, g, or t
  misc_feature (338)..(338): n is a, c, g, or t
  misc_feature (383)..(383): n is a, c, g, or t
  misc_feature (400)..(400): n is a, c, g, or t
  misc_feature (410)..(410): n is a, c, g, or t
cgatccccgtaaccaggcgttagcttgttcgccgacgagcgcacgcatcacaggcactacgacggcaaacggtgcctggggttgactgcttacatcttcccgctcgactctcgatctgcgccgaaagtcgttggttccgttgcgactttcgacaatgcaggccgcactggcacactcggttgcatccaccgaatagagcccgattgcaccaacctcggtgaacgcgcaccccgacgtaacgaccacccgatgctcagcatcagcattnatcaccggacactgttctcaccccctgttcagcgcgctttgacgtgcacggatattcaccgtngacacgnggttttcgcaggcaaattggaaaccgaacgttgtaattgaggtcntcattgttattgccgangccgtggttncaccgggggggcagaga

SEQ ID NO: 660002 - DNA, 306 bp, Homo sapiens
ccttcccaaaaggtttttgttttttttattccttttgggttaaagcagaccaagttcccccccggccccccggttgtgggggggcctgttatttttttaaccaacctcccctttccccccggggtcctccccctttccttggtgccaattttttccccccatagggcctttggggttgtttttttttttttgggtataaatggaatgttgggggaatgccccccccctgggggggggggttccttccccttttccccggggccggggtttttttgggggcggggcccgttggggccctttttttta

SEQ ID NO: 660003 - DNA, 973 bp, Homo sapiens
  misc_feature (619)..(619): n is a, c, g, or t
  misc_feature (973)..(973): n is a, c, g, or t
agcggggcggtccaagcaaggagcggcaagctgttgtccttttccacgttgtggtagcttgttctttgttcttgcaatgtatgtattgctgctgctcgttctttgggtccctgccacgtttatgagctgtaatgctcacccggaaggtgtgcagcttcacttctcaagccagcaaggttactgaaccaaggaaactcaggacgagccacttttatgaactgtaacactcactgtgaagatctgcagctatactcctgaagccagcgagaccaggaacacacctggaggaagaaactgcagacatatgtgaagaacaactccggaggagctgcccttaagaactgtagcactcactgcgagggtccgtggggcttctttcttgaagtcagcgaggccaagaacccaccaattctggacgagggagggctaaattgacatataaaacaaggtttacagtcttttgcatgcaaatatttctgtccgttctgaaatggaaagtggaaatcccttagcagctgggcaacagggagagagacaagaactcttttcaggtcatcaataaccttggtcctttggaactgattcttaatactcctagccatcatagggttcatcatgngcagaaatcgttattgcatagacaaaattatgctggtgttcttattatttgggataaaatttttgggacatttgaagcagaaaattgaaaaagttgtatatgggttaacagatccattaatacatttgaaccaatcgaagtgcagttccatcactttatttttccaatattggactaccattcttgggcaacaacctggattctttcaaataaagtttcctggtcatactctaacggagccggatgggggtccagggtaaccaagactggtctccgggaagaaattcccgaaggtcacagggaaagaaagttcccttttcattaatatttaagctcacgttttcagagcttttn

SEQ ID NO: 660004 - DNA, 289 bp, Homo sapiens
ttatccccccctgtgttctgtttgaaggggacgaggtgtattccaccatccggaagcagtgaatacaatgggaagatccctcttttccgccgcatccggggcgagagtgagctgtacaccagttcatactgtacactgcagaacccacacgttcatctatcagccaccatcgatgcaccaagtaccaggccttatcccgacgacacgggtacccgaggcgtcgaattccgtcaatcaatcgcgtccatagcgtgctttctcctagtcgtgaacaaccctgtgccgacac

SEQ ID NO: 660005 - DNA, 345 bp, Homo sapiens
ctagcagtaacatctgggctgctacgacggacagggaaccaagcgtttagatgaagaccaatctcaaattcatcctcatggactgcatggagggccgtgtagccatccaccgagtggccaaccttctgctgtgtatgtatgccaaggagcacgtgggctttggaatgctcaaggccaaggcccaggctttggtgcagtcactggcaggcagcccctccacccaagtggcggccatcttcaacggccattggtggcacagctggggtcagcacacagagcactgcaccatttgccaggggcggggcctcctcacaagcaacttcttcagaaatggggggcaggcat

SEQ ID NO: 660006 - DNA, 844 bp, Homo sapiens
agcgggtccccgcctcgcgcggcggcggcggcgtggtgatgagcctgaggcggcggcggggtgtggctccgcgcgcggtggtctcggggtgcaaaataacatggcagccacgacgaattacacaggagacttttgatgctgtattacaagaacaaatgccaaaggatatcacatggatgccagtggtgaggctgtaagcgaaactcttcagtttaaagctcaagatctcttaagggcagtcccaagatccagagcagtagatgtatgatgacgtccacagcgatggcatgatactccctcagtggaatctgtagtctcactctagtagatgccggaagagaagtgcctgagaagtgacgtatttccaggggccttccttcagatcaagcaacccttccatcagtgatgacagctactttccgcgaagaactgtggccgggactctggcaacttttctcgactctgattctcgggaccaggtcgattggccacgcggacaattggggcattgtccgtgtctcagtgactggaaactttgcgctccgtggtctcttgggaaccacagactttggccatccagtttctcaagagtcctcttggtcacagagagtatacgttgggtccctctgcacttttgggggactctggatcttccaagctgattgacaaagagtgtttggagaacggacagtcgggattatgacgttgaccatcctggggagggcttgactctgtgcttaggcgcggccagtcaaagtccaggccagaaagtcgaaactctaaacatcgttgaccatgaaggttccctcctaggaaaaggcgggaaacccagggcttgctcaaa

SEQ ID NO: 660007 - DNA, 147 bp, Homo sapiens
tttcatgaattaagcttttctagctctggtttctccccatctttgtagttttatctacctattggttttatgatagatggtatattggtagtaggatagtacctattctaggtagatagtatgatagctaatatcctatatctagct

SEQ ID NO: 660008 - DNA, 900 bp, Homo sapiens
  misc_feature (126)..(126): n is a, c, g, or t
ggagctatttatgacaaacccacagctaatatcattctgaatggtcaaaaacgtggaagcattccctttgaaaactggcataagacagggatgccctctctcaccagctcctattcaacatagtantggaagtcctggccagggccatcaggccaaagaaagaaataaagcatattcaaagtaggaagagaggaagtcaaattgtttctgtttgcagatgacatgactgtatatttagaaaactccatcgtctcagcccaaaatctccttaagctgataagcaacttcagcagaatctcaggatacaaaatcaactgtgcaaaaatcacgaagcattcctatacaccaagaatagacagacagacaagtcatgagtaaactaccattcacaatcgctacaaagagaatgaacatacctaggaatataacttacaagggatgtgaaagacctcttcaaggagaactacaaaccagtactcagggaaataagagacgaccccaaataaagtggaaaaacattccacgctcatggcataggcagaatcaatatcgtgcaacgatgggcatacttgcccagaatttatttacgttcccaaagattcaaggctatcccatcaagctaccatggacattcttcagatcagtcgggaaaaaactacttccaactttcatatggaaccaaagaagatcccgcatagccagaaaattcactaagcaaaaagaacaaaggtcgagtcattcatggtaactggacttcaactattcgacaagttccagtaaccaaagaagcttgatctggtgccacaccgatttctgaccctcgggcccggacacacggccccaacttataccccatcatctactcgaacttgacaactgaaaacccgctgggaacggtca

SEQ ID NO: 660009 - DNA, 314 bp, Homo sapiens
gacatcctgtcctctctgagctggtcctgctgggagccgagccatcctgggaccagctcccacatgcacacgcccacacctacacgcagggcagtggggaagggcagtgagtgggggagggcagcggcggtcctgggcccagctgggggtgaccaggagcatggaccccgcttcttggcccaactcccgcagtgccccttggctcctcaccctgcactgtgggaagtcagaggcctctggaccccatccccagcgctctaacccggccatttgcccgtgcagcctgttgcgctgtccccacctgcggggcctgc

SEQ ID NO: 660010 - DNA, 174 bp, Homo sapiens
  misc_feature (68)..(70): n is a, c, g, or t
gtaggttaactggtgactccgcgctacacatatcccagtcggggaaccctggccaaaattaccttacnnntaggacacagccgcctcatcaactttcgcgtcatccgttaagccaaagcggcgcagttggcgaactgacaccctgttattgcagacgccccatcaggcaatccc

SEQ ID NO: 660011 - DNA, 476 bp, Homo sapiens
gacctggaagggcagctactgtctggtcacctgactcaggatcaggtgcgggaggttaagcggcacatcaccgtgcgcctggactggggtaatgaacatttgggcctggacctggtgcctcggaaggactttgaagtagtggactcggaccagattagtgtctcagatctctataagatgggttaaatatatgtgtttggaaaagaaatggaaacttccactgccacaaccattcttcttacccatgtgatatggagcaattcaacaaatgagtgtggtaccatacctctagggtccaaaaggaagcaggatgaaatctctcattgtttcgtttaccaacaccacgcactgaacatttgtaaattcaccattattcctggccagggtttacttctaaatgtgaatggctttctataataactaattataaaaaataacaatcatactaataataaaaataccaattttgaataata

SEQ ID NO: 660012 - DNA, 713 bp, Homo sapiens
tcgttgaatagtcttctagtataagattcctctggagcgtcctgtagcctttgttttagtaaagattctagccccaccaaaccatgcttgaattcaccaaagcaagacatggtctccaagtggcaaaatccaacgttttcttgttcaacgataaactttaaggcatccgaatcacagtcagtagagatttgtaaaagcttttggccattgccagaagtttcacccttgatccagatttcattcctagaacgagaataataaacgccacgacccaaatcgatggcctttgctatagatttcttcgaagaatacaccaaccctagacaacgctcatattggtcgacaactagggtggtatataaaccgtcaggacggtctgtacgtacttcaccaagcacttctttggtcaacatatccttgcttaatttctttatggacacaattttatcttgcgagaatttttgttttaccatgaattgattggagaaaacaccgttctcttccacaacaacacgctcctttggcacattcaattgttcaaccaagtggtcggctgttttagcatcttggctagcaatgaacagagaagaaactccgttgttcaagaaggcaatgatttcatcatcgctgaatttaccacttggcaaggacaaagccaccaatggaacttcttcctctttggagaactggagaattctcttcattactcaggc

SEQ ID NO: 660013 - DNA, 334 bp, Homo sapiens
gtaataggtgaaagtggtaacctgttttaactttgaattcttgccgggcgcggtggctcacgctggtaatcccagcactttgggaggctgaggcgggtggatccgaggtcaggagttcaaaaccagcctggccaagatggtgaaatcccgtctctactaaaaatacaaaaattagccgggcgtggtggcgggcgcctgtaatcccagctacttgggaggctgaggcagagaattgcttgaacccaggaggcggaggttgcagtgagccaagatcgcgccactgcactccagcctgggtgacagagtgagactccgtctcaaataaaaaaaaaaa

SEQ ID NO: 660014 - DNA, 366 bp, Homo sapiens
  misc_feature (257)..(257): n is a, c, g, or t
  misc_feature (349)..(349): n is a, c, g, or t
cttctaacacgcaatctctacaaataaaaaaattggccaggcatggtgacacacacctgtggtcccagcttctcaggaggctgaggtgggaggatcatttgagtccaagaagtcaaggctgcagtgagccgtgacggcaccactgcactcagcctagataacagagggaaatcttgtctcaaaaaaaaggacttgggtaatgttctcttctactacttctactaccgaagccagctttttaggttgcatgcagccanatatttattagcacctattatgtgcaagaagttaccgcgagaattttccaaggtaaatgagctagcaaatgcaagggccctaaagtataccncaagattgcggtgttag

SEQ ID NO: 660015 - DNA, 695 bp, Homo sapiens
  misc_feature (17)..(18): n is a, c, g, or t
  misc_feature (44)..(44): n is a, c, g, or t
atctagacctaggggannctgcacgagggattttaggctccatntattttatagggtatcctttgcccattgcttgtttttctcaggtttgtcaaagatcagatagttgtagatatgcggcattatttctgagggctctgttctgttccattgatctatatctctgttttggtactagtaccatgctgttttgcttactgtagccttgtagtgtagtttgaagtcaggtagcgtgatgcctccagctttgtccttttggcttaggattgacttggtgatgtaggctcttttttggttccatatgaactttaaagtagttttttccaattctgtgaagaaagtcattggtagcttgatggggatggcattgtatctatttaccttgggcaatatggccattttcacgatattgattcttcctacccatgagcatggaatgttcttccatttgtttgtatccacttttatttcattgagcagtggtttgtaattctccttgagaggtccttcacatccttgtaaggtggattcctaggtattttattctctttgaatcaattgtgaatgggagttcactcatgaattggctctcttgttggctggtatttgtgatatgcttgtgattttgtacaatgattttgatcccgagacttgctgaagtgctaccagcttaagaggatttggcttagctgggt

SEQ ID NO: 660016 - DNA, 401 bp, Homo sapiens
  misc_feature (41)..(41): n is a, c, g, or t
tcatctagagatccgctgatcgttagtacaaggggctttgngtgggttccacccacgtcaagaggagacagacatctgtgctactggagagcagtgtggcaggcagtctgctggctgcttacgctgtcgctgggcaggaaacccgtgcatgcctgcgtgtacgcttggttgtgttttgtcctggttatcagcggtttcttaggaaagttccttgtcaaagctccaagtttcgcttggctgatccaagggaaaaagagacttagccgcagttgggtggggaaaccagagtgttcagaggcagtaccaaggtgtacagggctggagccaaggcacttctgggcagcttcatcagctactgttcttggagcaacttcctgagcccttacccatcttgcttaagc

SEQ ID NO: 660017 - DNA, 92 bp, Homo sapiens
ggcttaacaacacacatttattttctctgttctggaggctgaaagtccaagactgaggctccagtcaattccatctcttctgtcgtcttctc

SEQ ID NO: 660018 - DNA, 427 bp, Homo sapiens
  misc_feature (60)..(60): n is a, c, g, or t
  misc_feature (358)..(359): n is a, c, g, or t
gcgcgctcgaggtcctggctctttgtcgatgacgcagcgtgcgccgggccccattggttnaacgtccgctcggtgccatcctggtccctcgtccctcccccatcccggcgtccacgacccgggcgcaggccacatggtcctcggattgccggtcccgggtcccgcaaggcgcgtctacaccagccgctagacccacgcggcgaggggctgggcttctccgggggccacgggttccgaagtccgcccccgtccccgctccggagtcaccgctttgagatccagaactccgtccttggcctcctgcagcagcgacacgaacttggtagtgagcaccccaggctcttctcgtgcctgctgnnccccgccgcaaggcactgtcgctgcgggggcggctgcggcgttgcgctgcggaggagcgcggcggccc

SEQ ID NO: 660019 - DNA, 178 bp, Homo sapiens
agcaggccaaaagcccaggtgaggcccagcaggaacagcagcccaatgcctcctagcactcaagatccaccatagtccaagcaactgcagttacacttgagtacaaatacgctcccgacagcctcatgcagcgacaccctaaaggacacccgaacaccatcaataaccgaatagacta

SEQ ID NO: 660020 - DNA, 171 bp, Homo sapiens
cggctctgctcacctgcactatgcagctacatcagacacatttatggcaggctcggaatacttattaagaaacgatgcaaatccaggatccgtgataagcagcggatacaatgcagttcattattcagctgcttatggtcaccgtctatgtcttcaactgattgcaagtga

SEQ ID NO: 660021 - DNA, 926 bp, Homo sapiens
ttcccgaccaaatttcgccaccaaccacaaggggaccctgagcgccgaccccatatacggtgtgggttcccggtgcaagcagccgcaggaccaaaactggatacaaacccaagtatagggagaccgggaacccttcccaaaagtactccaccaaccagcccagagggggagaacaatataaaacacgattcttcaagcccagacaccaagaaacaagagggtcaagtatcaagatcatctagaaaacacgacctcaccaaatgaactaaataagacaccaggaaccaatgctgcagagacagagatatgtgacctttcagacagggagttcagaatacctgctttgaggagaatcaacataattcaagataacatagagaaggaattcagaattctattggatgaatttatcaaaatttaaaacaattaaaaagaattgagcagaaattctgaagctgaaaagtgcaatagacatactgaagaatgtattacagtcataagataattgacgaagcagaagaaagaattagtgagcttgaagacaggctatttgaaaatacacaaaggagacagaagagtaaaaaagaatgaagcatgcctacaagatctagaaaataaccttaaaagagcagacctaagagttgttgaccttaaagagaaggtagagagagagatgggggtagaaagtttttcaaaggcataataacagaacttgctgaacctaaagaacaatatcaatgttcaagtacaagaagattatagaacattaagcagatttaacccaaataggactacctgaagacatttaataatcaaaaaaggtcaaggataaaggaaggaggctaaaagcagcaagagaaaagaaacaaaaaacgtgcaacggatctccaatacatctgataacgtaacgacgtttcagtggggaa

SEQ ID NO: 660022 - DNA, 482 bp, Homo sapiens
agagtcttcatttaaaggtaaaatttaaggcacacctaacatgataggggcatgaaaaataaagtataaagggtacatttcttatcttagacttctatatgcaccttgtagcaaaaggtactttgatatacaactcttacagagccagcttctttaacctctacccctggctcccctccctgtcccaagagcttacactgaattaagtaaggtacacttttctagggggaaattttttgtttcttttaaaaacttcccatctttaaaaagggcccttcttatttcaaagggattaaacttaataatgggtttaaaagggagaaattcattcttctttacataaggcctttaaaacttgaaaactttttaccaaaaaccccacacccgagctccaccccatttctttgttcagtcattggattgcccaaatcaaaacatttacaattccactttaaggggggaaaaaatctaaaaaataacct

SEQ ID NO: 660023 - DNA, 406 bp, Homo sapiens
  misc_feature (269)..(269): n is a, c, g, or t
ggaatgcccaacccggatacccaggcgcatcagccacagctccagcgccgtccaggtgccggtggtgtcgccccacggtgagccgttatccatggtcatccggtccggcaggccgtaacgctcaaacacgctgaccagctgctgctgcacggtctcgcgccgttcatcggtacagtgcgccaggcacagggaaaaacgggagtggtcgtccagcagggtgagcggatggcagcgtccaccgccaaaaggaaagtggcccttaaaatccnatctccagaggcggttcggcgcgtcgtgttcgaacctggccgtggcgggaatgcccggtgaagcgcccggcagcaggccatggcgggccatcaggttatggacggtgctgaaggcgggcatggtgtgcccctggtcc

SEQ ID NO: 660024 - DNA, 411 bp, Homo sapiens
  misc_feature (287)..(287): n is a, c, g, or t
cggaggttttggccctggtgcttgattttcgaggccatctgctgggccgcctgtcggccatcgtgcctaaacaggcactgctgcgccggacagcgccggtcgtacgttgtgaaggcatcaacattccctgtcaactcctacagaaacacgttgaagtacctggctttcctccgtcaagctcatgaacaccaacacttcccgaggcccctaccacttccggacccctagccgcatcttctggcgttccgcgccaggtatcgctgcccacccaagcgaggctaggtcgntcttcaccgtctcgcagcccgcccgcatcccacccgccctacgccatggacgccccctggtcgctcctcctcctcctcactcccgcgcgctcctgacgctcctaccctcctccgcccctccccg

SEQ ID NO: 660025 - DNA, 623 bp, Homo sapiens
  misc_feature (19)..(19): n is a, c, g, or t
  misc_feature (74)..(74): n is a, c, g, or t
  misc_feature (212)..(212): n is a, c, g, or t
  misc_feature (234)..(235): n is a, c, g, or t
  misc_feature (242)..(242): n is a, c, g, or t
  misc_feature (245)..(245): n is a, c, g, or t
  misc_feature (251)..(251): n is a, c, g, or t
  misc_feature (254)..(254): n is a, c, g, or t
  misc_feature (309)..(309): n is a, c, g, or t
  misc_feature (378)..(378): n is a, c, g, or t
  misc_feature (398)..(398): n is a, c, g, or t
  misc_feature (400)..(401): n is a, c, g, or t
  misc_feature (405)..(405): n is a, c, g, or t
  misc_feature (408)..(408): n is a, c, g, or t
  misc_feature (413)..(413): n is a, c, g, or t
  misc_feature (420)..(420): n is a, c, g, or t
  misc_feature (468)..(468): n is a, c, g, or t
  misc_feature (516)..(516): n is a, c, g, or t
  misc_feature (519)..(520): n is a, c, g, or t
  misc_feature (527)..(527): n is a, c, g, or t
  misc_feature (540)..(540): n is a, c, g, or t
  misc_feature (615)..(615): n is a, c, g, or t
catttatggaaagaattantgtctagatggtctgcagaacgtgtttggggtgagtgggagtgaggggcaatgtnactttttctccctgtagtttggagtccattatgagctgctgctttttcttctcatcttgtcatcttctggggatgtttgaaggctgagttccaacagaattcacaaagggaataaaacaggattgattttgatgtaanggtggtaagatagggcattacnncaaaacnaangctgtnganacatgaaccttttgttttttgaggactatttttgttatctgtaacgctccacctnacatgccacgtcgtgtgagtcaacaggatcagtttggtacacacatgtcgagctgcagcgtctgtctgngtcgttggatgagaaaaacncnncccngcngcctnccatgtnataggcccacccaagagagtgacacacagtgctggccctgagacattnccacaaagtgtcaactctgccttgcatcctaaaactttttgggcatcnatnntgaaaantataggagccttnggaaggcctcttatgtttggaggggaagggtgttgagattgtcaccatccttcaagctgagactcctggtgagcntttgccac

SEQ ID NO: 660026 - DNA, 130 bp, Homo sapiens
tgagctgtggagagcatttcaacatggactgttgtccaccctgcacctccttgttgccctgtgccaagctgcttccagccctgacctctccccccacaacctctactggggatcctctagtagtctgacc

SEQ ID NO: 660027 - DNA, 925 bp, Homo sapiens
gatatacttgcagaatatttgaaatatcgtcaattcccctttcaaagattagatggatcaataagtaggagaactgacggaaaccaagctctagatcattttaatgctgagggactcagaggattttgacttttgctgtccacaagagctggacggtctagggacttaatttagcctctgctgacactgttgtatatagtttgatctccgattggaatccacagaatgatcttcaggcacaggctagagcccatcgaattgggcaaaagaaacaggtgaatatttatcgtctagttacaaagggactcagttgaagaagatattcttgaaagggcgaacacacgcacgatggtttcccgatcatcttgtacttcaaagcctggacacaactgggaagacagtactacatacaggttctgaccccatcaagttctactcctttcactaaagacgagttatcagccattttaaacgttgggatgctcgcacgaactctctttacaggcaccctgacaggagacaaaacaatgagccccaggcaccactggctctagactgacactctctgaacgcgcagctgaacctccctgacaaactgaaccaggtcccttgcaactgtcaggagactgactctgctttccccagttcaacggcttgacaaacttctcacactatggattgaggactgacccttgacgttggacacctgacagacacttcaagacatctgggaaggaaacagtactcccagacagcaatcaccaagacagaccgaacgtcgacgcaacgacagacacgacgaagaggacaactgcaacagaacatcacatactggcccccccacacgcgcaccgggtgccaccacgcgaatcagtctccaacggcgacgcgcaagcacagcccacacaacactcagccacatacc

SEQ ID NO: 660028 - DNA, 1033 bp, Homo sapiens
agtcccgggcgggcgtctcgggaaccaaataacatctgctttgctgccgagctcacaggagacacccgagacccctcccgctagccagagaggctggaggcctgctcatgaggggtgctttgaagatgccggagtgccccgtctcatgcctgttggcagtggtgttcgcatgggtcatggtgctgatggagatgtgtgcttgtgttgcatttcttgagagcacatggggctggggcattgtggcgttatccggtggggtggtcaggagattatcatgcagcggcaattgcaaaaaactggctcaattggtgtgacttcataaggagtggcagcatcacttgaacctatgtgctcgaagcatggcggagcctcgggaactccaacagagacgtcgctggatgggccattgacaccatactgcagagccggacagtgagtggtgaccgcgaacagtgggcggacgccggacatgggccacgatcgtgtacgccgtagattcacaggagggtcaaggcccgtcgcgtgctagtttggagcttcgcggcctccctggtgcgatacttcagtacgtgctgctggccccgtcttgctgtcgactcaggggccacggctcatgccccactcagagatcaaaaccccggtctgctgccgccatcacccagcggaatgggggattcccgctggcatgaacgggaccaagttcacgcttgttggtccggagcgtcccggaaatacatccgtcagtgggacaactcttgatcgtcgacatcaatggtgcttgtttccttcgaccctggtagcaccgcatgcggacacgccaatgacgagatgtggctcgcgagacgggagccgctctcgtgcaccggattcgcctgctggcacttcactcgacgtccgacccttggttccaccccaactgtgatcggcggtcgcgcccacaacacagcacagaccaagacaaagacgctaagatgacgcacacgaccaccaaactcgaggatccaagcgatcacgacatcgtcgtcctagtccg

SEQ ID NO: 660029 - DNA, 385 bp, Homo sapiens
gaccaaagacaatgattgagctcaatgataatgaacaccctgggacgatattcctggaaacagctgatcccgagctggctgctcatggagcgaccttacccaagatggatatacatcatgatgtggactttttgaagatgtctgataccatacgtgacttgctcccagctatgtgtgacagaccatgatacattcaagatactaaccttatactatatgaggaagttagaccgcgtttaccagagagaattctcgactatgacgtgtatcttgatcaagccattgatgaactattggatggagacatcctagtatttcacaacgatgaccctgactatgatatcagtgagttaccgaccgtacaggagtttccgagatctatacc

SEQ ID NO: 660030 - DNA, 481 bp, Homo sapiens
gggacattggtattggcattgcacgagaaaatggtcttcccggccccccaggtcctcaagggactgcacgctatggcaagatgggtgcaacaggaccaatgggccatcaaggcatccctggcattcctgggccccctggtcccatgggccagccaggcaaggttggccactgtaatccctctgactgctttggggccatgccgatggtgcagcagtacccacccatgaaaaccatgaacgggccttttggctgaaattacccacctgcctttggatgaaagactccgtggggaataaatggccaaagcttataggactctgtgacaagttgtgaatgtgcctaattgttgaacgtagagagcaaaatgggtcgtcaaattatgtgtttctgtttgaaacaaaactgctgtttattcatgctgaggtgaagggggggcctgcttcttacaaaagcctataaattgacccctcactataaatt

SEQ ID NO: 660031 - DNA, 238 bp, Homo sapiens
gtcctgctgcagttacccactcactgctaatcttggcccttattcctgctgtcgttggtggctgggcccgacagcgggcctcactcttgaagtcaggactgtgtctgacctggtgggatgccctgccagagtatgctcttttcgaggacggattggccctgtttgaaatgtttatcgttaagggacagccttcagcagcagctcacaccctaccttccccagacttgcactggggtgg

SEQ ID NO: 660032 - DNA, 88 bp, Homo sapiens
tgtttcattgcatgcccaccagcccagtggcatcagtgggtcctgcagctctgcaattctgtcaatccatggtccatcagctgttccc

SEQ ID NO: 660033 - DNA, 328 bp, Homo sapiens
  misc_feature (27)..(27): n is a, c, g, or t
  misc_feature (75)..(75): n is a, c, g, or t
  misc_feature (181)..(181): n is a, c, g, or t
  misc_feature (194)..(194): n is a, c, g, or t
  misc_feature (217)..(217): n is a, c, g, or t
  misc_feature (235)..(235): n is a, c, g, or t
  misc_feature (237)..(237): n is a, c, g, or t
  misc_feature (239)..(239): n is a, c, g, or t
  misc_feature (291)..(291): n is a, c, g, or t
ccaagcagctcaaaagaagcaaccgcnaattcagtcaacggctggggcaaacccagttcgcaatgaaaaagatangatataaatgaaaaaagtgaaagtaaagaaatatgtgtaaagaaaaaggccaaactatgacccactatagaaaccacaaatgagaaggataaaaaatttaaattcntaaagaaagccanagaacaagaagcagaagaatgangaaaaggaggagaattantncnaagaccaccggactacggcagttatacagaacacaataattagtgaaaatgnagaagagaaatagactcaaacatcgaaaaaatagagg

SEQ ID NO: 660034 - DNA, 673 bp, Homo sapiens
  misc_feature (350)..(350): n is a, c, g, or t
  misc_feature (372)..(372): n is a, c, g, or t
  misc_feature (542)..(542): n is a, c, g, or t
  misc_feature (622)..(622): n is a, c, g, or t
  misc_feature (659)..(659): n is a, c, g, or t
  misc_feature (672)..(672): n is a, c, g, or t
acggatagcggatctgcacattgttgtgcaatcatcaccaccatccatctcaagaacttttttcatattccagaactgaaattctgtatccattaaataataataataattggactcatgagacatacgctatcctctcagtcctctgaaaggaatctcctttccttcctagctctttgcttgcctgaatggcctcctttcccccaaactctttgaaaactcagaactgtccaaagatcaagtcttgacaccttgccatcatatccctaccttccttcaagtcacttcattttgacagtttccctttcttgcctgccatgacctctgcagagggctggctgataagagangcagagacaatcctgccacctntcagggatagacctctatttggacactgtggagggaaatatacttctggattttagtagtatgcctgccctgagttcatcatagcctccttggtatgctctgtagttttattacattgtgagcttctgagggaccccaacaaccattggttatagaccattttccaaggncatttctctctgcaaatcctttttcaaatggacccgtcagacatgtgcctgttgtgcaggactacaccttgtgagaagtnttctcacccattgaagccgaatgagctaatttctacntttttttagggtng

SEQ ID NO: 660035 - DNA, 308 bp, Homo sapiens
  misc_feature (41)..(41): n is a, c, g, or t
cggcctgctgctcctgcacggaatggaggggtaccgctgcnaccccgcccccccccgcccgcgcgccccgctgaccgggccaaggagccaggggggaagtgcgtgtgttgggccaggtaggatacgtaccccttgcccagagcagcccatcccaggcagagggtcttccctctgtccaaccactgttttattatttttctaacatggtgtgggcccccccctccggtcctgtccatccccgaccaggcagcagccacccagttcttcctcccctcccccgtgatcccataagcgactgtcccccgtgc

SEQ ID NO: 660036 - DNA, 764 bp, Homo sapiens
  misc_feature (1)..(1): n is a, c, g, or t
  misc_feature (96)..(96): n is a, c, g, or t
  misc_feature (111)..(111): n is a, c, g, or t
  misc_feature (113)..(113): n is a, c, g, or t
  misc_feature (115)..(115): n is a, c, g, or t
  misc_feature (117)..(119): n is a, c, g, or t
  misc_feature (142)..(142): n is a, c, g, or t
  misc_feature (162)..(162): n is a, c, g, or t
  misc_feature (225)..(225): n is a, c, g, or t
  misc_feature (240)..(240): n is a, c, g, or t
  misc_feature (245)..(245): n is a, c, g, or t
  misc_feature (249)..(249): n is a, c, g, or t
  misc_feature (251)..(251): n is a, c, g, or t
  misc_feature (267)..(268): n is a, c, g, or t
  misc_feature (271)..(272): n is a, c, g, or t
  misc_feature (279)..(279): n is a, c, g, or t
  misc_feature (290)..(290): n is a, c, g, or t
  misc_feature (309)..(309): n is a, c, g, or t
  misc_feature (316)..(316): n is a, c, g, or t
  misc_feature (322)..(322): n is a, c, g, or t
  misc_feature (332)..(332): n is a, c, g, or t
  misc_feature (402)..(402): n is a, c, g, or t
  misc_feature (414)..(414): n is a, c, g, or t
  misc_feature (418)..(418): n is a, c, g, or t
  misc_feature (489)..(489): n is a, c, g, or t
  misc_feature (557)..(557): n is a, c, g, or t
  misc_feature (649)..(649): n is a, c, g, or t
  misc_feature (654)..(654): n is a, c, g, or t
  misc_feature (672)..(672): n is a, c, g, or t
  misc_feature (682)..(682): n is a, c, g, or t
  misc_feature (684)..(684): n is a, c, g, or t
  misc_feature (763)..(763): n is a, c, g, or t
naatttctaacagaggcaaaacttattaccatagtttataagtagaaataccattctttatgacaatataagttcactaaggatgcacgatttatnttataattttttaancntntnnntctccctcttcctcctcgatttncccttgttcgtcggcctttncgtcctggtacttttttttttttttttaccatttttttttttttttttttttttttttttttnttttttttttttttnttttntttntnttttattatttcattnnttnntttctcnttaacattttngttaacttctctgatattngctttantatctnctttattttngttctttttcttgattatttttgccgatatctttaggtcgtggtgttttatttttcacacttccgttttnactttgtttgtnattnactccacgaagtatcttcttttctttttcttcacgtttatcatcttctcgttcaccttcttcatggacatncggccccggaaaatgtgcagccaccgtcaggtagctgccgttgcgcggggtcgcaggcgggccatcantgttctttggagtcgaacatctgctggggtgagctcgggcaccgtgagcgcccggtactgctggctgccccggctggtcagggggcgcgaancgggncatgaagaagtgcaggcnagggaagggnancatgttcaccgccagcttgcgcaggtctgcgttcagctggcccgggaagcgcaggcaggtggtgaccccgctcatggtng

SEQ ID NO: 660037 - DNA, 666 bp, Homo sapiens
  misc_feature (279)..(279): n is a, c, g, or t
cctgtctctgccagttccactgcccccttgatctttgaaggagtcctcaggtcccctcgcagtcataaggatgttttgcaactttccagaatctggccctagaaattagggcatctatttccttgtattgtagtagaggttaagcattgctgtgagctttatcagataagagaccgagagaagtaagctgggtcttgtaaattccttgggtgttggtgcgaataagcagtggcaatttgaacaaggaagaggagcaaagagggaatgagtcgtttgatngggcgtgcggcgtgattttggctccgttaaggcggggtttattgggtcccaaagtttgggggatattctaagcggccagcatcgagacctgccgaagtactggttgttgtatttagaccggactggataatctactttgggatatttgttttcctgtcaacatcttggaaagttattacgttaatttagaagaagtactcatgcagatatatatatatgatactttcttcccaagatgcctttttgtgtaatgagacggtcttctatggggatctgcacctccatccttgcatcttgttagacatagctgtttttgctgtgagtcgggtatagagtgggctctacgcggaggttagttaatcagaagtttgtttacagcgttcacga

SEQ ID NO: 660038 - DNA, 580 bp, Homo sapiens
  misc_feature (189)..(189): n is a, c, g, or t
  misc_feature (220)..(220): n is a, c, g, or t
  misc_feature (281)..(281): n is a, c, g, or t
  misc_feature (296)..(296): n is a, c, g, or t
  misc_feature (424)..(424): n is a, c, g, or t
  misc_feature (429)..(429): n is a, c, g, or t
  misc_feature (434)..(435): n is a, c, g, or t
  misc_feature (437)..(437): n is a, c, g, or t
  misc_feature (439)..(439): n is a, c, g, or t
  misc_feature (446)..(446): n is a, c, g, or t
  misc_feature (450)..(451): n is a, c, g, or t
  misc_feature (453)..(453): n is a, c, g, or t
  misc_feature (465)..(466): n is a, c, g, or t
  misc_feature (476)..(476): n is a, c, g, or t
  misc_feature (482)..(482): n is a, c, g, or t
  misc_feature (484)..(484): n is a, c, g, or t
  misc_feature (486)..(487): n is a, c, g, or t
  misc_feature (490)..(490): n is a, c, g, or t
  misc_feature (492)..(492): n is a, c, g, or t
  misc_feature (504)..(505): n is a, c, g, or t
  misc_feature (510)..(510): n is a, c, g, or t
  misc_feature (516)..(516): n is a, c, g, or t
  misc_feature (518)..(518): n is a, c, g, or t
acacccaggacagctatgactataatgcttatgcttctcctttgaagcaacacgaatgttgtctaaatcatcccaattctgcaagtggcataaaatctgattttcattcagttcagcaactgatcctcaaaaacactttgctgaatgcaaaaaaaaaaaaagaaaaaaagaaaaagaaaaaaagtgatngtccaggtaatatcttcccagcaaacagcanttaaagaaacccccagcttttttttctgagaaagagtcttactctgtggcccaggtgcaanggtgtgatcggcaanggtgcgatctcggctcactgcaacctccgcctcccaggttcaagcaattctcctatctcatcctcctgagtatctgggattacaggcttttgccaccacgcccggctaattttggtatttttaagtanagatngggtnncncnatgttgnccanncngttctcgaactnntgacctcagntgatcnancnnctngncctcccaaagtnntgggnttacangngtgagccagcgtccctggcagaacttttttctgtgcttatattttaattaaaaaaactttca

SEQ ID NO: 660039 - DNA, 126 bp, Homo sapiens
tatatctatggtcaagctgatcccttcttcttttcttttctttttttcttagttattatttaattttgttttgttttgggttttttttgagacaggttctcgctccgtcgcccaggctggaatgca

SEQ ID NO: 660040 - DNA, 637 bp, Homo sapiens
  misc_feature (169)..(169): n is a, c, g, or t
  misc_feature (244)..(244): n is a, c, g, or t
  misc_feature (261)..(261): n is a, c, g, or t
  misc_feature (338)..(338): n is a, c, g, or t
  misc_feature (346)..(346): n is a, c, g, or t
  misc_feature (423)..(423): n is a, c, g, or t
  misc_feature (444)..(444): n is a, c, g, or t
  misc_feature (446)..(446): n is a, c, g, or t
  misc_feature (473)..(474): n is a, c, g, or t
  misc_feature (520)..(520): n is a, c, g, or t
  misc_feature (524)..(524): n is a, c, g, or t
  misc_feature (547)..(547): n is a, c, g, or t
  misc_feature (551)..(551): n is a, c, g, or t
  misc_feature (560)..(560): n is a, c, g, or t
  misc_feature (572)..(572): n is a, c, g, or t
  misc_feature (604)..(604): n is a, c, g, or t
  misc_feature (617)..(617): n is a, c, g, or t
  misc_feature (624)..(624): n is a, c, g, or t
  misc_feature (630)..(630): n is a, c, g, or t
ttctttttggggaaaaacagattccagatgggcatgggtgttctattgacccccgggagggatgggggggccccataaatgattttcttaaaggagggttaagaaaggaaaaaatgtaacaaaggtggcaattattttggatctatcccctgtaatcaaaaaggggttntgcttgtcatccacacaacaccaggacttaagacaaatgggacggatgtcatcttgagctcttcatttattttgnctggatttatttggagnggaggcattgtttttaagaaaaacatgtcatgtaggttgtctaaaaataaaaggcatttaaactcatttgagagaangccttttngtttaaggcatatttaaactaaattgatcctgtagtgttcctggagaagctagagcctgattgtaggctactactcntcaattaacttttccagtggngnctacttttggggctggaatataaaaannaatcaaaggttttgtttttgggttgcaataaagggaaagcccatgntcanagcagggccaacatttgaagggngganccttacccntttcttcccctncaacggaagtagttaactggaagagattcccnagagaataaaaanagactcnttcagnggaagca

SEQ ID NO: 660041 - DNA, 1078 bp, Homo sapiens
  misc_feature (273)..(273): n is a, c, g, or t
cgcctgacgtgaggtaggtgagtgctcggtcgccacctatcactaggaggtatgcttatacaccttctcgatgatgcacctgcctcgtcagtaatcactcttgccattactcgtggcatgtccgtaacctctcgtggtactgcactcgttgtccgtgaagctaggtctagcaagcaatgatcgtaccttatagtacttatcgctattcttcacgaacgctctgaggaacctagagaactcgtctgcagctagtcctgctctcggccagtacanttgctctgaaatcctcgatcagcctcgtcgccagactctcataactgacagtccatctgacaatatagcgaggaccgagtggatcatattggacatctcctttccgcatgtaccgcaattgcaacacgtcagacgatttggccaccacagattggtggtagcttgtaggcctacaccgaatgtagacaccctgagcgtaccccgagggggatcgtacaatcctgtgcaattcgtccccatatacattaccttttcgcacctcacttgacctgttcgcgtatcgacatcacaaaggggcccgatccccttggcagagaactacgcgtgtggaacccgttccgacttccacctgcgtgaagggtatccctattctacctcccgcatgttttggacaagtgacacccctatcgattcttcgggtgagtatagggtagcatcgttgtaggcagtttccatgcaacacgaaatgccgcctctacgacgccaacccataccaggtagcaatgttctctgctgtgcccccccacgctaatattttaacgttgcccctcttattagaataaaagccacgtaggttggccagatttgaacacccctgaggtaatctcgcttcggtaacacaatcgccaaagaaatccccaatcgtttttgtccgaaacaccaggcgcttaataaactggataccctggagtgggggattaataacaataagaccgggtaccgaaaactaggcgttgcgtggaaaacaatttcgtatgctaggccaaaggcgagaaaggcccatagggatggctctcaaccatgg

SEQ ID NO: 660042 - DNA, 224 bp, Homo sapiens
ggttctgttctgctcagctccgaagtagctgggatacaggcgcccgccgcacacccagctagtttttgtattttagtacagacggggtttcaccatgttggccaggctggtctcgaactcctgaccttgtgatccgactccctcggcctctcaaagtgctaggattacaggcaggagccaccgcgcctggccaggtttttcttaaactggcatttgaacatctg

SEQ ID NO: 660043 - DNA, 886 bp, Homo sapiens
  misc_feature (722)..(722): n is a, c, g, or t
gggaaacgtccagaaccccgaaatgtggagaaaacaaccttcttttcacgggggcgtggcccgccggttgcagtacgcgaaattggcaaaatgatgtaaacagggaagttcggcagatttcagttcattgtaaacttgccaagggatccgcccacagacacgagagagctgctttgggacagtgaattactcttcttttgagacggtctaatgatgcctgggtggtgccttcgtaggatggtcgtcacacctgaacaagggggtccctggccccaggccccatgctttactgggccctgttctgtccctcttctggcatcatctcccatggagaaaagaatgtgttgaagccaagaagatgctccccccgcaagaatatcatctctgctagaacaggggctggagtgtaacggcatgatctcggctcactgcaccctcgacttcctggattcaggtgatcccctcacctcagcctccctagtagctggtgtgtccggaattggtgggttcttggtctcactgacttcaagaatgaagccgtggaccctcgcggtgagtgttacagttcttaaaggtggcgtgtccggagtttgttccttctgatgttcagatgtgttcggagtttcttccttctggtgggtttgtggtctcgctggctcaggagtgaagctgcagaccttcgcggtgagtgttacagctcttaaggcagcgcgtctcaagtngttcattcctcccgggggggttcgtggtctcattggcttcagcagtgaagctgcagaccttcgtggtgagtgttacagctcataaaggcagtgtggaacccaaagagtgagcagcagcaagatttattgcaaagaaagacaaaggtttcacagtattggaaggg

SEQ ID NO: 660044 - DNA, 208 bp, Homo sapiens
agtcatacgcgaaagttaatcaaggtcatacacgacattcacaaaagaaaagtcaaaaatcatatgatcatctcaatagatgcagaaaaagcatttggacaaagtccaacatccattcatgatcaagaccctcgccaaagtgggtatagagggaacactcctgaacatgatcatagtaacttaggacaaacccacatcaaagataatc

SEQ ID NO: 660045 - DNA, 628 bp, Homo sapiens
cctgcgcctgcgcggagctggagtcggctgggccgcagcgctggagaccggcggttgccgtggggaccggtcgggcccctccctcctccggtcccccgccccaggccttccccaccgagacgcgccggggacctggggcgagtgcagccggtgacccggcgagagggcggcgccgctcccaagatgtcgcagacggccatgtccgaaacctacgattatggttaaggttcttggttattggaaatgcaggaacttggcaaatcttgcttacttcatcagttattgaaaaaaaattcaaaaggatgacgtcagaatcatacaataggagtggaaatatggttcaaagataataaatgtagagtggtaaaatatgtaaagttacagaaatattgggatacagcaaggaccacgaacgatacaggtcctgtgaacgagcaagttattaccgaggggtcggccaggggctactacctcgacgtaatgattttcgccagccgagaaaccttagaatgcgctaacataattgggttagcagattcccgagatgatacgaccagaacaatgtgatcaacgcttgtgggacaagaggacctggaatgcagatcgtgaggtactcacagaagcctca

SEQ ID NO: 660046 - DNA, 456 bp, Homo sapiens
  misc_feature (39)..(39): n is a, c, g, or t
  misc_feature (62)..(62): n is a, c, g, or t
  misc_feature (68)..(69): n is a, c, g, or t
  misc_feature (72)..(72): n is a, c, g, or t
  misc_feature (89)..(89): n is a, c, g, or t
  misc_feature (346)..(346): n is a, c, g, or t
  misc_feature (361)..(361): n is a, c, g, or t
  misc_feature (397)..(397): n is a, c, g, or t
  misc_feature (399)..(399): n is a, c, g, or t
  misc_feature (401)..(401): n is a, c, g, or t
  misc_feature (440)..(440): n is a, c, g, or t
atatatcatggtgcagtgtagttttcatgttttcttganctgttagtttgcatgtgtctccnacaggnnctnttcttatggtaatagtntggacctttagttctaaggagattagaacccggcagctcagattggccctttcctctcttctccctgctcttcagttctcccaactggtcttaggtaaagaaagattaatttgagttgttgggtaggaagagatgggaaggggcaaattctaatggagcgtgatccctagagtggggagatccagggcagccgaacgggtgggcatagccacctcctgggatagaagctttgtagttcatagttcgattagtgtgtncttaggacataggtncagccctacagattagctgggtgaagaaggcaagtntntngacagggcttagtctccaccctcaggcatgggaccattnagggtgaagcctggga

SEQ ID NO: 660047 - DNA, 857 bp, Homo sapiens
cagtcggtcactcctgcttcctctctgcctctgttctagttctcactctgacgtcccgcgtccttttcatttgtctgcttctcgctcccttccgtgtctgtccctcttcctccctcttccctgggcctgttctcgctgtccctgtctttatccttctcatctgcctctttttggctcaccctgtttctcatgccctcccctccgcctttctcacccctctgtcctttggagctcttttggctctgtctcttcattggcctttgtgcactctcaaattctttcatcttcccattcgctgtctgtatttctccataatatatctttcttcctctgtctccgcccacccacatttttctcttccctttctctcttgggggaccctccccaatgctccccttgcccaatccccttttccccttcccgtcttctcatcctccattcccatctttccccagcaattaccagctctgttggtcgcacaacttgtttgacgacgaaaacacagccagttgttcatgcccgtgagagcttcccacacccgtgtttcacatgagctcctggagaacccacacccgccagcagacgaggataacggcaggactcatgctgtccgctggaaaagctgttgatacatacaagacgctggaaaggtcgtggttgccacccagggacccgatgggacccctgtttggtccgctgggacattcgacaaagatttcctttcagatggctccgggggggccaaacctgctaattatggaacgcctcgagtggcatctttgttcccatgggcacaactggtcatgcgccctttgtgcagtacatggtctgtcccctctgctggtttggaaaatgcc

SEQ ID NO: 660048 - DNA, 425 bp, Homo sapiens
cccagcatctagatagctatgttaaggacacttaaataactcaagctaacacagagaaggacattcagaattctatcagcataatttaacaaagagattgaaataataaaaaagaacctagcagaaattctggagttagaaaatgcagttgaaagactgaagaatgtgtgttttttaatagctgaattgatcaagaagaagaaagaattggtgagcttcaagacaagctatttataagagacaaaataataaagaatgaaacatgcctagaagactctagaaaaatgcctcaaaagggcaaatctaagagttattgaccataaagaagtggtagagagaagtagaggtagaaagtttattcaaaaggaaagtaacagagaacttctgagacctagagagagatatcaatatctataactttttaa

SEQ ID NO: 660049 - DNA, 153 bp, Homo sapiens
ctatcatagaacttagcatatagtgtgaaatatatttgggtcatatatctgagaaggctattaggtctcacaaacaagggagcatgtttattcatcactgataagtacctgtcacttagtagatgcttagtaaatgttcacctgaaatgggtc

SEQ ID NO: 660050 - DNA, 150 bp, Homo sapiens
attgaagactcacaatgactttaccaaaagagtagttactaaaacatctacttgaaaatacacattatgactgactcttagagcccatgaggctacaagcatttcaatctattagaactcagtgatttcctaggcagcaggagaataact

SEQ ID NO: 660051 - DNA, 383 bp, Homo sapiens
tggtgactgagtgattcaaattagagtacagcaagtggtctctgatttcgtataagtacagccacagaagtgtgaaagttctgagcttccaggaaccatagaagtcctctactccagaacacagagaccttggtcagctctgacttactctgtgacacaagtatatatgtgcagactccatgctagcactagggacaccttgaccaccaacacaaggttcctcccatcagcaaacttacagataggggctaatgaaagtctagatcccaagcatcttgactccacagcacagtaccctaaaaatctcattctaaattgtgcttaataacacagtatatgggaacaccccctctatatacagagtgcgatgtgtgcctaaggcc

SEQ ID NO: 660052 - DNA, 154 bp, Homo sapiens
gtcagaaagcatgcgccgcatggccttggggcagttgctgtagattttgctgaggtccggggacaggatagccattgcccaccataatagataatctgggtcacggcagccaatgtggctgtaaggcagtgagccagtcatatgctcgtagagc

SEQ ID NO: 660053 - DNA, 1088 bp, Homo sapiens
ggacccactgttgattcctaagttgtgggtgggtgatatcagtggcctcagatgcctgcataaccctcacctgtttatgactgatctacatgtaaccttcctcaggttgagagtgagctgctgtgagccagtgacaactactgcatacaacttgctgttacttgaaattcgtgtgctatgtatggtagcacaggagtaggcgggcgggggtaaaggtgtgggcactaggtaagtgggtggcaaccgagatacttagggaaccattggtgctgaccttatgcctggtcacctgcactgtgccataggccaagtgaatgttacatcttgagaacctgagaccatggagagtggcgaccaacatccctgaggagaaaggtgtggccaaaggaaaatcctgcatggatcctgcatccttcacccttcccatacatttcacttgggctaatgatgtaagccaccccttgaggtaggggatggtgtggagatagctgcaagaaaaccctgataacagacatcccaggacagcactaagggagttgagggtaactcataggagcatcaggactaagggagagaaggtggagtagaacaagaagtgcccgggaatccagccgtgtaagaactcaaccaagggaccccaggacagcaatgagctgattgaagaccaacatgatacttggagaaactagggacgacgaagagagaaaacaatcaaaagatcaaggacatcatggttgacacgaacataaaatagaacacaaaagaaggagaagacgggaaaagacaaaggggggagaggtcgacatgggggatgaaaagacacatagagaggatgtcacaaggggaagagtacacaatgaggatacatcacaggaggagacagatatagagcgtgaaacacaccccgtagagagcagaaaaaaggaacaggagagggaggaaaaaaaccaaaggaaggataatgaactcggagatcaccctgctcgcgtcccctcaggagaagaaagagacagaaaaaaagaacatagaaaaaaaaaataggagaaagaaagaaacagaaaaacaaagagagagaagtaaagaaaaaa

SEQ ID NO: 660054 - DNA, 921 bp, Homo sapiens
gctggacttggtcttggttccagaacctgacgacccggcgacggcgacgtctcttttgactaaaagacagtgtgcagtgctccagtcctaggagctctacggggaccgcctcccgcgccgtgcaaccatgcccaacttctctggcaactggaaaatcatccgatcggaaaactctcgaggaattgctcacacagtgctgggggtgaatgtgatgctgatggaatgattgctgtgggctgctagtcgtccaagccagcagtggagatcaaagcaggagggagacatctttctacatcaaaacctccaccatccgtgcgcacctaggcagagattaagcttcaaggttggggaggagtttgaggagcagactgtggatgggaggccctgtaagagcctggtgaaatgggagagtgacccaatagaatggtctgtgagcacaagctcctgaagggagagggcccctaagagcatcgttggaccagagaactgagcaacgtatggggaactgatcctgaacatgagggcggctgacgtcgtgtgcaccaggtctacagtccggaacagtgagatgggcacaggtagaaccgtggcgaagccacggtgtgcatgctcaccggccatgcttgaagtgtgcgaccttggttggacgggatcttactagaggttaacggtgagtgacagattaccttcaacgaactgctgggaggagctttgggactgacgctggaagggatagtcgttccttggaccttctggacgaatcctggtaaagtagccatgagattggtgcaaagatgccgatatgcttcaggtctctcggggatactagactgcttctggccggaataccaagcggacggtcgggccgggcttcagctctggcgcgggacgtgccgacattccctttggatgtcgtagaca

SEQ ID NO: 660055 - DNA, 147 bp, Homo sapiens
cggacaatgatgtcacgtctctatgtgtctctcactattcgtgtttgtgttgtttctaggttggctcaatggtaagggtgggattgaattgctgagccccctagtgtaacagtcttctgcccttgtgggtaaagagtggagcggtgg

SEQ ID NO: 660056 - DNA, 706 bp, Homo sapiens
gcaggaaccgtggctgctgagcttaacctggtgtggtggctatgaccttgcttctgcctcggttgaaaggacatcgcgtatcttcctgccgcagaacacacttccggtctcggcccggacgggatgttgctgctgctgctgctgctacccctctgttgggcagtagaagttaagagaccccggggcgtttccctcagcaaccatcacttctatgacgaatctaaacctttcacgtgtttggatggcacagccactatccccttcgatcaggtgaacgatgattactgcgactgtaaggatggttctgatgagcctggcacagctgcgtgtcccaatggcagctttcactgcaccaacactgggtataagcctttgtacatcctctctagccgggtcaatgatggggtgtgtgactgctgtgatgggacggacgagtacaacagtggcaccgtctgtgagaacacctgcagagagaagggtcgcaaggaaaaagagtccctgcagcagctggccgaggtcacccgagaagggttccgtctcaagaagatactcatgaggagtggaagacagctcgggaagaaaagcagagtaagcttcttgagcttcaggctggaaagaagtctctggaagaccaggtagaaacgctgcggacagcgaaaagaggaagcagagaggccagagaaggaggccaaggaccagcaccgga

SEQ ID NO: 660057 - DNA, 695 bp, Homo sapiens
  misc_feature (644)..(644): n is a, c, g, or t
  misc_feature (659)..(659): n is a, c, g, or t
  misc_feature (668)..(668): n is a, c, g, or t
  misc_feature (679)..(679): n is a, c, g, or t
  misc_feature (681)..(681): n is a, c, g, or t
ctccccccccagacgaggggggggggtttttttttggggggggggggtggttctttttttctccccccccaaaaaaaaaaagggggttataagaaagaaaaaaaaaaaattttcgtgtccctcttctttttttttttttgggaaagaaaaaaaaaaaccatcctttttttttttttttttttccagggggggggaggaaatttttttttaaaaaacacctccccttcaaaaaaaaaagaggggggggctttttttttttttttttttttacccaccccccccccgtgttggggggttgcggacaacaaaaagaagagagggcgccccggggcgccctccttttttttggggggggagagaggcgccaaaacccccccccccccgggtttttttttttttttgcctctttttagaacccggtttatagcgacaaaatttctccgggggggggggggggcgtttttatacccccgccccgggcgggcccaaaattattttttttgttttttttaaaaagcaccctgtgggtgggttttttcccctccccccccacaaaaggcccttgtggttttttcaagagccaagtgggcccacccaaattgcttatcccagagtttccatattaaatcctccccatccaccantttccagcagggtcnaatttactnctatttttaancnaccaggccagggct

SEQ ID NO: 660058 - DNA, 215 bp, Homo sapiens
cgcgtgacttccgcgcaggataagcagttagccaattttgagacattgagaaatgaagtgtattgatagtatacgagctatgatcattagcgtcacagatgtgctgatgtgttatactcaagatggcccggagcagaggatttatctgagattatgtgatcttcgtcctcaaactgatatgaatgggctgtttcacagcgataatctgtctgtgc

SEQ ID NO: 660059 - DNA, 235 bp, Homo sapiens
taactacatgatgtcaaggccgtggcagtggtgggcgggtgcactctggcttgatgtggaactgtaataatatggggaactcagcaagctggagttggggaagctgccagtgcctcgcatgtaggaggagtaggtgggtgtggccatagtgcatagccatgagtattcacttccgtgttggtggcacacatggggagagtgcctgtgagtgtgacagggcatcacatgcatgggc

SEQ ID NO: 660060 - DNA, 124 bp, Homo sapiens
ccatgtagtcaactccccagtgggctgacagctagggctgcacctcatgtgggtctcctgttcccagtgctacctgcatagcggcctccttcccatgctctggggcagcgcatgaggggtatgc

SEQ ID NO: 660061 - DNA, 4393 bp, Homo sapiens
  misc_feature (4224)..(4224): n is a, c, g, or t
cctgaccagtgggtcactctcatggcagatgcctgggcagatttctgaagtggagcaagagaaatcttctcttcttcacctgcttcagggaggcatcaaagtgccaaacaggagcaggagacgcggagctcggagcgctgagctgacctgccggagccgggcgtgggctgcagcctcggagctcccggaacgatggtgaagttggggaacaatttcgcagagaagggcaccaagcagccgctgctggaggatggcttcgacaccattcccctgatgacgcccctcgatgtcaatcagctgcagttcccgcccccggataaggtggtcgtgaaaactaagaccgagtatgaacctgaccgcaagaaagggaaagcacgtcctccccaaattgctgagttcaccgtcagcatcacggagggtgtcaccgagaggtttaaggtctccgtgttggtcctcttcgccctggccttcctcacctgcgtcgtcttcctggttgtctacaaggtgtacaagtatgaccgcgcctgccccgatgggttcgtcctcaagaacacccagtgcatcccagaaggcttggagagctactacgcggagcaagactccagtgcccgggagaaattttacacagtcataaaccactacaacctggccaagcagagcatcacgcgctccgtatcgccctggatgtcagttctgtcagaagagaagctgtccgagcaggagactgaagcggctgagaagtcagcttagcgggatgggcaagttccttacaatgtgtcacttgcaaataacaaagggactttgagggacatttcattaaatataattactgatactttagaggttactcatttacggtgcaattgcttctgtttgctaatgctgctttgcaaataaaacttgctgccgaccacccacgggcataaaatcaagtgcatttcagcattgcctaaagagctctgacaccacttttcatgttaagatcttcatttagctcctttactgggatttattggatgctgtaaaaaaataaatttacactggatatgcgaagggtttggatctcagataaatgcattttgtggaattgattttctgaaccgaccctgctgtctgcaaaccttcctccatagccatatctagagtgatctctcgctgtgctaagagcaagcctacttcgcatttcttcctcggccatcagcgggtaacagtgctgactgctgccaaggtgcactgtagtaagtaagtggcatagagaacgaggaaaaagacccccccacccctccctgtgctgactcctgagtcggggtgggacggccctgcaatgtggcaggctcggtgtggattgactactccctcccctctgactctggcatcttggtaaggagggaggggcaccacccatctgggtggagacagctggggtttgctccagtgtgtgtagactggcagagcatgtgagggagagggctgggaagagacggccctgggcccgtgaggtgcagaactctccctgcaggtagtctgtctgctctgtgatgtgctgataggaaagagcccccactggccctctggttcacttctattatgaataaatttgcaccaatagccccattagtttttaaagaaatgagctgggtgggaaaagtggaaatgtaatttctggtaagcttgagctactttaatttttattctatgaaactgatatcccttgatgtgggaaacaggcaggaaaggctgtggggtgggggtgggggactggtgtggcaccgtgcaaacaaaatgacaaatttcaactcacaatctttgtaagaaaattgttccagtttgaatcttgatattaaagtttatgtttacaaaactgccagttagatgaactaagtgtgtaaaacaaatagaaaagacattcgcagacatttcttctatgttattgaatgtgttgtttctggtgtacgtgtcaaaagtttcagttttttagatcagaaataaacgacaaatagtgtgagatgtgttgtgaacaggcatggtgaccgtggtcagcgccactcttgtttcctgaaatgtgcttctaagacagaaaatgtattttctcatcaagggtgtctggagacacagaccgtgaccttggcgcagcggtgtgcatcagaggcgtgtgctgagaagggtggtgttaagctgtggaaaatgactcaagagcaataaatcagtgccaaagcttccctgcgcatctgaatagacacaagtgaagcccgtgtgcgcacagtgcagaggccgagcctgtatttccaggtagacgtggactttattgactgtgaattcatttacatgtaacttctgacatttcactctgtgcaaataaagaacatgaggatacctgtgctgcccagtggactgtctgtacacacacgcatttcaccaggcgcagtgcagactgtctcatgcccatgtgggcgctgggatgcttcctgtacagatgtctcatgccttcagttacacataggtgttcctgtttacagttcctggaggtcagaagcacaggcacgagagaagcaggcccgttcttccgtggcccacttcttcctttgaacaaaggctccttggacccagtggcgggaaactggccctcccacaccccctgcctgttctgggggcagcagtctttggaggagtaatgccaggcagcccctcactgagggccccagtctcccctgcatttcttccctgattgattgataggaggtggctgggctgccactgaatttgtcaacttagactcattgacaacacattaaggggctgtaattatatttattagattaacaaggcagatgtgaattttctcttctataatccagtaagtctgtgtattcgttgactcagacagacaagaagccacaaggaaacaaagaagtaatcatttgttgagagacgttattaactatgatcttccctgaagctaccgggatgggaaaggtcagtgtcttcctttgaaccctgagacaattaggggctcttgaggcctgctgtgcccctgctgccaaggcagcctcaagttcaaggagcagctaatcacccactcctgcattcagtctgtcttgcctgatgagggctacgcaggctgcctcccattggtgtgcactgtttcctttttcagctgctaaatggctgaacaccatcggcctggggtatccctttttggggaatacgtctgtctgtctgaactcctttcccttcaaatggcactgtgataaaatctggtcataccatgctccagcactggaagtacatgaaagcacgcagtctgtgagtgcccatgaggactctcgtgctgggcccccgtggccctggctagctgtcgtaccagtcgaggaagagcaaggagaaggagcacatcacgaggaagaagaggatccacacgcggaagccagcgttgtttttaatggcctctcttatgtcttcgttgccttccttgatattttcagttgcccccacaactaactggtgaatgctgtcaatctcagcttcctgttgcaaaaccttttccgtgaatatctcttggagtctggaaatctcaaccactctcccttcgatttgcctcacttcatcaaacaagctgttcatttcaccaattagtcgctgattttcctgttcaaacatttgtatttcttctggggataactcatcttcgcctttgccatctccccacgttcccaattcaggttgtgtttcagccaaaattttttctggacgttcttcagtggcagggttttcttcagagtcttttgaaggactctgtgaaactttctcagaagatgtggattctcttgtctttgtatttggttctggttccagcttagataatcttttcttatccaccactcttttaactcggatggctctctgttctgagtaaagtttacatactcttttcaagtaatcttcaatgaaatccaaaacagcggtcctgtgctccttcacttgctgggaatgtatctccttgtgagcttctgttcgtagttgctgaattgcttctgaacaggtcctcatgaatatctgggcatcctggtctatctggtctcgttctgtgtctgtcatcctcccatattcagacatggtatggctataagcattaatataatctttcctgtgttccagaagaaaatctctcagtttgccaatgtgagaaatcacttcgcgggcccggctggagaagtcgcccttggnccgggggctccggcggaacagcctcgtccaacggctgccatcgaccccgccgcccaccagccactcccagcgaccgttgttccgcgtcttcacggtcattgacgctggcccggaatagcagcgtgatctccaccgccatagcgacccgcaccctcagccccacactagg

SEQ ID NO: 660062 - DNA, 124 bp, Homo sapiens
attcagacacttggcgatgctgacacatgttggcggtggctgtcagcgtcctccgcagctgatgggtctcgttgtgccaaggagcggcacaggaggtcactggcgtgcccggtcgctgtctggt

SEQ ID NO: 660063 - DNA, 3699 bp, Homo sapiens
  misc_feature (15)..(15): n is a, c, g, or t
  misc_feature (3530)..(3530): n is a, c, g, or t
ccggggtggcgcacncgcagccctcccgctccgggcgccctccgccgctccgagaccccctgggggcgcgtcctctcccgctcccctgttccctcccccggctcagggcgggcgcgtggtcccaggggaggctcccgcccagccccgcactcctttgtgcggccgggcgggcgctgcgtcaaggtggaggcgcggccacacgcgcgcacccacccgcgcgcacccagcccccgggagaggcaggaagggaggcggcggcgcgaggaggagggagcggccgtggagcccaatcgttcgctccccttcccgggtccgcgcgcggcgccgcctccgccattgctgcgagcaggagcaggagacgcggagctcggagcgctgagctgacctgccggagccgggcgtgggctgcagcctcggagctcccggaacgatggtgaagttggggaacaatttcgcagagaagggcaccaagcagccgctgctggaggatggcttcgacaccattcccctgatgacgcccctcgatgtcaatcagctgcagttcccgcccccggataaggtggtcgtgaaaactaagaccgagtatgaacctgaccgcaagaaagggaaagcacgtcctccccaaattgctgagttcaccgtcagcatcacggagggtgtcaccgagaggtttaaggtctccgtgttggtcctcttcgccctggccttcctcacctgcgtcgtcttcctggttgtctacaaggtgtacaagtatgaccgcgcctgccccgatgggttcgtcctcaagaacacccagtgcatcccagaaggcttggagagctactacgcggagcaagactccagtgcccgggagaaattttacacagtcataaaccactacaacctggccaagcagagcatcacgcgctccgtatcgccctggatgtcagttctgtcagaagagaagctgtccgagcaggagactgaagcggctgagaagtcagcttagcgggatgggcaagttccttacaatgtgtcacttgcaaataacaaagggactttgagggacatttcattaaatataattactgatactttagaggttactcatttacggtgcaattgcttctgtttgctaatgctgctttgcaaataaaacttgctgccgaccacccacgggcataaaatcaagtgcatttcagcattgcctaaagagctctgacaccacttttcatgttaagatcttcatttagctcctttactgggatttattggatgctgtaaaaaaataaatttacactggatatgcgaagggtttggatctcagataaatgcattttgtggaattgattttctgaaccgaccctgctgtctgcaaaccttcctccatagccatatctagagtgatctctcgctgtgctaagagcaagcctacttcgcatttcttcctcggccatcagcggtgtgcatcagaggcgtgtgctgagaagggtggtgttaagctgtggaaaatgactcaagagcaataaatcagtgccaaagcttccctgcgcatctgaatagacacaagtgaagcccgtgtgcgcacagtgcagaggccgagcctgtatttccaggtagacgtggactttattgactgtgaattcatttacatgtaacttctgacatttcactctgtgcaaataaagaacatgaggatacctgtgctgcccagtggactgtctgtacacacacgcatttcaccaggcgcagtgcagactgtctcatgcccatgtgggcgctgggatgcttcctgtacagatgtctcatgccttcagttacacataggtgttcctgtttacagttcctggaggtcagaagcacaggcacgagagaagcaggcccgttcttccgtggcccacttcttcctttgaacaaaggctccttggacccagtggcgggaaactggccctcccacaccccctgcctgttctgggggcagcagtctttggaggagtaatgccaggcagcccctcactgagggccccagtctcccctgcatttcttccctgattgattgataggaggtggctgggctgccactgaatttgtcaacttagactcattgacaacacattaaggggctgtaattatatttattagattaacaaggcagatgtgaattttctcttctataatccagtaagtctgtgtattcgttgactcagacagacaagaagccacaaggaaacaaagaagtaatcatttgttgagagacgttattaactatgatcttccctgaagctaccgggatgggaaaggtcagtgtcttcctttgaaccctgagacaattaggggctcttgaggcctgctgtgcccctgctgccaaggcagcctcaagttcaaggagcagctaatcacccactcctgcattcagtctgtcttgcctgatgagggctacgcaggctgcctcccattggtgtgcactgtttcctttttcagctgctaaatggctgaacaccatcggcctggggtatccctttttggggaatacgtctgtctgtctgaactcctttcccttcaaatggcactgtgataaaatctggtcataccatgctccagcactggaagtacatgaaagcacgcagtctgtgagtgcccatgaggactctcgtgctgggcccccgtggccctggctagctgtcgtaccagtcgaggaagagcaaggagaaggagcacatcacgaggaagaagaggatccacacgcggaagccagcgttgtttttaatggcctctcttatgtcttcgttgccttccttgatattttcagttgcccccacaactaactggtgaatgctgtcaatctcagcttcctgttgcaaaaccttttccgtgaatatctcttggagtctggaaatctcaaccactctcccttcgatttgcctcacttcatcaaacaagctgttcatttcaccaattagtcgctgattttcctgttcaaacatttgtatttcttctggggataactcatcttcgcctttgccatctccccacgttcccaattcaggttgtgtttcagccaaaattttttctggacgttcttcagtggcagggttttcttcagagtcttttgaaggactctgtgaaactttctcagaagatgtggattctcttgtctttgtatttggttctggttccagcttagataatcttttcttatccaccactcttttaactcggatggctctctgttctgagtaaagtttacatactcttttcaagtaatcttcaatgaaatccaaaacagcggtcctgtgctccttcacttgctgggaatgtatctccttgtgagcttctgttcgtagttgctgaattgcttctgaacaggtcctcatgaatatctgggcatcctggtctatctggtctcgttctgtgtctgtcatcctcccatattcagacatggtatggctataagcattaatataatctttcctgtgttccagaagaaaatctctcagtttgccaatgtgagaaatcacttcgcgggcccggctggagaagtcgcccttggnccgggggctccggcggaacagcctcgtccaacggctgccatcgaccccgccgcccaccagccactcccagcgaccgttgttccgcgtcttcacggtcattgacgctggcccggaatagcagcgtgatctccaccgccatagcgacccgcaccctcagccccacactagg

SEQ ID NO: 660064 - DNA, 232 bp, Homo sapiens
  misc_feature (6)..(6): n is a, c, g, or t
  misc_feature (21)..(21): n is a, c, g, or t
  misc_feature (56)..(57): n is a, c, g, or t
  misc_feature (65)..(66): n is a, c, g, or t
  misc_feature (73)..(73): n is a, c, g, or t
  misc_feature (100)..(100): n is a, c, g, or t
  misc_feature (111)..(111): n is a, c, g, or t
  misc_feature (195)..(195): n is a, c, g, or t
aaaganattttcatggagtgnaagacataaagtggagaccaagatgaagttcaccnnctgatganncttccanagagattagctcacctttctcctaggnaattataattngggaagggggaaggccacttactgccctctgtaaaagatgttaacatttctagttttcttttagtgtgaatttttaaaatagcngttattcaaggttttagaacttaataaatacctagtc

SEQ ID NO: 660065 - DNA, 4334 bp, Homo sapiens
  misc_feature (4165)..(4165): n is a, c, g, or t
cccctccccaacccagcactaaggagcaccctgctctggtctccgccaccacccagcgcctcctggacccatccccccaaacccttgaacgtcctcaggacccccaggctgcagcctcggagctcccggaacgatggtgaagttggggaacaatttcgcagagaagggcaccaagcagccgctgctggaggatggcttcgacaccattcccctgatgacgcccctcgatgtcaatcagctgcagttcccgcccccggataaggtggtcgtgaaaactaagaccgagtatgaacctgaccgcaagaaagggaaagcacgtcctccccaaattgctgagttcaccgtcagcatcacggagggtgtcaccgagaggtttaaggtctccgtgttggtcctcttcgccctggccttcctcacctgcgtcgtcttcctggttgtctacaaggtgtacaagtatgaccgcgcctgccccgatgggttcgtcctcaagaacacccagtgcatcccagaaggcttggagagctactacgcggagcaagactccagtgcccgggagaaattttacacagtcataaaccactacaacctggccaagcagagcatcacgcgctccgtatcgccctggatgtcagttctgtcagaagagaagctgtccgagcaggagactgaagcggctgagaagtcagcttagcgggatgggcaagttccttacaatgtgtcacttgcaaataacaaagggactttgagggacatttcattaaatataattactgatactttagaggttactcatttacggtgcaattgcttctgtttgctaatgctgctttgcaaataaaacttgctgccgaccacccacgggcataaaatcaagtgcatttcagcattgcctaaagagctctgacaccacttttcatgttaagatcttcatttagctcctttactgggatttattggatgctgtaaaaaaataaatttacactggatatgcgaagggtttggatctcagataaatgcattttgtggaattgattttctgaaccgaccctgctgtctgcaaaccttcctccatagccatatctagagtgatctctcgctgtgctaagagcaagcctacttcgcatttcttcctcggccatcagcgggtaacagtgctgactgctgccaaggtgcactgtagtaagtaagtggcatagagaacgaggaaaaagacccccccacccctccctgtgctgactcctgagtcggggtgggacggccctgcaatgtggcaggctcggtgtggattgactactccctcccctctgactctggcatcttggtaaggagggaggggcaccacccatctgggtggagacagctggggtttgctccagtgtgtgtagactggcagagcatgtgagggagagggctgggaagagacggccctgggcccgtgaggtgcagaactctccctgcaggtagtctgtctgctctgtgatgtgctgataggaaagagcccccactggccctctggttcacttctattatgaataaatttgcaccaatagccccattagtttttaaagaaatgagctgggtgggaaaagtggaaatgtaatttctggtaagcttgagctactttaatttttattctatgaaactgatatcccttgatgtgggaaacaggcaggaaaggctgtggggtgggggtgggggactggtgtggcaccgtgcaaacaaaatgacaaatttcaactcacaatctttgtaagaaaattgttccagtttgaatcttgatattaaagtttatgtttacaaaactgccagttagatgaactaagtgtgtaaaacaaatagaaaagacattcgcagacatttcttctatgttattgaatgtgttgtttctggtgtacgtgtcaaaagtttcagttttttagatcagaaataaacgacaaatagtgtgagatgtgttgtgaacaggcatggtgaccgtggtcagcgccactcttgtttcctgaaatgtgcttctaagacagaaaatgtattttctcatcaagggtgtctggagacacagaccgtgaccttggcgcagcggtgtgcatcagaggcgtgtgctgagaagggtggtgttaagctgtggaaaatgactcaagagcaataaatcagtgccaaagcttccctgcgcatctgaatagacacaagtgaagcccgtgtgcgcacagtgcagaggccgagcctgtatttccaggtagacgtggactttattgactgtgaattcatttacatgtaacttctgacatttcactctgtgcaaataaagaacatgaggatacctgtgctgcccagtggactgtctgtacacacacgcatttcaccaggcgcagtgcagactgtctcatgcccatgtgggcgctgggatgcttcctgtacagatgtctcatgccttcagttacacataggtgttcctgtttacagttcctggaggtcagaagcacaggcacgagagaagcaggcccgttcttccgtggcccacttcttcctttgaacaaaggctccttggacccagtggcgggaaactggccctcccacaccccctgcctgttctgggggcagcagtctttggaggagtaatgccaggcagcccctcactgagggccccagtctcccctgcatttcttccctgattgattgataggaggtggctgggctgccactgaatttgtcaacttagactcattgacaacacattaaggggctgtaattatatttattagattaacaaggcagatgtgaattttctcttctataatccagtaagtctgtgtattcgttgactcagacagacaagaagccacaaggaaacaaagaagtaatcatttgttgagagacgttattaactatgatcttccctgaagctaccgggatgggaaaggtcagtgtcttcctttgaaccctgagacaattaggggctcttgaggcctgctgtgcccctgctgccaaggcagcctcaagttcaaggagcagctaatcacccactcctgcattcagtctgtcttgcctgatgagggctacgcaggctgcctcccattggtgtgcactgtttcctttttcagctgctaaatggctgaacaccatcggcctggggtatccctttttggggaatacgtctgtctgtctgaactcctttcccttcaaatggcactgtgataaaatctggtcataccatgctccagcactggaagtacatgaaagcacgcagtctgtgagtgcccatgaggactctcgtgctgggcccccgtggccctggctagctgtcgtaccagtcgaggaagagcaaggagaaggagcacatcacgaggaagaagaggatccacacgcggaagccagcgttgtttttaatggcctctcttatgtcttcgttgccttccttgatattttcagttgcccccacaactaactggtgaatgctgtcaatctcagcttcctgttgcaaaaccttttccgtgaatatctcttggagtctggaaatctcaaccactctcccttcgatttgcctcacttcatcaaacaagctgttcatttcaccaattagtcgctgattttcctgttcaaacatttgtatttcttctggggataactcatcttcgcctttgccatctccccacgttcccaattcaggttgtgtttcagccaaaattttttctggacgttcttcagtggcagggttttcttcagagtcttttgaaggactctgtgaaactttctcagaagatgtggattctcttgtctttgtatttggttctggttccagcttagataatcttttcttatccaccactcttttaactcggatggctctctgttctgagtaaagtttacatactcttttcaagtaatcttcaatgaaatccaaaacagcggtcctgtgctccttcacttgctgggaatgtatctccttgtgagcttctgttcgtagttgctgaattgcttctgaacaggtcctcatgaatatctgggcatcctggtctatctggtctcgttctgtgtctgtcatcctcccatattcagacatggtatggctataagcattaatataatctttcctgtgttccagaagaaaatctctcagtttgccaatgtgagaaatcacttcgcgggcccggctggagaagtcgcccttggnccgggggctccggcggaacagcctcgtccaacggctgccatcgaccccgccgcccaccagccactcccagcgaccgttgttccgcgtcttcacggtcattgacgctggcccggaatagcagcgtgatctccaccgccatagcgacccgcaccctcagccccacactagg

SEQ ID NO: 660066 - DNA, 2611 bp, Homo sapiens
  misc_feature (15)..(15): n is a, c, g, or t
ccggggtggcgcacncgcagccctcccgctccgggcgccctccgccgctccgagaccccctgggggcgcgtcctctcccgctcccctgttccctcccccggctcagggcgggcgcgtggtcccaggggaggctcccgcccagccccgcactcctttgtgcggccgggcgggcgctgcgtcaaggtggaggcgcggccacacgcgcgcacccacccgcgcgcacccagcccccgggagaggcaggaagggaggcggcggcgcgaggaggagggagcggccgtggagcccaatcgttcgctccccttcccgggtccgcgcgcggcgccgcctccgccattgctgcgagcaggagcaggagacgcggagctcggagcgctgagctgacctgccggagccgggcgtgggctgcagcctcggagctcccggaacgatggtgaagttggggaacaatttcgcagagaagggcaccaagcagccgctgctggaggatggcttcgacaccattcccctgatgacgcccctcgatgtcaatcagctgcagttcccgcccccggataaggtggtcgtgaaaactaagaccgagtatgaacctgaccgcaagaaagggaaagcacgtcctccccaaattgctgagttcaccgtcagcatcacggagggtgtcaccgagaggtttaaggtctccgtgttggtcctcttcgccctggccttcctcacctgcgtcgtcttcctggttgtctacaaggtgtacaagtatgaccgcgcctgccccgatgggttcgtcctcaagaacacccagtgcatcccagaaggcttggagagctactacgcggagcaagactccagtgcccgggagaaattttacacagtcataaaccactacaacctggccaagcagagcatcacgcgctccgtatcgccctggatgtcagttctgtcagaagagaagctgtccgagcaggagactgaagcggctgagaagtcagcttagcgggatgggcaagttccttacaatgtgtcacttgcaaataacaaagggactttgagggacatttcattaaatataattactgatactttagaggttactcatttacggtgcaattgcttctgtttgctaatgctgctttgcaaataaaacttgctgccgaccacccacgggcataaaatcaagtgcatttcagcattgcctaaagagctctgacaccacttttcatgttaagatcttcatttagctcctttactgggatttattggatgctgtaaaaaaataaatttacactggatatgcgaagggtttggatctcagataaatgcattttgtggaattgattttctgaaccgaccctgctgtctgcaaaccttcctccatagccatatctagagtgatctctcgctgtgctaagagcaagcctacttcgcatttcttcctcggccatcagcgggtaacagtgctgactgctgccaaggtgcactgtagtaagtaagtggcatagagaacgaggaaaaagacccccccacccctccctgtgctgactcctgagtcggggtgggacggccctgcaatgtggcaggctcggtgtggattgactactccctcccctctgactctggcatcttggtaaggagggaggggcaccacccatctgggtggagacagctggggtttgctccagtgtgtgtagactggcagagcatgtgagggagagggctgggaagagacggccctgggcccgtgaggtgcagaactctccctgcaggtagtctgtctgctctgtgatgtgctgataggaaagagcccccactggccctctggttcacttctattatgaataaatttgcaccaatagccccattagtttttaaagaaatgagctgggtgggaaaagtggaaatgtaatttctggtaagcttgagctactttaatttttattctatgaaactgatatcccttgatgtgggaaacaggcaggaaaggctgtggggtgggggtgggggactggtgtggcaccgtgcaaacaaaatgacaaatttcaactcacaatctttgtaagaaaattgttccagtttgaatcttgatattaaagtttatgtttacaaaactgccagttagatgaactaagtgtgtaaaacaaatagaaaagacattcgcagacatttcttctatgttattgaatgtgttgtttctggtgtacgtgtcaaaagtttcagttttttagatcagaaataaacgacaaatagtgtgagatgtgttgtgaacaggcatggtgaccgtggtcagcgccactcttgtttcctgaaatgtgcttctaagacagaaaatgtattttctcatcaagggtgtctggagacacagaccgtgaccttggcgcagcggtgtgcatcagaggcgtgtgctgagaagggtggtgttaagctgtggaaaatgactcaagagcaataaatcagtgccaaagcttccctgcgcatctgaatagacacaagtgaagcccgtgtgcgcacagtgcagaggccgagcctgtatttccaggtagacgtggactttattgactgtgaattcatttacatgtaacttctgacatttcactctgtgcaaataaagaacatgaggata

SEQ ID NO: 660067 - DNA, 4322 bp, Homo sapiens
  misc_feature (4153)..(4153): n is a, c, g, or t
cccctccccaacccagcactaaggagcaccctgctctggtctccgccaccacccagcgcctcctggacccatccccccaaacccttgaacgtcctcaggacccccaggcaggagcaggagacgcggagctcggagcgctgagctgacctgccggagccgggcgtgggctgcagcctcggagctcccggaacgatggtgaagttggggaacaatttcgcagagaagggcaccaagcagccgctgctggaggatggcttcgacaccattcccctgatgacgcccctcgatgtcaatcagctgcagttcccgcccccaaattgctgagttcaccgtcagcatcacggagggtgtcaccgagaggtttaaggtctccgtgttggtcctcttcgccctggccttcctcacctgcgtcgtcttcctggttgtctacaaggtgtacaagtatgaccgcgcctgccccgatgggttcgtcctcaagaacacccagtgcatcccagaaggcttggagagctactacgcggagcaagactccagtgcccgggagaaattttacacagtcataaaccactacaacctggccaagcagagcatcacgcgctccgtatcgccctggatgtcagttctgtcagaagagaagctgtccgagcaggagactgaagcggctgagaagtcagcttagcgggatgggcaagttccttacaatgtgtcacttgcaaataacaaagggactttgagggacatttcattaaatataattactgatactttagaggttactcatttacggtgcaattgcttctgtttgctaatgctgctttgcaaataaaacttgctgccgaccacccacgggcataaaatcaagtgcatttcagcattgcctaaagagctctgacaccacttttcatgttaagatcttcatttagctcctttactgggatttattggatgctgtaaaaaaataaatttacactggatatgcgaagggtttggatctcagataaatgcattttgtggaattgattttctgaaccgaccctgctgtctgcaaaccttcctccatagccatatctagagtgatctctcgctgtgctaagagcaagcctacttcgcatttcttcctcggccatcagcgggtaacagtgctgactgctgccaaggtgcactgtagtaagtaagtggcatagagaacgaggaaaaagacccccccacccctccctgtgctgactcctgagtcggggtgggacggccctgcaatgtggcaggctcggtgtggattgactactccctcccctctgactctggcatcttggtaaggagggaggggcaccacccatctgggtggagacagctggggtttgctccagtgtgtgtagactggcagagcatgtgagggagagggctgggaagagacggccctgggcccgtgaggtgcagaactctccctgcaggtagtctgtctgctctgtgatgtgctgataggaaagagcccccactggccctctggttcacttctattatgaataaatttgcaccaatagccccattagtttttaaagaaatgagctgggtgggaaaagtggaaatgtaatttctggtaagcttgagctactttaatttttattctatgaaactgatatcccttgatgtgggaaacaggcaggaaaggctgtggggtgggggtgggggactggtgtggcaccgtgcaaacaaaatgacaaatttcaactcacaatctttgtaagaaaattgttccagtttgaatcttgatattaaagtttatgtttacaaaactgccagttagatgaactaagtgtgtaaaacaaatagaaaagacattcgcagacatttcttctatgttattgaatgtgttgtttctggtgtacgtgtcaaaagtttcagttttttagatcagaaataaacgacaaatagtgtgagatgtgttgtgaacaggcatggtgaccgtggtcagcgccactcttgtttcctgaaatgtgcttctaagacagaaaatgtattttctcatcaagggtgtctggagacacagaccgtgaccttggcgcagcggtgtgcatcagaggcgtgtgctgagaagggtggtgttaagctgtggaaaatgactcaagagcaataaatcagtgccaaagcttccctgcgcatctgaatagacacaagtgaagcccgtgtgcgcacagtgcagaggccgagcctgtatttccaggtagacgtggactttattgactgtgaattcatttacatgtaacttctgacatttcactctgtgcaaataaagaacatgaggatacctgtgctgcccagtggactgtctgtacacacacgcatttcaccaggcgcagtgcagactgtctcatgcccatgtgggcgctgggatgcttcctgtacagatgtctcatgccttcagttacacataggtgttcctgtttacagttcctggaggtcagaagcacaggcacgagagaagcaggcccgttcttccgtggcccacttcttcctttgaacaaaggctccttggacccagtggcgggaaactggccctcccacaccccctgcctgttctgggggcagcagtctttggaggagtaatgccaggcagcccctcactgagggccccagtctcccctgcatttcttccctgattgattgataggaggtggctgggctgccactgaatttgtcaacttagactcattgacaacacattaaggggctgtaattatatttattagattaacaaggcagatgtgaattttctcttctataatccagtaagtctgtgtattcgttgactcagacagacaagaagccacaaggaaacaaagaagtaatcatttgttgagagacgttattaactatgatcttccctgaagctaccgggatgggaaaggtcagtgtcttcctttgaaccctgagacaattaggggctcttgaggcctgctgtgcccctgctgccaaggcagcctcaagttcaaggagcagctaatcacccactcctgcattcagtctgtcttgcctgatgagggctacgcaggctgcctcccattggtgtgcactgtttcctttttcagctgctaaatggctgaacaccatcggcctggggtatccctttttggggaatacgtctgtctgtctgaactcctttcccttcaaatggcactgtgataaaatctggtcataccatgctccagcactggaagtacatgaaagcacgcagtctgtgagtgcccatgaggactctcgtgctgggcccccgtggccctggctagctgtcgtaccagtcgaggaagagcaaggagaaggagcacatcacgaggaagaagaggatccacacgcggaagccagcgttgtttttaatggcctctcttatgtcttcgttgccttccttgatattttcagttgcccccacaactaactggtgaatgctgtcaatctcagcttcctgttgcaaaaccttttccgtgaatatctcttggagtctggaaatctcaaccactctcccttcgatttgcctcacttcatcaaacaagctgttcatttcaccaattagtcgctgattttcctgttcaaacatttgtatttcttctggggataactcatcttcgcctttgccatctccccacgttcccaattcaggttgtgtttcagccaaaattttttctggacgttcttcagtggcagggttttcttcagagtcttttgaaggactctgtgaaactttctcagaagatgtggattctcttgtctttgtatttggttctggttccagcttagataatcttttcttatccaccactcttttaactcggatggctctctgttctgagtaaagtttacatactcttttcaagtaatcttcaatgaaatccaaaacagcggtcctgtgctccttcacttgctgggaatgtatctccttgtgagcttctgttcgtagttgctgaattgcttctgaacaggtcctcatgaatatctgggcatcctggtctatctggtctcgttctgtgtctgtcatcctcccatattcagacatggtatggctataagcattaatataatctttcctgtgttccagaagaaaatctctcagtttgccaatgtgagaaatcacttcgcgggcccggctggagaagtcgcccttggnccgggggctccggcggaacagcctcgtccaacggctgccatcgaccccgccgcccaccagccactcccagcgaccgttgttccgcgtcttcacggtcattgacgctggcccggaatagcagcgtgatctccaccgccatagcgacccgcaccctcagccccacactagg

SEQ ID NO: 660068 - DNA, 2243 bp, Homo sapiens
  misc_feature (15)..(15): n is a, c, g, or t
ccggggtggcgcacncgcagccctcccgctccgggcgccctccgccgctccgagaccccctgggggcgcgtcctctcccgctcccctgttccctcccccggctcagggcgggcgcgtggtcccaggggaggctcccgcccagccccgcactcctttgtgcggccgggcgggcgctgcgtcaaggtggaggcgcggccacacgcgcgcacccacccgcgcgcacccagcccccgggagaggcaggaagggaggcggcggcgcgaggaggagggagcggccgtggagcccaatcgttcgctccccttcccgggtccgcgcgcggcgccgcctccgccattgctgcgagcaggagcaggagacgcggagctcggagcgctgagctgacctgccggagccgggcgtgggctgcagcctcggagctcccggaacgatggtgaagttggggaacaatttcgcagagaagggcaccaagcagccgctgctggaggatggcttcgacaccattcccctgatgacgcccctcgatgtcaatcagctgcagttcccgcccccggataaggtggtcgtgaaaactaagaccgagtatgaacctgaccgcaagaaagggaaagcacgtcctccccaaattgctgagttcaccgtcagcatcacggagggtgtcaccgagaggtttaaggtctccgtgttggtcctcttcgccctggccttcctcacctgcgtcgtcttcctggttgtctacaaggtgtacaagtatgaccgcgcctgccccgatgggttcgtcctcaagaacacccagtgcatcccagaaggcttggagagctactacgcggagcaagactccagtgcccgggagaaattttacacagtcataaaccactacaacctggccaagcagagcatcacgcgctccgtatcgccctggatgtcagttctgtcagaagagaagctgtccgagcaggagactgaagcggctgagaagtcagcttagcgggatgggcaagttccttacaatgtgtcacttgcaaataacaaagggactttgagggacatttcattaaatataattactgatactttagaggttactcatttacggtgcaattgcttctgtttgctaatgctgctttgcaaataaaacttgctgccgaccacccacgggcataaaatcaagtgcatttcagcattgcctaaagagctctgacaccacttttcatgttaagatcttcatttagctcctttactgggatttattggatgctgtaaaaaaataaatttacactggatatgcgaagggtttggatctcagataaatgcattttgtggaattgattttctgaaccgaccctgctgtctgcaaaccttcctccatagccatatctagagtgatctctcgctgtgctaagagcaagcctacttcgcatttcttcctcggccatcagcgggtaacagtgctgactgctgccaaggtgcactgtagtaagtaagtggcatagagaacgaggaaaaagacccccccacccctccctgtgctgactcctgagtcggggtgggacggccctgcaatgtggcaggctcggtgtggattgactactccctcccctctgactctggcatcttggtaaggagggaggggcaccacccatctgggtggagacagctggggtttgctccagtgtgtgtagactggcagagcatgtgagggagagggctgggaagagacggccctgggcccgtgaggtgcagaactctccctgcaggtagtctgtctgctctgtgatgtgctgataggaaagagcccccactggccctctggttcacttctattatgaataaatttgcaccaatagccccattagtttttaaagaaatgagctgggtgggaaaagtggaaatgtaatttctggtaagcttgagctactttaatttttattctatgaaactgatatcccttgatgtgggaaacaggcaggaaaggctgtggggtgggggtgggggactggtgtggcaccgtgcaaacaaaatgacaaatttcaactcacaatctttgtaagaaaattgttccagtttgaatcttgatattaaagtttatgtttacaaaactgccagttagatgaactaagtgtgtaaaacaaatagaaaagacattcgcagacatttcttctatgttattgaatgtgttgtttctggtgtacgtgtcaaaagtttcagttttttagatcagaaataaacgacaaatagtgtga

SEQ ID NO: 660069 - DNA, 4276 bp, Homo sapiens
  misc_feature (11)..(11): n is a, c, g, or t
  misc_feature (44)..(44): n is a, c, g, or t
  misc_feature (46)..(46): n is a, c, g, or t
  misc_feature (4107)..(4107): n is a, c, g, or t
cgagagggcanaaaaccttcgggctaggtacgaggcctgggtgntngggagcggccgtggagcccaatcgttcgctccccttcccgggtccgcgcgcggcgccgcctccgccattgctgcgagcaggagcaggagacgcggagctcggagcgctgagctgacctgccggagccgggcgtgggctgcagcctcggagctcccggaacgatggtgaagttggggaacaatttcgcagagaagggcaccaagcagccgctgctggaggatggcttcgacaccattcccctgatgacgcccctcgatgtcaatcagctgcagttcccgcccccggataaggtggtcgtgaaaactaagaccgagtatgaacctgaccgcaagaaagggaaagcacgtcctccccaaattgctgagttcaccgtcagcatcacggagggtgtcaccgagaggtttaaggtctccgtgttggtcctcttcgccctggccttcctcacctgcgtcgtcttcctggttgtctacaaggtgtacaagtatgaccgcgcctgccccgatgggttcgtcctcaagaacacccagtgcatcccagaagagaagctgtccgagcaggagactgaagcggctgagaagtcagcttagcgggatgggcaagttccttacaatgtgtcacttgcaaataacaaagggactttgagggacatttcattaaatataattactgatactttagaggttactcatttacggtgcaattgcttctgtttgctaatgctgctttgcaaataaaacttgctgccgaccacccacgggcataaaatcaagtgcatttcagcattgcctaaagagctctgacaccacttttcatgttaagatcttcatttagctcctttactgggatttattggatgctgtaaaaaaataaatttacactggatatgcgaagggtttggatctcagataaatgcattttgtggaattgattttctgaaccgaccctgctgtctgcaaaccttcctccatagccatatctagagtgatctctcgctgtgctaagagcaagcctacttcgcatttcttcctcggccatcagcgggtaacagtgctgactgctgccaaggtgcactgtagtaagtaagtggcatagagaacgaggaaaaagacccccccacccctccctgtgctgactcctgagtcggggtgggacggccctgcaatgtggcaggctcggtgtggattgactactccctcccctctgactctggcatcttggtaaggagggaggggcaccacccatctgggtggagacagctggggtttgctccagtgtgtgtagactggcagagcatgtgagggagagggctgggaagagacggccctgggcccgtgaggtgcagaactctccctgcaggtagtctgtctgctctgtgatgtgctgataggaaagagcccccactggccctctggttcacttctattatgaataaatttgcaccaatagccccattagtttttaaagaaatgagctgggtgggaaaagtggaaatgtaatttctggtaagcttgagctactttaatttttattctatgaaactgatatcccttgatgtgggaaacaggcaggaaaggctgtggggtgggggtgggggactggtgtggcaccgtgcaaacaaaatgacaaatttcaactcacaatctttgtaagaaaattgttccagtttgaatcttgatattaaagtttatgtttacaaaactgccagttagatgaactaagtgtgtaaaacaaatagaaaagacattcgcagacatttcttctatgttattgaatgtgttgtttctggtgtacgtgtcaaaagtttcagttttttagatcagaaataaacgacaaatagtgtgagatgtgttgtgaacaggcatggtgaccgtggtcagcgccactcttgtttcctgaaatgtgcttctaagacagaaaatgtattttctcatcaagggtgtctggagacacagaccgtgaccttggcgcagcggtgtgcatcagaggcgtgtgctgagaagggtggtgttaagctgtggaaaatgactcaagagcaataaatcagtgccaaagcttccctgcgcatctgaatagacacaagtgaagcccgtgtgcgcacagtgcagaggccgagcctgtatttccaggtagacgtggactttattgactgtgaattcatttacatgtaacttctgacatttcactctgtgcaaataaagaacatgaggatacctgtgctgcccagtggactgtctgtacacacacgcatttcaccaggcgcagtgcagactgtctcatgcccatgtgggcgctgggatgcttcctgtacagatgtctcatgccttcagttacacataggtgttcctgtttacagttcctggaggtcagaagcacaggcacgagagaagcaggcccgttcttccgtggcccacttcttcctttgaacaaaggctccttggacccagtggcgggaaactggccctcccacaccccctgcctgttctgggggcagcagtctttggaggagtaatgccaggcagcccctcactgagggccccagtctcccctgcatttcttccctgattgattgataggaggtggctgggctgccactgaatttgtcaacttagactcattgacaacacattaaggggctgtaattatatttattagattaacaaggcagatgtgaattttctcttctataatccagtaagtctgtgtattcgttgactcagacagacaagaagccacaaggaaacaaagaagtaatcatttgttgagagacgttattaactatgatcttccctgaagctaccgggatgggaaaggtcagtgtcttcctttgaaccctgagacaattaggggctcttgaggcctgctgtgcccctgctgccaaggcagcctcaagttcaaggagcagctaatcacccactcctgcattcagtctgtcttgcctgatgagggctacgcaggctgcctcccattggtgtgcactgtttcctttttcagctgctaaatggctgaacaccatcggcctggggtatccctttttggggaatacgtctgtctgtctgaactcctttcccttcaaatggcactgtgataaaatctggtcataccatgctccagcactggaagtacatgaaagcacgcagtctgtgagtgcccatgaggactctcgtgctgggcccccgtggccctggctagctgtcgtaccagtcgaggaagagcaaggagaaggagcacatcacgaggaagaagaggatccacacgcggaagccagcgttgtttttaatggcctctcttatgtcttcgttgccttccttgatattttcagttgcccccacaactaactggtgaatgctgtcaatctcagcttcctgttgcaaaaccttttccgtgaatatctcttggagtctggaaatctcaaccactctcccttcgatttgcctcacttcatcaaacaagctgttcatttcaccaattagtcgctgattttcctgttcaaacatttgtatttcttctggggataactcatcttcgcctttgccatctccccacgttcccaattcaggttgtgtttcagccaaaattttttctggacgttcttcagtggcagggttttcttcagagtcttttgaaggactctgtgaaactttctcagaagatgtggattctcttgtctttgtatttggttctggttccagcttagataatcttttcttatccaccactcttttaactcggatggctctctgttctgagtaaagtttacatactcttttcaagtaatcttcaatgaaatccaaaacagcggtcctgtgctccttcacttgctgggaatgtatctccttgtgagcttctgttcgtagttgctgaattgcttctgaacaggtcctcatgaatatctgggcatcctggtctatctggtctcgttctgtgtctgtcatcctcccatattcagacatggtatggctataagcattaatataatctttcctgtgttccagaagaaaatctctcagtttgccaatgtgagaaatcacttcgcgggcccggctggagaagtcgcccttggnccgggggctccggcggaacagcctcgtccaacggctgccatcgaccccgccgcccaccagccactcccagcgaccgttgttccgcgtcttcacggtcattgacgctggcccggaatagcagcgtgatctccaccgccatagcgacccgcaccctcagccccacactagg

SEQ ID NO: 660070 - DNA, 1755 bp, Homo sapiens
  misc_feature (15)..(15): n is a, c, g, or t
ccggggtggcgcacncgcagccctcccgctccgggcgccctccgccgctccgagaccccctgggggcgcgtcctctcccgctcccctgttccctcccccggctcagggcgggcgcgtggtcccaggggaggctcccgcccagccccgcactcctttgtgcggccgggcgggcgctgcgtcaaggtggaggcgcggccacacgcgcgcacccacccgcgcgcacccagcccccgggagaggcaggaagggaggcggcggcgcgaggaggagggagcggccgtggagcccaatcgttcgctccccttcccgggtccgcgcgcggcgccgcctccgccattgctgcgagcaggagcaggagacgcggagctcggagcgctgagctgacctgccggagccgggcgtgggctgcagcctcggagctcccggaacgatggtgaagttggggaacaatttcgcagagaagggcaccaagcagccgctgctggaggatggcttcgacaccattcccctgatgacgcccctcgatgtcaatcagctgcagttcccgcccccggataaggtggtcgtgaaaactaagaccgagtatgaacctgaccgcaagaaagggaaagcacgtcctccccaaattgctgagttcaccgtcagcatcacggagggtgtcaccgagaggtttaaggtctccgtgttggtcctcttcgccctggccttcctcacctgcgtcgtcttcctggttgtctacaaggtgtacaagtatgaccgcgcctgccccgatgggttcgtcctcaagaacacccagtgcatcccagaaggcttggagagctactacgcggagcaagactccagtgcccgggagaaattttacacagtcataaaccactacaacctggccaagcagagcatcacgcgctccgtatcgccctggatgtcagttctgtcagaagagaagctgtccgagcaggagactgaagcggctgagaagtcagcttagcgggatgggcaagttccttacaatgtgtcacttgcaaataacaaagggactttgagggacatttcattaaatataattactgatactttagaggttactcatttacggtgcaattgcttctgtttgctaatgctgctttgcaaataaaacttgctgccgaccacccacgggcataaaatcaagtgcatttcagcattgcctaaagagctctgacaccacttttcatgttaagatcttcatttagctcctttactgggatttattggatgctgtaaaaaaataaatttacactggatatgcgaagggtttggatctcagataaatgcattttgtggaattgattttctgaaccgaccctgctgtctgcaaaccttcctccatagccatatctagagtgatctctcgctgtgctaagagcaagcctacttcgcatttcttcctcggccatcagcgggtaacagtgctgactgctgccaaggtgcactgtagtaaggtgtctggagacacagaccgtgaccttggcgcagcggtgtgcatcagaggcgtgtgctgagaagggtggtgttaagctgtggaaaatgactcaagagcaataaatcagtgccaaagcttccctgcgcatctgaatagacacaagtgaagcccgtgtgcgcacagtgcagaggccgagcctgtatttccaggtagacgtggactttattgactgtgaattcatttacatgtaacttctgacatttcactctgtgcaaataaagaacatgaggata

SEQ ID NO: 660071 - DNA, 4378 bp, Homo sapiens
  misc_feature (15)..(15): n is a, c, g, or t
  misc_feature (4209)..(4209): n is a, c, g, or t
ccggggtggcgcacncgcagccctcccgctccgggcgccctccgccgctccgagaccccctgggggcgcgtcctctcccgctcccctgttccctcccccggctcagggcgggcgcgtggtcccaggggaggctcccgcccagccccgcactcctttgtgcggccgggcgggcgctgcgtcaaggtggaggcgcggccacacgcgcgcacccacccgcgcgcacccagcccccgggagaggcaggaagggaggcggcggcgcgaggaggagggagcggccgtggagcccaatcgttcgctccccttcccgggtccgcgcgcggcgccgcctccgccattgctgcgagcaggagcaggagacgcggagctcggagcgctgagctgacctgccggagccgggcgtgggctgcagcctcggagctcccggaacgatggtgaagttggggaacaatttcgcagagaagggcaccaagcagccgctgctggaggatggcttcgacaccattcccctgatgacgcccctcgatgtcaatcagctgcagttcccgcccctaaggtctccgtgttggtcctcttcgccctggccttcctcacctgcgtcgtcttcctggttgtctacaaggtgtacaagtatgaccgcgcctgccccgatgggttcgtcctcaagaacacccagtgcatcccagaagagaagctgtccgagcaggagactgaagcggctgagaagtcagcttagcgggatgggcaagttccttacaatgtgtcacttgcaaataacaaagggactttgagggacatttcattaaatataattactgatactttagaggttactcatttacggtgcaattgcttctgtttgctaatgctgctttgcaaataaaacttgctgccgaccacccacgggcataaaatcaagtgcatttcagcattgcctaaagagctctgacaccacttttcatgttaagatcttcatttagctcctttactgggatttattggatgctgtaaaaaaataaatttacactggatatgcgaagggtttggatctcagataaatgcattttgtggaattgattttctgaaccgaccctgctgtctgcaaaccttcctccatagccatatctagagtgatctctcgctgtgctaagagcaagcctacttcgcatttcttcctcggccatcagcgggtaacagtgctgactgctgccaaggtgcactgtagtaagtaagtggcatagagaacgaggaaaaagacccccccacccctccctgtgctgactcctgagtcggggtgggacggccctgcaatgtggcaggctcggtgtggattgactactccctcccctctgactctggcatcttggtaaggagggaggggcaccacccatctgggtggagacagctggggtttgctccagtgtgtgtagactggcagagcatgtgagggagagggctgggaagagacggccctgggcccgtgaggtgcagaactctccctgcaggtagtctgtctgctctgtgatgtgctgataggaaagagcccccactggccctctggttcacttctattatgaataaatttgcaccaatagccccattagtttttaaagaaatgagctgggtgggaaaagtggaaatgtaatttctggtaagcttgagctactttaatttttattctatgaaactgatatcccttgatgtgggaaacaggcaggaaaggctgtggggtgggggtgggggactggtgtggcaccgtgcaaacaaaatgacaaatttcaactcacaatctttgtaagaaaattgttccagtttgaatcttgatattaaagtttatgtttacaaaactgccagttagatgaactaagtgtgtaaaacaaatagaaaagacattcgcagacatttcttctatgttattgaatgtgttgtttctggtgtacgtgtcaaaagtttcagttttttagatcagaaataaacgacaaatagtgtgagatgtgttgtgaacaggcatggtgaccgtggtcagcgccactcttgtttcctgaaatgtgcttctaagacagaaaatgtattttctcatcaagggtgtctggagacacagaccgtgaccttggcgcagcggtgtgcatcagaggcgtgtgctgagaagggtggtgttaagctgtggaaaatgactcaagagcaataaatcagtgccaaagcttccctgcgcatctgaatagacacaagtgaagcccgtgtgcgcacagtgcagaggccgagcctgtatttccaggtagacgtggactttattgactgtgaattcatttacatgtaacttctgacatttcactctgtgcaaataaagaacatgaggatacctgtgctgcccagtggactgtctgtacacacacgcatttcaccaggcgcagtgcagactgtctcatgcccatgtgggcgctgggatgcttcctgtacagatgtctcatgccttcagttacacataggtgttcctgtttacagttcctggaggtcagaagcacaggcacgagagaagcaggcccgttcttccgtggcccacttcttcctttgaacaaaggctccttggacccagtggcgggaaactggccctcccacaccccctgcctgttctgggggcagcagtctttggaggagtaatgccaggcagcccctcactgagggccccagtctcccctgcatttcttccctgattgattgataggaggtggctgggctgccactgaatttgtcaacttagactcattgacaacacattaaggggctgtaattatatttattagattaacaaggcagatgtgaattttctcttctataatccagtaagtctgtgtattcgttgactcagacagacaagaagccacaaggaaacaaagaagtaatcatttgttgagagacgttattaactatgatcttccctgaagctaccgggatgggaaaggtcagtgtcttcctttgaaccctgagacaattaggggctcttgaggcctgctgtgcccctgctgccaaggcagcctcaagttcaaggagcagctaatcacccactcctgcattcagtctgtcttgcctgatgagggctacgcaggctgcctcccattggtgtgcactgtttcctttttcagctgctaaatggctgaacaccatcggcctggggtatccctttttggggaatacgtctgtctgtctgaactcctttcccttcaaatggcactgtgataaaatctggtcataccatgctccagcactggaagtacatgaaagcacgcagtctgtgagtgcccatgaggactctcgtgctgggcccccgtggccctggctagctgtcgtaccagtcgaggaagagcaaggagaaggagcacatcacgaggaagaagaggatccacacgcggaagccagcgttgtttttaatggcctctcttatgtcttcgttgccttccttgatattttcagttgcccccacaactaactggtgaatgctgtcaatctcagcttcctgttgcaaaaccttttccgtgaatatctcttggagtctggaaatctcaaccactctcccttcgatttgcctcacttcatcaaacaagctgttcatttcaccaattagtcgctgattttcctgttcaaacatttgtatttcttctggggataactcatcttcgcctttgccatctccccacgttcccaattcaggttgtgtttcagccaaaattttttctggacgttcttcagtggcagggttttcttcagagtcttttgaaggactctgtgaaactttctcagaagatgtggattctcttgtctttgtatttggttctggttccagcttagataatcttttcttatccaccactcttttaactcggatggctctctgttctgagtaaagtttacatactcttttcaagtaatcttcaatgaaatccaaaacagcggtcctgtgctccttcacttgctgggaatgtatctccttgtgagcttctgttcgtagttgctgaattgcttctgaacaggtcctcatgaatatctgggcatcctggtctatctggtctcgttctgtgtctgtcatcctcccatattcagacatggtatggctataagcattaatataatctttcctgtgttccagaagaaaatctctcagtttgccaatgtgagaaatcacttcgcgggcccggctggagaagtcgcccttggnccgggggctccggcggaacagcctcgtccaacggctgccatcgaccccgccgcccaccagccactcccagcgaccgttgttccgcgtcttcacggtcattgacgctggcccggaatagcagcgtgatctccaccgccatagcgacccgcaccctcagccccacactagg

SEQ ID NO: 660072 - DNA, 1756 bp, Homo sapiens
  misc_feature (15)..(15): n is a, c, g, or t
ccggggtggcgcacncgcagccctcccgctccgggcgccctccgccgctccgagaccccctgggggcgcgtcctctcccgctcccctgttccctcccccggctcagggcgggcgcgtggtcccaggggaggctcccgcccagccccgcactcctttgtgcggccgggcgggcgctgcgtcaaggtggaggcgcggccacacgcgcgcacccacccgcgcgcacccagcccccgggagaggcaggaagggaggcggcggcgcgaggaggagggagcggccgtggagcccaatcgttcgctccccttcccgggtccgcgcgcggcgccgcctccgccattgctgcgagcaggagcaggagacgcggagctcggagcgctgagctgacctgccggagccgggcgtgggctgcagcctcggagctcccggaacgatggtgaagttggggaacaatttcgcagagaagggcaccaagcagccgctgctggaggatggcttcgacaccattcccctgatgacgcccctcgatgtcaatcagctgcagttcccgcccccggataaggtggtcgtgaaaactaagaccgagtatgaacctgaccgcaagaaagggaaagcacgtcctccccaaattgctgagttcaccgtcagcatcacggagggtgtcaccgagaggtttaaggtctccgtgttggtcctcttcgccctggccttcctcacctgcgtcgtcttcctggttgtctacaaggtgtacaagtatgaccgcgcctgccccgatgggttcgtcctcaagaacacccagtgcatcccagaaggcttggagagctactacgcggagcaagactccagtgcccgggagaaattttacacagtcataaaccactacaacctggccaagcagagcatcacgcgctccgtatcgccctggatgtcagttctgtcagaagagaagctgtccgagcaggagactgaagcggctgagaagtcagcttagcgggatgggcaagttccttacaatgtgtcacttgcaaataacaaagggactttgagggacatttcattaaatataattactgatactttagaggttactcatttacggtgcaattgcttctgtttgctaatgctgctttgcaaataaaacttgctgccgaccacccacgggcataaaatcaagtgcatttcagcattgcctaaagagctctgacaccacttttcatgttaagatcttcatttagctcctttactgggatttattggatgctgtaaaaaaataaatttacactggatatgcgaagggtttggatctcagataaatgcattttgtggaattgattttctgaaccgaccctgctgtctgcaaaccttcctccatagccatatctagagtgatctctcgctgtgctaagagcaagcctacttcgcatttcttcctcggccatcagcgggtaacagtgctgactgctgccaaggtgcactgtagtaagtaagtggcatagagaacgaggaaaaagacccccccacccctccctgtgctgactcctgagtcggggtgggacggccctgcaatgtggcaggctcggtgtggattgactactccctcccctctgactctggcatcttggtaaggagggaggggcaccacccatctgggtggagacagctggggtttgctccagtgtgtgtagactggcaaaaccttttttaggtattgttcttgtataaaaattgctcatatggatccttattgtttgataaaagt

SEQ ID NO: 660073 - DNA, 188 bp, Homo sapiens
ggcacgaggggacaatttgctttgggtattttgagagggtcttgttttgtagcccaggctggcctgaaattagtgatcctcctgatgactgggattatagttatgtgtcaccccaacccagcaaggcatttgtttactgaagttcccacaactggctttataatcatttggggtaagcagctagagat

SEQ ID NO: 660074 - DNA, 104 bp, Homo sapiens
ccacagtaattacaactactatccggcatcccatacatgggacagacctaggttcaatgaatctgaggaggctactcagtagacagttccacccctacacgatt

SEQ ID NO: 660075 - DNA, 960 bp, Homo sapiens
gagtttgagtgtccaggcaacgggcgacgataatggagtcggggagatcgcgaaagccccaatcatggtttgtctctcctaggaaatagcgggtgatcttgggctgtggtggatgtggtgagacatgcctcgataatcgactgagcccaaggaatatagatagcgtgggaggctgtcaggtgccttaacggctcatttgcactatctcatcagtggcagtactctatggggtgtgacatggccatccagagtgataagctagaccatccttgctaggacagacatcctgcggatccgcgctagtactcattcatctgaaaatagatggaccatgcatcctacccttaagcacagggacccctgttgtgaccccttcgtgtggctgtctccagaatgccgatgagaacctgaaaaaagtcctagtgaccaaattgttacctgtaagatggtgggccgacccacgtcgagctcgacagacatttttatgctctcaaattttgccactctctatacacgtagggctaggtgcaataattatatgaatgggatcttgacgggcagacgtagcgaaagcaacacaaagggaaaaaaggacttgcggcaattgaatgaacaggccagcgaacacccggtagcgagcaaatgaagcaaagaggtccgaagacgctggcagtaaccggaaattgaagatgtcctttggggcgtccctttgagttgttcagaggccggcaccaagggatggggacgtccggggacggtgttatgaaatgggcccactcggggttggcctcaagggttcctgaggaacaacgcgtcgggggggcgggccccatttttcgtgaagattcccaggggcctttcttatatgccgcacatcccttggcagcggtaacgggtttgtccccctaaaacacaagctcggggggctcatgtgtgggccccttgtggcctcggcaggtg

SEQ ID NO: 660076 - DNA, 754 bp, Homo sapiens
agcggcttctgccttcaacagctggtttgaaaatgcagaggaggacttaagctagaccccgtgcgctgcaactccttgtcaagaaatcaaccgctttgcgcgaggcccatcgacgccttccgctcctccctcagcgtctgcgacaggctgatcttcaaccatggctggccgagctggaccgccgagatcaagagcttccgcgctagcctccaagccactacacctggttgtaccatgcgaggcccaggaggagaacgacgagctgcgccaggaagttggcccagcacgtccaacgccttgcaccagtggatccaagagaccaggacatacctcctcgatgggtcctgtggtggacgagtcggggaccctcgaatcccagtttgaagctaccaaacgcaagcaccaggaaattccgagccactgagaatgtcagctcaacaaatgatcgaggacctgggggccgtcatggaggacggccctcatcctggacacacaagtacacggacgcacagcaccgtgaggcctcgctacagcagtgggaccagctggaccagctgggcatgcgcatgcatcacaacctggagcagcagatccaggccaggaacacaacacgtgtgactgaccgaggccctcaaacgaattcagcatgatgtaatagacacgttagacaaggacaagtctggcaggctgaaccatcaggagttcaaatcttgcctgcgctccctgggctatgacctgcccatggtgggaggca

SEQ ID NO: 660077 - DNA, 188 bp, Homo sapiens
tgagctggaggcaaggttgatgcactgatggctgagattaacttcatgacgatgttctttgcggggggacgctgtcccagatgcagacgcatgtctctgacacctcagatggtcctctccatgggcaaacaacccgcaaacctggcacctggatagccatccatcgctgcagcgaccaaggccccagc

SEQ ID NO: 660078 - DNA, 478 bp, Homo sapiens
ggagtctcatcgacacactcagccactggaggtaacgcctgagttcaaatctgtactgcaccctggatgtggattcctttgcggtattttgtgaataaagcaaagacgcgcgtctacaggacacagctgagccaacactggcaactgaacgcgaactttgacgatacagctgcgcagcggctcccagagcccctcaccatacttctgcctactcacaaccgctgtcacacacacgtaccaacatccccaatgcacgaccccataccactgacaacctccatccccgacacccccccctgctcctagcacacctctgagatcactctcctacgaccttctgagcttgatctacacgtatcgcactgcacaccacccaacaactcatccctcagagtcaccaccttctctatcatctgacgatatttcatcactaacacctgcacccacacaccataacaccattgccgcactacccaac

SEQ ID NO: 660079 - DNA, 351 bp, Homo sapiens
gctagttccacagtagggtataaagttctctgtctaggtgattttatctagagtttggtgaagaaccaaggatttctcaagtgtttgctttaattatttgaattgtatattaaaattgttggtgccaaggtctgaattgactgccttgtacccattggagattggtggagagggattaccccaaactaaatatttggtaattttggaggcattttgagacttcatttgttatggtcttgtttctttgaaaaatagacgtttccactttattttttggttttatattgtttctaggtggttttgtttttaaataaaaagaaagcgagtcttttagataattgggaaatgaga

SEQ ID NO: 660080 - DNA, 258 bp, Homo sapiens
cgtggagatggctcctcttagctacttttacctggattgctctctgatgaactagatggcctgcagtttagttactgttctttaaggtatgttatcattttctaaagtgtccttaggcctgtacttccccacactgtttcaaataaagtcagttcctttggagagtacctcggagctctcttttgttatgaactgtctctcgccctgggaaaggtctctgaggcactactctgggtgctgggtgggatagtagcctct

SEQ ID NO: 660081 - DNA, 443 bp, Homo sapiens
cgatctacaggaccttaaaagtgcactcttctatatctactaaaaataaaaaactagccaggcatagtggcacacgcctgtagtactagctactcaggaggctgaggcaggagaattacttgaacctgggaggcaacaggttgcagtgagccaagatcacgccactgcactccaaacctgagggtcttctaaggaggtgagactctatctccctcaatcaatcaatcacatcaataatttggggataaaagagagtgggacaagaactagttagagaaaacagaaaattccgcaagtaagaaaaaaccattacagctataaacatatggtaggggtctaaaataaactagggtttacaccctaaattaacgaacaaggggatctaataaggaggggataattttcaagggtagatattagaagaggggacttatgggggaacc

SEQ ID NO: 660082 - DNA, 106 bp, Homo sapiens
aaggatgcggtccaccttttgcagaactcatatctcgagcagtttaacttaagggaggcgaatttttaatttaaactgctcgagatatgagttctgcaaaaggtgg

SEQ ID NO: 660083 - DNA, 206 bp, Homo sapiens
tttggaaaaaaaaattcaggtttccaatttccctcccccggaggggggccagccccgaggtttttttgaacagaaatttatttttggtaaccctcgggtgggcccccccggatcccgggggtcccccgcccccattcctttggaaaagggtttccaaaacccctccccacccaaaatatattttgggcccctgggtttggggggga

SEQ ID NO: 660084 - DNA, 423 bp, Homo sapiens
tttacgcgtttttttcaaaaatattcccgccaattatttatcaatcgccctttatgctgcacatttttttagaaaggccattggtgggggcttttttaattttgcacctggtgaaaaaagggtgtttttctacaaggttattttggttggttaccccattttttttccagtcaagttgttttaaaacggccgccaatttatttttattcgccccattattgggattttttggcagggggcccccccataagttttttttttttttttttttttttttttttttttttttttttttttttttttttttttttttttttttttttttttttttttttttttttttttttggttttatagatttattttcaaagagtaaaacacatacaatttaaatacaagtccatcagaatcactctgtcagag

SEQ ID NO: 660085 - DNA, 1399 bp, Homo sapiens
  misc_feature (932)..(932): n is a, c, g, or t
cttgttatctttgctcttattttctcttgttgtttttgttgttctttttcatgtatagtgtcgtttctatttgtttggtcatctgtgtgttttttttctttctttcttagcttctttgctgtctggcttgctactgcatgtcttatcctgtctgtgctcttgtcttttctgtctttttctctggttgctccgttgctgccttctgcttggtttgtttgcttcttttccttctcgttgtgtctcgtttttgtgtttgttctgcttggtgctcactgccggcgggctctgtcgggtgtgggttataaccagaacttcgttttgtgggaccctctccgtttcctctcctggtggcacgccctactccccaccccgtgtttttggcccccgccctttgagaagaaccccccggggtcccgtgtgtccagcccttcctggatttttacctttggccctcggggacggggagtgaccgaagttgccaccacacgggaccccgtcgttattgcgccctttggtcgctattttaatgtgaccacttattagcagcccaagttgtaccccaaaaacacggtcgtgggtgacccgcgtcccgcgaatttcccccgggatttttttccgacccccaccgctgttccgccccgtggcaccccccggctggccgccagcccctttgccccgcggcccccgcccgggcctctacggccccgagggagcccctcacgccgcgtacccttttgcctcctccgccttctggggaactcgtcttctctgggccccccgcgggccgctggtcccgcgccccttgcgcccttctctgcttgggtgaccacacgctgggcgcaccgcaccgctgggccccacactctcccacgggaatttctcgggtttcttcgcctctgttctcggcctcgggggagcaccccccgcgaggncccgctctcacgtgtccacacgccacactctcctcgcgagtggcaccttccacacacacctctctatggagacgccacgcgaggggttttccgcgcggagttggtttccgcagggcttcgcttccgctatgagatttggagaattcgccccctcgaagaatgtagagccctcccagggatttaatgtcacaattctggctccctctccacttctacgcctccgcggaggcctcgaacgccgttctcctcccactccgccaccctcggagtccacgagcgctggatttttgtatttgctcggtggtgcccacgtctctgccccacgaggctttggagttccatcttgaaaggggtgttctgggggaactttactgttgccaagttgtaaataaatggttaatttatatcctattttttctcacccccctctttttagaaacacctataaaggctattattgtgatcca

SEQ ID NO: 660086 - DNA, 99 bp, Homo sapiens
gtggtttccgaaattcctgggaaggggggtgctggcgtgtggaattgtcgcggcccctggtctgccgcggcgttttttgtctacattcgtcgtagctcg

SEQ ID NO: 660087 - DNA, 181 bp, Homo sapiens
gcggcctcatgaacacatccaacctctacatttacaaaacgaattcagggtgcggaagtacaaacaggtcgatcgattcacaaaactgaaatacttcattagcccacctaaacatacaaactgcttacagattagctgaaatggtctcaattgggctatcaaattcattgggattttcctc

SEQ ID NO: 660088 - DNA, 547 bp, Homo sapiens
  misc_feature (9)..(9): n is a, c, g, or t
  misc_feature (25)..(25): n is a, c, g, or t
  misc_feature (133)..(133): n is a, c, g, or t
  misc_feature (211)..(211): n is a, c, g, or t
  misc_feature (279)..(279): n is a, c, g, or t
  misc_feature (282)..(282): n is a, c, g, or t
  misc_feature (303)..(303): n is a, c, g, or t
  misc_feature (364)..(364): n is a, c, g, or t
  misc_feature (370)..(370): n is a, c, g, or t
  misc_feature (373)..(373): n is a, c, g, or t
  misc_feature (382)..(382): n is a, c, g, or t
  misc_feature (391)..(391): n is a, c, g, or t
  misc_feature (463)..(463): n is a, c, g, or t
  misc_feature (496)..(496): n is a, c, g, or t
  misc_feature (534)..(534): n is a, c, g, or t
ctgctgccngcggtcgcctctagangacccaatatatccggcctatcctgtgttgttgttgttgttgttgtttttaattaagtaaatgctgttttagaacctgaaaaaataaagtccatctttcttgaccctncataaaaaacaaatctaaaaccaagaagaaatgaaatggatatgatacgttcttaaaatgccagccttctcttatggncacagcatttccaagtatattcctgccctataaaaagaatagtcaggctctgcacctacaaaaaaagnggngttaccattgaatccattcanctgaattcattgcaataaaatattgcatttgagttttttataatgagcttttactataaanagaagngcnggtctatanctagaaaanagatcctaccattgaatccattcacctaaattcattaaaggaaaatatttgcatttgagtctttataatganatttactgctttcttataatatctccccatagncctttctataacgattgtttaaatttaaaactttgtcncttaatattaaaa

SEQ ID NO: 660089 - DNA, 1543 bp, Homo sapiens
aggccgctccccgcaggtgtttaataaataggaaataaagcggaggtgatggaatattaaaggtcaaagaggggggtgatattattaaaagtatgaataagatttgtttgtttgtgataataagaagcggcgagaaaaattaggggagagtttttgagaaaaagtatgtccgcatctccaacaaccaggggggggcaccgacgtattcaccacagaatgtttctccccggggataagaagtaaatatgataagataattttgggggaacaccacccaataagaggggggcttctccccccccgccaagaagaagagcgtctgctcacacatagggggggttttctatcatagcacagcgtgagttcttcttctggtggcgtctatataaaaccttcttgggaggaaaactgctggagaaaatgatctcataatctccccaacgactttttgtgccgtctttgagaagagggtataatagggtttgcgccgagtaatattatatcgcggaagcaccaccagcagctgattataaccccacagcacgttgtgccccgcggcgccaacagaggtgttgtttgacaacacgacgctgctgttctcttgggagaggtttttttcttagtagtaaaaagacgctcgccgccacacgacgcggtcatctggttggtagaaagctcgtaggagcacccacggcgcagtaatatagatacctcgccggcgtcactacacgggaggacacatcttctcgtgtgcgcacaacacacacactcggaggggcccccacaggagggtgccgcacacacaagatatgatgattataaaagaggaagagtctcatagagagagacactccgtataatatagagctcataggtgggtgtttgtgagagatgtcacactcatcagatggggcgtgtgatgaacacacacagtggggccccccccccgcactacagtgtgttgtaaaggggtgacgacaccacacagagagaccccctctcttggagaagagaaaatatactctttagagagagtgttgtttgtgtgtgctctgggatgacacacacatgtttcttttggccctctctttgtgtcactctctgtgtgtcacactgtgtgtgtgtgtccccacggaggacactactgtaaaattgtgtgtgtcacacatttgtcacagtactcttgtgagagagggagataactactgagagtgagagagagaggggtgtgtgtgtgtgtttgtgtgtgtgttctgagagaggagagagaatatacacccaccccctccaagtgagatcccgcagaaatatgagtattgttaccacagcgttccaggaccacacagaggtgtgggccacatatattgagcggcacacgtgagataaatagtgtggagagggggtcacactctccacaaatgtcacacgagatgtttgatttttgagttttctcacttccgccctgtgtaaaagggccaacccctttgagaaaatgcccgagcccgtttaagtttaaaactatggggttaatttttgaccccaa

SEQ ID NO: 660090 - DNA, 913 bp, Homo sapiens
tctcctgcctcagcctccagagtagctgggattaaacctgcctcggtctcacaaagtgctgacaattacaggcatgagccaccacgcctggctgagttttgacacgttcagcactaaattctatgaagttgtacaacatatcacaatgaatctctgccaaggatggacgagacatgtgcaaacaagcagacgcgtacaagaccaactaagttatttttgcctgttgggagcaaggccccccaaaaatccggccaataaactggccccaaggactggccattaaaccaaaaatctctgcaagcacatgtaccccattgttcccataaatgggcccctaatgcccaaagctgtaataggtagtctactggaaattcacatagcttggagcgctgaccaccattgacggcaaagttactgacccattccaacgacttctcatactctttccatcctctgaaaaccacaactactccatgggaacacttcggagttggcacttcaatatacttgccaggtcgcctgaggtaaccttaaggttgttaccctctttgtttcccaactgggcattgcaaacggggacatgtgcttggaaaacgcaaacaagttgcagatgaagaaactctggatcccctacagggcatcctctgaccaccacgagtcggggcgcctgggcatacggcctgtacgggccggagttcagggctcaccaccttggcttttggcagcacgaatgccagggacgccccacagtccggacggacacatgcaacacgagacctgtactgccagaagactactgcctggctagacggtcctctagatagagggacacggcacaaaattccgccgggcaataggatctaacgtgggccgaccggccaaacgggacacgcaaccagaccgcacacacaca

SEQ ID NO: 660091 - DNA, 830 bp, Homo sapiens
  misc_feature (642)..(642): n is a, c, g, or t
  misc_feature (672)..(672): n is a, c, g, or t
  misc_feature (746)..(746): n is a, c, g, or t
  misc_feature (756)..(756): n is a, c, g, or t
  misc_feature (828)..(828): n is a, c, g, or t
caactaatgggaaaaataaccaagctagcatcataatgacagaatcaaattcacgcataacaatattaaccttaaatgtaaacaggttaaatgccccaattaaaagacactgactggcaaattggatagagagtcaagacccatcggtgtgctgtattcaggagactcatctcacgtccaaagacacacataggctcaaaataaagggatggaggaatatttatcaagcaaatggaaagcaaaaaaaaaaaaaaaaaagcaggggatgcaatcctagtctctgataaaacagactttaagccaacaaagatcaaaaagacaaaaaagggcattacataatggtaaagggatcaatgcaacacgaagagctaactatcctaaatatatatgcacccaaaacaggagcacccagattcataaagcaagttctcagagacctacaaagagacttagactcccacacaataatgggagactttaacaccccactgtcaatagtagacagatcagcaagacagaaaattaacaaggatattcaggacttgaactcacctctggaccaagtggacctagtagacatctacagaactctccaccccaaatcaacagaatatacattcttctcagcatcctgatccacancatcacacttttctaaaactgaccacatantggaagtaaaacagtcctcagcaaatgcaaaagaatggaaatcataacaaacagtctctcagaccacagtgcantcaagttagngttcaagattaaagaaacttgccccaaactttcaactacatgggaaactgaataacctgctccaaaatgacnac

SEQ ID NO: 660092 - DNA, 313 bp, Homo sapiens
taactgtcgggaccaaactgggttgtgggtgatcttcttctcctcggatcccacgagcattcagaaggctgttcctggacacggtaccgttgcccatgcggggattacatgtgcagcgctatgtccctgaggagccaccttgaagttgatagcaaagctcttgcctgtgggaggcacatagaccttgatgatgatggttcttcgagctgtgagccctcctatgcagtctttcgaaatatggcacaggcgggttgcaggcatgggggtacttcccatggagggcaggctgtacacatagtgggtggcagaaatt

SEQ ID NO: 660093 - DNA, 421 bp, Homo sapiens
ctgtgaacccggccgggactaaatctatctgctgcttacgggttgagagctccgtctcgggtcgatgcgatcacgacatatccgacctttcagcgcataatatcatgcgcagtggacttgattccgcagtcctgcagcagccttgttttcatatagacactatgcagtgtccacccacaatctttgttctgtaaaattatcgtgccatggcctgcgcatttatttacagatacaatacgttgtgtgatggaccagctcttagctgtccatatcaacacaccctcttcttccatgtgctgcgtgtcccatccgtctgccatttttcgccgcacaatgctctattctatagtgtcctgacgccctgacgttcctttcatctcagacccgattgcttttctcgccggccttgttcatcctgtgg

SEQ ID NO: 660094 - DNA, 1488 bp, Homo sapiens
gtgcctgggcccgcacatttctgccattgcgggatttcctcggacgtcgtactcgtgtgtatactcgtggtctgatcggagtctagcacctcgggatccgagcgaactctctgagcaggtggactggtggggtcgagccgtctcgatttagagatcgggtagacaatgatagtaggggttcaggtccaatgatcacccgaaaagcagaggctaagtgagcagcatctgaatgaccgagtcttgcagaagctcccacgaatcgagggaaagacgctcgctgacacctagtcccaagcgtctactggagaacgggaccaagcttgaggtgcccacgtccccgtgtggctcctgagtggcctcgttgacgacgcctgtcgggtggccggagggggcccagccaagtgggtcgctgtgtgtctcaccgtcgaggactcgtcagcgttggtcagccccaacggttacactgtgtaaccaattgtgccgcactccattggcctctggcttttgtccttctctatgccttggtgcccttaggtggctggctcgttctcttgtcttctcattcggtcgtcgtcgagtaccttgactgcgaaagacatgagcgtcctcgtgaggccggacttaaccccggaaggtactaatgcaaccctatatgttcccacttgcggcagctcgtgcccaaaaacactttttgttccaacacaaatgctggggcccttttgttcatttggctaccaagagtcgcaacgcaccggactggatgcctatagttgcttcgcaatttgcccccagtttagactttgccctgttgaaactccactaacactgggggtagctccattcctttgtggggcgccttgtgactctcccgatcgtacacctgcttcctcttggggaagggaaccctcttgtgtcccacaaaccttctttcatttcaacgtgctacattatccaacgttgttcattccacttatgaaccctttggcatcaggccataagagtccccccctcttccaaaacggggttgaaccttttgcggtgcaaatccatgccccttttccccagttgggcgccttttatccttcatgtcttcccctaggaagcttcttttgaattagcctatggtccaacaaagccagttcgttcccaagctcttggatccctgcgcgtagtgtggagactttaatgattggcccttgggcaacttacccttagttcatcccttcctatcagttattaggaacgaaggcccaaatattcttctgttcaacgggggcgcccacatccactgaatcgcctttattgaccaaagtacaccacttgtgaggggagcccccacgacacaacttggtcgctcccttgacgcaacacctgtgacttcttctgctcggataccctgtaatggtgtcccagagggtatctattttagtgcccagggtggtagtgtggtcagctatgagattggagcttgtcccatagtgggattac

SEQ ID NO: 660095 - DNA, 640 bp, Homo sapiens
gagatagcctggtaacaaacgagggttcccgggattggacctgacgcagccatgctgggcatggtagcatgcgcctgtagtcccagctacttgggaggctgaggcaggagaatcgcttgaacccgggaagcagaggtttcagtgagcagagatcagcgccactgcactccagcctggacgacagagcgagacttcgccactgcactccagcctggacgacagagcgagacttcgtctcaaaaagaaaaaaacctctgcgacttgatatcaaaagaaagctaactgctagatctgatcgagttaagagtgtggatctgcatcctacagagccatggatgttggcaagtctttacaatggcagtgtgtgtgtcggaaatcatgaaaaacagacactggtgaagacatttgaagtatgtgatcttcctgtatcgagctgcaaagtttgtggcaaggaaggacttggggtggtgaacaggagtcggtgttgccatgccagacttacaaggggtcacattaccaatacttctgggagaggagttccacattgttgggaagcaccctccagaacctacttcctcaggaatggcggtacaatccaaacccagccttacatctcaaactagcattggatacttgctaa

SEQ ID NO: 660096 - DNA, 185 bp, Homo sapiens
ttatttgtgtgtttgtgtgtgtgtgtgtgtgtatctcaaaaaggaaaatatagtgaagtgaatatattggggttgtaagtggtattgacatgaaaatggagaggaagtgatgccaggagaaatggtcagtttatgaaggtctcacttcagaggtgtggatggatggtagggaaagagaattgagg

SEQ ID NO: 660097 - DNA, 203 bp, Homo sapiens
  misc_feature (23)..(23): n is a, c, g, or t
ccctaccccatcaccctgagtanagaatatttatcattacagcatcatttacatgatccaacatcacaattattctcataggaataaagataataattacagctctctactctctctacatactaattattacacaacgaggaaaatacacccaccacattaacaacatcaaaccctcattcacacgagcagcaggaggagga

SEQ ID NO: 660098 - DNA, 960 bp, Homo sapiens
agcgggctggctggaggtggcggagagcaacgtggcagccgggagcccatcagaggagaaagtctcgaggactgctgtgaacttcctgactgtccatggcggtgacagtgtcatcccgaaaggaccggccccagttttcagtactttatatcgctgtaatctagtgaccactgagcctgacgaaaggttccttcagctaactccagtggggaggaatactcgtaggcagacgtcggacaggaggtgccgcatggcagtggtcttggtcaactgattgtttgcagatggtggcacctacctggttcattttgatgaatgggctctttaagtggacttaggggtattgaccttctcagatggttcaaggtatgagtggggagtttgcccagagtcaagtttaactggcgtcgaagtctacattcgactatgacaatcatgagcctttgatgggggaactttagaatacatggcaagagtagatggttgtaggcctgctgactttccctgatggttctcattggaactcccccgcaatgaagggtctcttgggataacgaacaagctgctgcgtacgtgacgaagtgtttctgccattgttcagcgggcccagagctgcctccaatgtcaggcagaaatctaactgccttgaccagcgcaggtggtgcaccagcgtgataagtattgggtaaagccagtgcccctgtttgtcgattcgaggtgaaccaatgaatcagaagcggagaatgagcttgacgaatgaccgtggaagcagagggctggttttgtgcccctggcacccggccattccaggaactgggacacagcaaagtgctgaagatgctgggcaggaagacccgccagcagtcattggggggtcggtcgttgccctaacccttatgtttggaggacaaaggggcccctcttttaaatggtgagaattttgccaaaacccggttccag

SEQ ID NO: 660099 - DNA, 358 bp, Homo sapiens
actcaaatgatgacaactccagcttttggttactcaggccaaactctcagagtcattctagacccttctctttcaaaatgtacacccaatctatcagccagtcctgtcagctctattttaaaatatatgcagaaactaaacgatagtggtagaaaatagatccgaggggcttggagtgtggaataagggggatacaaaagaacaggagaaaatttggaagctgatgggaatgtgaagtatcttgactgtggagatggttgagtgggtgtatatgtgtgtcaaaatacaataaattgtacactatatgtgtggtttaatatgtgctagttatgcctcaataaaactgttttttttttta

SEQ ID NO: 660100 - DNA, 1864 bp, Homo sapiens
  misc_feature (15)..(15): n is a, c, g, or t
ccggggtggcgcacncgcagccctcccgctccgggcgccctccgccgctccgagaccccctgggggcgcgtcctctcccgctcccctgttccctcccccggctcagggcgggcgcgtggtcccaggggaggctcccgcccagccccgcactcctttgtgcggccgggcgggcgctgcgtcaaggtggaggcgcggccacacgcgcgcacccacccgcgcgcacccagcccccgggagaggcaggaagggaggcggcggcgcgaggaggagggagcggccgtggagcccaatcgttcgctccccttcccgggtccgcgcgcggcgccgcctccgccattgctgcgagcaggagcaggagacgcggagctcggagcgctgagctgacctgccggagccgggcgtgggctgcagcctcggagctcccggaacgatggtgaagttggggaacaatttcgcagagaagggcaccaagcagccgctgctggaggatggcttcgacaccattcccctgatgacgcccctcgatgtcaatcagctgcagttcccgcccccggataaggtggtcgtgaaaactaagaccgagtatgaacctgaccgcaagaaagggaaagcacgtcctccccaaattgctgagttcaccgtcagcatcacggagggtgtcaccgagaggtttaaggtctccgtgttggtcctcttcgccctggccttcctcacctgcgtcgtcttcctggttgtctacaaggtgtacaagtatgaccgcgcctgccccgatgggttcgtcctcaagaacacccagtgcatcccagaaggcttggagagctactacgcggagcaagactccagtgcccgggagaaattttacacagtcataaaccactacaacctggccaagcagagcatcacgcgctccgtatcgccctggatgtcagttctgtcagaagagaagctgtccgagcaggagactgaagcggctgagaagtcagcttagcgggatgggcaagttccttacaatgtgtcacttgcaaataacaaagggactttgagggacatttcattaaatataattactgatactttagaggttactcatttacggtgcaattgcttctgtttgctaatgctgctttgcaaataaaacttgctgccgaccacccacgggcataaaatcaagtgcatttcagcattgcctaaagagctctgacaccacttttcatgttaagatcttcatttagctcctttactgggatttattggatgctgtaaaaaaataaatttacactggatatgcgaagggtttggatctcagataaatgcattttgtggaattgattttctgaaccgaccctgctgtctgcaaaccttcctccatagccatatctagagtgatctctcgctgtgctaagagcaagcctacttcgcatttcttcctcggccatcagcgggtaacagtgctgactgctgccaaggtgcactgtagtaagtaagtggcatagagaacgaggaaaagtggaaatgtaatttctggtaagcttgagctactttaatttttattctatgaaactgatatcccttgatgtgggaaacaggcaggaaaggctgtggggtgggggtgggggactggtgtggcaccgtgcaaacaaaatgacaaatttcaactcacaatctttgtaagaaaattgttccagtttgaatcttgatattaaagtttatgtttacaaaactgccagttagatgaactaagtgtgtaaaacaaatagaaaagacattcgcagacatttcttctatgttattgaatgtgttgtttctggtgtacgtgtcaaaagtttcagttttttagatcagaaataaacgacaaatagtgtga

SEQ ID NO: 660101 - DNA, 1334 bp, Homo sapiens
  misc_feature (15)..(15): n is a, c, g, or t
ccggggtggcgcacncgcagccctcccgctccgggcgccctccgccgctccgagaccccctgggggcgcgtcctctcccgctcccctgttccctcccccggctcagggcgggcgcgtggtcccaggggaggctcccgcccagccccgcactcctttgtgcggccgggcgggcgctgcgtcaaggtggaggcgcggccacacgcgcgcacccacccgcgcgcacccagcccccgggagaggcaggaagggaggcggcggcgcgaggaggagggagcggccgtggagcccaatcgttcgctccccttcccgggtccgcgcgcggcgccgcctccgccattgctgcgagcaggagcaggagacgcggagctcggagcgctgagctgacctgccggagccgggcgtgggctgcagcctcggagctcccggaacgatggtgaagttggggaacaatttcgcagagaagggcaccaagcagccgctgctggaggatggcttcgacaccattcccctgatgacgcccctcgatgtcaatcagctgcagttcccgcccccggataaggtggtcgtgaaaactaagaccgagtatgaacctgaccgcaagaaagggaaagcacgtcctccccaaattgctgagttcaccgtcagcatcacggagggtgtcaccgagaggtttaaggtctccgtgttggtcctcttcgccctggccttcctcacctgcgtcgtcttcctggttgtctacaaggtgtacaagtatgaccgcgcctgccccgatgggttcgtcctcaagaacacccagtgcatcccagaaggcttggagagctactacgcggagcaagactccagtgcccgggagaaattttacacagtcataaaccactacaacctggccaagcagagcatcacgcgctccgtatcgccctggatgtcagttctgtcagaagagaagctgtccgagcaggagactgaagcggctgagaagtcagcttagcgggatgggcaagttccttacaatgtgtcacttgcaaataacaaagggactttgagggacatttcattaaatataattactgatactttagaggttactcatttacggtgcaattgcttctgtttgctaatgctgctttgcaaataaaacttgctgccgaccacccacgggcataaaatcaagtgcatttcagcattgcctaaagagctctgacaccacttttcatgttaagatcttcatttagctcctttactgggatttattggatgctgtaaaaaaataatacggggagcggccgaacaaccccgaacccgcgcacccggctgctctctctgtgaccgagata

SEQ ID NO: 660102 - DNA, 753 bp, Homo sapiens
acaaatataccctgggttctggattctgccatgaggcgaatgatttgagaaactgaatatagatgcccttgtccggaaccccatggccgatctaggaatgtctactactggacctagggaccagctcatgaacagtgctcacggaagcacgacttatcggcgaacttggagaggaagaactagagtggttattcaggggccagatataagtatctattgtacgtgatgccctttatgcagcctgtatagtgaaggtacaggtcgagcttaactcatttgtatcatccaaagtgttcgtgggaccttcccgagctgatcctaatcatcttgttgatgatctgttacacaccttgctctccaggtgaccctggtgccgttgaaatgacctggcatggattgtccctgtgagatcaactctgggtagtccagtggttctccattgctcgagatatgtgagtcgtgtcacctatacataactagcaagaaccactatcagtgcaatgatacatgacttgctggatgagtttaagaagtgaacagacagatctcggtcccgaaggctaagccgaagacaaggacatgatgcttaccgatattgtattctttcttctcatagatatctatgtctatttggatcgcatcaatagtttccagtgaaaagatcttttaccccattggaagtacacatctcacttcggcagtttcattcgggttatattgtacttttcctccattacttattaatactcctag

SEQ ID NO: 660103 - DNA, 2050 bp, Homo sapiens
  misc_feature (64)..(64): n is a, c, g, or t
  misc_feature (71)..(71): n is a, c, g, or t
  misc_feature (90)..(90): n is a, c, g, or t
  misc_feature (1881)..(1881): n is a, c, g, or t
aaaccttgtgcttgccccaagtggaactgtcctggtaacaacaacaacgacattttcaccccangcgcaantgcaaaactgtcctcaatnccccatgtgggcgctgggaatgccttccctgtaacagatgtcctcatgcccttcaagttacacataggtgttcctgtttacagttcctggaggtcagaagcacaggcacgagagaagcaggcccgttcttccgtggcccacttcttcctttgaacaaaggctccttggacccagtggcgggaaactggccctcccacaccccctgcctgttctgggggcagcagtctttggaggagtaatgccaggcagcccctcactgagggccccagtctcccctgcatttcttccctgattgattgataggaggtggctgggctgccactgaatttgtcaacttagactcattgacaacacattaaggggctgtaattatatttattagattaacaaggcagatgtgaattttctcttctataatccagtaagtctgtgtattcgttgactcagacagacaagaagccacaaggaaacaaagaagtaatcatttgttgagagacgttattaactatgatcttccctgaagctaccgggatgggaaaggtcagtgtcttcctttgaaccctgagacaattaggggctcttgaggcctgctgtgcccctgctgccaaggcagcctcaagttcaaggagcagctaatcacccactcctgcattcagtctgtcttgcctgatgagggctacgcaggctgcctcccattggtgtgcactgtttcctttttcagctgctaaatggctgaacaccatcggcctggggtatccctttttggggaatacgtctgtctgtctgaactcctttcccttcaaatggcactgtgataaaatctggtcataccatgctccagcactggaagtacatgaaagcacgcagtctgtgagtgcccatgaggactctcgtgctgggcccccgtggccctggctagctgtcgtaccagtcgaggaagagcaaggagaaggagcacatcacgaggaagaagaggatccacacgcggaagccagcgttgtttttaatggcctctcttatgtcttcgttgccttccttgatattttcagttgcccccacaactaactggtgaatgctgtcaatctcagcttcctgttgcaaaaccttttccgtgaatatctcttggagtctggaaatctcaaccactctcccttcgatttgcctcacttcatcaaacaagctgttcatttcaccaattagtcgctgattttcctgttcaaacatttgtatttcttctggggataactcatcttcgcctttgccatctccccacgttcccaattcaggttgtgtttcagccaaaattttttctggacgttcttcagtggcagggttttcttcagagtcttttgaaggactctgtgaaactttctcagaagatgtggattctcttgtctttgtatttggttctggttccagcttagataatcttttcttatccaccactcttttaactcggatggctctctgttctgagtaaagtttacatactcttttcaagtaatcttcaatgaaatccaaaacagcggtcctgtgctccttcacttgctgggaatgtatctccttgtgagcttctgttcgtagttgctgaattgcttctgaacaggtcctcatgaatatctgggcatcctggtctatctggtctcgttctgtgtctgtcatcctcccatattcagacatggtatggctataagcattaatataatctttcctgtgttccagaagaaaatctctcagtttgccaatgtgagaaatcacttcgcgggcccggctggagaagtcgcccttggnccgggggctccggcggaacagcctcgtccaacggctgccatcgaccccgccgcccaccagccactcccagcgaccgttgttccgcgtcttcacggtcattgacgctggcccggaatagcagcgtgatctccaccgccatagcgacccgcaccctcagccccacactagg

SEQ ID NO: 660104 - DNA, 364 bp, Homo sapiens
  misc_feature (1)..(1): n is a, c, g, or t
ntggagaggaatgaagggcccgatagagatggctcctcactctacagggttgatgcttatggggctaatatgtcgattcaaattcatttcacagttaagagtggtatcttaaaaatatgattcacggggagaagctctgatagcatacgtttcccaggaagctttccatggatctgcagaacacctttagacgggacgccgggcatactttcggcgatgctgctggtccactcgctccaggtaccaagtacttgggaaaagtctgtttgtgtcaccaggtggggagaaattcaccttatggtagaatcgctctctttggttcgacaggtctgatgtgctgcacaccaacttgtacaggggagag

SEQ ID NO: 660105 - DNA, 1304 bp, Homo sapiens
  misc_feature (15)..(15): n is a, c, g, or t
ccggggtggcgcacncgcagccctcccgctccgggcgccctccgccgctccgagaccccctgggggcgcgtcctctcccgctcccctgttccctcccccggctcagggcgggcgcgtggtcccaggggaggctcccgcccagccccgcactcctttgtgcggccgggcgggcgctgcgtcaaggtggaggcgcggccacacgcgcgcacccacccgcgcgcacccagcccccgggagaggcaggaagggaggcggcggcgcgaggaggagggagcggccgtggagcccaatcgttcgctccccttcccgggtccgcgcgcggcgccgcctccgccattgctgcgagcaggagcaggagacgcggagctcggagcgctgagctgacctgccggagccgggcgtgggctgcagcctcggagctcccggaacgatggtgaagttggggaacaatttcgcagagaagggcaccaagcagccgctgctggaggatggcttcgacaccattcccctgatgacgcccctcgatgtcaatcagctgcagttcccgcccccggataaggtggtcgtgaaaactaagaccgagtatgaacctgaccgcaagaaagggaaagcacgtcctccccaaattgctgagttcaccgtcagcatcacggagggtgtcaccgagaggtttaaggtctccgtgttggtcctcttcgccctggccttcctcacctgcgtcgtcttcctggttgtctacaaggtgtacaagtatgaccgcgcctgccccgatgggttcgtcctcaagaacacccagtgcatcccagaaggcttggagagctactacgcggagcaagactccagtgcccgggagaaattttacacagtcataaaccactacaacctggccaagcagagcatcacgcgctccgtatcgccctggatgtcagttctgtcagaagagaagctgtccgagcaggagactgaagcggctgagaagtcagcttagcgggatgggcaagttccttacaatgtgtcacttgcaaataacaaagggactttgagggacatttcattaaatataattactgatactttagaggttactcatttacggtgcaattgcttctgtttgctaatgctgctttgcaaataaaacttgctgccgaccacccacgggcataaaatcaagtgcatttcagcattgcctaaagagctctgacaccacttttcatgttaagatcttcagtgccctcccattcttccttgttcagtcctttgggccacctgattatggctctagccagaggtatctcagtggtgga

SEQ ID NO: 660106 - DNA, 1207 bp, Homo sapiens
  misc_feature (1038)..(1038): n is a, c, g, or t
tgccagtagtacccccacccaccctggattgctcctttggaggctggtgagccactgcctctcgaaagcagctggaggtgggcgacaaggtggtgggtctcatgaacacacgcagctccgcggtcacacaattttgtgatcagccccgtgagctctgcccagcaaggctcctgggcagctgtgccggcgagactaacacccgctgctgggactcagtgctgcgccacgtcgcacctggggaacctaaacagtgcctacctctcttatgtcttcgttgccttccttgatattttcagttgcccccacaactaactggtgaatgctgtcaatctcagcttcctgttgcaaaaccttttccgtgaatatctcttggagtctggaaatctcaaccactctcccttcgatttgcctcacttcatcaaacaagctgttcatttcaccaattagtcgctgattttcctgttcaaacatttgtatttcttctggggataactcatcttcgcctttgccatctccccacgttcccaattcaggttgtgtttcagccaaaattttttctggacgttcttcagtggcagggttttcttcagagtcttttgaaggactctgtgaaactttctcagaagatgtggattctcttgtctttgtatttggttctggttccagcttagataatcttttcttatccaccactcttttaactcggatggctctctgttctgagtaaagtttacatactcttttcaagtaatcttcaatgaaatccaaaacagcggtcctgtgctccttcacttgctgggaatgtatctccttgtgagcttctgttcgtagttgctgaattgcttctgaacaggtcctcatgaatatctgggcatcctggtctatctggtctcgttctgtgtctgtcatcctcccatattcagacatggtatggctataagcattaatataatctttcctgtgttccagaagaaaatctctcagtttgccaatgtgagaaatcacttcgcgggcccggctggagaagtcgcccttggnccgggggctccggcggaacagcctcgtccaacggctgccatcgaccccgccgcccaccagccactcccagcgaccgttgttccgcgtcttcacggtcattgacgctggcccggaatagcagcgtgatctccaccgccatagcgacccgcaccctcagccccacactagg

SEQ ID NO: 660107 - DNA, 373 bp, Homo sapiens
  misc_feature (40)..(40): n is a, c, g, or t
  misc_feature (58)..(58): n is a, c, g, or t
  misc_feature (75)..(75): n is a, c, g, or t
  misc_feature (115)..(115): n is a, c, g, or t
gagaccccgggattgcagactcacccttcgtgcgctcacncaggctctcctgctttgntccctgctgcctgctgngtgctgcccagtgtgactggcgatggtgggtgggtgagcnctgtcagtcgctgttcctgtgctggatgatggggcaggtaaatgccctctctgcagtgtcttacagcacacctgcatctccagttttcggcccctcactggctcttaacaggtcacgtgatcactccagacaacatattgcaacctgtcatcagcatcagggtcaccaaccacccgctagagtacacgttccagaaaagagaccttcatcagatggtcagtcccagacagctcgctgcacctcaccagaccacaaata

SEQ ID NO: 660108 - DNA, 164 bp, Homo sapiens
agttgtagtgctcgtggtcacaatattaaaagatcccatctgctaataggatcaaaggccagatgtgtatggcctgtgttcttaaatgtcgattgtatttataccttggtaattaattcatactttacacacacatatcctctccaaagaatttgtatcagatt

SEQ ID NO: 660109 - DNA, 1011 bp, Homo sapiens
  misc_feature (86)..(86): n is a, c, g, or t
  misc_feature (842)..(842): n is a, c, g, or t
ctcctccatcacacgtgtgcagaggcagctctgggtagtgagagcttttccctgaggagctctgcgcacacacacctgctagcaanacatggctctgctcctggctgtgtagagcagcagcctttgggaaaaatgtctcgtgctctcaagtacattcccctttgagtgaaaacatacagctcctttgtttttgtttttttacctgttgcaaaaccttttccgtgaatatctcttggagtctggaaatctcaaccactctcccttcgatttgccatttgtatttcttctggggataactcatcttcgcctttgccatctccccacgttcccaattcaggttgtgtttcagccaaaattttttctggacgttcttcagtggcagggttttcttcagagtcttttgaaggactctgtgaaactttctcagaagatgtggattctcttgtctttgtatttggttctggttccagcttagataatcttttcttatccaccactcttttaactcggatggctctctgttctgagtaaagtttacatactcttttcaagtaatcttcaatgaaatccaaaacagcggtcctgtgctccttcacttgctgggaatgtatctccttgtgagcttctgttcgtagttgctgaattgcttctgaacaggtcctcatgaatatctgggcatcctggtctatctggtctcgttctgtgtctgtcatcctcccatattcagacatggtatggctataagcattaatataatctttcctgtgttccagaagaaaatctctcagtttgccaatgtgagaaatcacttcgcgggcccggctggagaagtcgcccttggnccgggggctccggcggaacagcctcgtccaacggctgccatcgaccccgccgcccaccagccactcccagcgaccgttgttccgcgtcttcacggtcattgacgctggcccggaatagcagcgtgatctccaccgccatagcgacccgcaccctcagccccacactagg

SEQ ID NO: 660110 - DNA, 670 bp, Homo sapiens
atacacctacgaatgccaatccaaggttcccaatatcacccgcacatcctaaggggacaagacatatagacgtatgctacaacctcctctcctctcctggcctcactctcacaacctgcctttgcccacccacctactcaacagccgaggcgccttccgccgtagccgcctcgacggattcccgcttgggtgggaacgtcggacgaatatgcgtatccctacctcgaaatagagggatccgaaccgtatgtgtctaagtcagtaatgctaagaggaagctacactacggagcccaagccctaagcgatagacccggatatataaggagattacctagataaggtttcagtaactccgatgctttgcgatctagaaattccggcgatagcgtatgtctcatacctactaccgtatttcaaagccccttccatggaagccctggcggactaatattgtataggattttcggatgcggtcaggaacctacgagagccggtttagaacgcgcctatgggcaagtggtaagcgtaatagacggccgacgccctaatttaacgtaagacgaagatgtgccctcgtaaaagcgaggtaaacgcccctttaattaaacttccggcaacttcccgaaacccgaaaatccgtgttgctataatataaagacgagcgagac

SEQ ID NO: 660111 - DNA, 516 bp, Homo sapiens
tgcatttggttattgaagcaggtaggggcagatttcacgaagtgactgcagatctggaatagggggtatgttgtagatctgcccatagagctcactttagaccggcctatactcctacaaggaattggggtaggatcttctactcagccttgccacaatagaatgtccaatgcccttctagtatgtttggtgaaggtcttgaaggcaccatttcccccatccaccctggggagaaattgagtccctaaagtcaacgacatggcttattgaggctgagtttgcaacagatccgatctgggaggtagaaacaaaaatgactgaacatctttttatcccccaatcgttacaaagcctaaataactctaaacgggatgggagggcaaattttaggtcagttgacatcctggagaagatatcctaggtcctgtctcattccctagaccgcataacactccaaccgtgtaaatctcaggaccctgaagaagacagttgtaggggagaggaggggagctagct

SEQ ID NO: 660112 - DNA, 185 bp, Homo sapiens
tgcagtgcattgccatataaatatggtgagggaaaggcagatatccccacgaggcctgccaggtaaagccattgtaattgcctatggtcaggcctgaaaattcacacatggattttaaccaggggctgtactcttcaggcacttcttcagcaggacttgagattgtagtttaatttcattcccgc

SEQ ID NO: 660113 - DNA, 367 bp, Homo sapiens
ggttactggacttcttctacacacgttaaacaataatttctcaagacctgatttaagagcaaactttttaaactgagtacttatggccgggtgtggaggctcatgcctgtaatcccagcacttcgggaggccgaggtgggcggatcgtgagatcaagagattgagactatcctgggcaaccaacatggtgaagccccatctctactgaaaatacaaaaattagctgggcatggtggcgcatgcctgtcatcccaactacttgggtggctgaggcatgagaatcgcttgaacccgggaggcagaggttgcagggaggcaaaatcgcgccccttcactccagcctggtgaaagagtgagactccatctc

SEQ ID NO: 660114 - DNA, 908 bp, Homo sapiens
tactaaatatttcttgtgcttgtcttaaatgactatgcttggttgtacaaaaatctctgtggtatctctcatgcatgtggaaaaatggactttttaggtcactagcatgtcagttgttaactgacccctatccagtttccaaatagaatgtaacaatctccctatgttcttcgatgtgcatgactggccttgatgttttaataagtcgctgagatgtatctgtaaaaggagacgggaaatatgcctgggaatagatgcgtgcttctgaaattgtgcgtaaaatagctatgtaagaaatataagcatcgaaagagtgaaacattacttatatctcctctaatcattaattgcaaggtgaataagcattcattggttatttcctctagggcttgtattaaaccactgactcaattgtcttaatagtatactcctcacagaactaaaaggagtaccactagacagatgtcgagaatagtacaaaatatttacaaagatagccttagaacggtactctgtaccataaaagctacgaggttaccaattacctattcacttaaagtgcaaggcgcattactgaacaaatacttctgattttgacactgttgacgccagatatgtgattgcatcttcatgcctgcattttcggtccactagaaatttattcacctgtgccctcagaaggtaccgttgtcagccatgtatttcttcatcagttgggatatggccagtttaaggctggccatttaaacggaggagggattagacttaattacttaaatgaccaatcatgcatgaacggcaatgagaccgcgaagaaaaatgacgaaacggccctaaaatgaaaaaaaaaaggccgaaaaagacgaaagaacgaaatgaaagggatatttcatccttttcttttctag

SEQ ID NO: 660115 - DNA, 163 bp, Homo sapiens
  misc_feature (144)..(144): n is a, c, g, or t
gatcaaacccaaagggaaaagtgttgctagagaaaattggggaaaggtgaaaaaggaaaaatggtagtaattgagcagaaaaaaattaatttatataatgtaattgattggcaaccagatttatctaaggtggcctgaattggntagggaaaaggaaaacctg

SEQ ID NO: 660116 - DNA, 1171 bp, Homo sapiens
ggcccaccccgtatctgtctccagacacccctgactagaagtgagtccctttcccccacccgatctgccgggcactggaccagcgggccggtgccctctgcggtgtaggggaggccgaaaggctgtgagccacagtgtgctgtggactcacactagtgactgcgggggcacatgggtggcaactctgatctgcggctgtccttgtccaacaggctcgtcgtcacgtctacggaccgatatcgtacgttaataccagctggctgtggacgcaacagcttgccagacaccctgcgtactccgaaagcctcagggacacaaggattccccccaaggggctggtgcctgccgccgcgacccttgtgcgcaagagacactcgttgatgacccatctatggaaggaagctgcactatacagagagtggaacaaacccataacctatggtcccgggttacgagccctcacaaggttcttggacttggaaccatggagcgtagcaatgatcagccaacgtccacttgactagtagttgcccgtttatccggcagcaccagttgcctaagaacccccagtccttgcactcgcaccagtgtattccttgagataactaaagtggctacaagcctccacatagggctataacgcagacaacactcaattgcgtgttccacggagcaacacaccacgaaaaactatcacgggaaagaccacgattgacataagccaacgacaccggtggcgcatccctaattaagcatacaggcaggacgcccctaagggccccagtcattcttccttccattccatgactctaattggacccccctgtcagtggtcatccctgtgccacctttcatcgaaagtttgatgcaagggagtagtgcatttaagtgtcattatagtggacacaaggtatagggccagatacagtagatatctgtttcagctaactcgcgtaagcacgaataagttttccagagaccagggataattggtagcagcgtaactcaccaaagggatggtcatggagaggtcaaagaagataccaaagaagtatgatagcgaacaggaatagaaatcaaggtagagatcacaaggatagaacagtagggtggttaacgaacacaagcgaggtagattcctgtggcgtactacatttagtacgattattag

SEQ ID NO: 660117 - DNA, 670 bp, Homo sapiens
atcccagcactttgggaggccgaggcgggtggattactcaaggtcaggagttcgagaccagcctggccaacatggcaaagccccgtctctactaaaaatacaaaaaattagccaggcatggtggtgcatgcctgtaatcccagttacttggggggctgaggcaggagaatcacttgaacctgggaagtggaggctggagtgagctgagatcacgccaccgcactccagcctggacgacagaacgagactccatctaaaaaaaaaaaaaaagcaacagggctctgagattcccaaaatgaaaggggccaacagattagggacagagaagtgatccagacaggcctgtaccacctatacagagagggaggggtccaggtatacatgaaagataggtaaatgacgacaaacagaaacacaagaagaaaagttggtcataaaggggcacaggaaacagttcggtgcgaccaggcaaccagataagtgtacacaggaagccaaggaaaaagcacgggatgaaacaacggaataacacaaagttagaaatccatggacatagacagtgagcaaaatcattgttgaactccacggaccagaagattccacatatacaccgaggcccagaattgggccacggtaaaatcggggtcaaagaagcaccccaaggacaagg

SEQ ID NO: 660118 - DNA, 1486 bp, Homo sapiens
ttggcaagttgcacatttcacaggtgcattcattttggtgtgcacaattcaaacagcctaagtgacaacaccagcaaatcttgtgtcagtggcaatgcacacattgtgtaatgtgtcacccccaatctggtcagcattttcaattgcaacagtttagtgggcacatgttttggtgcacagcagtgtgtgcattgtctcacagtttgcacatcgccagcacatttccaactcaagatacttcagatgtcaagttttcaagtgatcgtagctctcttatttatctcaagcacattccaattgtacatgtgcacaacaagtgccagcattttacctgtcttcacaacacattttgcacaatccacattttcaccattgcacgatatcgtttgcacacattcgtcacagccacaggttattcattggtagtccagcacaccatcttacaacacaacttccatcccagaattatctccaccagggcgccaacccattacaattgcatttcaccttgcatccacatttctcggcacaagggctttcaattgtcacagcctcaagcactttcaaagctgcacacctcttgggattcccatctggttgttaccattggcaatggttaactggcggcaacattgccacaccaacacatgttcccactgggcccttactcacctcccaagctaccggacgatggtttaccacaccgttggcacacacgactgacggcctccttacgttaacagaggtcccactaagctcccttctcctcaaccctccaaccatttgacccattgtagacccacagacttatccctttggttacataccaagccgcctgccacttctgggccacggaatcacgcgacgccactgcattctacacgttggtagctgccattcacagggcaccaaaggtggtgcgctacgggctacagggacaccgaacgaagcacatggacccacaaacacgtgaaaacaagaccatgtgagaatggggaacagctcggccactgaccccgaccaaacaagcgcacgaacacaaccaaggcccccacaacagcacacaacacacacgaacgtgggcacccgaaaagtggacacacagccaggctcacaccacagtgtggaacagcaccacaaagcacagcgatgtgcaaacatagcccacagagcgcgcgcagagagaagagtacggcgaagaagaacacagaaggaggagcgagacacgaattagacccgcggaagaaacaaccagcaactgcagagaaagcaaacaacagaagacagagggtaaacgagcagggaacagagcaacatcgcaacaacggagcgacaaatgcgcgatgaacggagagaccaagatagaacgtaccaacgaccacacaaagagagagaaaacaaggaaggatgacaggacagaaggccacacgacgagactgacacggtagtcgactattcacgatggtcgagtcatgaagcaaggaat

SEQ ID NO: 660119 - DNA, 405 bp, Homo sapiens
catggcgcatcattaccattaatccagagacctgcagacaggtgatacgagaccatgaacagcagagaaggagcatcttagtagcagagaaggtatcttataaaacatcctcatgttagcaaacccacgacttactaaattggcctctaacagaggagataggtgcaacaagtataggaaccccctttattgatgaaatgtttgcagcttcatttaaggtgcacttatgcagtggggaatatgacttcatagaggcatacaatgtgccagaaccgtgatagtccaatattcttgcgagattcaggccaaagagaaatgggttctgtatgtatgagtaggttgaattgagtgtttcgaatatgagtaaagttgaagaaggaaagaagtgggaatgtggaaagagag

SEQ ID NO: 660120 - DNA, 353 bp, Homo sapiens
ctgttcggattgggtgtctgcatacgttaggtgcggattgagaagtcacagctggcatgggtacccggatgatgttatatcgagtccttcttcagagaagtacgatttacgtagcaaatttttgggccgcgggtgacagggcaaggatgttgcgagcagcagcatctgtcatggaccctccaaatcccttcactttctggaacttctgttctggctgcagggtcagtagcaggggctgtgcccgtgtgaataggctggattgggcccatactcagctccatccgttgcccacctgcgtgtactctcatagcggctgaaagtgtaccaagggcaggaacagcgtcggggggtca

SEQ ID NO: 660121 - DNA, 167 bp, Homo sapiens
acaagtggcagggggtattcagacgcagtatcatgagaaaatagcgtagtgtacatgacacttccataggatggtacgtgcgtctggatccgaacaggaaccactgttcctgggagggactgcaaagacccagcatttgccgaggcaaaatcttcttgaagaacctg

SEQ ID NO: 660122 - DNA, 99 bp, Homo sapiens
tactctgctgtactgtgctctgtcactagtaactgcgcagttgctggaatactgctttgcccccctattgaatttgtgaataaaaccttctctttacat

SEQ ID NO: 660123 - DNA, 316 bp, Homo sapiens
  misc_feature (44)..(44): n is a, c, g, or t
  misc_feature (53)..(53): n is a, c, g, or t
  misc_feature (81)..(81): n is a, c, g, or t
  misc_feature (179)..(179): n is a, c, g, or t
taggaaggaacctgagaggcagagtgagcaggtctaggattgcntagcttgantaatttcaatgggtttggggtaggatgnccctagttgtccagtctctgggggatagtggtgcagcgtgtaagagcccagtaaaggaggtggttggaaggtatgggctctggattggttagtatgantatgaaaggcacggcacgcttgcaggtgagtgagtgagttactatctctagggaattggatgagaggatggagtatgatgaacctttgattcctggagggccatgagttcactgtgggatggaaatgcaactgtgct

SEQ ID NO: 660124 - DNA, 227 bp, Homo sapiens
gctaagaccccacttgcggacactcaagcagtgctcgactataagtaatgtacattctgcgatatggtgacttgctagactggtcgataaaggatgtcaggttaaaataaaggatgtgggacagtttttgtgcgagaagtgctcgatagccaacttcagagacagcaggttgtaaattgtttcttttgggcgggaaaaaaccccccctgttttttttttttttaaaa

SEQ ID NO: 660125 - DNA, 564 bp, Homo sapiens
  misc_feature (370)..(370): n is a, c, g, or t
  misc_feature (523)..(523): n is a, c, g, or t
taagactagtatgaagttaattatttaatggatagctaacaaagttgtattctggggaataaagtgctgaatcagtgatatgggagtaaacatcttttttggatgaaatactaatatatataaaaatgatagtagctagctagtagctaacatttactccaggtagtatcacatttacttcacacagtaatcctatgaaggaagttctatttgtattattttaagatgaggaaactgagtcagagaagttctcacttgaccataccatactactagtgggcaatgcagccagtatttgaacctaggtattttgtccgactccatgatctcctcagccactgtggtgtgctactgctattgtggacatgtncctggtgtctgctcagagctgtagagattggttttaggtctcagcaagaggaaccttgtcccccttggtaactttctgtgttggtattctgaatgggaactatatccttccattcttctggttggctattgtttctcagtattctcttcctgncaaaactagctcttagtttttctctactgctgtgtctttgt

SEQ ID NO: 660126 - DNA, 333 bp, Homo sapiens
acatcccccgttacgtgagtctctactcacatttttgggagaagagaacaattttgttattgtagactacaacccagtaactagtgcagtatctatagagctgctgtgtttttccatagtttatcttatctacatctaggagctctagtaagagaagtaatacaagaaaattaaattaataactctttgtcatttaggcttctggtgactgcaacatgtaagcagcgtctaccgattggtcttttgcaatttttatttttatttttattaggaaccgttctggactctgttcaccccacggaagtgtgatgttctcggcaagtgggtgttgca

SEQ ID NO: 660127 - DNA, 110 bp, Homo sapiens
  misc_feature (57)..(57): n is a, c, g, or t
gcagggtgtaaagcagtttaacagagggccctttttttttttgttcaaatgattttnattattgggaagccccatttttttaatatgcaaataaaaagtttaaaaagtta

SEQ ID NO: 660128 - DNA, 605 bp, Homo sapiens
  misc_feature (377)..(377): n is a, c, g, or t
ggaatcacttgaatgtgttcactgatttcaatttttaattttcaattatctactacaggtcatgaggggaaaataaaatcagtacactttaaagattagtgaccataatatctgcttgagatacatgatattgtttaattgcatgctttcatgcatgatacattgagttgtcttagttgtctgttccgttggcatgaggttgagaaatgttctgaactgtgtctgtgcaaaccgaaacatataaatccttgggcttttgaactgaaatggttgttttaacctgttgctttcagatttcaagtctttaatttttttcctaatttagttattactcattcataaagctactatcatagaaaaccaacatataaatgttntgcttagcatgtatggttgttctaaagtaggatttaacttgttagaatatgtgttagcgtatcaggcaagcattccttgttctagagaagaaaaatcacatagttaaaaaaacctacactttaaattgaagaattcaaatatattaccatatgttttggctttttatgaatagcggattcaaaaattacttaatgtctaaaactatgtgacgttgcaaatagcaaaaa

SEQ ID NO: 660129 - DNA, 338 bp, Homo sapiens
caatttttgtatttttagtagagacagggtttggccattttggcagggctggtcttgaactcctactcaggtgatcctcctgcctcggcctcccaaagtgctgggattacaggcatgagccaccaggcccatcctctgatatgaatttcttattggagaatccctttatgtgtccagccctgtggtaggctctgagaatatagtaatgaacaaggtaaacaaaacatacatagtctctcccatcatgaagcttacgttccagcaaggagctagaccttcaatagataattatcatttaaaattataccttgtaatcagtgctatcaagaaaaataagg

SEQ ID NO: 660130 - DNA, 137 bp, Homo sapiens
catgtgggcatcatggcttaaacacatttttctaatttccctgtctaggtttttttttttcattattattattcctgactgaggcagggggcagtgtgtcaggcctataattccagcacttggagatgccaaagtga

SEQ ID NO: 660131 - DNA, 175 bp, Homo sapiens
aacggccaaaaggggttgggttaggtcccagcttgggccgaccccccccccaggggtcagcaaagcccaggaggggacattgcccgcccgccgttcccagaccttgcccgagtgggttttgttgtttgaataaacgtgaacgtgaacccagggggaagggacccgggaattttga

SEQ ID NO: 660132 - DNA, 972 bp, Homo sapiens
ttgtggttgtgcggtagtcgggcgtacgtttttgtgctctgtctggtctctcattttcgtgtcttgctggttctgtctggtgctgtgctctccgagtgctgcgccttgtggtccgaccgtttgtggagaccttgcgggcctttgtccgaggcctgagccccctgggtccatgttgctcccgttttgtgaccgggcgtgtggtgtaacgcgccccacggctttgtgcacccgggccgagtacttgggctcccccctgtccttgtgcactgcccctggggcgccaaatttaaccggccgcctgctgcgttttgccaaccagccttttatgtcgctccgtacaactttttcatagcgccacatgcgctctgtggtacacgacttttgtcgccaaagcccccctcgtgttttcccgcgtgccccatcattttaatattcgccccccggagttatacatctccccactatagttttcggcccttgccaaattccaattgcggaaccactcttcacccggttgccttcacaaatcctcctcctctcaagagcgcttccaactctcatgtccccccgcaaaaaagctctttttgaaaataactctcttctaaccagagcgcttctcctaaacctctgccctttatcccctcccccgattcttacccccctgggaaaacacttttccttggcggtagataacaacgaggttctctctgtgaccaaatatccacctcgtcccctactttcacaggacctccacaaacttatgtcgaccagccccctattatctcgcccttttacaagaaatgtacccccacccacaattgggcggctaacctacccccccaacgtcaactaacccattctactcctctcttttccaccgatggaacaccccttctgtgtcaatacacccccccccctttccccctttccccccacccccaaccctccggggtttccccctaaaaaaaaaaa

SEQ ID NO: 660133 - DNA, 151 bp, Homo sapiens
atagtatggcttcgaactaatatgctataaagcatgctagtgcttcctggccagagacctgagcacactgcacacgcactgccatctagaagccaccctggcaactgtagaaggcacttatggaggcagccagctcatgtcatgcggagac

SEQ ID NO: 660134 - DNA, 146 bp, Homo sapiens
acctaatctgcccatgccttatctgcggcgcaaataaggccggcaagaagctcttggctgaccaggctgaggcccgcaggtctaagaccattgacgcacgcaagcgcggtgaagagcggcctccaggccaagaaggaggagatcat

SEQ ID NO: 660135 - DNA, 664 bp, Homo sapiens
tattgataaatgcaactacttattaataagagtctacaaggtaacaaaaagtgtaaagagacatctttttgttaccttgtagactcttattgataaatgcaactacttattaataagagtctacaaggtaaaaaaaaaaaaaaaaaaaaaaaaaaaagaaaaaaaaaaaaaaaaaaaaaaaaaaaaaaaaaaaaaaaaaaaaaaaagagggaggggcgcgcacccacacaaaatgatccaccacgaggggagcagacaaatatgaaggcgaccacaatctttattgtgaacaaagaaggggcccacacaagagaaggagcaattaaacaacaaaagaacgagagcgagcgaacccgctaaaaaacaacccgcgtgtaaactgggcgaaacaatgcatagcagcgcagaacttttgtgaagaagaagaccaactatatagtgggggaagagcgaaaaatatggggagaacaaactaatctactatgaagatatatattaaagccgttagcagaggaaatatataaaaaagtatagaggaggatataatgatggagtacaaacagagtactaaatagttgagggaaagaaaaaaaatttgtataaacatagagtgatattgtaaagagatatttatataaaggagatgagtagatataaataggta

SEQ ID NO: 660136 - DNA, 140 bp, Homo sapiens
gtttgtggggttgggccccccaaaaggggtttgggcccctttccaggggccgggggccagccccgggttgcttccgggcccttaggttaaaactgccccttccggggggtttttatggggggggggggcccccccaggat

SEQ ID NO: 660137 - DNA, 807 bp, Homo sapiens
atcgtgtggcgccggaggacgtccccgcggcggagccatggagatgccgctgccccccgatgaccaggagcttcgaaatgtcatcgacaagctcgcccagttcgtggctcgcaatgggcccgagtttgagaagatgactatggagaagcagaaggacaaccccaaattctcgtttcttttcggaggcgaattctacagttactacaagtgcaagctggcgctggatgcagcatgcagctcatctgcaagcagcagaccccggagctggagccagccgccaccatgccacccctgccagcagtcctccgctgtgtccccgccgtagccacagtccgcgccggcccagggtcgcgcgcatccatggacgagctcactctcagtcagtagccaggttgtgagagctccagacatgtcagggagcatcaacttgcctggcgcgtcagacaggagcgagtgacagcgtgccgtggcccacagcggttgtaggcatgtcagatgcacgaagctatctggaggagcatcccaggcgtagaccattgatcgaggtttgacaactctcctgcagccccatcatcagacgacgtgcactcaatggacgccaatctgggccgggaaagcaagtggatgttcagcacagtgcctggtgccctgtcgcgctgtgtgctgatggccgagcagctccggaacccgactcacggtgatggggcacacttcgagctgcgggctgcaccgtcatctacctgatcaagtgaccgttgctgcaccactggcagcgcatgcaggcccgggaagctgattggacggcct

SEQ ID NO: 660138 - DNA, 376 bp, Homo sapiens
ggtcgtcatcttctgaatccgagtgtggggggattctcgaccagctaacagaactggacctttacgtggtgagccatgaagaaaggtttgctcccggtgtggaacagtgtattatccaacctcctccccttaagagtcatgctcacgagagacactctggcaactttcctggcagagattcagttccctttgatttccagggagcattcggggcctccttttgcgaactgtagaggagcattctttcaactatggagctagagacggaccgcatggtgactatcgatgaggggagggacctggacatgatttcagggggggagattgatcgtcttctgatttccagagcatagattcatcacagccggacttcagg

SEQ ID NO: 660139 - DNA, 365 bp, Homo sapiens
cgctccgttatatgagaagcacactgacacttctcattaacatggatctaaagttaaatgagcctaataagacctggacaccagatctaaaaagactaatatagcttgtctacatagtggaccccgatgtctatgagtgcggcgtagttggagtttgctaggctcaatagtaatgaggatgtaagtccgtgtgcgatcatgataatgactgcgcctggtatgcttcagggggtttggatgagaatggctgtttctactacgcgtgctctctggcttgtcgaagagtatgcgatgtttcgaatttaggtctgtatgtcgtacgcggatggagcttgtcataagttgtgcctcataggccgcgtaga

SEQ ID NO: 660140 - DNA, 295 bp, Homo sapiens
agctgggattacaggtgcccgccaccacacccagctaatttttttggtatttttagtagagacggggtttcaccatgttagcccggatggtctcgatctcctgacctcgtgatccgcccaccttgtcctcccaaagtgctgggattacaggcgtgagccaccgcgcccggccgagaacacacatttctaccagttcccaggtgatgctgatgctgctggtctagggacctaacttccagaaccactattgtgagggatggaaaaataaaagaaagaacttgcgtaccgagctcga

SEQ ID NO: 660141 - DNA, 172 bp, Homo sapiens
ttctacatgaggcagtagcaatataggactgatcgtacactgacccagtgtcaatgagacagacacgtggtcatgtacaactgcagctgcatggctcgagacctgaccaaaatcttagaggactacaggttcctgggccaggaaggcagctccatcccatcaacttggcccc

SEQ ID NO: 660142 - DNA, 113 bp, Homo sapiens
aaggtgctgggattataggcatgagccactgcacccgccctcaaggtccattgtaaaagtttttatccttactatttcaaatgctaaaacttagtatgatccgagcggccgct

SEQ ID NO: 660143 - DNA, 457 bp, Homo sapiens
  misc_feature (94)..(94): n is a, c, g, or t
  misc_feature (350)..(350): n is a, c, g, or t
  misc_feature (373)..(373): n is a, c, g, or t
  misc_feature (394)..(394): n is a, c, g, or t
gaaaaggaagaggaagggagaaagagacagagaaggattaaactactagaaaataccttacaaatgaaaaaattggaatgagcatagagcaacntgggaaatctctattctagagaattattaccagttcagtcactcccttggatggattgaatgaagtctttctgggaattagatcaaagagaaagcactctcagggcttttcccaaaattcctgtggatcaggttgatgaaacttatggttgggggaaaataattttgtgtttagataatgagaatttcctccactcccacccattcctggcttttctccctgtggcttttttgcctacttggtttccttactctgnacctaggaactatcctttttttnaccatgcctttggagggggantggcctgcccctttgaaaggtggggggaagcaaggttgggcccaagaagaagggaaagaaggg

SEQ ID NO: 660144 - DNA, 101 bp, Homo sapiens
ggggtcccatgacatcgtggatggaaaccaccggctgacccttggcctcatctggaccatcatcctgcgcttccagatccaggatatcagtgtggaaactg

SEQ ID NO: 660145 - DNA, 1100 bp, Homo sapiens
taatagtcctttctgaattgtgaggtcacatgcaggtgcaagggacagaaatcccaccctgggccatgtggatgcttcagcccctgtgggctacagatctgggtgttggcaaaaaggcagcgggtgaggtcgtgctgcttaagtcttggatctggggatgggttgcatctcttcctaaagagatctctctaaggatggtgctgcacttttttttaagagataaggtcttgccatggtgcccaggctggcttcatactctgggctcaagtgatcctcctgcctcagcctccaaagtagctggacgagtagctagtgccgcaccttttagggttgttgaggcttctgtgcttacccactgtgatggtttcttattgtatggggtgcccttctacagaagttcacattgtcacattacactggggtctcagaggccaaggttttaaaaatgggagtcttttggttttggttctcccacatgtgagcctttttctggctcactgctactcagactgcacgtgttgtagtgaagatacagacctaatcccaaaataatgctcttcccatcactgcacacccggagatttttaaataatcttcactgggccgtcctgtaagagaatagttgatagtggctttgtgggtcatttcctctttgtaatggattattctctagacacaatgttggttattttcacttaagtacaacctgacagttgcttcagtgaggctggcctgctgtctttctgtttcttgcctgaactcgggttgtcctgcattttgtcccgtgagcttggcacttcactgtccggaggagcgtagggccgctgcacacctggagattttggtggggcactgcttaaatcatgcagatgagaaccagtttctggagaccttggcactagacgcccagcagagaagtgccttttttgagacttggaagacacaataattttaaattgcctacagcaggggttggcaaatagtggtgcaagggccacatctggctagcagcctatttttgagaatgaagttttatgagaacccacacatctgtttgtagattgctatggctgcctttgagttacagcagtggagctgag

SEQ ID NO: 660146 - DNA, 798 bp, Homo sapiens
tggtacttttaacggtggataatggtactcctggcttatagacttcgatctacttggatggctgccggggctaattatagtatctagctgacctgtctgctggaggtatggccttgcatggctccgctagcttctcgctcagcaaggagaatcctccctgtgtcctccttggctcttaaggttgtcggttctggtcggggctgttcgtgatggtcttgtatcctcttcctgggagtcctccatggtctacctgagcacgggtggctacggaggtaaccaggtgctgtgtccctgcgctatcctgtctggagcctctcggatgattgatcaatggagacacgctgagtgaatgaatcaacattaatgtctctggtgatcctgccctgtctgtcctatatgtatggatctgtgggtaagagtgagggagagatctaatgtgtgacgctttttttataatatgagggacttgatctcggatttgagtgatcattacgggctgacggtctgttgtctctcgggatggtagcgacggctgcttcctgcgtctggcaggcgatgggctttagccgtttggaaatccttctaggaggctcctcgctcgcatggcctgcagtctggcagcagccccgagttgtttcctcgctgatcgatttcgggtcctgcaggtagagttttctttgcttatgttgaattccacttgcactcttttcgcatcacacgaagtgatgttggatcgttcttttgtttgtctgattatggttttttaagtatatcaaagtttacacagggtctgaaaga

SEQ ID NO: 660147 - DNA, 873 bp, Homo sapiens
tacacggtgtggggcccccacagggggcaaaccacaccgcggtcaacgttgtgtgccacaggacacctcaccccgtgccgtacacaggaggcgcggaagaaaaaatgtgtgtgggcctgcccccaccgacacctggggatgtgcccccgcaacatccacacccgccaccacacggcggtggaaacaccgcaccaccacgtaaccgcgtgtgcccgcgggaagggcctcgccacccgctaactcgttgtcatgaatgtgtgtgggcgcccacacgtggagagaaaggccccacaggccacacacgtgtgtgtgtgtgagaagaccccacacgtgtgtgtgagagggacgcccaccgcgaggggggagatataccccccgccgtgtgctcccctcgccaacgtcgtggggtcacacacccccacacaacaccgcgggagaaaacatggtgccgcggcgtgtgtgtgtgtgaacaaagagagcgggccgcccccccccagtctcggtgacccgtgcgccgcgtgtgagagaaaacacatgtctcacccgtgtggatgcgggccaccaaaggggacccacccacacgtggggaccaccaacacacccgggcccaccaaggggcgtgggctccccgagtggccccccacgggtctccggcgtgtccgagtgagcacaaaacccccggtgggcgtgcggtgcgggagaaccccaccccccccgcccccaccccctaccccgggccccaaaacaccccgcgcggggcgtctgggacagaccccgagatggtaaaagggccggttcggggaaaaaaaaaaagaaggaataagtacgtgagcagtacggctggcgagagagagtgctctcggtgggcgggtt

SEQ ID NO: 660148 - DNA, 1144 bp, Homo sapiens
gtcctggttgtgagttccgttctgcgcggattgttctctgtgaacacagcgttctgttgtatgctccgttcacgtcttcttcttccgtagcccttaacggtgctgtgccgtgcgagccacgaatgggaatgaattccgtagttgtgcagcattggtagcactgacggtctcctccctggaagtggccctccacgaaaacatattactgtatatgcatggtatgctgtacatcgttgagacagggtcgcgcacagaagcattgatcatcctttttaaggttggtagtacttgattgagaagaatgatgacaactgatgggtgtactacctttatatacggacatgcggggtcatgatgtaaatgggagcggtctgaggtagacagaaagagaaatgaaggtttgcatcacatgtgctgtagaatgcagagaggggcaaattgaatttgagcagagatgggcacagtatatatttaaaggtaagctccatgggcatagctttgaattaatgtcgtgaaagcaaagcactaatctgggttaccgcttttgtggttggttttgtgatacactagatctatactaactctatgttgtggtcttgtaatgggttggaaaggttggttggtctctagggaccctaagatggtactatatttagttgagtagagaaatattagtatgcattgtgcggtaggacacgaattgccataagattagaaaagaatgaaggaaggaaggaaaggaattgttgagaagcatcttttatagataatcattctagtgaaaagaggttggggtacctgggaccggttgtggcaggggttgagttagacaataaggttttccgactacggaagagttacttcgttactacatctttcggcatggcttaggaattgtaggggaacttgtagtgtgtaacctggatttgaattggagtctcgtaacagagggggatgaactgggattggaacgaattggattgactcgaatttgtaggtgaatttttgtgactgaatgaattgcataagctggaagaatgcagaggcgaccaaggtgtaaaataattcctaatgcgtatgcatactctaatgtcaaaggaaatggcacacaatcagtttcacttaaaatgctggtacttacatg

SEQ ID NO: 660149 - DNA, 779 bp, Homo sapiens
  misc_feature (23)..(24): n is a, c, g, or t
  misc_feature (33)..(33): n is a, c, g, or t
  misc_feature (40)..(40): n is a, c, g, or t
  misc_feature (44)..(44): n is a, c, g, or t
  misc_feature (55)..(55): n is a, c, g, or t
  misc_feature (65)..(65): n is a, c, g, or t
  misc_feature (68)..(68): n is a, c, g, or t
  misc_feature (74)..(74): n is a, c, g, or t
  misc_feature (77)..(77): n is a, c, g, or t
  misc_feature (103)..(103): n is a, c, g, or t
  misc_feature (567)..(567): n is a, c, g, or t
taagggccctgttctctttcccnncccccagtnccaaggnaaanatttgatgacntctgtaggancgncagcgngtngttgagatagaacgggcggaggaggncattatgggtggggggagatagaaaggagtttttaggaaggagtaggtggtgggatcatagggagggtatgattagatttttgtctgaattgataggttgagttttattggaatttgaaatggttggcggtaaggttggaaaggattttggaaagggaaagaaaaaggcggttttccgctcgaagagagcaggtttgaagttataagtggggcgtattgatggatacgtaaaatttaggaggataaggtatggacgtgtgggtgggagtgcagttgtgtacagtggaggaatcgtggagtacgtcactggagaggtacttgaactgggaggaaatgcatgaaaagaattaaaggtaaagggtattagcccttgttaattgaaatttggtattgggggagatgaagaaattggattatttaattaagggtaaaattggtggtggggggtgttattttaaaaattncaaaaatttttggatgggaagaaagggaaacaggagaatgtctaagggaggcggggatgttttggtatttaagggctataaataagttaaaagtgtgtaaagggggggtgaatgaaggggaatgggttatttggggaaaaaaaaaatatttgggtttttgggaattttaattggggaaaggggggagggtaaatgagggtttgaagaaaatg

SEQ ID NO: 660150 - DNA, 406 bp, Homo sapiens
  misc_feature (19)..(19): n is a, c, g, or t
  misc_feature (25)..(25): n is a, c, g, or t
  misc_feature (74)..(74): n is a, c, g, or t
agagcaaaaggggcccctngaaggnaacattgcattggacctgtagattcaaaataacaataattaaagccctnccttatcccatgaaacatgatgctattatttaatgatgcccatttttttaaagtttcctacacacaggccagtcgtggtggctcacacctgtaatccctagcactttgcgaggctgaggtgggaagatcacttgagccccaggagtttgagaccagcctgggcaacataatgagaccctatctctacaaattttttttaaaaaaattagctgggcgtggtgatgtgtatctgtagtcccagctacttggaagggctgtggtgggaggatcacttgagctcaggagatcaagagcgcagtgagctgtgatcttccccatgccttccagcttag

SEQ ID NO: 660151 - DNA, 726 bp, Homo sapiens
ttacacatgggtcgatcggtcctgagagcatggtgatggaaatcccatcaccatcttccagagagcgagatacccatccaatagatcacatgtagtgggtcgatgctgagcgctagagtagcgtcagtgagagtccactggccgtcgttcaccaccatggagaaggcaggggctcatttgcatgcgggggagccaaaaggcgtcatcatctcatgcgcccctctgctgatgcccccaatgtgcgtctatgggtgtgaaccatgagaagtattgacaacagcctcaagatcatctagcaatgccttcctgtgccaccaactgcttagcaccccgtggcctaaggtcatccatgacaacatattgcgtatcagtggaaggactcatgagcacagaccatgccatcactggcagccagaagacgtgtggatggtcccttccgggaaactgtggcgtgatggccgcggtggctctacgcaggaacgatctatccctgtcgctcatactggcggctgccaaaggcatgtgggcaaaggtcatcccgtgagctgaacgggaagctcacttgtgcatggccttccgtgtcccctattgtcaaccgtgttcagtggtgggaccttgaactgccgtctagaacacaacctgccaacatatgcatgacatcaagaaggtggatgaaggcagaggtggagggccccgtcaagggcattcctgggactaaactgagca

SEQ ID NO: 660152 - DNA, 878 bp, Homo sapiens
  misc_feature (142)..(142): n is a, c, g, or t
  misc_feature (165)..(165): n is a, c, g, or t
  misc_feature (195)..(195): n is a, c, g, or t
  misc_feature (197)..(197): n is a, c, g, or t
  misc_feature (204)..(204): n is a, c, g, or t
  misc_feature (206)..(206): n is a, c, g, or t
  misc_feature (210)..(210): n is a, c, g, or t
  misc_feature (213)..(214): n is a, c, g, or t
  misc_feature (223)..(223): n is a, c, g, or t
  misc_feature (225)..(227): n is a, c, g, or t
  misc_feature (237)..(237): n is a, c, g, or t
  misc_feature (250)..(250): n is a, c, g, or t
  misc_feature (253)..(253): n is a, c, g, or t
  misc_feature (256)..(256): n is a, c, g, or t
  misc_feature (259)..(260): n is a, c, g, or t
  misc_feature (262)..(262): n is a, c, g, or t
  misc_feature (264)..(264): n is a, c, g, or t
  misc_feature (268)..(268): n is a, c, g, or t
  misc_feature (272)..(272): n is a, c, g, or t
  misc_feature (275)..(275): n is a, c, g, or t
  misc_feature (281)..(282): n is a, c, g, or t
  misc_feature (286)..(286): n is a, c, g, or t
  misc_feature (289)..(289): n is a, c, g, or t
  misc_feature (294)..(294): n is a, c, g, or t
  misc_feature (297)..(297): n is a, c, g, or t
  misc_feature (300)..(301): n is a, c, g, or t
  misc_feature (306)..(306): n is a, c, g, or t
aatgcccgtgcccgcattgtggctgaagagttccttaagaatttttaaaccatctggctggatctcgtggccttccccctcagactacccatgtctccacgaaggcgtcctggagtcactccccgagcagcgcggggcggcngggagtgggtggggtgggcattngatgcgggaggtgggtggtgtgcttgctancngggcaananagcngcnntggacctgncnnnaggccacacntgcctggtcaggntgnctnctnntntncagncccntgngccggnncagnttnttttnaangtnngaaanttaaactctgtgctgggtaggatactgtaaccttttgtcttttttttttttttttttttaaacctcaacctccaggggctgggacgggtcccggggatatataacgtgatgggtggcggggggctcggggcgggcgcctgggagccagaggggacgttattttttctcgtcctatgccaccccagggtggggagggagggaggttccagactccagtttctcccttgcctttttatgcccaagcctctttggccccggtatagggtgtttgcgacctctttgccagctcctggagtctgggctaaggagtggccccccagcacttggtgtggggcacacggcgcccaatgttgggtggaccaccccattcatttgcctaggaacgtgggggccaagatggcggggaacctctggctcggggcgcatgggtgccctccccaattgaggggggccgtgtttccgcttgtcggtagtggccattgcctgtcaaaggtggcggggggtctcaaggttctgggggccctcttggcgtggggcttttggccagcaaagggccttcggttggggccccc

SEQ ID NO: 660153 - DNA, 126 bp, Homo sapiens
ctcgataagccggatctccagcctagttgtgatgctatagcacccatcatcctgcgctaaacacccctttcaggctgtaggtaactagagttgttcctgttctttgacggtaacaccatatgtacg

SEQ ID NO: 660154 - DNA, 309 bp, Homo sapiens
  misc_feature (9)..(9): n is a, c, g, or t
  misc_feature (31)..(31): n is a, c, g, or t
  misc_feature (196)..(196): n is a, c, g, or t
  misc_feature (208)..(208): n is a, c, g, or t
  misc_feature (246)..(246): n is a, c, g, or t
  misc_feature (259)..(259): n is a, c, g, or t
tgtattttnagtaaagacggggtttcaccgngttagccaggatggtctcgatctcttgaccacgtgatccacccgcctcggtctcccaaagtgttgggattacaggcatgagccaccatgcccagcctgtttatctttgttaagccgtaatatgtgtgcgattattaattttttattaacaaataatacacatggnataatatttagncaatagagaaaagtaattttgaaaaattactcataggnttatcacacacanaaagatcacttttaacatttggtcgggctcttttatttgtcaacttaggg

SEQ ID NO: 660155 - DNA, 733 bp, Homo sapiens
  misc_feature (512)..(512): n is a, c, g, or t
  misc_feature (515)..(515): n is a, c, g, or t
  misc_feature (521)..(521): n is a, c, g, or t
  misc_feature (524)..(524): n is a, c, g, or t
  misc_feature (531)..(531): n is a, c, g, or t
  misc_feature (533)..(533): n is a, c, g, or t
  misc_feature (541)..(541): n is a, c, g, or t
  misc_feature (566)..(566): n is a, c, g, or t
  misc_feature (568)..(569): n is a, c, g, or t
  misc_feature (571)..(571): n is a, c, g, or t
  misc_feature (573)..(573): n is a, c, g, or t
  misc_feature (575)..(575): n is a, c, g, or t
  misc_feature (577)..(577): n is a, c, g, or t
  misc_feature (579)..(580): n is a, c, g, or t
tcattggccgtcctctcaaggctgtcttgggcaaggagggcccctggggaatcgtggtctatatccccgataaatattctgcctcacgggtctaccttgttctcctgcacccgggttgtcagcaccctccatcatttctccctgcacaggagggttggaatactggggtgtcgacgcccatagggtctccgcatgtagtagggtggggaaccttcgcctgcggtagggccggcgttgttgggcctggccttcgggagcactctccgatccctacgttcttttccccatcttctcactaatatcctgggtaaatttggctgggtcaattggctggggaggacccctacgacgtggatagcgtctaataatgggtaacggtctggctgcatattaactggccttgaactgggaacaccaccaggacctgtaacattggctgcctccgcacccttttctccttcaacaacatcaaactccacagtctctccatctcctacactgcgaaggtactnccnggggtnatncttcttnanggcagtcnggtgtacaaatacatcttcctgggngnnancncngntnngaaaccatatccgttccttacattggacccattttactggttcccaaaaccttcgttgcaatagaccttcttgtcccccgccggatggcgccgccaatgtaaggccgcccgggccaccgctccctgggccgttgcccgtagtgccgggattgg

SEQ ID NO: 660156 - DNA, 277 bp, Homo sapiens
gggggggggggaaaattttgaaaggcccctttccgggcccctttttttgaaccctcccattttttggcatttttcctttgggattttgcccggaatttttgccccccccccttgggggaaatttttgccgttgcccagccttttcaaggtttttttttttcccccaacccccttttaaaatttccctacccctttggcccgcccacccccttcgatttttccaatttttttggaagggtttagaatttttaaaaaatttaaaaaagtttggggttta

SEQ ID NO: 660157 - DNA, 479 bp, Homo sapiens
ttatgacaaagcagggcttgagtatcaccatcttgacccgctcctgctaacatttgctggaatctaccaaaatggtaccctaaccacttaacgagttggtgcgaagacccagaggatcacattcccgccggggaccaattggatctctatcagggggctgccaataaccgtaaaggggatgctgaaatgccacttacggcggcttgaatacattgtatacttactgcccaatctgcggaataatttgtaagacccgctggccgaaaccttttaatgatacccgacccaaaaaaaacatggcctgaagttatggtgagtaggaacgtgggaaggacttgtcacccttgaactgtcctgtggctataacgcaatttccctgtggcctaccgagcttgagggaacacacagacacattggttctaaaattgatgatggtcttggagattggagtcgcctttccagcttcaacaaagagcact

SEQ ID NO: 660158 - DNA, 162 bp, Homo sapiens
gaagtcagactctagagcatccctctcagtaggtacagggagagcactgggcactatttgacaggatgtactccagaatatatcaaagaattattctgatacaatttcactaaagacaagtttttgggctggatgtggtagcttacacctataatcccagca

SEQ ID NO: 660159 - DNA, 387 bp, Homo sapiens
  misc_feature (334)..(334): n is a, c, g, or t
actatgtcgagctcatgagtgatgaatcctgatgcgagtatacggatgtgttaggaggggactctaggggattagcggggtgatgccggtggggggccagtgccctcctagtgggggggtaggggctaggcgggaggggtaaagggctcagaaaaatccggcgaagaaaaaaacttctgaggtaataaataggattatcccgtatcgaaggccttttgggacaggtggtgtgtggtggcctgggtatgtgctttctcgtgttacatcgcgccatcatgggtatatggttagtgtgtgggtaagtaggcctagtatgaggagcgtaatggagggnaagtgaaatcacatgccaatcaacatagtcactatgtggatgggttagtagaa

SEQ ID NO: 660160 - DNA, 188 bp, Homo sapiens
atggtccaatcagtcggggctagacttgaactggaagaccgagcatcactttgggattttgttgatcatctctccatttcttcctagtgacaacgccaacagcaagagtcttggaatggggacagtcgtatccgcttcatttcctcgctattcttgacccaatactcgattccgacacttctctcgaa

SEQ ID NO: 660161 - DNA, 122 bp, Homo sapiens
ttgtctgaccagtaaacggctctccgcgctcagatggagcaagcgcaccggcctacggatgtgtgactctcctcacagaccgagcggcgggcttcacggtatgcacagaagtgcgcctggtg

SEQ ID NO: 660162 - DNA, 242 bp, Homo sapiens
ggtggacttgtcattggtattctagggatgtctgctattaagtttcatcaattgtgggcaaaacatgtaaaaactgtctctttgaactattgaaaatttaaggttcagaaaaaaaccaattttgaatttttaagggggtttatgaaattttaaaaaccagcgagtccttcgtttgatcaataaacagtgttccaaataacttcaagtttataaaaaaccagtgaaatttctccaaagctcta

SEQ ID NO: 660163 - DNA, 324 bp, Homo sapiens
agctgagaaggcaagcaggacatggcccggactgcatgcgatgaataccaggagctcatgaagaccaaagctgagccctggaacgtggagatcgccacttaccgcaagctgctggagggactgatgcaatgcacgactcagtggagacggagttggaccagtcaacatctctgttgtcactagcagtgtatcctctggatatggcacctggccgtggctatggcggtggcctcgtgtggaggtcttggcggcggcctcggtggcggtctagccgtaggtagcagtggaagctattactccagtagcggtgacgccgtgaggatc

SEQ ID NO: 660164 - DNA, 268 bp, Homo sapiens
  misc_feature (166)..(166): n is a, c, g, or t
agatcacttgaggtcaggagtttgagaccagcctggccaacatggtgaaaccctgtctctactaaaaatacaagtagccagtcgtgatgacaggcacctgtaatcccagctactcgggaggctgaggcatgagaattgcttgaacccgggaggcggaggttgcagngagcctggatcatgccactgcactccaacctgggcagcagagcaagactctgtctcggggaagccacacattggtacctttagttctctgggccccgttttt

SEQ ID NO: 660165 - DNA, 721 bp, Homo sapiens
  misc_feature (24)..(24): n is a, c, g, or t
  misc_feature (57)..(57): n is a, c, g, or t
taatatacttttatcacgtgttcnagatcagtagattaatgggagaaaacatttaanaattgttttaaatttaaatacattgaactctaacatagatgaaaaatgtgtttactgctttcagtcgacctgataaaaagcaacgtatggtaaatattgaaaactccaggcatcgaaaacaagagcagaagcaccttcagccacagccttataaaagggaaggtaaatggcataaatatggtcgcactaatggaagacaaatggcaaatcttgaaatagaattggggcaattaccttttgatccctaatactgattcacaattgagttaaattagacaactgttagagaaaaaataatgccttggattaaggtgggaattgaaactatgaaattccaagaggacaatggcctttcttttgttctaagattcaattgatactttatttttcctcagacctttgttaaaagctactacccggctttccgtagttaacttcgtgaatttttttgcaatggaaatgtcaatgtgtttatttaggaagccggcctgccccgtatttgggcctgaaagaaattctctcaggtaaaacttaagcagcccgtttccctgcaaagggattacacagggttgggtaaattcccaaactctgaaagacaaggtcggaatctccttcacttttaactcccccctttgtctttgggggaagaccctcctttgtaaat

SEQ ID NO: 660166 - DNA, 1157 bp, Homo sapiens
gtcacgtccgctgtactagccgaggacaaccttagcggagaccatttacccaaataaagtataggcgagtagaaattagaaaccctggcgcaactagatatagtaccgcaagggaaagagtgacaaattataaccatagcactaagtatagcaacggtactatacccctagtaccttctgcactaatgaagttaactagaacataactttgcaaggagagccaaagctaagacccccgaaaccagacgagtctacctaagaacagctaaaagagcacacccgtctatgtagcaaaatagtgggaagattcataggtagaggcgacaaacctaccgagcctggtgatagctggttgtccaagatagaatcttagtgcaactttagaagtttgcccacagaaccgctctaaatccccttgtaaatctaactgtgagtccaaagaggaacagctcttgggacactcaggaaaaagagcctggtagagagacgtaagagaatttaacacccatagtaggcctaaaagcagccaccaattaagacagcgtacaagctcaacaaccactacctaaaaaatcccaaacatgataactgaactcctgcacgacccagttgggaccagtctatgaccctatagaagaactaatgtaagtcataagtaacgtgaaaacattatcctccgcataagctgcgcatcagactgaaaacacttgagctgaacagtaaaagagtcactatctagcactaagccaacaagtcgttattaccctcactggaacccataaaggcatgccataagagaacggtcaaagaagtaaaaggactcggcaaatctaaccggccgggtaaccaagaacgtcacctcctagagtcaccggaataaaagcgccgctgccacggaccagtgtcaacggccgaggacccctaccaaaaacaacaccaacggggcaagcacaaaaaatcacccagggaacgacaacggacccagaactgactaaaaggacacaaacgactgcacgaaccaaccgaacgcatcaaccatgatgggcacagacagagacaataaaacgtcaggaataatcaacaacacatacacgaaaacaaaagacacgatcacacaaaagacaagaacgcggcagcacacaacagacaacaacaaa

SEQ ID NO: 660167 - DNA, 432 bp, Homo sapiens
ttgttgataggtcctggcaagcccatgtgtgttgagagcttctcagactatccaccttttggttcgcttctgctgtgcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgttggtttcaatgggccatttaagtttagtagtaaaagactggttaatgataacaatgcatcgtaaaaccttcagaaggaaaggagaatgtcctgtggaccacttgggtttcctttttggcgtgtggcagttttaagttattagtttttaaaatcagtactttttaatggaaacaacttgac

SEQ ID NO: 660168 - DNA, 621 bp, Homo sapiens
gtactttgggttgatctcactgtacaaaaaaagtgtaccccatattggaagaaataaggaatactgaaggttctccttctatctacacttgagtcatgtgcaaggttgaaccagtatgaaattgccagtgtgcaaccattgctgatctgctgaagcgacaatatcatatgcctcaacctaacatttactcttagatgctggttcgaatctctgtgaggcaaagggataatattctctaggaactcacttttgagagtagtttatctctaacccatgtggagtctaaatgttaagagaataggaatgaatctcttaatggcagcttgtggagagtataaaatattttgagcacaatatgcagcacataacttttcagattgtgtcttgcagtagaaaaggttaaaattcgaatgctttcagttactgtatggttcatgtcgtggtaaaggtcgttcctacattgtgagacgagaccctttaacataggctgccttagtaacaacaataaaacagatgtgtcaataatattaactggtcctaaagaacatggtggtcttgcaatatgccaatggaactggaatattctactttccttgtgagtatcatgaccgttaccaaagg

SEQ ID NO: 660169 - DNA, 891 bp, Homo sapiens
gctgagatggctggccgtccgggatcctggtgtgtgtgctgcagagggtgccgccgcctaggcgaagtagggccgtcactgagcgaaagaaccgtccccatgtcaggagcaccatcattggcttatcaaagaatcccagagcccgcccgggaaggtcagcgaaccatggagtcttccagttcatctacctcttagtttctccgtgtggaccaaaccagttcccagcgctgtcgtgctcctctactcgaagtggagctcaagacacgtgggatgcagttctgaagatactccttagaacgcagatggacggccagtgtcctgtgacttctgcgaggtcctgccttgagagatgctcaccaacgcgtctccgctcgtaatcaaggggcaaaattgacaatcacgaatgggtcatccgcccataatttggagtgatctacacaagtgcttacgatggttgcgttccacactttcattggaagggaagcaatgtgccactataatgctcgatgtgaatgaccacggggttttccccaaaaggggaaatgccccctttctaagtccgtggtcgacaataggtccccatccggatgaggcgcaaagagtgaagcctgtagggatccgtcataagaagtgatcaattgaacctcaccgaggcagacggtttgccagatcggtaaggggagagatcacaaatctatcggacgaaagatctagcacgcgcttgtaacagccccgttgaatggaaaaacacggtgtaggtttataatacacaagaatacattatagcgctcgggagaataagtaggcttagtttgcttcaaacctcggagaggcggatacacgtggtaaattacccagataaacgcctaccaacacagagaagcgccacat

SEQ ID NO: 660170 - DNA, 174 bp, Homo sapiens
accggacattagaatatgtgggaggggacaggtttgcatctctgttatgggtgcaggacttgggatgcaaagaatagagaaggatgcataaggatacttaaattagaagcttcagggaggtaaggagtgtgagtcagtgccatcagtaaagatagtagatagttgtaaatggcg

SEQ ID NO: 660171 - DNA, 815 bp, Homo sapiens
ctttgcaaggactaattttagtagcagggcgtcggcgtctgttgcccggtgtgtcccgaggttgatttttgtgttgcatcatgggccgccatctcgtggttctggtacgcgggaagttccagaagagttcgtgatggtgtcgtgcgatcaaactggccgaaccaaggggcttgtgggtaacagagcgtgacggtagtgtgtaattctaacgtagacttttttgtgccttagtctgattggattaggtgacaaagccactgtgaagtttcgtcccccggtgacgcgcagcagtctccacttggtcgttccagccccttgaaggtgtgttccaatgccctagagtgcttggaggacctaaatgccagagttcgacgatctagctgggctcttcttgtcagcccagggttaatactgtagggtctcggaccttatgtcctgaagtgacagcatgtaagtctgaagctatgttactagcaaagcttcttatgcccagcgaggtggctgatggcctaccgcgttctgcctggcatggatcgtccgccactctaggggtcaggctccattaggatttgcgcctttcccatctcttccgtacccaaccactcagattaatctttcgttacctgagaccagttgggagcatctcgtagtagcagggagagagaggggaagggccagtctgggctgccgggttctagtctcctctgctactgagggcctcactattaccatgtgaagagggcatgtgggagcctagcgaaactccctgctgcaagaagacatggagactcctgccataactcccaggtgcaatt

SEQ ID NO: 660172 - DNA, 132 bp, Homo sapiens
tctaaggatctcgggagccttaacctatcacttcaagaggacaacgtgggaaaagaattgcttgagtccaggagttcgagagcagcctgggcgatacagcaagagcccatctctacaaaaaaatagaaaaag

SEQ ID NO: 660173 - DNA, 89 bp, Homo sapiens
ctgtgcgtgtgcctttgccttcttccctttcttcctgttttctgttcttttaatttggggattgagaaagctgtacgattttgttaaag

SEQ ID NO: 660174 - DNA, 129 bp, Homo sapiens
cccgacttaaaaaatcactctgataagtctttgataagttctaataaataataactgagtaagtccattgaactttgctatcatgagttacttattcttctagtagctaaacatgatatgtactcctat

SEQ ID NO: 660175 - DNA, 315 bp, Homo sapiens
gccttaaatagagacgtgggtttcactgtgttggccagtgctggtcgtcgaacacctgacctcagtgtgatccattctgtcttggcctctcgaagtgcttgggattccagtgctgtgagccactgcgtgccatgcacatttccacgttttagatcctactccaataccacagtgtttcagtttaatgcaagaaatgagctacgataaagtgtgctacttctgtgttaccgccacccgtgcacagatgtgcatttcttacacgtgctaggcagggtgttgagacttgctgccttggccttgccagcccatatgggg

SEQ ID NO: 660176 - DNA, 214 bp, Homo sapiens
ccacccgtttgctggtgcaagtaagggtgatggcctgtttgctgtcagcattgagaattcgatctctacaagaattcaacagaaacctcaggaagcccctcagtctgttgtcctgggagctgctgctgatcaagatacgattgtgaaggcagcaagaagtttgcccacagcgataatgtcaaggctctggcaggtggagtcaacccgtcgacgc

SEQ ID NO: 660177 - DNA, 195 bp, Homo sapiens
aggtgagggaaattatagatgcttcgaacagcctggaaagagcaactcagtagtaactagtgggaagttaacgatccgcccgagtgcagagagaacaaccaggaaacgccttgaccttccagctgcaaccacgcgttagtcgcgacgctggatgtccttattcagtacgcacagaattttcctttatgaatttat

SEQ ID NO: 660178 - DNA, 221 bp, Homo sapiens
ccatcaatcgacgcctctcacacatatcagagagatacgacagggttctaaatggttacggttaggcattcggcaggcaggaatttcatggtgcacttcatggaagaagacagaagaagggataaagagcctggcgttaaagccctgacgactggaggcggagtaagcatgctggttcttgaggagagaaaggattttccccctggatcctttcgtctcga

SEQ ID NO: 660179 - DNA, 151 bp, Homo sapiens
actctccaggattttagcagtgggtggctgtggtacttacatgtagttgctggcagcagcagagcgcgcagcagaatacttggcggagtacggcttgtctgtgcggggtggacagttgcagcaaagcaagccccccgccaaaggagcagca

SEQ ID NO: 660180 - DNA, 1048 bp, Homo sapiens
  misc_feature (23)..(23): n is a, c, g, or t
  misc_feature (97)..(97): n is a, c, g, or t
  misc_feature (101)..(101): n is a, c, g, or t
  misc_feature (205)..(205): n is a, c, g, or t
  misc_feature (271)..(271): n is a, c, g, or t
  misc_feature (289)..(289): n is a, c, g, or t
  misc_feature (314)..(314): n is a, c, g, or t
  misc_feature (319)..(319): n is a, c, g, or t
  misc_feature (326)..(326): n is a, c, g, or t
  misc_feature (591)..(591): n is a, c, g, or t
  misc_feature (599)..(600): n is a, c, g, or t
  misc_feature (604)..(604): n is a, c, g, or t
  misc_feature (608)..(608): n is a, c, g, or t
  misc_feature (615)..(615): n is a, c, g, or t
  misc_feature (630)..(630): n is a, c, g, or t
  misc_feature (637)..(637): n is a, c, g, or t
  misc_feature (649)..(649): n is a, c, g, or t
  misc_feature (660)..(660): n is a, c, g, or t
  misc_feature (667)..(668): n is a, c, g, or t
  misc_feature (674)..(674): n is a, c, g, or t
  misc_feature (679)..(679): n is a, c, g, or t
  misc_feature (683)..(683): n is a, c, g, or t
  misc_feature (704)..(705): n is a, c, g, or t
  misc_feature (714)..(714): n is a, c, g, or t
  misc_feature (718)..(719): n is a, c, g, or t
  misc_feature (728)..(728): n is a, c, g, or t
  misc_feature (732)..(732): n is a, c, g, or t
  misc_feature (921)..(921): n is a, c, g, or t
agttgcaaggcgcatggcttcgnaggcctatagccgcagggattaaagcctgtgtttccacagaagcaccacctatcatatttgccacaccaactanactnacctccgattccacagtgtatgattatgctgggaaaaacaaagttccagagctacaaaagtttttccagaaagctgatggtgtgcccgtctacctgaaacgagncctgcctgaccaaatgctttaccggaccaccatggcgctgactgtgggagggaccatctactgccngatcgccctctacaatgnttcgcagcccaaaaacaaatgagtnaggcngcagagnactggtttgttttttggcataaaccctttgaagttcctttttcattattaaattaaaattttttttttacttggatggcttaacatttttgcaaaaaaaatagaaaaatatgaaaataatgttttggtttgtttataaaatgcatatggcttatcagagctcattcaacagttaaaaccattgtttaaaaaaacggtgctttgctctgtgtttgtgctcctgatttccctggaggttctggataaaggctgaaaacaggcttgtnaatatcannctgngctnagaaccncaggaacttgaggtngcatttntgagcatggggngcaggagcctntctgaanntggatntggcnatgnaaagaaaacaaaagccaaggnnatgtgcatnaaannaggagtttnagtnagtcacctcggggattttttccattttgcagtaaaatgttaaattaatgtagcctgcctctatttgttgggcaggtaatttcaaagggttatttgcctcatctcctatctttagtgaaatcttatgtgtaattgtgtgtatttattccaccgtgggaacagagaatacctgtttagtgttgcactttanactggtgtctgttttgttaatgcagctgtgccacaaattctcctttatcttttaaaaatgttatagctttaaattttgatttattttgactgtggaataaatacatgtatgagatgattttaagtgt

SEQ ID NO: 660181 - DNA, 606 bp, Homo sapiens
tgggcaccagagttgatttttaattggtcctaaagccgtctgaagcaaaaaccatgataaaactttcttgtctttctttttcttttacaaccccaggacaacacttaaaaaaaaaaaaaaaaaatgaaataaaaaaaaagaaaaagaaaggggggggggggactaaagacagtttctccctggaagagcaccacaagtcttatcgtcctacacccgagttttgtttgtgtaaaagagggcggccccatattaagggaggtagtatttattaagagaagaggcgggggcggcgggtataaaaagaggtgggagtgggaaacaacgtgatcgtggagcagatctctttggggagaggagaccgcttatacttcggtgggggggggagaacatctgttggggacacaactcctctcataaggaaattttcaacgccctactagagggaaaatctaactaacactttaaagggtgtatactggttgtgttaaccacagcgccggaattttgctatggggtataagaaagtttgtggctaacaggagaagttttagttctatcgagagacacttttttttcccggggcagcttcgtatctataaatagcga

SEQ ID NO: 660182 - DNA, 595 bp, Homo sapiens
gagaggtctattctcacaagattcgaatagaccacgtctgccctaagcaagggtatatatggctaccagtggatcccatggtatgctacttattagtagcatgtgctttattagcattcagtcatctcgaaagcattcttacgacccatccaaaccccaacattacttaaagctccaattcgagatgtatcaatgtgatgctatcagcacagaatttctctatcgtttacacttctacatgaatttagggcagtaatcatggagcttaggtacttctctttctgtaactatttgtaggctaaacaagactgggccgatacgagtttgctgtatttgccaatgcctaatacaacattagaaacaagacgggtttaggttgagcaaaggctgagagagtaaagttgttattattacaggatgaggaatcaaacccaaaatgtagtgttttgctgctgcttttgaattgttttggcatgtgtcaggtgctgagaataaccattactacatctcagtctgatttaactttcccaaacataaaatactgcagctgctattagaggtaagcaatctatctccttacactacctgatactgc

SEQ ID NO: 660183 - DNA, 961 bp, Homo sapiens
gccagggctccgacccttgtcgactgctggccatccatgctgacctttccttgcttgccttgtagtgttccaccgcatggccatcccataacatcacctaccactgcaagaacagtcgtggcctacatggtaccagcaagactggccacctcaagaaggccctgactcctcacagggctctcaatcgtagatcgagatcgctgcggccggagggcaatcgagtccgtcttcgatcctactagcgtcatcctgtcaggagtgagcatgcaccagcatgttcatcacacgtgaagtcgcatggggccaatgagctagatgcattcgaagtactaagataccatccagagcaaccattccccgactctgccgccatcgaatcgggatcgtggcccacctcattggaaccgcttgagtgcaccctagcaaccaatgtagatatcagtggctatcgatcgattgcatcaccatgttcgtgactttccttgctaacactccccatcccataccctagtcccttgtctcaccatcgccaaccccagactctacttttacctccccacacaccctcctgggttcccctcagacacagaagcccaaagcataaaacacttgaataccacaccttcaaaaaaagctcgacaaacactattgagtcacccaccccaactcaatcaccatgtaggataccttacgccggctcaaaacatttctctccctccccactttcgtccctccccactccccgtcattatccccctagtatcccctttacacttggtacaccaaaccccgtaaccatgtgatcctaacctaattaccaccacaaccctctacttagcaaatccttctaaccaaacacctaataaaacccactaaccaccccgcccaaccgcctcccaaaacatatactccccccccacaaccacaccacaaacccaacccaaccactaccacaacaacc

SEQ ID NO: 660184 - DNA, 163 bp, Homo sapiens
ctggcattatggacttctcacggtggctcatgcatgcactttgggaggcatgctgatgggtcacttgaggtcaggagcttgagaccagcctgaccaatgtgatgaaaccctgtttccactaaaaagcaggtgagagttcacaatgaaggtccagtgtatgcct

SEQ ID NO: 660185 - DNA, 410 bp, Homo sapiens
  misc_feature (16)..(16): n is a, c, g, or t
  misc_feature (49)..(49): n is a, c, g, or t
  misc_feature (245)..(245): n is a, c, g, or t
  misc_feature (358)..(358): n is a, c, g, or t
  misc_feature (360)..(360): n is a, c, g, or t
  misc_feature (406)..(406): n is a, c, g, or t
gggcgagatatggcgntcaacagatcatcgagggcggcgggtgatcgtnaataacaccgagagcatctaatgtcctatgatcacgtggactcacattcaatgacatgaagaacgtgccagaagccttcaagggaccagaaggcattctaccttacccttaccggtcattttctgtccagggcaaggatgccatgcagtccttcatgatgcattttatctcatgaagactgtgagatcagcagccntatttggtgcaactacatcagggacagtgagcggaggggaggtggctggaagctctgttcctcaagttgcttcacgcagggcgcatgagttcgtcagcggtgtccagtgcatntnagctcaagtgagtccagtgggcttgtactttacagccacgggcttntctt

SEQ ID NO: 660186 - DNA, 169 bp, Homo sapiens
tctatctcctgacagatgagggtaataatagactatgttggttagatagtagatatatgggctagtataattagtcagtatcagtgttttaatactgacgcaggcttatagcggagagaaaatgtcttcatagttacttatactcaacattagttctatctatacgggt

SEQ ID NO: 660187 - DNA, 224 bp, Homo sapiens
atcccttgcgtgctcgtgcctccttgtctcctgctgcctgcctcaacagcagtgtccccttccccccgcgtctgttctcgaccttacccctgtgcacctttgcctggctggggaggtgggctttgagccctgtctatgccggacgtgctgacgggtggtacgacggacaccttcaccagagcagcacgaggtccacatcttccggggagtaccgacgctcgaat

SEQ ID NO: 660188 - DNA, 1129 bp, Homo sapiens
tcccggtcggggtggtcttgcaagtggagtgtccgttgtgcccgggcctgcaccagtgagcgttcccggcctttcatctcgacattcagtgtgaaaaaaatctcgggtttagaaaatgtggattttcagtgacgtggaatctcttcaccactgtgaaaaaaagacaaacccttttaaaacttactttagtgagcgccacttgtgtgtggctatgtgtacagaagagaagtgtgtagtgctgtgcttctcaaagagagtctctagtgggtggaatatgcgcctgcggacaagtttcaccacgagagaggacacaaagtgcttctccacgaggctctcgagagttttgaagtcgcccaaccaggggtgttattggatccagaacgcatttgaaagaattcacaaatgtgcaattttctttgttgtagaccacccttatctttattttataaaacccaggttcaagagttttgtgggaagggggaaaccttattttcatagtagtctcttttaaaccccattatatgggaggagttggctaaaatatgtggggtatccatatattgtccacgagtttttatatccacagcaatcatatcaaccaagacttcctctgtggattcacacttttgggctcgggtaaacctctgtgaaccagagatatttggggccacacaccatgtggaaccactctcaccatctacactatactactatggggggagaactcgggccacgcttaacgacaaatataaggggggacaacatcacacctattgggacacaccaacactgaggcagcgaacgggaaactcttccacaaaaattgcggcaacctctagatctgatgtgtaacgaacacgctcttcgaggtaacatcgaggagccgacggttaggggacactttaaacaaggtggtatccaatactgaggcaaaaaaattgttggatgacaaggaagccagcagagtaaaaagagttaatatttgtataagctaaataagcacccaccatttgggcacatttttggggcaaaaaccaggtgtcatgtgggaaacacaaaggggtttgattaaccaaaaattataaatggtgcccgggtaacaacacaaatattttgtgaaacaaaagtt

SEQ ID NO: 660189 - DNA, 183 bp, Homo sapiens
ttgaaccctctcttgcctgaaataagctgtacagagtacaatttaaaaacacagctcagcctgggcgtggtggctcatgcctgtaatcctaggactttgggagaccgaggtgggtggatcagatcacttgagcccaggagttcgagagcagcatggtcatcatggcaaaaccccgtctctaca

SEQ ID NO: 660190 - DNA, 94 bp, Homo sapiens
tacaactaggcttaatagggacatggcaatattcatatgttcatttagatgtttgagctcctgaagacagacccttaatttaaatctttcaaaa

SEQ ID NO: 660191 - DNA, 564 bp, Homo sapiens
ggatctggacattagaatttcaatgaatccccattttcagccctctttcttccataaggcccacggtctccaaggcctcggtcttcccaggaacatcctggtgccagtatacttttctgcaggctcggctaagtcagtcaccactcttctattttctcaccaccaaaaactggacatctcaggtctgcttctatattctcctctatggtcttttataccctccagttggcttatgcactcaggttcatgaaataaagataaactcatgtggttaatcagccacatttaaatgcattttaaacaaattaggcggggcacaggggctcgtgctggcaattccagcaccttgggaggctgaggcaggtgatggcctgagctcaggagttcgagaccagccggggaaacacggcaaaaccccgtcccacaaaaaatacaaaaattagccaggcgtggtggcatgcgcctgcagtcccagctactcagggggtcgaggtgggaggatcgcccgagcccagaaagtgtgaggcgcagggagccatgatcatgacgctgcactccaggctg

SEQ ID NO: 660192 - DNA, 497 bp, Homo sapiens
tgggttgacccaggtactttatggatggtccatgacaaggtgcggtccctaggcccctcccctcttcaaggggtctacttggcacactgtaaggaggggaaattcatgtggtggggaactgattgtggaagggatttccccagaggtgagggtctcttctaatttcctcatggatgctacttgactggggcgctgggtggtccagggggatcttacatcctttgggaggccatgtggcgccattgagtggtccacaccacctcggtgttgggatgtgtagcacaaaattatcttgtgcaataccacaggggaaaattaggagctttgaaacaaatggtggctccgtcatagagggggcgaaatgtgccatatcacccaggaggttcacacaggcgttgagacgagaagttgtgggtgctgctcagcctcgtgtagaacggcatccaagaatgaagacccagcagtggagttgctctccaggtagtggccacggaggg

SEQ ID NO: 660193 - DNA, 399 bp, Homo sapiens
  misc_feature (20)..(20): n is a, c, g, or t
  misc_feature (51)..(51): n is a, c, g, or t
  misc_feature (56)..(56): n is a, c, g, or t
  misc_feature (61)..(61): n is a, c, g, or t
  misc_feature (69)..(69): n is a, c, g, or t
  misc_feature (140)..(140): n is a, c, g, or t
  misc_feature (375)..(375): n is a, c, g, or t
gtatattaacatcgaatttnaaaaagtatttgcttcgtaagtggacatttnatttnatttnattttttnattattattatactttaagttttagggtacatgtgcacaatgtgcaggttagttacatatgtgtacatgtnccatgctggtgtgctgcacccattaactcgtcatttagcattaggtatatctcctaatgctatccctcccccctccccccaccccacaacagtccccagagtgtgatgttccccttcctgtgtccatgtgttctcattgttcaattcccacctatgaggtgagaacatgtggtgtttggttttttgttcttgagatagtttactgagaatgatgatttccaatttcatccacggncctacaaggggcatggactcatcc

SEQ ID NO: 660194 - DNA, 189 bp, Homo sapiens
gtataaataggcatatgtaacaaaaactataaaaaaataaaagcttagacagtataaagaatgtcttgttcctattctgctcaccttcagtttactcctccaaggcccactgtagtgtttcttgcggttctttcaaagatatacttggaatatacaagcgtatgtatatatattccttgaaaaaacaca

SEQ ID NO: 660195 - DNA, 333 bp, Homo sapiens
tctatgaggatcccctatagaggtggatgttctcgccgaacttacgtagttggccaggtgcagtggctcacacctgtaatccctgcactttgggaggccgaggcgggcggatcacgaggtcagtagttcgagaccagcctggccaacatggtgaacacccgtctctactaaaaatacaaaaaattagccgggcctggtggcaggcgcctgtaatcccagctactcgggaggctgaggccggagtatggcttgggcctgggatttcaaggctgcagtggggctctgatcacgctactgccttccagcctgggcggaagaacgagacctcgtctc

SEQ ID NO: 660196 - DNA, 317 bp, Homo sapiens
cgcggtaacggtacgcacaaggcgatccttcttctccatgtcgtcctccacaactggtttgggttggggaagttgtatctttccttctccattctcaagcactgctgggagaaattgtggttcatgtatgttgcctccattgcctggttgcggggtgaattgaaggaattaccttcatcttgagggggctcattagcatatctcactccactagtcaggaggtcaaagtcatagtttgtctccctagtaaaagaagagtatggaccccaactctctaggacaacaatattcccccggaaatacaactgagcgggtac

SEQ ID NO: 660197 - DNA, 270 bp, Homo sapiens
ccccctttttttttttgtcccctccccccgggggggggggtggtttttttttggacccccccaaaaaacccttttgttttggggtttggccccaaaccctttaaaaggaaggggttttttcccccccctaaccccccccccccccattttttttttccctttttttttaaattggggaaaagttttttttggacccgactttttttacccctttttccgtttttttcctccccttttaaaaaaaaaaaattccccggggggggtttttta

SEQ ID NO: 660198 - DNA, 520 bp, Homo sapiens
tcatcagaaggcgaggaagtacatgggattgggaaaagagcaaggagatataagtttgaggaaaaaaaatcaccatgtagtgtgtcttcttgagtaggccaatgttgcgtatagagagaaaatgactatcaggagattgtaaggtatgatatattgttaagagtagtacatatttaagaagacgaaaatatgtttttgatccccaattatatcacttgtacaggatgattttcatattttgaagggattcatcacttcacaaagcatctccattctatcttgttcagctttacatttaaaaataaactcttcttgttcgtataaaccttatctcttacataaagtgaaatctgttaattttttgttttgacaaggataaactacttacctgcatctgtttaagaatagattaacttattttgagaagaaattctgggcaccatttttgaccattgaagacttatttgtaatttaatttctactttacattgtgaatgttcattttctaataaacaagatg

SEQ ID NO: 660199 - DNA, 1111 bp, Homo sapiens
gactggccagtggctccagctgaaatactcctggaatttggaattctcacctaaatcctgatcgccaaggctagtgtgacttggtaaagcaggagtggccactgacatctcctcacacaaaatcaatggaactggggaaagaacaaggactaccccaacagctaaacctggaggcatctccctgataatgacttcctgcaactatgggttaaaaaaaatccagccttaaacatggtgaaccatgttcggtgaacgaactggatacgtggtatacatgaagtccatggaagtccaggtatccagtcccagaaaaagccaggaagcaagtgttaagtgatactgcaacgctcacgatctgtgctcatcaaataggcttcaaacaacttcatttcctctccgacgcaaacaaccaacaaaagcgcttcccacacatggctggctttccctgcacactgacaaaatgtcctccacacgaaagtaatactgcaacccctggcctacatctatctctactttacaaccaaacctgccctccaactatctccaagtcctaacgtaagctaaaccgaacaagctccaacacacattatcgccacattacgatcctatacctggacagtccctgccccactccaccaaccacgccacctacctcatcgaaaacgcacacctgctacaacctagaccaaccccaaccccccaagcttaagctaattagactgcacacaaattcttcaaactgcgctcacactcgcacacacgcacccaaaaccaaacccgacatgctcaacttcagcaaccaacaattcacgacatgactttccaaacacaaacaacctaaccaccaacatcactggccacctacaccacaaactccactctccaaaatcgcccactcccaatcacacatcctaatagcaccctctcgaacaaccattcaccacaaacccacacacctcacgcatccacacccacgctccattcaacacgccccacacactcatctacccacctccccctaccactcaccagcaaaaaaaacacatagaaccacaccgtatctagcacacacacacacacaccataccctaacacccacacacatataaga

SEQ ID NO: 660200 - DNA, 166 bp, Homo sapiens
gaacacactgcttagcctgcaggggctcaaaaagactttgagggaggctgaggcgagaggatggcctgaggccagaagtccaaagacctggccctgttctgcactagtctctaccgctctccccagcaggaacctgagtctgcaggcttctccccggcccccattc

SEQ ID NO: 660201 - DNA, 692 bp, Homo sapiens
tgtattttgactccccaccgggtgtgtgcccgcctttattctcggcggggctctttggggggtggaccccccccgtgcacctcgagtggcccccttttgtgtcccccgctttgtccccgcagtccctgtggctcggacaaaggagatactgtgattatatgacgtttcgcacaacacttttctctgcccgcttgtcccttggagacccccctttgcacccactttcaagaccccccctggggaccacgctgataatactccactttctctcgaacaacggcgcgcttcgttgtgccacacacacaagggccacggtattccttctcacacgcgcttggaaggagcccacttattttattgtaaagtgtggcacttggtgaaggctgtgtccacagtgcacagtatgtggggcgagagcctgggcactcacctgtcacacccaccactggcacagttatacccgggtgatccacaagaaagtgggaaagccggctgaggctgctgagagaatgtttggtattcgaacacgggaattccacttgcacacacagactgtgaaggggcctcaatcacccaaggcctatgggcgggtattgaacgatgttggggcgggggttataaacattcctgagattttgggaaaggtgctccaagaatgtactgagaggaggggtaaaaatatgttttgagga

SEQ ID NO: 660202 - DNA, 363 bp, Homo sapiens
ctcggttttccatggccaaggcagcatgatccctctccaacataattctaagcaccactcattaaaacattatcttcgaggcagatttggggtcccaccacgtgggtggctccattggccatttaaaaagcaaaaggcttctcagggcacgctttggagatcccacactaatatctggggaggcttggtagaaggtgcagttgtgtccaatggcggatcgggcgattagatatcctaaactggcatccatttttattccaaatattggagagataccttatatggtcggtaaaaccacggccacagttaccaccatgttggcagcaccggttaccttcaggttggattagttggtgcggaggg

SEQ ID NO: 660203 - DNA, 854 bp, Homo sapiens
  misc_feature (422)..(422): n is a, c, g, or t
gtcataaaataagataaatttttaaaaaagagaagtgccatactgttttccaaagagtctgtaccattttccacttaccagcattatatgagagttccagtgcttgcatccttgtcagcacttagtatgtcagtttcttctttctttctttttttttttttttatgaaacagagttcgctcggttggcccaggctgggatgtgcagtgggcatgatctcgggctcactggcgaaactccacctcctggggttcaccgccattctcctggcctaaagcctcctgagtagctggggactacagtgtacccggtccccaatacctgggctaattttttaatttctaagtaagaagacgggggttctcaccatggttacgccaggatgatctcgatctggacctggtggatctggcgccacctggngctcccaaagtggctggggatatatagggcatgagccactggtgccgggccttaggtatcgggcagctctccaaaagacaaagaaaagcaacaacagaagacaacaactgtgttgtgcggcgcgctgggcgcccccgagagaaaggctctgtgagaccaaagtgggcgtgggcggcgggggcccacatgggatctaggcgacacggggcacacacaggcggggtcacacgaaagaaaacacgaggggcagaggaccaacagcggggtgtgaatatgtccgcacacagatgaaaaagacgcgccgcggggggaaaacaacacgaggatggtctttggaaaacacgctcagaagaggggaatcacggggaggccacaagcggggggcactataccaacgagggggcaccagagcggagcggaatataaattgcg

SEQ ID NO: 660204 - DNA, 381 bp, Homo sapiens
tctgtgcatcggaactctcattacttctgggccgtgtctgcgcatctgtggccagctacgttgcagagctgctcgacctgctgtgtggcttatgcggacccggtcgctcatggcctccatgttgccctgaatcctcctccagcacctcctccagctgggcgatccagggcctccaggcggagcttactcgtacctaggagtgcgtaccttcccgacaggctactggacagctcctctgccagttcctccttctcgaggtccgcttgtatgcgagccctctcagcggtggcgaggtcctcttgtagctgcatgaggtctgcttccaagctcttggctttcttctcattctctttggctgtggcaaagatctcatcgctggag

SEQ ID NO: 660205 - DNA, 338 bp, Homo sapiens
ttggctggatcgctcgccttaacatatgcgctgcctaccagccttcatgggttgggtctgatgtcaaccagcagtcttaccagaaactcgaggtctgtgtgatgtggcaactgttagctacacctggaaaacccttgagattcgtgggagatgaaggcacgcaccaggatatagcccatcagtgagctcagagcacaccttgcgtctttgtaggaagcacttggtacactagacggttgccctctatgtctgctgtccaccttagtgctaggttctgcacgggttagctggcccctctgagaagggacattagaaagggcaatcacgcttgggtaccg

SEQ ID NO: 660206 - DNA, 343 bp, Homo sapiens
acaagaatcgagctcgtaccggcattgctgtaggccagcgagaaggtcacagcgacgatcggtgcggcggctgtgggtgtccgtccatgccacggcacacagcgcgatggggtggtcggggatgacatggatgtcggtgatgcgctgttccagcagcaggtcttcggcttcgaagcgtcgggtcatgtagggcgccgtcagggcaaaagaaaagggggcggacccgcacctggcgagctgcccccacgacctgcggcttaacgctgctggcggttgccgccctgctcgcggttcgagccttcgttgccgcggttggcctcttcacgctggcctacagcacatg

SEQ ID NO: 660207 - DNA, 358 bp, Homo sapiens
atttggaataaatatgtagaaagaattcagaattatgccccagctttcacaatgttgggttacttaaacgaacatctacaagctgaaataaggaagcagcaaaatgcataccaaaggggcaatcttggttggttacagacttgcatgtaagaccagagatactttacaactgttgcaactaaagaaattacggcagattgttatgttccaactaggttgacagttattgactacaagccttagttccaagggcttggttaaagttcaaagcagccacctttggaaagtggttgaggcaaagaacgagttcaattaagcgtttatgtggcagtttgggccttgttaattccatggaaac

SEQ ID NO: 660208 - DNA, 271 bp, Homo sapiens
ttgcgatattgaggccaagtccgagagcggatatgataagtattagattccatagactgcattagataaagttgtccagcgaaagagaagatgtcctaaggcttcttcctactgtatcccgaatgagctagacctggtgcttgcgagtagagacaactttggtaagcaatcactctggcacaatcttcaacgcagtgaggataataccttgcgccactgaatattctagatactatatgatacgattcttggccttgccatatgcgagggc

SEQ ID NO: 660209 - DNA, 324 bp, Homo sapiens
tccgccatacgccacatacgccatgacattcttttgttctttagctcaaatcatgctccttgctcataattgtcccctgtttaaattttttctcccacatcttagcaaatggagatttaccaccctaatagccttaaccttggagactctagcaaaggaacgtgctgtggattttaacatctaaacaattccttgggatggatggccgtggaggtggcagatccctggaatcacgcagcagtaggcagcccagagagaggcctgggcatccctcagtgccccaagttcctgcatccgtctcctgcagctgcgtttcacttccga

SEQ ID NO: 660210 - DNA, 326 bp, Homo sapiens
ggcccgataagctggtaagcatggacgcagaccccgtcagcactggaccccgatagacggctcgcgcgcgctttcgtgctaggccctgtatgtgaggggcggctccccgtagagtgggtcgggtgtttgattctgtccgtcgcattggagttccctcgcaccatagtactcgcgccattcgtcgcctcttgacgggtccgggcctatccctatatgccttcccaagccagcagacgtggtcccctggatgacgcgtcgcggccggtgtctcccgtgcgtcccgcgccccccgcggtcgctcgctgtccatgggctcctgaaccgca

SEQ ID NO: 660211 - DNA, 1126 bp, Homo sapiens
actctcgaccgcctcgaccagtccccgtggtgggaggcggccaagaggatctccaagccctcggtttcggcctttttcacgggtccagaggagttaaatggacacggcccattctgcagccctgctggcacagctacaagtccttctacgacgctgcgtgctgctgtgtgatgtgaccatcgaggtggtgacgcctgtgcagcggagcctggcactgggtcgcctcttattcctgcaatacgcaacgtgctagcagctgcgtgtccctacttacaagagcatgttcacaggtaggacatgtaccgaagatgccaggcagtgccagctgttgacccatagccacgcatagctgcgaccgctcgacgtacctttactgaggtcgtataggtacagactaacttgctaacagcgggtacgatgtagtactctacagttgaggccaatgtgcagcgcctgtacgcggcctccgacatgctacagcctggaatatgtgcgggaagcctgtgcctccttcttagcccgaacgtcttgagctagaccaactgcaccgccatcctcaagtttgcagacgccttcgaccatcacaagcttcgatctcaggcccagtcctacatagctcacaacttcaagcagctcagccgaatgggtcaaattcgggaggagactctaacagatctaaccctggaccagatgctggctgtcctacgcctggatagtcttggacatagacagtgcagcggactgtatgcatgtagctgtgccatgattggacgctggctgccaagagcggggtcccagtgctgataaagtctcccagtgacgtgcgcatggattcctacacctgacgaggatcaggcttatttacacggccgtgacacagccatcgttgcaacaagcttttgtccttgaccgtcttcataacgggccccggagaagcgcctattgtagccatgatgacaacggctcttgagtgacatgatcaactatttcatacacctatacaggcaaatacttgtctttggccgagaatactgactgatccggataccttctaccagacagtcgcctattggtgacactagatcgcatcgtgatgcagtacgagcataatagacaacgacaaact

SEQ ID NO: 660212 - DNA, 158 bp, Homo sapiens
aaccggccgggttacgtgctgtgggttgagtggcttccactaggcttatacagttcttgacatgcctcataggcctctaagcagcccagaaagatagacggtaatcttgatctgtattgtattactgacaaagtatatagttcagtgtcctaagtgcc

SEQ ID NO: 660213 - DNA, 106 bp, Homo sapiens
cgcatatgagggagactgtttctaactctaaacgttagaaaaataattcgtttaatgtgttgagtgttatgaaaatatcactgaagaccccggactaaccttgaag

SEQ ID NO: 660214 - DNA, 81 bp, Homo sapiens
  misc_feature (20)..(20): n is a, c, g, or t
  misc_feature (27)..(27): n is a, c, g, or t
  misc_feature (66)..(66): n is a, c, g, or t
  misc_feature (79)..(79): n is a, c, g, or t
ggactctcaaagagtcctcnccaaacnccaaagtttgaaaggatcaatttttcagagcccaacttnctttattggccanaa

SEQ ID NO: 660215 - DNA, 129 bp, Homo sapiens
atccttcctctctacgatccttccctttctcacgtagggatgctccgcctgtatatcattccaactggcagttactggtacatattgtgggctccttattgcccccttttttcttcttttttggggtca

SEQ ID NO: 660216 - DNA, 453 bp, Homo sapiens
  misc_feature (201)..(201): n is a, c, g, or t
gcctccatggagttcgtgggctacaaagacttcttggctgctgcaggccatctggatgtatatgtgcagttcacaggggttacaatggcttagctctggctcagaggcctgacactgacctcagatgatccacctgcctcggcctcccaaaatgctgggattacaggtgtgagccactgtgcccgcctgggatcatatgtnacacgcatgtttgttcaataagcatggagtgcagccacccacatgaatattcatagctcctcctgtagcctgttcaatatgtatgtttagctaaccccttcagcataaagctcctgccccaacccctcctgcttctaaatgtctgtctctggtgttaaccagaggctgctcttcccaggctgctggatggctaccttgcaggctgtcacccttaacaagaaataaagtgtcatttgcaaatgcaaaaaaaaa

SEQ ID NO: 660217 - DNA, 315 bp, Homo sapiens
  misc_feature (2)..(2): n is a, c, g, or t
anaaataaatgcagataatttttctcccacagacagaggtgtccttgaatgattctaatgattatctgtaagcctttgtaggggagggaggccatgcaacggtcatgaaaggcagaagagtctaattgtgcctggatttctccaggacagcagtggaccctcgttttatcattcccagtccattgtcatcacgtcagcagaaaaatcttcaggggtgctcactccacgtggcatttattttgatccatcactaaccgagaacggttaatgcgtacaagcataccacatggcccttccatcttgtacattcctgtg

SEQ ID NO: 660218 - DNA, 131 bp, Homo sapiens
tattccccacgtactgacgagttctggcctaatggattactgcagccatcaggaccctgagtcaagaggacagtcatccagtcccctctagtgcccctacagactgttttggtcattgccagtttagaaac

SEQ ID NO: 660219 - DNA, 424 bp, Homo sapiens
gagatcttggcttactgtaacctctgcctctcgggcttgagtgagcctcccaccttggctttccaagtagctgggactacaggtcaccatgcctggctgatttttgtattttttttaaagaatgagttccaccatgttgcccaagctggtcttgaactcctgggctgaaatgatcctcctggctcagcctcccaaagtgctggacttacaggcgtgagctaccacgcccagccaattattttcttttttggggggtgggggaaggagtcttgctctgtcacttaagctggagtacggtggcgcgttctcggctcactggaacctctgtcttccgggttcacgccattcttctgtctcagactcctgagtagctgtgactacagatcaaacagatgatgggggcggcaacacgactcgaggaggg

SEQ ID NO: 660220 - DNA, 354 bp, Homo sapiens
ataacctgaagcctgaggtggcagagttctatgggacaggattacagatgaaccagcttagaggtaggacgtcctgtcacacgcatctaggcgggtacgctgggtggaacatactcataggcttactttactgagacttacctgagccacgtgaacctattgaggcagagcccaatttcttctcgagcagttgtgccctctgtgccaatggcacggactagcgccagctgtgtcaactgcgttcagagtgtggctgctacacccttgaccaatacttcaggtacttgagagccttcaagagtgtgaaggatggcgctgtggaagtgaactttgacgcactgcgctatatttgag

SEQ ID NO: 660221 - DNA, 227 bp, Homo sapiens
atcacaaatccttctgggatgaacaatactgttcttttcagaagaaaaaggcatattaccttttctatttctattatgaaaaacagagctatacaattttggtatttttagtagagactgggtttcaccacgttgccacgctggtcttgaactccttcaaggtgttctgccttttttggcctcccaaagttctgggattacagatgtgagtcaccccgatctcccca

SEQ ID NO: 660222 - DNA, 1065 bp, Homo sapiens
ctggttttattccttacgtcatttgttccagtaattcacgagtgtctaggtgccgttgctcgcgcacaccagggctgtgctgttatgcaggaaaaacacgcgtctgcttcatggctagccccctgggtgcctgcgaccattcgcctgcttgctcttcactagaagaccatcgtagccgtgtgcatgaatcaggctgttacaccagatggacctaggttctttgctccgaacggcgccatcacatggtatccggttcacaaaccccgggtgctgtcaaagagtatggtaccacggttgttaacgctcccacggtacttctgggtggggggaccacatatcatgctcggcagatacacctgtgacattgtgggtcatccaaacagagatggtgtgtttgagccaagtgtcacatgttcctcatcatcgttgccgcatgcacgtcgcgccggtgtgtggtcctaacacgcaatggggccaccagctaaaaaatggtttgttggggccattacgggatgcgaatacttgtgtgtgcagtagctgcgagttgcactgcccgctcgatgatatacgcgaggattggatgatgttatcgttttgccataactcgcgcagtgccataaatataagggtaagattctgcttcagatcgcctgttagtgaggtactacttcgggccccgcgtagtggcaccgcaagcacacactaaatgtcgccaatttctgcgaagaaggatcaaacctacaccgtatgataaaaaatatttgtcgtgcaccgcgggcacacagggagtacatcagtaggacgccacaccgcaatagggattggctcgtgggtggtagatagtcgaagaatttaatatgcatgttctatatgagacatttgcccggaatacatttttgccgcgcgacccacttgggtcgatcatcgcttgttaatacccacgcatcttctgtggagagaccgttatagcgggggctactcaaggagtccactaggacttgtcacagcacgtttctgtgctaaaacccgcggggaaaccccggttttgaataaaacacacaaaac

SEQ ID NO: 660223 - DNA, 716 bp, Homo sapiens
ggtatggtctctgccaacatcctgtatcagcattataaaataagaatggataacttcaagctttgccttgactgtatttccttggcttggataaaaagctattgtaatggtcaattccaatgcattttttacaggcccaggtaatggttaaatacgtcagattactgaataataattgaacgtatattattcttctaaggatacagcttgtctctggagttaaccagtcttaatttatatatttgtaaaatcgtattttaatgcttgatttggccatttatagacgtagtagcagtaattgcgagaagttcttgagctgaattcctgttgtgacaaacttcctataattaacagtagatacaacttttcactttaagtcgtatataacttttctataaatgtgtgatggacaatgagatatgcttatccaataagaataagcttaaatatgagatggtcttgggtcaaaatgttctttatacaaatgacctttgttatgagtacgttagggtaaatacttgaaagctttttagtatcttaaagaatactggttgaaaagcatattagatcgttaaacagtggtggccagtgtggatttacaagtcatgggtctagtgtgcagacttgattttataaaacatatcacacatttaatggttatacaggatacacattttggggaactcggggaagcaattaagaaagtcgggaggggg

SEQ ID NO: 660224 - DNA, 770 bp, Homo sapiens
ggttcgttagtggattacttctgagcttgcaacatagctcactgaagagctgttagatcctggggtggccacgtcacttgtgttatttgttctgtaaatgctgcgttcctaatttagtaaaataaaagaatagacactaaaatcatgttgatctataattacacctatgggatcaataagcatgtcagactgattaatgtctactgtgaaaattggtagtaaattttcatttgatattagatataaatatctgaatataaataattttaatatactagtcatgatgtgtgtgtattttaaaaattatctgcaaccttaattcagctgaagtactttatatttcaaaagaatgaataacattgataataaaatcgctactttaaggggttggtccaaaataaatattgtgggccttatatatcacacctattgtagaaagtattatttaatttaaaatggatgcaggtgtgtctactaaagaaagattatatattaatatgctaatggttcataatcaacagaaaccaagatagagctacaaatcagctgtacagttcgtacactaaactcttctgcttttggcattattaggaattaagtctcgattattaggtgatcacctggatgaatcagttttctgctgaaggcacctaactcaggattctttctcttattatctggatgggaattaatctctccttgtgtcattttggtgcttaaatcaggttatcagccattggttcctttacaacggctgggaaaattttttg

SEQ ID NO: 660225 - DNA, 1391 bp, Homo sapiens
taacataaattaacccatttattatagggccagggatgtctcaaagagtaaaggagcgtctacggggtcttttcaactctcctttcagtctttcgtggtgtgggggacttttaccggtgacaggcggaaggtggtattgggtacgtctccaggccccgccagccagctgtggtctctcagtgcgggacccccgaggtgccagactccccaaaaggcctcggtctctctttcaatctgtgggagttgtggccacacaagaaaaagagagacagaggtgttcacatgtgggggtgcgtgggcgtgaaattctcaattttctcttctccaccaattttctccggggaggggagcgccccccttaaggcgggtctcccgcggtatttataccgggacagaactcccgaacttttctctgtggggatacgtttgtggggccccgtgtgtccgccgggaacaccccctttaagagaggggggccctctcttagagaccctctcctataatgcacctctcgcggccttagccccatgtggtagatttttcaccttctccactctccaaataacggcctccctctcaatactataggggcgcataataaaacccaacaaaccatctataaccccatttatttccccacatgtggaggggggcgcgagatgtggttaaccacgggaagaagagccgctctatacacccagaggggcccccaccacaaaaccacaccatctctgtgtgtccccacaaaaaagaggggctctctgcgaaaaacacgggggaatacaaatccctaaattttaatttaaactcctgccgaagagagttctttattattctatcacgcgggagggaatttattccccgagagagcccctttttataccccaccttcccaaggcctatatgcccccttataccccccccacaatatttttgggaggggtgcacctgtgtgcccccccacaaagaaggggctctataacccccccggattataaattcccccctttaataaatggtccccaacgtcccatataaaacaacattccctggaatataaccttccgccactcaggggggggtatttcactccacccctgtgaggctcttccccatttggcttttttattctagaaaacctcgccggataccccaattattccaaggcccttgtgtttattcaccatttttccggggtctctctttttaaccccccctaaaaagcccctcaaaagactattcgagggtcccccttccccaattccaagggactttcggggcccacattttggttgacacggggttccaggcatacggctatatgtggaccatctccataatgtggtgtctcggcgcaaaattatttttattcccacatcttgttcgtcagc

SEQ ID NO: 660226 - DNA, 501 bp, Homo sapiens
  misc_feature (1)..(1): n is a, c, g, or t
  misc_feature (360)..(360): n is a, c, g, or t
  misc_feature (433)..(433): n is a, c, g, or t
  misc_feature (442)..(442): n is a, c, g, or t
  misc_feature (475)..(475): n is a, c, g, or t
nacttcggcacaggcactgatacagcccagttcctgggtacccataggtatgagtggtcagtaggtgtatatacttttaaatatatttcctaagagccattaaatgtaaaacccaaatgacggctgcagctcttcactcatgagtgatgccaaaccacattccacagtctctcagcacccctgaagggaaccgtgtaaactctagacatctggccagatggctttctgtcttccattccaactgccagttatttccttttttgtcccaagacggctatgccctgacacacaaggaaaacagttttatctagaactaggaggagggattccttttgcctattgctaattaggggcctattnggaacaaatttcaagtttttgggggagggaagaggtttttagaaggaaaccactttttccagctgttgtgttnagggcaggnccagggcattgatattcattcggacaggcattntgctttttctgttcttggttctttcc

SEQ ID NO: 660227 - DNA, 818 bp, Homo sapiens
  misc_feature (806)..(806): n is a, c, g, or t
ggtaagcataccttcacactttcggagccaagatggacgcttgtccttgtgagcttatcgtgatgccaataggaccccccttttgaacggcttataggacggttcaatttcatcggacagtgcccccgcttggtgaccaggagcgacccattcgtcaaaggcgcctaacttattatggtaccaggcacctctggggatcgatagaacctcgattgggaattcaaaagtgattcgaaattcgggacagccttacttgatatttaccagtatgtccctagacctgtatggcacctcatcactgctcgagagctacgcttgtctctaagaacctggatggactaatttacccaaaggagcctgtgcccttctaatgaacctctgtggatcatcgatcgcgcacctgtgcatggcatgtgagggttaatgtgctcattgtaccaggtatatagattgaaaccactgtgggtccaggaaaattccaaacttcacctacgatgtgtcagagttgacttaaaggggcaacatggccagaagtggcagcacgaatatcttgttggacatttagtgtgcagctgaagattgctaaagatcgcgggattccttcagtaacctagaacacatgaaacccagaagacaccaaatctaggtgatcatctgaagcaacgcaaccgcttccaccaccatggtgtttgtttctagaactttagccactccattgaagaatgggttctgtgtctaatcctgaaacaaagaaaactacaagctggagtgtaggaattgactatagcaattgatacattctacancggttcctgatt

SEQ ID NO: 660228 - DNA, 252 bp, Homo sapiens
caagcttatgactattccaagaagtggctccaggctttgaaagtagaatacaagaagaatttcaaaaagatagagtgcaattgctgcatcgttggaacagtactcgggtgcctcaggcgcatatttttaaagcacacaacattcacatgcttcttacaaccacatcagtcacatcactttatagaaacactctgcacttgtgcaaagaagacccatctatggtttttaaaaatgggaatccatgggtcccgc

SEQ ID NO: 660229 - DNA, 1346 bp, Homo sapiens
taaaaaaacaaaaagccacaaccattttttttttaattttttcacaaaaggggagggagaggggggacacctgtgtgtggggcctcggcccaaacccgcggcccacacccgggcctgtggcccgtgctcgtgaaaacaaggggactcgtaggggaaaatctccaggaactcaggcagagaataggaatctggggcagagaccatctgagaggccgtgggggaatgcccaagaggttagagggtgggaacagaggcttcaccggaaggaaaacaaatggagagccacgtgggcaagggaggagggaacacaaaacagaagccaagaaaaaacaaaaggaagcacacatggggggggccccccctgtgggaacaaccccagaaaggggaacacagaggtccagagaggagggtggacacaccgagtggccagaaagaagagagggtggagagagagcgccccgagaggtctcggcgaaaagaggcgaaaaaagtgaacaaaggcgtgcggcgaaaaaaaagaaaagagaggcggagcgcaaaacctcggggagcgaaaaggagcccccaaaaaaaacagggagagcccccgggtgtgtagaaagagagggtggggtgaagcactgcggggggggtggcgccccaaaaaagcccaaagaagaacagagagcacccacaaagaagcgggccccacacacagagccaccaagaaccggagtatgggggaaagaggggagaacacaacacacaaagaagagcgccccaaaatagggcaggagaaatacacagacgagaagaggggaaaccacacagagagacaataccaccccacgtaaagagggaagaagcccaataacaaaaccaggaggccgccactataacaagaacatacataataatatacaattttttcacataaatccatcaatacttactcccctataaaataatccacacctattataaagctatttggagaaatacattatattcatttacacacactataaagaccgcaatcactacctaactcaataaaaaaaaaaatatttaactaatacagacatatccggcgagaagacaaaccacaacgaacaaataacaaatgaaacaccaaacagaggcaccgaggacccaacgcagcgagggaccacccacgcacttcgccacagagggcacgaggcgagcgacaacggagagagaggcaaaggggacccgaggcaacaagagagtacccaacaacgtagagggcacacgcgaaacaggagcagagagaacgagaaaaacacagaaggaggcacaaaactacgtggcaggacgaaaaccaggcaattaagagaaacagaaaa

SEQ ID NO: 660230 - DNA, 469 bp, Homo sapiens
tgagagaactagtctcggtttattttatatttattttaagagtgaaaacccggtaatgatgtcggggttgagggataggaggaaaatgggggataggtgtatgaacatgagggtgtttctcgtgtaaatgagggttaatgtcgtaatgttggtgggtgagtgggccccattgtgttgtggtaaatattgtgagggagtatagggctgtgactagtatgtagagtcctgtaaattaggagagatgatatttgatcaggagaacgtggttaccaccacagaaagtcactccccagataggtaacataaggggcgggtaaggcgaggatcagagaggctccctaccaaaccactcaaaaagctataaggtgggagctacagtcggaagtccttgaaacaaggatacataatccgactgtgaactgcatcagacaatagcgtacgctacccacgcacacccaatcgggaatgc

SEQ ID NO: 660231 - DNA, 160 bp, Homo sapiens
agtcggacgctagcctggtcgcaggtcccaattgctacttcatggatgtgaaatgcccaggatgctataaaatcaccagggtcttgtagcccatgcacaaaacggtgagttgaggtgtgtcgggtgctccacgtgtcctctgccagcctacaggaggaaa

SEQ ID NO: 660232 - DNA, 1528 bp, Homo sapiens
cggatgtcgttgtgtcgcgcttgcgttgctgtgtcatggtgtgtgtgttgctctgctgttgttgtctgctgtgcctacgtggtgctcttgttctgttcgttcgttgcttggtcttctcttcgtctctggtggtggtgtttactacatctctgttttgtgccgttttttttcgcggtgagcgtctcattcatcctttggttgtccgctccttgtggtacagcccgtggtcggtgctgtctctgcccggtcttttatgcctttgggcccggggggtcggtttatcacattgttgcctactccgggtagcccactgctttggcccgttttagcgccttattgtttgggtgcctcctgttgttagcacccgaactgtttgtgtgccgcatagttcattcgcagtgtcgtgtgtttacccccgggttctcccggggatttttccctcgggggagtttttccgtcgtgcgcgacacctccacgcgggtgtcgctccatgggctcgccgcttctttctgggagttgtcacttgcgcgcttctgtccaaacctcgggggagtgtcctgcaaacccctgttttgcctactcctgtgtgtaaaggtgataaccccatgggcccccccacctgtgtgtgaggcgggatacaacatttccatattgccgggaatccacaaacacccagaattgggggggttacccaaaccagggggtcactcttagtgggtggagagagcatttattcccaaagcccgtgtttttggatgacccacccaaaaggaggaattttcccccccacccttattttttgtgttctttcggaaaaaattccaatatggcacaagcgtttttctgagatgaatctttgtcttctaaagggggaacacacgtatctggttggaccccctgtaaaggaccccgtccccaattcttgttgcccgggcacctgtgttgaaaaattatcaaatgcacaatctagggccccggtatgtattgccacttgtgttttcgtggataggggcttgaaaatgttgtgtgaaagaacggggccccgacagtcaacagactccgcgggatgagccacaacccctgtcaagagacgtcccaaagccgtggggagaccacatcacgctggaggagactctctgttacaatatacaacagttggcacggagaacacttattaacactggcacagtgaattttcttggaagaattccacgaagaaaggagatctggctctgtggtttcacacccctgagggaaatctggtatgagttaacaccgaagctgtgctccacgaaactggagtctatgaatgaacacggaggggcagaccaccacttgcttttcacaatccactttcccctccttcccacatgggcacgaaggacccacggctgtatggaaaatctaagttaatttacacacggaccttcactcataatttggagggaagcttttggagctgtgagttcttccctgtacagtgttaccatccccgaccatctgattataaatgcgttcctcccagcca

SEQ ID NO: 660233 - DNA, 345 bp, Homo sapiens
  misc_feature (251)..(251): n is a, c, g, or t
  misc_feature (319)..(319): n is a, c, g, or t
tttagccctttgaacatatttaagatagttgttttaaagtatttgtctaggaatatacattattacagtcattatagagaacagttcggaggttcctcaggaaactaaatatagagctaccatgtggatcctgcagtcccactgctaggtatatgcccaaaagaaaggaaatcagtatgtcacagagatatctgcattcccatgtttattttaggcactcttcacaatagccaagatatgggaagtccatncaacagatgaatgggataaaggaaaatgtgggtacatctattataactggggtacttatttcagggcntaaggaaaggattgaggattacattc

SEQ ID NO: 660234 - DNA, 504 bp, Homo sapiens
gctcagttgatgatgctgttgctgaggcctccaaggagacgcaagcttcgtgatccttctgtccacgcggagcaggggggctggaatgtcgagctgcatgcagagcaagacaatacggtgcactggctcagtggtgtacgccaacaatgtgagcaacggttggcgcagagcctgcgccagcctgtcagtttgtatctggcaaaatcgaggtaggcatgatgctgccacctttgatacttcccagattcaaaaccgatattgcggttgcccggcagcgcttggggcaagggttgtgtatgccgttcgaggtcgctgggtcgagtggcgagttgagaatggagcctggtactgctcctgtgggcatccagccgctctgcttcgaaaccgcctgtggcgtcttggccttcagtgagccaggaccacagttcagcttgatgggtgaatgccccgtgacgctcgagccggccgggaatgatccggacgcctggttctgggagttgtccc

SEQ ID NO: 660235 - DNA, 364 bp, Homo sapiens
tctggcacagtgtggctcggattctctgctccggctcttaaaggctgccattaagcggttggcaggacaacattccttcatggaggctctggtggaagaatctgcttctcacgttcattcaggttgttggcggaattcagcttctttgctggctctcagctggaggcccctctctcatctcaaggctgcctgcattccttcttatgttgtcccctccagcttcaaaccagccttactgctctttctcatgcttcatatctctctcccgttctcctgtattaggggcatatgattcgctcaagcccacagatatattttaaggtttattgtgcgatagaacataattgcaggagtactgtctcat

SEQ ID NO: 660236 - DNA, 487 bp, Homo sapiens
aggttccagccagttccaagtgaagaccccacccctggacatcaagaagctacccttcctccactagatagagcagggtgagagttccatgatccccaataggtagggactatgccccaagccagcatgaagcagttacagaaaaaagaccatcggtccctctgcctcccataaagatttatggggatcacatctcttgaaggggcagatgaggcaggaaaatagggtctgaagtgtgaagatcgattcacacttcagctataacaggaaatatcctctccatagggtgtatgactatgtaacttgaatacttcatcctctccatttacataaggtgtatctgaagtaaccaatggaatcctctgggggtaaatgccccacaattctgtaacgggacctttgagcccctacgctccgcctgctcccacactgtggtgtgtatgttcattttcaataaatcccttcattccttccttaaaaaaaaaaa

SEQ ID NO: 660237 - DNA, 344 bp, Homo sapiens
cgagcagcgcggtgggtgcggctgtgagaccggcaggatgacttctgtccccgctgtgtgcacgcgaccctcgagacgacagtcgcggctattgccagtcgagctgaaggcgcctcccgccggagcggcccagacggcgcccgctcgcccatgccgtagctgagctgcggcatgcggcgtgcgggaatgctggcgctgctggccgccagcgtggcgctcgcctgtggcctgctggggcccaggacatgcccgtgcgcccggtagccgcttcgtgtgcacggctattgcccccagaggcggtgcacgccggctgcccgcttccccgcggtatgccctatgcaggg

SEQ ID NO: 660238 - DNA, 584 bp, Homo sapiens
  misc_feature (579)..(579): n is a, c, g, or t
gcgaaagtgacaaattataacctaagcataattatagcgatgggactaacccctataccttctgcataatgaattaactagaaataactttgtcaaggcagagcctaacagcataaagtacccccgataaccagacgagctacctatgaacagctataatagcacacccgtccatgtagcataatagtgggaagatctataggtagaggcgacaaacctaccgagcctggttatatgcctggttgcttctctataataatcattagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacctaattggaccaatctatcaccctatagaagaactaatgttagtataagtaacatgaaaacattctcctccgcataagcctgcgtcagattnaaaca

SEQ ID NO: 660239 - DNA, 655 bp, Homo sapiens
  misc_feature (265)..(265): n is a, c, g, or t
  misc_feature (267)..(269): n is a, c, g, or t
  misc_feature (272)..(272): n is a, c, g, or t
  misc_feature (275)..(275): n is a, c, g, or t
  misc_feature (282)..(282): n is a, c, g, or t
  misc_feature (295)..(296): n is a, c, g, or t
  misc_feature (304)..(304): n is a, c, g, or t
  misc_feature (316)..(318): n is a, c, g, or t
  misc_feature (331)..(331): n is a, c, g, or t
  misc_feature (336)..(338): n is a, c, g, or t
  misc_feature (343)..(343): n is a, c, g, or t
  misc_feature (349)..(349): n is a, c, g, or t
  misc_feature (359)..(359): n is a, c, g, or t
  misc_feature (362)..(362): n is a, c, g, or t
  misc_feature (396)..(396): n is a, c, g, or t
  misc_feature (415)..(415): n is a, c, g, or t
ccccatgcgggatgaagactacgagggtgacatggaggaggaggtccgaggaggaacgaagagggtgtgttctggaccagtggcatgagcatggtccagctgggacaacatggactatgtgtgggaggaggaggacgatggaggaatgacctggactactacttgggggacatggaggaggaggacctgaggggggaggatgaggaggacgaggaggaagtgctggaggaggttgaggaagaggatctagaccccgtcagcccantnnnccncgnctccagnccctcggaggtgnntcacatgncctcagtgcgannngagctttcctcgncggannntccgncccaanctgcagctgnccnatatggtccaggtgattcggcagatgcacccaanccctggtcgagggagccgngtgacgatcagggcatctgtcccaaaccaccaagaagccctgaagctctaactgcgaggtagacgaagaggcccattcagatgtggtgtgaccgacgaatccaggagccacaaagagcaacagcgctggatgaccatatggaggcaggtcggagcaagagtcacacaaggacaaaactgcaggggagcagcgtggaagacacatgaggcagacaactggaggacagatgcagagaggatg

SEQ ID NO: 660240 - DNA, 152 bp, Homo sapiens
gatactctttacagacatccattgtatgactcccttgagacccatgtcagaagcccccatcgctgggtcaatagtacttgccgcagtactcttataactagtgcaggccatggtataatacgcctcacactcattctcaaccccctgacaaa

SEQ ID NO: 660241 - DNA, 132 bp, Homo sapiens
cagcaacattttaaggaattggataattgggggaaaaaaaaaggagacttgactgctttgatttttttcctttgatgaaatgaggaaaagggaagtagagatttcttcaagaatctaacattaaaacatgac

SEQ ID NO: 660242 - DNA, 720 bp, Homo sapiens
gcacacccgggcagggctggaccctgggtctagccagtgttcctacctcaggcctgctctctcttgtcccccagacaccatccttacccccccaccgaccccacagttgtccagctgtctgttgtgtttgtcctgaccgccccaacaactcgagggaggtctgggctgacagctccatttgtatgtgggagccaagaccaaggagaatgttgtacagagcgtgacctcagtggccgagaagaccaaggagcaggccaacgccgtgagcgaggctgtggtgagcagcgtcaacactgtggccaccaagaccgtggaggaggcggagaacatcgcggtcacctccggggtggtgcgcaaggaggacttgaggccatctgccccccaacaggagggtgaggcatccaaagagaaagaggaagtggcagaggaggcccagagtgggggagactagagggctacaggccagcgtggatgacctgaagagcgctcctctgccttggacaccatcccctcctagcacaaggagtgcccgccttgagtgacatgcggctgcccacgctcctgccctcgtctccctggccacccttggcctgtccacctgtgctgctgcaccaacctcactgccctccctcggccccacccaccctctggtccttctgaccccacttatgctgctgtgaattttttttttaaatgattccaaataaaacttgagcccac

SEQ ID NO: 660243 - DNA, 84 bp, Homo sapiens
ctagaagattcagcaaagtacttttgtgctcttggggaatttggggattcctactgggggatacatagggccgataaactcatc

SEQ ID NO: 660244 - DNA, 999 bp, Homo sapiens
  misc_feature (160)..(160): n is a, c, g, or t
  misc_feature (163)..(166): n is a, c, g, or t
  misc_feature (168)..(168): n is a, c, g, or t
accggtacggcccggaattttgggatgggaaggagagccctgcaggcatggggcttccaggcttgggacacctgggcattcctgggccaggaaagcacccaagtaaacctgcaactcagaagccaaatgagacctatcccaggcaggtccgctctgcganggnnnntntcatcggcgtcaataggaggcatcggggacagccgctgcggcagcactcgagccagctcaagcccgcagctcgcagggagatccagctccgtcctgcctgcagcagcacaaccctgcacacccaccatggatgtcttcaagaagggcttctccatcgccaaggagggcgtggtgggtgcggtggaaaagaccaagcagggggtgacggaagcagctgagaagaccaaggagggggtcatgtatgtgggagccaagaccaaggagaatgttgtacagagcgtgacctcaggcctgccttggggctggggctggggtggaggccagccagtgtcctcccatagtggccgagaagaccaaggagcaggccaacgccgtgagcgaggctgtggtgagcagcgtcaacactgtggccaccaagaccgtggaggaggcggagaacatcgcggtcacctccggggtggtgcgcaaggaggacttgaggccatctgccccccaacaggagggtgaggcatccaaagagaaagaggaagtggcagaggaggcccagagtgggggagactagagggctacaggccagcgtggatgacctgaagagcgctcctctgccttggacaccatcccctcctagcacaaggagtgcccgccttgagtgacatgcggctgcccacgctcctgccctcgtctccctggccacccttggcctgtccacctgtgctgctgcaccaacctcactgccctccctcggccccacccaccctctggtccttctgaccccacttatgctgctgtgaattttttttttaaatgattccaaataaaacttgagcccac

SEQ ID NO: 660245 - DNA, 182 bp, Homo sapiens
ttacttgtgccttatatagtgacctgtatgcatttctccacgatgacaaggctggctctgactatgatccattgaaattgacctgtgcgagacgaggcgcgcatgacacagcgtgacgagatgaccctatggagctttaatttattagtgcagacagtacctacactgcgtacactagtgga

SEQ ID NO: 660246 - DNA, 444 bp, Homo sapiens
tctctgatgcctgcctctgcgttttctgtatgctcacattctttcactgcttagtttcctcagattcgaacgggagagaaatgctcatacatgatccaccagcccgtgtgggattccctctgcccttctggtatctgaaggctgtgattcaaagatcccccctgcaaccttcccacaaatgaaccaactgattctcacaagcgaagggagaattgacacctcccattgagggacaaaaaaaagtcacactctggcctgctggggagtcacctgtcatttccagctcatcttcattgttccatagttagtcctattctttaggtgagaatattaagactattaaaagcttctatgaggtgcactatgtgtgtctctggggtcagtcttgtgcttgacacagcgaaagctcattctagttcagtgtgaaaaaccagaccttaccaa

SEQ ID NO: 660247 - DNA, 500 bp, Homo sapiens
ccgtcagcttgtgcaaatgttaatctcagatgacggtatcatcctggaccctccttgagtaatatgagagactacaacacagagaacaatcaaagttgccccccaatgctgaacaagttaagagcttcatttacaggctgaatttcaaagaatgtcagctctgttgaaccaataatgacatctgccagtcccacgatgttttcaggacatacggacaacaaacaggattggcatcctgacaggtagaagactcagatccaagccttcttgttgccaaacttagaagaatcattctgctttgttaaagatactcccctaaaaaaatacattgcagtttctgggagaatactccatgaggtagaacaatacagcaccttgggagagtctcacaagagctttcccaagtgcaaggcataatctgacacacaacagggaggaagaaagctgggtgggtccacacagtccagttgaaaaggtacttgagagctggtaggcatgag

SEQ ID NO: 660248 - DNA, 539 bp, Homo sapiens
catcccctagtcttttaaaattatcctttgtttacatctcaaaaaagagttagtgacccgctatgtcacatatttaaactgttcgctaaagcggtgtatccttcccttttttgcgggcaattctgtagtcagcagcctctctgatttagtgctcctcccacaatgctcctgccagttgtggtgagtttgaatcaccgagccctcgtgacgcataatcgtgcttcctacagacaacgcatggttgtaaatcgttttataatacccaaatacatatttcttctagatgtgctgtgctcccgcctatagtcaaaacacttgaggagcctgagtcactcgcgttcattgatctcgtgagtccctagaccagcttcgtccacaagaagaaacatttccattctgtacacacaaaaagcacccaggtttggtgcagagcatcggtggtgtaaacaacacaggtgttcgttttaggagaatctctttttcttaggtgcccgtgtttgcttgagcccacattaaaaaaactcgcgtgcaagcagatc

SEQ ID NO: 660249 - DNA, 133 bp, Homo sapiens
ctgcgttgtatggccgccggattcacattaccggcagcatcgttgaggatgccaatattgcaacggcggccgaggtgactcgtgcccgcgagttcgtgaaagccttggtgttagaccttctggcaaagggtgc

SEQ ID NO: 660250 - DNA, 543 bp, Homo sapiens
  misc_feature (500)..(500): n is a, c, g, or t
cccaagtagctgagattacaggcatgtgtcaccatgcccagctaatttttgtatttttagtagagagggggtttcaccatgttggttaaagctggtgtggaactcctgacctccagagatccgcccgccttggcctgccaaagtgctgggattacagacgtgagccaccatgcctggccaagataacagttttttaagcatatccgtaataccatgtattctgcctccccaaattttcttactatcatttaataactacacaattcaaattttcctattgtctcagtaaatctttcacatttggtttaacaggatccagcaaatcccatgcattttatttggttactgaggtcttttccaaaccagtaagaggcagttaattccctgtttaattcagtgaagcagagagcaatgtttttctgaggaagatatttaagtagtttaaaatcactgctttaaatatggagaaattcaagaagaaatcctcatatgaaaagtcnccaattgatagcgtgttgtaagaaatgtaattgtacctgatgc

SEQ ID NO: 660251 - DNA, 253 bp, Homo sapiens
attagaggatccgggatgaggaagtcactgctaacaaccttctagacaagtcaatgattgtgattttaccacatagcacctttttactcttaagtcaccatctcctttctctaactgtgaattcttttttttttgggagacaaagtcgggtccggtgggccaggtgggagggcaaggggggtgatctcagcaaccttggccttcccaggttcaagcagattctcgtgccttcagcctcctaagatagcgggaa

SEQ ID NO: 660252 - DNA, 173 bp, Homo sapiens
  misc_feature (123)..(123): n is a, c, g, or t
gatccgtattgcggtgctttccagaagctttgtaaatacagctttagaattcagaacatttccatggaattgaatatcaccggtgacggtttgtgctaaggttaagccaataacatttcccanacacactgaaaactgttagcaaaggtgaaaaatgcaggttggagttccaa

SEQ ID NO: 660253 - DNA, 900 bp, Homo sapiens
  misc_feature (33)..(33): n is a, c, g, or t
  misc_feature (82)..(82): n is a, c, g, or t
  misc_feature (84)..(84): n is a, c, g, or t
  misc_feature (89)..(89): n is a, c, g, or t
  misc_feature (92)..(92): n is a, c, g, or t
  misc_feature (105)..(105): n is a, c, g, or t
  misc_feature (134)..(134): n is a, c, g, or t
  misc_feature (145)..(145): n is a, c, g, or t
  misc_feature (149)..(149): n is a, c, g, or t
  misc_feature (161)..(161): n is a, c, g, or t
  misc_feature (243)..(243): n is a, c, g, or t
  misc_feature (268)..(268): n is a, c, g, or t
  misc_feature (336)..(336): n is a, c, g, or t
  misc_feature (338)..(338): n is a, c, g, or t
  misc_feature (340)..(340): n is a, c, g, or t
  misc_feature (392)..(392): n is a, c, g, or t
  misc_feature (415)..(415): n is a, c, g, or t
  misc_feature (442)..(442): n is a, c, g, or t
  misc_feature (453)..(453): n is a, c, g, or t
  misc_feature (469)..(470): n is a, c, g, or t
  misc_feature (473)..(473): n is a, c, g, or t
  misc_feature (475)..(475): n is a, c, g, or t
  misc_feature (482)..(482): n is a, c, g, or t
  misc_feature (485)..(485): n is a, c, g, or t
  misc_feature (490)..(490): n is a, c, g, or t
  misc_feature (493)..(494): n is a, c, g, or t
  misc_feature (496)..(496): n is a, c, g, or t
  misc_feature (503)..(504): n is a, c, g, or t
  misc_feature (512)..(512): n is a, c, g, or t
  misc_feature (514)..(514): n is a, c, g, or t
  misc_feature (527)..(527): n is a, c, g, or t
  misc_feature (529)..(529): n is a, c, g, or t
  misc_feature (578)..(578): n is a, c, g, or t
  misc_feature (585)..(585): n is a, c, g, or t
  misc_feature (605)..(605): n is a, c, g, or t
  misc_feature (609)..(609): n is a, c, g, or t
  misc_feature (617)..(617): n is a, c, g, or t
  misc_feature (621)..(621): n is a, c, g, or t
  misc_feature (632)..(632): n is a, c, g, or t
  misc_feature (641)..(641): n is a, c, g, or t
  misc_feature (659)..(659): n is a, c, g, or t
  misc_feature (673)..(673): n is a, c, g, or t
  misc_feature (676)..(676): n is a, c, g, or t
  misc_feature (694)..(694): n is a, c, g, or t
  misc_feature (696)..(696): n is a, c, g, or t
aaataaataatttaaccatctcaaactgcattnacccctgccccagccctgattgaccccacttcttttggccaaaggtttntnggctntgntgggaccctattntcagctccccgggaggccaggttcatgcnaggtccctganccancccccttaagcnagctaggtagggtccccggacaccctgggcacacagacgagatgcagggacagcaacagggaagggtcacaaaatgccagcncggtggccctcggacgctgcaagtncgttcagctgccagccctcctgacctcccagaaacactttcctggagcccaggaaggaggatggtggnangnagcggaaggtgggcagccccacagtccacacgtggccggccctgctccagcntcctagctgttatccccattttnacccgggccgcggattaggcgcttatngccccgcttgntccctgggcccttggnnttngngaaggcntgnttganggnntnttgtttnntgtgcacntngtcgtataggaantntgctgttatttcttctccatcgccaatttcaatttttttttttattttnatatggnatttctgttccacggatttnaggnggcggctntttnagctggatttnagcattcgntccttgatgctgcacttntaccccggcatggngtngatgaacactacagattnangggggtcgccctcatgggtgtgcttgttgaggaagaagtggtagcgggcagcatctcggggcaccggggagggcagctgggccacatccgtgggctctgtgtgcaccagctcaatggtttcccgctctaggtccagcttcatctggatgtagttgaccattttctgcttgagctgctggagtgcccgctgggcctcaggctgca

SEQ ID NO: 660254 - DNA, 534 bp, Homo sapiens
agaaacagagtctcactatgttgccctcgtggtctcaaactcctggcctccggagatcccacagtcttggtctcccaaagtactgtggttacaagtgtaagccaccacatctggctctcactgattattctttgtcactttatcttgctttcctttgtagggcctctatatctgttctaagattatgctgtatctctcatccgtgtatagctcttcttttgttttcccaattatattttatatatttatttttgagacggagtctcgctctgtcgctcaggctagagtgcattggcacaatctcggctcactgcaattgtaagctccacctaccgggttcacgccattctcccgcctcagcctcccgagtagctgggaccacaggtgtcctccaccacccccggctaattttttgtattttttgtacagacggggtttcaccgtgttagccaggatggtcttgatctcctgacctcatgatccgcccgctttggcctcccaaagtgctgaagcaggagaatcacttgaggttag

SEQ ID NO: 660255 - DNA, 746 bp, Homo sapiens
ctaggtcagcttgctgccctaggctccgtcggtagtcagggctgccagacggcaccacccagcagccagcaagtccaactaacaagaaactcacccccaaggggcagtcggaggggcgtggccagcagctgcgtagaactgaggaggaaggagagaaggggaggagggcggggggcacctactacatcgccctccacatccctgattcctgtgttatggaaactgttgccagagatgtcaggttctctcggagtatctgggaactgtgccggtttgagtttcctctaggctgctggaggataactgtgactctgactggaaagggaaggtcctgacagacaaggtagcccgtggccagaggcttgtatgtctttcggtttgttatgaggtgggatatccctatgctgcctaggctgaccttgaactcctggggctcaagcagtctacccacctcagactcctgtgtggctgggatgatagattggagccaccatgcccagctcagagggttgttcgtcctagactgaccctgatcagtctaagatgggtggggacgtgctgcctgctggggctgtcacctgtcccggatcccttgaatggacctcctgtagcgatgactcaagtgtctcagtccatcctgagctggcatccaggatgccactctgtgggcacgctgtgggcggtgggagcttgattctcagctcttggtggatctgttgtgtctgtggagagggttgagtgctgga

SEQ ID NO: 660256 - DNA, 521 bp, Homo sapiens
  misc_feature (57)..(57): n is a, c, g, or t
ctgcccgtgagggactttgtggcacctctccttgctcagccggcttggagccagtcncctcctccagggtctaacgcgctcgcgttcattcggtgggagttccccaacttcaacagccgaagcaaggacttgctgggtcgctttgttttggccccgcgacacatagtggctgcaggcttcctgatagtggccgtccccttctttgagtggctggccctccagtttgaatggctggaaggcgccttcctcaaggacctgttgcgccaaccggtggctttggcgctggcccagtgccttgtgcccgcagcttgggctgcgtgcctctcccccgggggtctttctgtgggcggcccttaagggtcccccttgagggcaaacctctgtgcaggaccttggccagagtggggagggtggccccccccttttatgggacaaaacgtccttttgtgtataataaaccttttattttggtgttggacccctagagacctttccaaaattagtaaacctataaaaagtca

SEQ ID NO: 660257 - DNA, 308 bp, Homo sapiens
  misc_feature (83)..(83): n is a, c, g, or t
agaaggaggacatgtgacccaaaagtcagtactggtctggaaacataagtgagacccatataaaaaagaaagatcaagcatgntgaactgaaaattgaagtgaactgtgaatgttcaacaggctggttgcagaaatttaagaagagatatggcattaaattattattttttatttatttatttttttgagacagcatctctgtcacccaggctggagtgcatggtgtgatgataggtcactgcggcctaagaatctcctgaagacacgaaatagatccccatcaaatagcctaccaagaaaaaaacca

SEQ ID NO: 660258 - DNA, 478 bp, Homo sapiens
caacatggtgaaagctcgtctctactaaaaaatgtaaaaatcagctgggtttgatggtacaagcctgtaatcccagctactccggaggctgaggcaggagaattgcttgaacctgggaggcagaagttgcagtgaaccgagattgtgccattgcactccagcctggacaacagtgagactccttctcaaaaaataaataaataaatagaacaaatacaaaagaagagagaatggtaaaagtgaatgaattgcgctacccgtcgtctgcctttaacagttagcacatcacaacccctcattccaccgcttcattctcctaccctcatcttggattattttgaagtgtatcctagctattcatttcaattgtaaatatttcagtgtgaatcataaaaataaggatctctttaaaaagataactatagtactgttattatcatactaaaaataaacaattccatattattgtcaaatatat

SEQ ID NO: 660259 - DNA, 381 bp, Homo sapiens
  misc_feature (353)..(353): n is a, c, g, or t
gaatgtttcttccatccttataatccagtcatctgcaacctcagtctcccaggttcaagtgattctcctgccttagcctcccgagtagctgggattataggcacccaccaccacgcccagctaatttttgtattattagtagagacagggtttcaccatgttggccaggctggtctcaaactcaactcctgacctcaggtggtccacccgcctcagcctcccaaagtgctgggattacaggtgtgagccaccgcacctgggcctctgtcctcttttagtctagtgtctggttttctaggcaaacagtaaatttaaacaagtaaaactattatgggttccattgcttacaaaangatttttcctttaacattcttatcatgg

SEQ ID NO: 660260 - DNA, 1041 bp, Homo sapiens
gagcaactttatagtgaatttgcagttcaagcatgctaaagattcaagattcaaagcaattagagaaagatgaaagaccgcagcaagccgttgtttcaaatgcagttatgtggccgctgctcaggcaagcacacagcagaaagcaagcattcgcacagacacagaggtgagcaagcattcaacatcggcatttcgtttgacactcattcatctcaatccatcactatggaccagtcagtctacgatggcagacaaagtacaaagcacaaagtcagcaaagtagatcccacgtatacaaagccagtagatcagttcatcacatgagcagaagaccttcgtacaaaacgagatcacatagcacaaacacatcagccgaagcaatttaaggactccaagcacaaaagcaacacaggcagctatgcaacaggccaaagcccagcaatagcaggccaaagcctatcgaagaaacgagcaaagggcaggttcacaaaggcccagttcagcaacaacacaaacagaaaatagcatcgcagcagagagcagcagcacgcaaacggaagaagaaagctatcgcagcaataccaaaagccacaacaagaacatggacaatgggaacagtacctatacaggagggtagacaatggaactggataaatacgataaggaaccacaacgcgaaagaaggatcaaacagacaggagaaatacacaggacacccataacttagggcaaaaagaaacaagggacgcacaagacagaaacacaaccacaaacaatgaaagccaccatcacgaaagaccacacacccaaaaaacacacagaacgaagaaacaacatataagagccaaccattcctggggaatgacaaagcactactggccaagtaaacactcaacacagtcaccaaagagggcaacagagaggtaacaaaaaacaacacaaagaagaggcaaagaacacatagaaggaaacatacaggaacacaccacaagtcgacaacaggaaagaaaacacagacgcagcaaaacagaaagaaaacaa

SEQ ID NO: 660261 - DNA, 502 bp, Homo sapiens
atggggcttccctggcttgggttgggcgactgtgttggcaaggacttgcagtatcattcacgtttgcatgtgttttgtaacatgttgtggtggccgctgctctcggagagggccttgccgttcgtggaatggtccttctttcagtctaccttgtgcttccgtccatttggccgactgtgttgatacgtatgatgaaccatgccccatgtcgtgacttggaatgccctggagagaacacctggccacagcgtctggaaactccttatctaagaagagggacagactcatgcccacatgatgagttctgttgagtaccaaggtagcagaaaaggggagctttgaactccatttgggagtagccagggaagatggcctttctgcaagattcttgagggaatgatcaggcactcaggcctgggaggggagaagacatcagacgtcaggggatggtcagatgcctgtgcagaaggtaaaatgaaatctgtcagataaaatctacaaa

SEQ ID NO: 660262 - DNA, 159 bp, Homo sapiens
cgtatgtgtgcgcggtggcactggctggggtaatgtctgacgtcagacataaggagctcatctggcaaatacgccatgcgagactagtccacaggcttccaggagggaacaacagcaacaacactgcaagcaagtgcatgtcggatgcaccagtgacag

SEQ ID NO: 660263 - DNA, 182 bp, Homo sapiens
ccacagacttattctttaatgtgattttggcaagggctcactcccagtgactctttggatctttcttactctaagtagatagggacagctgtaacgaagagacttggagggcaaggcaagggaattaggacttaaaccttaaccaaaggggccgagagaatctttaggtaacttggagggcg

SEQ ID NO: 660264 - DNA, 468 bp, Homo sapiens
tcgcggccgcgtcgacggctgagtaggtctgtctccctgcctgggggtgtctacctggctgagtaggtctgtctccctgcctgggggtgtctacctggctgagtaggtctgtctccctgcctgggggtgtctacctggctgagtaggtctgtctccctgcctgggggtgtctacctggctgagtaggtctgtctccctgcctgagggtgtctacctggctgagtaggtctgtctccctgcctgggggtttctacctggctgagtaggtctgtctccctgcctgggggtgtctacctggctgagtaggtctgtctccctgcctgggggtgtctacctggctgagtaggtctgtctccctgcctgggggtgtctacctggctgagtaggtctgtgtccctgcctgagggtgtccccaccctgagatggtcctatatggggtctttaggtgttgatggttgttttataaca

SEQ ID NO: 660265 - DNA, 138 bp, Homo sapiens
ctgaggatcccataggacgatgtgcagagaaaacttgtcgatatacatctttgaatatgacaaaagattgccatgtatggagaggagtttattatctatgattacaataatccattggacttacccgaaagaattgct

SEQ ID NO: 660266 - DNA, 150 bp, Homo sapiens
gaatgactggatatccatgggaggacacatggcttccttagcggtatccaacaggcctaagcccatgctattgattccaagccgttgtggtcacagcatctggggtcttcactacgggagtgtgaggaaatcaattaattggaggagctg

SEQ ID NO: 660267 - DNA, 1363 bp, Homo sapiens
  misc_feature (323)..(323): n is a, c, g, or t
ggctgcccttccatgaaacatgagatgcttcagtttcggagaaacttatttagatgctcacttttgctgtacaggagcttgaatattaaactaggactacacagattaatgcgatcaacgaagttgtttaatggagagcaagctgacatacacggttaagtcgatgagactcatggccttagagagatctcagatctctgctggacttgctagtacataatgagacaatgtggtaccatgtatctaaccagtctattccagtcgctggtacagcgaaggcagagtaatacatttactgatggtagtagtactgagacttcgcnacctagagcatgtataataccgaagtggtcatgtgagacaatggcacaagaggtacctgcacgtacattagacacaccgtatcattcccatattacatacgttgtcacgcgatatagtagcgcaattagatcgtgtcacaaagcaaccggttggactagttaaagccctagagcctgtaccctcatttgtattcaatggcataggaacgggaaaacaccaatgtggaacgtcaaacaagggtcggtaggagttatagccttaaatcctttggggccatggcagggacacttttttggtgccccttaagagtgggttcccgccaccctttggggaagacaccatttccttcctaaaaggaccgaaacccatggtttgggccttaattttccttgcctccaaatcttggagggagaaaccacccccatagggtcccgtcaagtccggtacgacacatgcggattcagagcaccactagattcatcaacatatgagcactaggattattcatatacaccccagagagtctcacaaccggggacgaaacccattcaaattataggcgatcaggaacagacattacgggcacaaattcatacagtataacacaatatcactacaggaaaacgagaaggagaatacaacgccatacactactactgcagccagttttaatgcgcccacattattaccgtgtcaagagggtgtgcaacaacaacgaggccgacaaactcgccgaaaatctctgcagtgcccccggcaagttcatgctcccccagattaaaacccattggtcgccacgtcgggacaccttacttccacgtttctctgccaatcagcacatgacgcagaatacaaggtgtaaattatgacccatattattacgttcctaaataaacactacgctcacaacattttacgcccataggatacaagaataaaaaggaacaattaggagatctagtatgatgcacaagttgcatacacaggaataccaaccacgcacatgattggtgcgatatctcacctaggtatgaagaga

SEQ ID NO: 660268 - DNA, 102 bp, Homo sapiens
cctttaagcacagggaggcagatgttgcagggttgcagtgagcaagattgcatcactgcactccagcctgggtgacagagcaagtctcctgccctcagcctc

SEQ ID NO: 660269 - DNA, 174 bp, Homo sapiens
agtacagatacgaagtcgagcgcggaccagaggatgagagaacccccctgtctctctctctccgtctctctctccctctctttctccgtctctccctctgtctctctctccctctctctctctctccctctttctcgatgtatggatttgtgcctaacacccagacgtttatga

SEQ ID NO: 660270 - DNA, 197 bp, Homo sapiens
gggtacttgaagatagtaaaatatttctacaactatatttcagaatctgtcagggggcccagaacatcataggacttggtcaatacagaagtcgaggagttcccgtcgtggcacagtggttaatgaatccgactaggaaccacgaggttgtgggttcgatccctggccttgctcagtgggttggggatccggcgttg

SEQ ID NO: 660271 - DNA, 559 bp, Homo sapiens
  misc_feature (522)..(522): n is a, c, g, or t
gtccatccgtggatgaacagataaagcagatgtggtctatacataccatggaatattattcagccttaaaaagaaggaaatcctgtcctatgctacaacatggatgaatgttgaggacattgtcctaggtgaaataatccagaagaaaaacacaaatactgcatgactccacttacatgaggtccctggagtagtcaaattatggaaacagaaagtaggatggtggtcagggtagcgggagagggaatggagagttgttcaatggatacagagttccagttttgcaggataaaaaagttctagaggcctattacacaacaatgtgagcataattagcactggtgaacttaaaaatggtgaagaggataaatctttttttttttttgagacggagtttcactgttgttgcccaggctggagtgcagtggcacgatcttggctcactgcaacctctgcctcctgggttcaagcgattcttctgcctcagcctcctgagtagctgggattacagacatgtacctncatacccagataatttttggatttttaatagcgacat

SEQ ID NO: 660272 - DNA, 155 bp, Homo sapiens
gaggaggagttgagagaacggagcggacgcatggggaccaacatcgagcagatttttaggtctttcgtggtcagtaaactccgggaaattcaacatggagctttccatgtgtaaggaagtgaaggccagcgtgaatggtgaaacaaaatacaccc

SEQ ID NO: 660273 - DNA, 162 bp, Homo sapiens
cagattctcaacgggtgctgattccagacgggtgctcgattctcatacgagatgctacatgtacaaaaactagcccccatctcaatcatataccaaatctctccctcactagaacgtaagcgcttctcctcacgtccctcaagtcgttatccgatcatacgc

SEQ ID NO: 660274 - DNA, 129 bp, Homo sapiens
gagctatgctgagcggagcaggacctagactctatagccataccaggtctcatggaggggaacaacgctggaggagcaggactctagccctccacaggccactccagtggctcatgaaggggaacaagc

SEQ ID NO: 660275 - DNA, 430 bp, Homo sapiens
  misc_feature (362)..(362): n is a, c, g, or t
  misc_feature (413)..(413): n is a, c, g, or t
ccattgggccaggcgggtctcgaactccggaggtcaagtgatccacctacctcggcctcccaaagtgctgcgatggtaggcatgagccacggcgcccagcccagcttttcttcataactctcaactcttggcagtcaggcagttctcagagctaattagggcatttcaggtcacagtataagtggggtatgttttttctatggcttaaggaaaagcaagatagtaacgtataatacttttggtccaaaagtgcaagatatttgggtcggtgagtctcataggagcccctagaaataaatatagtttggcttttaactgttagaaacggcagcactctgagtgtcctatgcccaaagaagggncttctcttggtggcgtcaacatagcaggctggcttctttcggcctcagggntttacatgtgtggtttc

SEQ ID NO: 660276 - DNA, 448 bp, Homo sapiens
aactccataacgctcctcatgttaggctactaaccaacacactaaccatataccaatgatgcgaagaaaaaaacttctgagccttttaccactccagcctagcccctaccccccaattaggagggcactggcccccaacagggttttttgattaccatagttttgtagtttttgaaattcagaagtgtgagacctccaactttttctttttcaagattattttgtgtgtctacgtctattcctactgtaaatatatggtgtgctcacacgataaaccctaggaagccatttggatacataggtatggtctgagctatgatatcaattggcttccttcctattgataggacatagtggaagtgagctacaacgtagtacgtgtcgtgtagtcctgtggataattccaacagcttcctaagtgggatccctgcttcctgcttttcccctg

SEQ ID NO: 660277 - DNA, 486 bp, Homo sapiens
  misc_feature (151)..(151): n is a, c, g, or t
ccagttctatgagggggtgcatttggtgttcatgccgcccaacaccacccagatgtcacttggtcaagaaggtccggaccctccgtatgcacctgttcacggccctgcaattgttttgcctggccctgttttgggccgtaatgtccacagntgcctccctggccttcccctttatcctcatcctcacagtgccgctccgcatggtggggctcccccgttttttccccgcccaaaaaatgaaatgtttggatgctaacaaggcaaagccggtgttttatgagcgggagggtgtggacgagtacaattaaatgcccatgcctgtgtaaccccccccaagggacaaccaagggcccaatggacaaggggacaggttggtgggatggggttccccctcccatgcccctccctcctttttttttaagtgaataatttaaagttttttcctccccccctgcccctgcagtaaagtgttttggccccccccta

SEQ ID NO: 660278 - DNA, 458 bp, Homo sapiens
  misc_feature (17)..(17): n is a, c, g, or t
  misc_feature (104)..(104): n is a, c, g, or t
  misc_feature (129)..(129): n is a, c, g, or t
  misc_feature (181)..(181): n is a, c, g, or t
  misc_feature (255)..(256): n is a, c, g, or t
  misc_feature (279)..(279): n is a, c, g, or t
  misc_feature (325)..(325): n is a, c, g, or t
  misc_feature (339)..(339): n is a, c, g, or t
  misc_feature (361)..(361): n is a, c, g, or t
  misc_feature (382)..(382): n is a, c, g, or t
  misc_feature (392)..(392): n is a, c, g, or t
ggttgctgctgcccaangaccgcggagtcggacgcaggcagaccatgtggaccctggtgagctgggtggccttaacagcagggctggtggcatggaacgcggtnccagatggtcagttctgccctgtgncatgcatgcctggaccccggagagccagctacagctgctgccgtccccattntggacaaatggcccacaacacatgagcaggcatctgggtggccccatgccaggttgatgcccactgcatcatgnnggccactccatgcatctttaccngtctcagggactttccagttgcatgcccctttcccagaggccgtgnattgccggggatgnccatcacttgctgcccacgggntgtccacttgcagtgcagacngggccgatcntgcttccaaagatcaggtaacaactccgtgggtgccatccagtgccctgatagtcagttcgaatgc

SEQ ID NO: 660279 - DNA, 1783 bp, Homo sapiens
  misc_feature (374)..(374): n is a, c, g, or t
  misc_feature (1372)..(1372): n is a, c, g, or t
tgtgcaccagatactgttacacatagcggtgtctcactcgtgatgtaggttgtattaaccaagcagtctgtccgcatcacagtccgtcggcggtgattattttttataagggggctctccatccataggcaacctcccatataagaatgggtgcctcccccacggagtcttctcatcaccggaagagtgtgttcttcccccacgcgaacagacgaaaagtggtgactgatactgattcgactacataccgttgttacattcatcccccttgctcgccgcggagggaattattcttttctcctccccgccccgcgcgtgatattatttatggatggcttggtgttttccgcccaccgcctcccttgtttgggggntcgcacacccccacacacaacgcgggtgtggtgttggtgagacaccaaccacgttaggtgcacgtctggtggtgtatactcccccgtcgggggggtatcccccctctgtggtttattatataatcaccctcgtggtggcgcgtccgtttgtgtttccctcccactgtttgttaggaagcccacgttatggtgtatgtctccctccctggtcgtgattgttttatttaatgaatttctcatcaatatatgactctcagctaatatcaagaagtgggttctctattcctcggggaggttgtttcaatcaataaattgagttaataagatgatttagtaacccctgctcgctaataaataacaaattgggggggccgagcaataatcttcacatcaagttttaaagcgacgtaccacacaagatagagagtcgtgttatgtgtagacacagttactttcattttgtggtgtgaggcgctaccccatcacggggtggtgtttatgattcgcgtctaatataagaattactccccccctcggttgatgtactaccacacatgtttgtatttgtgggcccaaacctctatatattatagccgtgtattagtatgtggtttctactctcgtggtgcgtctactatatatagagagattgccgcgcgggggagaacacccaccaccccactcgcgcgcgccctctgtgttgagagactggttgtcccacctcgccgccctcgtgtaatgatataatacgctcctgtatatatatcatatatataatatatcgcgcacacaacacacacacatagtggtgagagatatatatgtgtgtgagagccagcacagcagagagatatatagagaggggtgtgtgtgtgacacacacacactctcgagtatatatactcaccctgctgagaggagtagtcttttgtgtgtgcgcgcacacacacaccacacacacagtgtttgtttcttatatataacacacagagagatantgtgtgtggtgcgatattgttacacacacactttgtttgtgtttcgccccactacagcagagagagaatatatgtgtgggcgacgacacactcacattgtttctctcacagagtgtctctcccgtgtgtctctctctatgatgagaggtgttgtctcccaccggagaacacatctcacgcacagacccttgtgtgtgtacacacacaataagaagagagataacatatgtgggcgcctgttgttataacacacacaatatatgtgtgcccgcccgctattatctccctttctctctccctttttctctttttctcctgaaaaaaatatgagagagggggtgttataaaagctttggttccctttttctctctaaatacaaaaggccccccgaccccctttttttacacaca

SEQ ID NO: 660280 - DNA, 148 bp, Homo sapiens
gctggacccgtctccttctgctgctgtcctcctcctgctgctgacctcctcctgctgctgtcctcctcctgctgcttaatataacggtacatgtctattttgggggacatctgtatttatttgaggcaccaaagcagcaggaggagga

SEQ ID NO: 660281 - DNA, 611 bp, Homo sapiens
cgcggtggctcacacctataatcccagcacttggaaggctgaggcgggtgaatcacctgagatcaggagttcgagaccagcctggcaacatggcaaaacccgtgtctctactaaaaacacaaaaattgtgccgggcatggtggcagatgcctgtaatcccagctacttgagaggccaaggcaggagaatggcttgaacctgggaggcggaggttgcagtgagctgagatcgcaactaactgcaactccaggcctgggtgaacagaggtaagaactccatcttcaaagaaaaaaaaaaaagaaaaaacaaacaacaacatttggtggggcgcggccgtgggcccctggagaaaggttttgaagaacccatgtggggtgggcgggcggggcccccacgagcgggcaaaacggaaaccatgggggcaaaaatagggggtgtccccaaatagagagaaacaccggggggacaagagagcaaaagaggcgcgggggattccttacaacccaagttataaaacaaaaacgcgccgggggggaaaccccgaggcgcggtgctcctggaacaactctccaacgaggggggagcaccacaggaagggacacatcaagggg

SEQ ID NO: 660282 - DNA, 694 bp, Homo sapiens
  misc_feature (94)..(94): n is a, c, g, or t
  misc_feature (96)..(96): n is a, c, g, or t
gtaatacgtctatgaggtataggaaagcggtgatgaacgtgccaatcgggagcacggaccacaataggtgccaatgcagcagtcctctgagagntnagccatgtcttccttcgatgactccacagtccagtgctcaaccagctactagaccgagtgttcagggctgttgcatggagctggtggtattagactttgcaacttcgtggtcacctgctcggaaaggtcagacgcgtacacccattcctgatgacgaggctctggctacacgagaatgaatcacatggtcacattctcgagcacgggacagaagctgattagatgggcccatcctgcctgatgagcccaagtcttatatcacaacatctctgcgtggatgcttgcttcgattatcgtatacatgagaaagcagcaatctgagtaccggagacgataggatgccctgatggcctctagatgcagatagatccattatgttctaatctcatggggcacctcatgacacggggtccgacccgtcggcagagggtaaaataattcatcaacagtcgactggcgttgtaatgaagataccctgcgaaggagacttggagtgatgccaggcggcaaagggtcttggtgtggttacggccccatgaaaaccctaccggtacatcaatgattacgaaggcggatcgggaacctgattgaaactcta

SEQ ID NO: 660283 - DNA, 948 bp, Homo sapiens
  misc_feature (36)..(36): n is a, c, g, or t
  misc_feature (65)..(65): n is a, c, g, or t
  misc_feature (67)..(68): n is a, c, g, or t
  misc_feature (78)..(78): n is a, c, g, or t
  misc_feature (89)..(89): n is a, c, g, or t
  misc_feature (95)..(96): n is a, c, g, or t
  misc_feature (116)..(117): n is a, c, g, or t
  misc_feature (122)..(122): n is a, c, g, or t
  misc_feature (128)..(130): n is a, c, g, or t
  misc_feature (153)..(154): n is a, c, g, or t
  misc_feature (194)..(194): n is a, c, g, or t
  misc_feature (202)..(202): n is a, c, g, or t
  misc_feature (205)..(205): n is a, c, g, or t
  misc_feature (208)..(208): n is a, c, g, or t
  misc_feature (211)..(212): n is a, c, g, or t
  misc_feature (215)..(218): n is a, c, g, or t
  misc_feature (231)..(231): n is a, c, g, or t
  misc_feature (240)..(240): n is a, c, g, or t
  misc_feature (262)..(262): n is a, c, g, or t
  misc_feature (267)..(267): n is a, c, g, or t
  misc_feature (272)..(272): n is a, c, g, or t
  misc_feature (280)..(280): n is a, c, g, or t
  misc_feature (285)..(285): n is a, c, g, or t
  misc_feature (300)..(300): n is a, c, g, or t
  misc_feature (333)..(333): n is a, c, g, or t
  misc_feature (335)..(336): n is a, c, g, or t
  misc_feature (350)..(350): n is a, c, g, or t
  misc_feature (353)..(353): n is a, c, g, or t
  misc_feature (358)..(358): n is a, c, g, or t
  misc_feature (364)..(364): n is a, c, g, or t
  misc_feature (366)..(366): n is a, c, g, or t
  misc_feature (368)..(369): n is a, c, g, or t
  misc_feature (372)..(372): n is a, c, g, or t
  misc_feature (383)..(387): n is a, c, g, or t
  misc_feature (391)..(391): n is a, c, g, or t
  misc_feature (405)..(405): n is a, c, g, or t
  misc_feature (589)..(589): n is a, c, g, or t
  misc_feature (613)..(613): n is a, c, g, or t
  misc_feature (700)..(700): n is a, c, g, or t
  misc_feature (887)..(887): n is a, c, g, or t
  misc_feature (908)..(908): n is a, c, g, or t
ctaatgttctcacataacagtagaaaaccaaaattnggaggcatcgcttcaaagaatcgagaagngnngacaaaaaanaccttacatanattaannatgaatactatttatatggnntaaangcaaannncttttatatttcataagtaattnntagccaatggggtgtgggctaaagacattagtgaagaaangaaatgtnccnccnacnnctnnnncgggccaaccctnacagacccncaagataaaataactggttttngtcancctcnagagaaancccanaattatttcagtccntgacacgttaataccctgcatagattagaggcngnnggccacacagattnacnaagcnacagantngnnttncataagcacgnnnnnaccntagccacgaagganccaagccacacgtactaaaggttgaactcaaagatatgtacagggtattaaacaaataccaaggggaacagttaacttcaatacaaggtcaaaatcagcaacaagttctacaatccagtgctgatatcagatacaagcttcaaggacaatttcttttcgaagggttattccagtttggtgaggntagcatgaggtgtgtgcatttgcnagggggaaatttctattctcaattaacccatggagcaaatgctacgcatctgctgagtccgtttagagagcatttgcggtggacganggaggggcccgactcgtcgtactcctgcttgctaatccacatctgctggaaggtggacagtgaggccaggatggagccaccgatccacaccgagtacttgcgctctgggggtgcgatgatcttgatcttcatggtgctgggcgccagggcggtgatctccttctgcatcctgtcggcaatgcccggntacatggtggtgccgcccganagcaccgtgttggcgtaaaggtctttgcggatgtccacgt

SEQ ID NO: 660284 - DNA, 354 bp, Homo sapiens
  misc_feature (3)..(3): n is a, c, g, or t
  misc_feature (9)..(9): n is a, c, g, or t
  misc_feature (34)..(35): n is a, c, g, or t
  misc_feature (39)..(39): n is a, c, g, or t
ggnacccantaaaagaaaaaatcaactatccgannttcntattatttttatgaggctgatgtaggcggggaaagtttagctacatctgtgataaccatatttagcttacttacctgtcaggataaactacaaaaatagtagctttatgtaagtctcttccatgatacaatttcagttcacagaagattttactctctttgcattaaagtttcaaataatataatagtgaagcagatatacgaagaatatatctgaaggtggagttcaaacatctgacttattaataacctgtgcttgggaattcttgcttccagctacagctgtaaaaagttgtcactcactctcaccacgaca

SEQ ID NO: 660285 - DNA, 233 bp, Homo sapiens
  misc_feature (56)..(56): n is a, c, g, or t
  misc_feature (65)..(65): n is a, c, g, or t
tccatcttcacatggccttctcctctgtgtctgcctgaagtctcccttcatttctnttgtaaggncatcagtcattggatttagagcccaccctaaacccagaatgatctcatctcaagattacatctgcacagacgctatttccagataaggtcacagtcaaaggtaccaggggttaggatatgaacatatctttttgaaagacacgatttaacctacagcaggtgctcagg

SEQ ID NO: 660286 - DNA, 363 bp, Homo sapiens
ctcagaggatcctgagcgagtgcaatggctgtcgcattagatgatcgctgggtgttggctgtgcattagatgatcgctgggtgtttggctgttgcattagatgatcacttgtctgttgggctgtggcattaaatgatcactgggtgttgggctgttgcattaaatgatcactgggtgttgggctgtcgcattaaatgatcactggtctgttcggctgtcgcatcaaatgatcactcgtctgtccggctcttgcatcagataatcagctgggtgctgggctcctgcatcagatgatcacttggactcgcaggccctgtggctcaagatgatcactgggctcgagagcctgagccctgaagataa

SEQ ID NO: 660287 - DNA, 130 bp, Homo sapiens
  misc_feature (49)..(49): n is a, c, g, or t
  misc_feature (99)..(99): n is a, c, g, or t
ctcgaattcaagcttctaacgatgtacggggacatgcccatcgtcctanaattaattcccctaaaaatctttcaaatatggcccgtatttaccctatancaccccctctaccccctctatatccaaaaaa

SEQ ID NO: 660288 - DNA, 90 bp, Homo sapiens
  misc_feature (62)..(62): n is a, c, g, or t
gccacttcagggacagcctgggcccaggcacccagggggacggcggaagcgtccggcaccanacagaggtcgggggggcaggaggcgacg

SEQ ID NO: 660289 - DNA, 154 bp, Homo sapiens
ctgcgtcgcgagagtgctgtggcgccccggtgctatcttccgcagcgcgtcgtctccccaggcctggggggtgtagtccgcctgggcagtgatcttcttggcaggtgcgcccgccaggggggcctcatcgggttgccgacgtccgtcatcgaag

SEQ ID NO: 660290 - DNA, 630 bp, Homo sapiens
ctcgcaagtcacagcatcccccgtctgctatctcttgggagagtgggagcggaggagcgacgcaggccgacgcagcgggcaggcgagactctttgagtttctgtaaaccatggggcagaggctcctattactggtgaccacttgtctgtgggctctttcatgcgccgtgccgcacgatgcgttcctcgcctgagtggactgctaaggatcagacctgaacaagaagagcttgaccctatgaatctctggctgcagcaaaggccgcgaggcagcaaggcgccctccggctgaagagcagcgattcagacagcgacatcgtgcctcttgtcgactatctcaacacccagtactatggggtcatcggcctcggcacgccgccgcagaatttcacggtgatattcgacaccgggagctccaacctgtgggttccctcgtcgaaatgctatttctcgatagcatgctacctccaccccaaatacaagtcgagcaagtcaagcacttacaaagcagatggtgagatttgcaaaatcacatatggttctggtgcaatctctggatttttcagcaatgataatgtgtggctggggaccttgttgtgaaaaatcagaaattcattgagacaacacgtga

SEQ ID NO: 660291 - DNA, 379 bp, Homo sapiens
gccccagaaaaggtaatttccccttgtccccctgcccaggatcaaaaaaaaatggcacaaaaatggccaggcaagttggttcacccctgtaatcccagccctttgggaggccgaggcaggaagatcccttgaggtcaggagttttaaaccaacgtgggcaacataaaaaatcctcctttctcccaaaaaaataaaaattagccgagtgtggtagggcacccctttggtcccagctactcgggagggtagggcgggaggatcacttgagcccaggaggtcaagggtcccatgagctataattgcccccctgcactccagcctgggtgacaaagggaggccctggttttaaataaataaataaataaatcccctggcaaga

SEQ ID NO: 660292 - DNA, 716 bp, Homo sapiens
tattcgggaagctgagttaggagaatcacttgaacctggaaggcagaggttacagtcagctgagatcacaccactgcactccagcctgggtgacagagtaagactctgtctccaaaaaaaaaaaaaaaaaaaaaattcttgtccctggggtcccccgtggtggtacttgtgggggtgggattgaaacccaggaatttttgtgttggactcttaccctctagggctgaactggcctctttccaagcttgctttcacagggaagaagaaaatactgtccctttctgtgcctcctcatgctcagggccttgacacacagggtaaccgggtgacttacgagagttattggcaacaaaaccctccacataacaggaaaaaccttggccactgctaaattgtcatcctgtgatatatctctgcattggaattccctccccaatttactcagacctaggggtataatctcggggtgcccaagtgagtctgctcccacagaaccttcaaaatgctcacgggtcccaagcagtgcctcatttgccagcacagtttgacagttattttggtggggcaaggggcttcgtgactctaggatgggtcctctgaccctgcctttaatattggatccccgggttacctctttttactaaccgtttgaaattgagactgtagtcgctacttccctccttccattatactttgcgggacaccttcgaagggtg

SEQ ID NO: 660293 - DNA, 115 bp, Homo sapiens
tggtttcactactacctacgtatggggataggggtgtaggtgtgccttgtggtaagaagtgggctagggcatttttaatcttagagcgaaagcatatatcagctctgccagaggg

SEQ ID NO: 660294 - DNA, 153 bp, Homo sapiens
taggtcagacgcgcagcacggctcagccaggcagtggctgttctgactgccagtgcctgaagcctggccactgccctgctggctgatcatgcactggctgtcctgacactggctgcatgaccagtgcatgactgcgagagacgtagttccttg

SEQ ID NO: 660295 - DNA, 722 bp, Homo sapiens
  misc_feature (1)..(1): n is a, c, g, or t
  misc_feature (51)..(51): n is a, c, g, or t
  misc_feature (57)..(57): n is a, c, g, or t
  misc_feature (76)..(76): n is a, c, g, or t
  misc_feature (80)..(80): n is a, c, g, or t
  misc_feature (106)..(106): n is a, c, g, or t
  misc_feature (165)..(165): n is a, c, g, or t
  misc_feature (209)..(209): n is a, c, g, or t
  misc_feature (221)..(221): n is a, c, g, or t
  misc_feature (236)..(236): n is a, c, g, or t
  misc_feature (273)..(273): n is a, c, g, or t
  misc_feature (294)..(294): n is a, c, g, or t
  misc_feature (302)..(302): n is a, c, g, or t
  misc_feature (307)..(307): n is a, c, g, or t
  misc_feature (332)..(332): n is a, c, g, or t
  misc_feature (363)..(363): n is a, c, g, or t
  misc_feature (375)..(375): n is a, c, g, or t
  misc_feature (392)..(392): n is a, c, g, or t
  misc_feature (403)..(403): n is a, c, g, or t
  misc_feature (408)..(408): n is a, c, g, or t
  misc_feature (411)..(411): n is a, c, g, or t
  misc_feature (423)..(423): n is a, c, g, or t
  misc_feature (429)..(429): n is a, c, g, or t
  misc_feature (433)..(433): n is a, c, g, or t
  misc_feature (435)..(435): n is a, c, g, or t
  misc_feature (438)..(438): n is a, c, g, or t
  misc_feature (440)..(440): n is a, c, g, or t
  misc_feature (443)..(444): n is a, c, g, or t
  misc_feature (458)..(458): n is a, c, g, or t
  misc_feature (463)..(463): n is a, c, g, or t
  misc_feature (481)..(481): n is a, c, g, or t
  misc_feature (487)..(487): n is a, c, g, or t
  misc_feature (489)..(489): n is a, c, g, or t
  misc_feature (492)..(492): n is a, c, g, or t
  misc_feature (501)..(501): n is a, c, g, or t
  misc_feature (510)..(510): n is a, c, g, or t
  misc_feature (544)..(544): n is a, c, g, or t
  misc_feature (566)..(566): n is a, c, g, or t
  misc_feature (586)..(586): n is a, c, g, or t
  misc_feature (597)..(597): n is a, c, g, or t
  misc_feature (631)..(631): n is a, c, g, or t
  misc_feature (666)..(666): n is a, c, g, or t
  misc_feature (704)..(704): n is a, c, g, or t
nttattatttccaactgagacaaacatttttccaaagacagtagcacagtnattgtnataagcatgttaatatgtntatnttgcagaaaagaatatgctacaagtnatgcaattcacattttcaatagcattctgacagaaattaaagacaattccaattgtgtnaaacatttaatgaatagtaagttctactttctgcccttgggtanataaatggtgtntttcagtgaagtggngaaaaacagatcatgtgatggctgcttcttaacagtncccaccgccccaatgacagtnagcccctntggcngaatttctcagccatcttctgtagntccaaatccattgcagccaagttttcgagtncttttttctcgncctctgtcaggactgtntgggcagcccngtccnttncattttctgccncccggngggngngcncnggnnccccagaatcatanaagtntggaaactcagcggactncttccngnagngaaggagcnggtccagtngggccaccctgtcatattgccttttcaggtccancttggggaccctggcgaggttnctcttctcaaacccccagtncacatcctcanagaagggctttttctcccaccagttatagttgtnttctgggaagaaattcttctcgttcaagggcagcncattttcctcctcaccctcgagaaaattgttatttatnttgtctcttctttcaaaa

SEQ ID NO: 660296 - DNA, 382 bp, Homo sapiens
  misc_feature (13)..(13): n is a, c, g, or t
  misc_feature (18)..(18): n is a, c, g, or t
  misc_feature (205)..(205): n is a, c, g, or t
  misc_feature (259)..(259): n is a, c, g, or t
  misc_feature (289)..(289): n is a, c, g, or t
  misc_feature (298)..(298): n is a, c, g, or t
  misc_feature (371)..(371): n is a, c, g, or t
aatggccaaaatnttggntcactgcaacctccgcctcctgggttcagcaattttcctgcctcagcctcccaagtagctgggattacaaggcacccaccaccatgcccagctaatttttgtatttttaatagagagctaataattgtatatttaataaagacggtttcaccatgttggccaggctggtcttgaactcctgacctcnaggtgatcctcctgcattggcctccatgcactttatgtggagactactgccccnccgtggcctcgtgtccgcgaggccccagcncgttccggnaccgccgcagaccagctggcgggtgtggagaccaggctcctgaccccgccgatgcatgcagcgccacctgganacccgcggtcc

SEQ ID NO: 660297 - DNA, 317 bp, Homo sapiens
gctgcatgcttgttggtcgtctctacagatcccccatcatggggttctggaatctccccttcctccacagcaccagttaattaatctgatgtcgtctctctggtagccaaacagtttctgtctcccagccctctacgatttcagcccatattttacctcttaattgccttataagggtctgcagcttgttagttcagttactcacagccctcggtgccagatcaagcaaaggtaaaaagttagctactttatagccattattttcaccttaccctgtggccactgattttaactgtttaaacctatatcaagatgca

SEQ ID NO: 660298 - DNA, 233 bp, Homo sapiens
gtaaactctattttcttattatttcaaattattttaatataaaacttccccttctttccttccttcttccctccctccctccaggcgcgctgctgctgctgctgctgctgctgctgcttcttcttcttcttctttcttctttcttctttcttctttcttctttcttcttctttcttctttcttctttcttcttcttctcttttcttttcttcttcttctccttctccttttcc

SEQ ID NO: 660299 - DNA, 663 bp, Homo sapiens
  misc_feature (638)..(638): n is a, c, g, or t
gggctctgcttgtggctcgcggtggtggcttctgaggctgtcgtggtcttctgcgtggtcgcggataggggggccccgaatacccttcttgcttcaggtcttaagatagctggccggggtgcaataaggaagcttacaaacgaatggaagagcggagagtgaagaggaggagtccatagagtctttgtacgatgcccaccctgatacatcagtgttgtcaaatgccagaaagacagatatgccacttaccagctcgaggtaacaagctacagggtttttcaacatcctggcatcacaggtcaatcttcatcaggcgagtcaaaggtataacagagagtgtgatgaagaggaacacacgaccaagagctctcacgggttggcagaggagcaaaaggcgcgtcaggtccaacttcccgatcgcagacagctccgttccgtcgacgtgatgtgcgtcagcagtgttccgaggagcatgggacgagagggcctggctcacggtcttgggaactgactttccacgtcatggcaaagacttcatagcagttttggtcacattgaagtggtcccgatttgaaccagactggcacacgatggttccgtggcgaagtggcgaggtacgaaattgtagcgtccgcgtntggaatttggtgagcgtctactggg

SEQ ID NO: 660300 - DNA, 118 bp, Homo sapiens
atgcctgcggcgtaaaagatgatggtctggagcgggctgatatttattgctcccatgaagcgcttgtcatggattacgagcgcgccttcgtccatcttgctgaaaaagaaggggagca

SEQ ID NO: 660301 - DNA, 872 bp, Homo sapiens
gcttaaacatcacagatccatctgcggggtgcaatcgggctactgttagtcctcttgtaagatgcagtcactcctcctggtcacctagtgagcagggacatagccaggagtcaagtgcagtgccaaggttgcactgaccctctgataagtcactggtgctgatttgacctccgaactcattggttgtgcaaatgccatgtgcatcctttcctgagtgccatatgtgagggcttcctgccagctgagatctatgcaggccatcctctcaactaggtgccacatccaatgtgcggtcctcggtgcagctagtcagcagacttcacttgatgggtgtggtggggggaaggggcgggtctcagaaaatgctaggttcccaagttcccaccctggaacttctgagagggcgttgtgaccaatctgagatctcccttgatgcttatctaacaaatagtgtgaagccgactacatttagtaacaattcctgcctattaacctctgggcgagtatcgcatcgtagatttgacgctaacgcctagggaatagtgaacttgtacacgcagagagggccagctgacttgaatttcctagggctgttccctgagacacacggtcaaggtagacgtctgggaacacactactgtctgtacacctcttgaacggtgtcgaagtgtatgtgtatacactcaagttgagagacgcatagttgctgatgcgctaggcacagtcccccaaaggagcacttaatctgcttgcaagcagcattattgggtgagggaaaacttgtggctgcgagatttccagtggtaccactgtttccttatggctgagagttgaccggagagatcacttcacaggtagaccccttgtatttc

SEQ ID NO: 660302 - DNA, 1150 bp, Homo sapiens
  misc_feature (1149)..(1150): n is a, c, g, or t
gctgctgcccttcgtcctcctattcatcactggaccatattgagcaccgagatggtggatgtactgtagcgctttacctccacttcaggccgacttcgttggaagggatcccggagtctggtggtccggaatgacccgccagggatggctggacatagccctgcaggaccgcagcataccttgcccccctggacatgaggatctggggctcctgcttactatttgttagggcatgcatcagcactcatgtgcagctgaaagcagctgaaggcatggacatcccgggtactttggaggatccttcagagagtcactgatatgtggcctgcatctgcacctggacctatagcagcataggtgatgcggtactgggagcccatacccaaaggccctgtgttgtgggaggctcgggctgagccatgggccagctgggtgccgctcctctgctttgtgctccatgtcatctcctggctcctcatctttagcatccttctcgtctttgactatgctgagctcatgggcctcaaacaggtatactaccatgtgctggggctgggcgagcctctggccctgaagtctccccgggctctcagactcttctcccactgcgccaccagtgtgtgtggagctgctgacagtgctgtggggtggtgactaacctgggcacggacgtctctacttggtttcctccttaacctttaactgggcctgggtcacgggtttgatcagaagaacttcgtaactccgcggccaggtacaacgaaaactccacctgggtctccacggacccacggatgggaggcgaggtgaggagcacacactggtaaacaggccggacacgcctcgccagagaaacaaaaacgcaaaacacgaccggggagtaagccccagcggcacacatctagagtagagggagagagacccagcaagcagggggccgaattctactaggagaagacccacacagtacatcgggtgtaccagaggaacaggcagcgaccacacaggagagggagcggagaggtgtcacccgtgaagagaacccaccgagagagagagagccccaggacgatcgcagaagcgcgtgacgcgaagcgtggacccacatctagcgctccaccgtccgaactcaccctagttatctaccgnn

SEQ ID NO: 660303 - DNA, 294 bp, Homo sapiens
gggatccccttcttgtttgggggccagagtgaggaggaggggtccttcaccctcaatgccattaacaagggccccctgttgaagccttgggccctgcccttttcctagggccgagccctgcaggcttttgccctaaaggcttggggggggaaaaaggaaacccttaaggttgggcagggggggtttgtcaagcgagccctggtaaggataggcaggaggtgggcagggggcctggggggatgggactcggaaaagagcccttttccctccccccctttcccccctttagggcca

SEQ ID NO: 660304 - DNA, 248 bp, Homo sapiens
gctggagcataagggtatagcctcagcattatcacacagtggttggcacatcaatgaacttgggtgtcaggccagcacgaactttgttgtactgaacacgccatgcactccacgcagtctccattcaggtatgcatggggtacgttggcctaccagaaacatggcctccccaggcttcagggtaagcaggttccagaagtagatggcaaagcagacgatatcacctgggtactgctggtgcagctgta

SEQ ID NO: 660305 - DNA, 934 bp, Homo sapiens
  misc_feature (497)..(497): n is a, c, g, or t
agcggacttcctgtccctgcatgctgtgagggcagtgcagtgcagtgtcgatctgggaagtgttcactatgtactttccttctacaccgcctctaccagtgtcctcccaccccacccactcgagtgtgttatctagcttacttgagaccctgagtgcacttgtgcgtacagaagcgaagaatcgagaaatgtggtgaatgtgccttgtctgggcctagatcatggttgatccccatgctggtgtgctggctagctgaggtgcagtggggtgtgctgcgtgtgctcaagagaaacagcgcctcgcctgagaattggggaacccaggagatactagggcgccctagtgacctcgtgctaatgtagaggctactgatttggagtgtaccttctccattaccttggggacttcacgggtcttgctatcttagcacaacaagtgagcccaagggcgattgtaaccactggcaaagcagcctccaggagtggatagctcatgntggatccatgttgccttcagaccatcatctgccccacaaagcttgggtccaatcatccattgcatgctagtgcccagcattgggagggacaacaacccccctcagatcatacgtcagggatgttgattgcaacgttggcttcatcaattttgctgaacttactatgtacttgggcccttggataacaacgtgggtgggatgacgttgcaagcagcagagtggtggggccttcttgattggaaagacgttggcgcaccaataatggtggggcggacaaaggggcctattaacaactcccaagagccactttgccgagggaaaggccgaccgaaccaatatgaacacccggacacaggcataatacaccagcggggaaccgtaacatacgattacgaagaacaccaaaaagtgaggaacaaacatgacacaggtaaaga

SEQ ID NO: 660306 - DNA, 103 bp, Homo sapiens
agctgacttctagaggatccctatcgtattgagtggctgcctgcagaagatgtgatgaattatctgtagtacaagattatcttattcccctgccagtgtggag

SEQ ID NO: 660307 - DNA, 318 bp, Homo sapiens
gggctttaaaaccccccccccaaaagccccccttggggtttttttttttcataaagttttaaaaccggggccccccccctttgggttttaaaacccaaaaaggccaaaaaaacccctgggggggggggggccggaaaacccccaaaggggcccttttgggggggggcccttttttttttccaaagccccccttgggggggggttttttttttaaaaatcccccaggggggccggggggggccttttttttggtttcttttttttttttttcccccccaaaaagggaacaaaaattaaactttttgggtttttttttta

SEQ ID NO: 660308 - DNA, 619 bp, Homo sapiens
  misc_feature (427)..(427): n is a, c, g, or t
  misc_feature (465)..(465): n is a, c, g, or t
  misc_feature (582)..(582): n is a, c, g, or t
  misc_feature (619)..(619): n is a, c, g, or t
atcccacaggtgctgttcatccccaactttgacctggactgttgcagtgttttgtcgcagtgtttctccctttttttgtactgggatttctccccagaaacaaacccatatgtataaaaagtagttgggcttgctataaagatgactagtggaaacctcaatagaggtacgatttcctaaaataaatcttgttcagatattacagggcaaagtgaaacagcaaagctccctcctcagcactcagggtgcaggcctcacttttcctcatcttttcctcctgtggcctccatgtatcccaaaggtgagatgacatcgccccagattggtccggaaagtgcactggtcgtcactgtgggtgtaccctacaggagtctttcagatatgggaagctctggatctcactgtggatgtattccccctaggggtncccccaggttgtggagggaaaagggaagctttagttcntcactgtggttggcatcccccaccacgggttcagttcctgagggagggttatttgggtcatcactgtgatctacctcccaggggttcccaggttggtcctgaggagaagggaagttnagaacttcattgtgggttttgccccattagggtcctn

SEQ ID NO: 660309 - DNA, 150 bp, Homo sapiens
acaatgggctcagcgacgggaaatggcagttagtgctgaacgtctgggagaaggtggaggctgacatcccaggccatggcaggaagtactcatcaggctctttaagggtcaccagagactcttggagaagtttacaaagtcaaagcacct

SEQ ID NO: 660310 - DNA, 731 bp, Homo sapiens
ggaggcctttgcaaaagtgatctgcaactctttcaccatctgtaatgcggagatgatgcgaagtgggtgtgagggctatatcccagatatctctttgctcaatgcacgagtgtgtgaccccaagtgttcgatggtagtacaactgggcgccaagctcgttactgcagaagccagatcccgagaacatcagcaggtggggtagaggagctcaccgatcttaggctacgctgggtgtcactgcgtgatgaacccagtgcaggcagcgccgtgagagcaagcctgcagggaccagatactgctctctggaatgtgcactggttgtccgttcgcctacaatccgaggacaaggtatgcgtagatcatgcttaaacgtgtgtagtattgaaggcgaaaaggtcatggtggacagggcaaaagtttgccagatgaatacttcccccgtgtagaccacacatatggttggaataagtagagcatagtagaaggggccaccaacattgcgaaaaagtcgcgcgaaggccacggctctccgttggcccattgttggcacgaggcgccagaagtctatcacacgctacgacaaagtgtcttgaaactggactgtccccccgagtgattcaactaatctattcatggctgaaaggcgttgcgtacagagtcgtcggccatgtggagtggactgcaatctacaactgcaggggcttgtagggagtgaacgcctctggttctat

SEQ ID NO: 660311 - DNA, 214 bp, Homo sapiens
atcaccgtgacccatgtcactgtcaaaaccaccctacgggctgggagtggtggctcacacctgtaatcccagcactttgggagtccgagacggatcacttgaggtcaggagtttgagagaccagcccggccaacatggcgaaagcccgtctccactaagattacgaaaaattagccaggccgttggcgcactgcctgtaatcccagctattcag

SEQ ID NO: 660312 - DNA, 182 bp, Homo sapiens
actctaaggatcctcgcagaggcgtttagcaacacaaacccagagtcgaggccgcgttcttggtttgtccagatcgtcctgtgcatgttttgtctgatactggttttattagttacagcgacggggacacatggcatcttccacaggaaaggctctcgaatgcccatggcattgggcccggc

SEQ ID NO: 660313 - DNA, 222 bp, Homo sapiens
cttcccatctgtgcgctaaataacttgaggccaggttctctcagactttaaagccttggcaatcctatgcattgtattgtttgtgtgtagatgtgcagtttagaggggtagcttactctaaggtgtacataactccatcaataagttcagacatcatgttcactgatatacctgagtccatactccacagagccaggggtgcctgctcagagtcaggtctgc

SEQ ID NO: 660314 - DNA, 543 bp, Homo sapiens
  misc_feature (541)..(542): n is a, c, g, or t
gcataatcgtttccgccttaaaattcctaataaattgtagtatttgaactatattttagataaaaacatttttctgaaattttaatcgtactgcagaattactagtttagtttactaaaaccctaaaactttaaaaattacctttattcacaggaatttgatgtctcagatttccgtaagattgtagaatggaacttgttttttagaagacgcctcagccgcctgattatcatttttcaaaatcttaaatttaggccaggcagccaggcgcggtggttcacgcctgtaatcccagcactgtgggaggctgaggcaggtggattacttgaggtcaggagttctagactacctggctaacatggtgaaaccctgtctctactgaaaatacaaaatttgctgggtgtgctggtacacgcctgtgatcccagctactgaggaggctgaggcaggagaatggcttggacccaggaggcagaggttgcagtgccgagattgcaccactgcactccagcctgggtgacagagcgagactctgtctcanng

SEQ ID NO: 660315 - DNA, 125 bp, Homo sapiens
  misc_feature (30)..(30): n is a, c, g, or t
  misc_feature (36)..(36): n is a, c, g, or t
  misc_feature (112)..(112): n is a, c, g, or t
aaaaaaaaagacagccaaaaaaaagaaacnacaacnacaaaaaaaacacaacagtgtacaggtttgtaactgccaaaatttgatgattaaaacaagttttcaagtaaaaagnaaaaaatgaaact

SEQ ID NO: 660316 - DNA, 383 bp, Homo sapiens
accgggggctagttacgtggtaggtaagcttatatggcacatgatgaagtccacattcgtattctgcataatgctttctgataattccggagcattatactcatgcagcagtggtaggaagtactgatgtttttttaaaaaatgtccattcttggccaggcgcagtggctcacgcctgtaattccagcactttgggaggccgaggtcggcggatcacgaggtcagatcaagaccatcctggctaacatggtgagaccctgtctctactgaaaaaaaaaaaaattagcggggcttgggggcacacgtctgtagtcccagctactcaggaggctgaagcaggagaatggcttgaatctggaaggcagaggttgcagtaagccaag

SEQ ID NO: 660317 - DNA, 232 bp, Homo sapiens
gcagcatggtctgagggaccccgttcccaagtagggctgtcccaagtccccactcccatggtggccaggtttcctggccacttttgtatgatagcagatggatcaatattagtaaccccatcgcaatgattgaactgtgaaagagaggttcgcagggggtatctacctcagtgccagtatacttagtgatgtgttacccaggatgcagcaggtgtgtgcaggtatcttgctt

SEQ ID NO: 660318 - DNA, 128 bp, Homo sapiens
gatcccctgcgaacgactggcggttggtgacgacggccggttggacgaacggacgctggaggcccgggtgcggaagccagcggaagcggagcgctacaagctggagcgcctagccgaggcagagaagt

SEQ ID NO: 660319 - DNA, 134 bp, Homo sapiens
gagcggtctgacattgctcggatcccgtgttgctgtggctctggcgtatgctggtggctacagctctgattagacccctagcctgggaacctccatatcatgcaggagtggctcaagaaaaacgcaaaaagacc

SEQ ID NO: 660320 - DNA, 438 bp, Homo sapiens
atatacaattcacttaccattgaccaggcaccagctcagaaaatttagaactaccaataatgcttctaggagaccacagaatgtatttccagtggctggagtggcatgaaaggtattcattctattcacaacatatttacaagcatctattcagcactggctaaatttttatgctacataacataagtgaaaatatattgtgctcaagtcaagaaaaccaagctagcggatttctaaacgcaaacacacgatcccatagctagatattggtggccccctctgagatcgggggtataggtgtgctgacacttttttaaattattcaaacccgcttaaacggttttgtacatatcaaaatgtgctccttttaggataatagatcaaaatatttaatgcttctattacatctgctcatgtaggttttacaatattccatgt

SEQ ID NO: 660321 - DNA, 210 bp, Homo sapiens
gaagaagttaggtgtccagagcacgggactttctgctttcttaagaccggcgttcgcatggcccgaataaaggaacagagcttttacgtttgcccggcagacacgtgcagcttcgtgcgggcaccacatttcctgttttccattgcttattgcataaggtctttgtggagatttcaggtttgcttctgcaaggcaggcgataccgttttt

SEQ ID NO: 660322 - DNA, 1535 bp, Homo sapiens
gagatctgactcgtggtgccccgagttgtgagaagctgatgcccctggcgtgccttgtcctcctgtcaggctgcacgaaaaggagtgtggacagtctgttctagacgatagctagctgaagatccatatattgagctaggcagtagatggttagtgtcggcgagcaatagcatgaagtagttaacggccttatagctgtaagatcatagccaatgcttgaatatgtgggcgaagaattatgcatgagcagcccatagtggaggtatggaatatatgcgtgagctatttggatgacaaattggcacgtataggaaggcttcttcggcttgcataggtggccgtccaagcgacgtgggcagagtccacactgggcttgtcgactacgtacgaaaaagcctatccagtcaaacgcctccactagcactatgcgctaggtgtgtgccaaacgtccagacctatcattcccggtggccactttcgaaagtcgcagtcgcattgcagtgtagctctttggcgccgggacttcactagggacacaaattaggcaggcccttagcacaaattggactccaggtggcgataacgactcattatccgatgatactaggaaaaggaagtgggataagtgagggaaccgtcggtcggctctttctaatggccccagaatagggtctcgaggctcccaagtcggaaatgtggattcaatctggaaatacggtgcaagtagtatccctgtcaaggagaaatatctccaagttccaatcgcggcatacatctactgactcgccgaaagaggattgaccttgggcgacattaaccaccgcgtttgcgcacttggggcccgttcccgaacgaccgtccacttaggactcccacaagaacgagtgaaacgtaacctaagtattgtcatatatggactccccttcggatccacccctcaaatcggaaagtcctttgtataacagccatgtggccattatacagccaagtggccatggtggtcgaaaaaacgaccgacgggaggtcctataacggcgggaggcggatgagcttccaaaagtcgtccttgatcacgacttgggccaggggaacaatttggctgagcacaaattaggcgtcacacattcaacgaggagaggtacgcacgctgcacggggcgccattggccattatgtcattgcaaggccgtatactttaggactgttcaccacttggacggacagacacgggcccaccgagctccaccggacgagtcaccgaaccaacagacggacagggcggggtgaaaaccaacacgcgcgcgcctccagggctgataacagtccaaatccccgggtacagttagagcccacacagaggagactgcccaacaacccctgtcgagggcgcacaacgtagacaaggttccactgacagccagaggcacaggggtcacatacgaggggaacaccccagcacaagacgacaagcataaccaacacaaggagaacgttgagggcgcaaggccagccgctcagagctccaccaacaaccag

SEQ ID NO: 660323 - DNA, 302 bp, Homo sapiens
atggttagaatgataaattttatgttatgtgtattttctccaacttaaaaaaaaagcataaaaagataagccaaaattaaaaatcaagccccataatgtaagatagccaatatcatataaataacataaagaactcctacaaatctggctgggcacagtggctcacgcttgtaatcccagcactttgggatgccgagatgggcagattgcctgaggtcaggaagagaccagcctggctaacaaagcgaaaccctgactccagaacaagactccagccttactccagagcaagaactgtctca

SEQ ID NO: 660324 - DNA, 852 bp, Homo sapiens
  misc_feature (57)..(57): n is a, c, g, or t
  misc_feature (70)..(70): n is a, c, g, or t
  misc_feature (102)..(102): n is a, c, g, or t
  misc_feature (109)..(109): n is a, c, g, or t
  misc_feature (116)..(116): n is a, c, g, or t
  misc_feature (119)..(119): n is a, c, g, or t
  misc_feature (255)..(255): n is a, c, g, or t
ctggccgtgcaattgctggaaatacaaaacacatgttgatacagttcttgcttaccntcaaaagtttttngaaacatttgggaaaggggggactaataaacnatacttncattatncanaaggtctccaaatagattgggagaaaatcaaagccaaaattgagatggaaattacaaaagaaagagagcaatcatcaagcagccaatccagcaagagtataggtttaaagccctaaatggggggggggtctttaanaaattttatcttttgaaacacgttctgattaaccaagggtaggcgtgttttggttgctaaagaaaaaagcataatctttaaccaagtatgagtacttgctgggtatttagggaaaaatacattcaaaaagatgaaacacggaggattgggggatttctatctttaatatttttaagtccagtaattaccaaatattactatgtgcttaaaagattccctgggaggtggcgattatatgtgagtttttttcccattacttaatccctaaatcttcaagatgaacaaatattaatggcgataataaaaacttgggactctttaaaattggtgggaccatttaatttctatgtggacctcctaaattgggaaaagccctccaaaagttatttattagaaccaaaaatcctgagggggggggtttgacaaaatggttaaaaagcgcattttttaacacccaaggtcataaccagctttgctgggaataccaaagatggaaaccgcgtaggttgtctttagagatgataagaaattgtgctttagacctaacaggggagtagatttgactttaaagagagatgaaattgagatcatacctcc

SEQ ID NO: 660325 - DNA, 951 bp, Homo sapiens
  misc_feature (25)..(25): n is a, c, g, or t
  misc_feature (35)..(35): n is a, c, g, or t
  misc_feature (55)..(55): n is a, c, g, or t
  misc_feature (184)..(184): n is a, c, g, or t
  misc_feature (221)..(221): n is a, c, g, or t
  misc_feature (226)..(226): n is a, c, g, or t
  misc_feature (229)..(229): n is a, c, g, or t
  misc_feature (260)..(260): n is a, c, g, or t
  misc_feature (285)..(287): n is a, c, g, or t
gataaatgaaacatacattcttaanaccccccccnctcaactgtaaaagcatcanaaaatgcaatattaatcaacccattatttctaattgctgtattcatttccaccattaaactatttaagcatttcatctgctgaaagtccttatatacatggtagacggaatatttctccattaatgatngatcaaaatgaagatatttaaaaattaacaaaatcangccanggnaggaggatcactttagcccaggaggtccagnccagcctgggcaacacagcgggacnnngactccatttaaaaaattaaaaaaaaaaaaaaaaattttaacttttaaaaaattaaaatttacgcaaaatttcacttatcccagggacacgctgggcatttgggactcaatggacaaaggggcccctaaaggaaaataagggctagactggaatgtttcccataatttccacacaattaacagtccctttctatccagcttggccttccattaatctctagggtaaagctttacagggcaacatcctgggccattggcccaggaagtacctgagctaatcagtgatcgggaatgggcccaggaaaccggaatccattgggtgccctccacctgggattacaaagatatctgggaagttgtcgcacaaaacatcaggtccatgccctctcagagctcatgaggccttaaaacctacccttggaaccacatcaggtgccaaaggacagggatacgctacttaaacacccgaggcaccaactaaaggtattcggctaacacggtgtgttgttacccatccgatagcggatggggacacgacacagtggtcttagcccttgacacaatcagcggggccccgtgtatcaaacggcggggtgggctacagtgagacgattgtttttacaccgcagctcgaatttaggtgaagcattaaagtcagacaatg

SEQ ID NO: 660326 - DNA, 1032 bp, Homo sapiens
  misc_feature (938)..(938): n is a, c, g, or t
ggcggagggggagagcgcgggccgcgcgggggaaagcgaagagggggcgggccagcgagacgcgcgagagacacaggcgcgagcggccaggaagggctcaggccgaggacactttgacaggtgccggcagcggcaaacgagctgcggttgtgcatacagtgatccggcctccaaggacaaccggcaagtggtcagcgccggcggttggtcgcaacaaaagaatgtccaccacaagacggtccaaggtctggccaaaaccacagggaagtcatactcaccacggtggggcaggaatgatacgaggcgtcaacattcaaaaaaggggcccaccacacaaggtacaggcgaactggccaggtgagggagcaccccgggtgtaatatttggaccggccagaacggtgacatacgttgcaaaggcagacacctcctggcagactggcatggacaaatcgcaagacgaagcataccaaccacaggagcgggaccgggtccacaacacggaacaacagtccgtgcggctgggtgcccaagcggctggaacaaaggtcgacatcacgcctggccaaacagcggagcacaccaataaacacaaggggggcgagcatgtcgatccaccccaaacaagttcacaccccggaagttagaagacggacagcaaggggggacctcacaacgcaacggttggcaagccccacactgacaacagcacaccaccagaggccaaaacactggcaaagctatcacacgcgacgacagaaacgcctgctatctaagcaacaggcaggacggtcagacacggggacccggcaactccatgcacgcgcgctggcaggccgtaacgacagccagggcggaagacaaacagtaggggacacacggccgaacgcaaccacagcagtacgcaccaggcggctctttcaggcgcaacggcgacgntatacagtgacacagaactaagccgatcgaggagagcgcatacaacccaacagcgactgcttagagcgactgaacgcgaacacagcgacgagct

SEQ ID NO: 660327 - DNA, 326 bp, Homo sapiens
gtcttctagagaatagacctcttagagtcatctttcactcctttcttgctctcacatcctacatccagtctgtcagcaaggcatgttttctcttccttcaaaatatagccagaaactggagttcccatcgtggctcagtggttcacgaatccaactaggaaccatgaggttgcgggttccatcccttgccttgctcagtgggtaaacgatccggcattgccatgagcctgtgtgtaggttgcagacgtgggctcggatcctgaggttgctgtgcctctggtgtaggctggtggctaccgctccgattagaccccgagtatagcgat

SEQ ID NO: 660328 - DNA, 1112 bp, Homo sapiens
tgactctctgtgttttgttctgtctgacgatatgttgtgtcgcgcacagtctcagggctctgtgttgggtgcacgcgctgtgttccgcctctttgttggggtacccgctgcgcgcttgtcgccagaggttcttttcggcatgggcgcccctgtgcccccctctttgtggtctgccggcgcaatatactccgggctaccggttgtccgagcacgcgtggctacttgtgggattcccctctttgtgagagctcgcatttcccgcccctttgtggtgcaccgcgttagttccccggttcgcgagctagcacggaatcactgggacccctgagttgagggtccatggagcccagggtgacccccgcgaattgcagccggggcaacaagagcgagactcccgtcttgaaaaaaaagaaaggacccccctgttactgtcctcatcatccccagtttgagcgccagtgctggaatggggaagccctcttagaccctagaggttggaagacgctgagagatctatcccgcccagccccctgatggtaccagagccgagacacgagtgcccccaaccacggaaaaaggcaccttggccccccggtcaatacggcacggttgccccccaaagccccaagatggcacagcccttcctcacagcgtgcctcaccgtgccacactcccacgaagccacgggaggccccacttaaacccaccactcaatgttcttaaagagtaatattctggctccttgagccacgccatctggccctgggaagccacccacaggtgggaaaaggcgccttctgccacgagtccacggccttgggatgacacgacacgccttgcccgcacacactcgggccccacctaaaggaatttagggccttttttggcccctgaaccccttccctggcactgggagcgctggggacggggctggccttgggaggagcggcaggggcatcacctccttcctgctgcttcttccctgctcctaccctcaagggcctgggggctgcccaagctgcctcttaatgcccttctgggggtctcaggccccctgctgacacttctgccatccagagaaacaactaaataaagccaaacgtgtttgccca

SEQ ID NO: 660329 - DNA, 131 bp, Homo sapiens
gcggccgcctactactactactgctcgaattcaagcttctaacgatgtacggggacatgcagttctttaaccaatgtctgtttggctaatgtaattaaagttgttaatttatatgagtgcattccaaaaaa

SEQ ID NO: 660330 - DNA, 398 bp, Homo sapiens
actgacctgctagctctcgactcctgggtacgagtgaacccctgcctcagtcctcccgagtagctgggaagtatggacatgtgccacacaaacccagctacttatgtgtacctagtagagacaggataactctgtgtcagatcaggctggtctcgaacgcccaacctcaggtgatccgcccacctcggccacccaaagtgctgggataacaggcgtgagtcaccgcgcctagcctccggccagacttaaaactgtatagcctatgaaggtagttgtgcagacgtatctcccagccttaatttgctcttctatgatagactcatgaggttcagcaccttttcatatgtttactggccatttggaatatatgtgtacctaatgtatcacttgacagattc

SEQ ID NO: 660331 - DNA, 626 bp, Homo sapiens
gtcctttcgttggctgatcgacggcatcatggggtcgtatgcatgctcccgggaagggcctgtcccagtcggttttagccactatcgaggcagagtcccccactttggttgaagttgagatccgtgactgacgtgaaggagcagatttacaagactgggcaagaagggccgttactccgttcactagatcggtgtaatcgctgagagattcacgatggtgtagtactaagtacggtgtcgtgagaggcaataggaattttgaagaattcttgaagtctaagggacttgcgtcctgatcttgccgtgaagatctcgtacatttaattgaaggaaagcagtttgctgttcgaaggcatcttgagaggaacagagtaggataacggattggtaagattgccgtggtgattctaatagagagccgggattcaccgtgtaggctcgatattataggaccaagggagtccatccgctcccagttggcaatgtatgaatcatctacagtcgtctgcccatggtcgcataagattttgtctgtgtactcagagcaataaaactgattgtcctaggcacgacacaacaaagatcgacacatctccacaagaacatggggttttgggggaactttc

SEQ ID NO: 660332 - DNA, 346 bp, Homo sapiens
gggggggggggggggccccctttttcccccaaaaaccaaggggggggattttttttttccccccccccccccccccccccctttttccgggggggggggggggggcccccccctttttttttctttggcccccttttttttttgggggaaaaagggggttttttaacccccccccggggccccccccccaggggggggggtttttttggggcccccctgggttttttttttgggggggggggggttttggtttttgttttttttccccggccctttttttgggggccccccccccccccctttttcccccccttttttggcccccccttaaggtttttttggggga

SEQ ID NO: 660333 - DNA, 884 bp, Homo sapiens
cgcgtccgccccccgcggcctagcctggagcccgaggagcccaagaggcctgtccccgtcagagcgcggtagcagctctgggacgcccaagctgatccagcgggcgctgctgcgcggcaccgccctgctcgcctcgctgggccttggccgcgacctgcagccgccgggaggcccaggacgcgagcgcggggagtccccgacaacacgcccaccacgccaacgcccgcgcccatgcccgaccgacgccgcccccctaccccgcctcatctgcttctcgctcaagacgcccgactaccccggccacctccgtgccaccccctgtcagctagcgaccctgggcgtatacccatgaagcggaccacgcgagccacaaggacacacgacgcccaccacgacacgatgcaggcacggacgccaccgacgcgccacgctccccggccacccgccccccgcgcaccagcccccacacacgaaaacccccaccatgccctccccacgacaccaccgaaacacacaacggccacccccaataccgactaccgaggcaagcaaatctggaggccactacaatcaagaccgacaccctcagccgtcccactcgacacaccacacgacaacaaccaaggccccggacaaccaacagcaccacgcacctaaatgcgcacagcccctccccacactcgcatccacgaaatgagagccatcgaacgcgggcccccctgcatccacactacggcagcctcgtggccgcacagagtacagaacgcgcaacccacgaccacccatgatgtcacaccccctcctcgcgcccacgcgcaatgcaagtaaaccccacgcgctagccgcccagccccactaggccacccgcccaccacagtccgacc

SEQ ID NO: 660334 - DNA, 293 bp, Homo sapiens
gctccccgcatgagagcatttttggaggggctccccatgatggttcaggagcaggatgcctataaaaaaccccatgtggtttgtgggggccaacttgtttaaagcccccaaaaacaaaggttgggttccccccctggggggatttatttggatcaaatgttggggaaccccccagggcccccccccccccaaaactgtgggggagaggccatttttttttcatattggccggggtttaaacccaaagcacatttggatttgcccttttccctaacggttggaggcggttttta

SEQ ID NO: 660335 - DNA, 892 bp, Homo sapiens
ctcctgcctacttccttccttgaatggctctgactgagagaaggggctggtgagaagcttccccagactgagctccaaacacctcccctcccaggacatcttcctgcccacaggctcctgttgctcctttgcagagtccttgattctccagagcagtcttcattcatggtcctgagcagaggccatgggatggggctctggggagtgactcatgacacctccctaggatgtgggaaacacgccaaatctaaacacatcaggacacctctcctccatcgtcttggactctccgtaagccacaaactgcagtccagattctcaagagttattctgccttctggattcctgcctacccaattacccagccttgttgagattctctattgcctcctgaatacaaattaacactcatcctggttttaaggagaaaaatgattatccttcctctttgtttatacgtatgatataatttggatattttttccctacaaatctcaatgtgaaatttcatcccctatgttggaggtggggtcaggtgggaggtgttgggtcatggggatggattcatcatgaatgacttggtgttatcttggtctattagcacccacaagatctgattgtttaaaagtgcctagcagctccctcttctctttttctcttcctctctccccatgttatgccaactccacttcactgtccactgtgagcagaagcactctgaggccctcagcagcagatgcaagtaccatgcttcttgtacagtctgcagaaccaaaagccaaataactctctttataaattacaaaccacccctccccccaaacaaacaccacacctcacgcgcgagccaagcccataaaaccacaaaacagggcgggcgcataaatcccct

SEQ ID NO: 660336 - DNA, 317 bp, Homo sapiens
  misc_feature (257)..(257): n is a, c, g, or t
  misc_feature (260)..(260): n is a, c, g, or t
agaggcctacttttaagcagctggtggaagctctggacaaggtcctgctggctgtctctgaagagtaccttgacctccgcctgacctttggacccttttctccctccaatggggatgccagcagcacctgctcctccagtgactcggttttcagccacgaccctttgcccctcgagccaagccccttccctttctctgactcgcagacgacatgagccggggagcagcaatgttgtatgggctacgcggcccatggntgnggtctcctcgctgagctgcaacctgatgcatcgacatttaatgttggcagtgtcagg

SEQ ID NO: 660337 - DNA, 194 bp, Homo sapiens
  misc_feature (98)..(98): n is a, c, g, or t
ccacggacgcatcagtaatttttgttactcaccctcctccagcatccaacttctgagtctccagtgtcgttattccacactgtgcccacatgtacacnattattttgcttcaacttataagtgagaacatggcctccaggtccttccatccttccacgttgctacaaaagacatgatttcattcttcctttatg

SEQ ID NO: 660338 - DNA, 836 bp, Homo sapiens
  misc_feature (579)..(579): n is a, c, g, or t
actccacctttactacgcagtacaaccttagccaaactcatttacccaaataaagtataggcgatagaaattgaaatcgggcgcaatagatatagtaccgcaagggaaagatgaaaaattgtaacctaagcataatatagtcgaaggagctaatccgcctatagcttctgcagtaatagaatgaacataggaaataagctgtgcaaggagaggcgaaagctaagatcactggcgagaacaggaggagtctactgaagaactagtagttgagagctagaccgtctatgtagctacaatagggggaagattgataggtagaggcgaatacgtatcagagcctggtgatagcgtggttgtccaagatagaatcttaggtgcaccttgagaatttgtccacgagagacccgtcgtaagatcccgcttggtaaagttgcagtgttagtccaaagaggaacagctctttggacactaggaaaaaaccttgtagagagagtaagaaaatctaacacccgtagtaggctaacagcaggccaccaggttagaagcgtcaaagcatcagacacccactaacttaaaaanatccccatatgtataactggactcctcacgacccaattggaccaatcgtatcaaccctatagaagcaacgatgttagtataggtagcatgaaaaacatttgcatcgcataagcctggtgagataagagctgaatgcccagttacagccagatctaaatcccgcagaagtcttattacctcatggcaccgagaagggaggcctaggaaggtacaccgtaaggacggcagttaccgggtgcaaaccaaacggcatcgcg

SEQ ID NO: 660339 - DNA, 298 bp, Homo sapiens
gcttttgactttgctatttgtattaacacacagtcttgacctcatgggaatcatcaaataagctctatggtcgttggacaatcactacagctgggaacttacttattaaggaatttccaataatgttatactctctggtttttagtatttataccatggaatcttctctctgaaaaaatgtctaatataccaaagtcaagttcactcgagtattatcaacgagacctccaactaacagttttcaattcgagatctccaaaaagtttgtatgtttcaaagtccaggcctacagctaatt

SEQ ID NO: 660340 - DNA, 332 bp, Homo sapiens
  misc_feature (163)..(163): n is a, c, g, or t
agtgactgaagccctccgtgggccctaacaaaccgagcccgccttacaaaagccagccggctgcttggcctttcatgcataacgccgcctaaaaaaagtccccagcgccggtcgatgctttaaccatgaaagttctgctgaaagccagctactcagactcagnccagactgacccgtggttctcgaagtcatggcagtccggctaaggcccacccccccccaggctggtggagcgaccgtcctacttaagaaagccttatcagaatctctgtcttaatgtgaaaaccgccatgtccctcggccattggggcgaaatctcatggacggcccgg

SEQ ID NO: 660341 - DNA, 108 bp, Homo sapiens
ttataacaatctgaaatctctggaggctgcatctgaaaaggtaggtggttggcttgagctggagggtggcttgctggactttgttcttttcttctccccgggatacag

SEQ ID NO: 660342 - DNA, 293 bp, Homo sapiens
gccgtgatattgtgacacaaatcctgctgacaatcccatgacacccacagcaccttcctgttgagtccacctgataatgaaaagggagaagaccccctgccaagtgccaaaccaaaaagcaaacccgagagggactcacttatgggaatccatccgcgacatccctcttgaaacccagaaaagaaacccaggattcaataaaatgggaaagaacgaatctgagggcgtcttcaggttcttgaaaccagaggcagtggctcagctatggggttaaaaagaagaacacagcagca

SEQ ID NO: 660343 - DNA, 164 bp, Homo sapiens
ggcacgagccctcaccccgcctgctccgcagcgggaccgcgtagacctcaacttcccgagcagcgcaggtgggccagggaaggagaggaccgaggtctgccaaggtccatgggtgccgcgctggggacaggcactcggttggttccctggccggtccgggcctg

SEQ ID NO: 660344 - DNA, 479 bp, Homo sapiens
gcgacactcttgagttgggcatggtggctcatgcgtgtaatcccagcactttgggaggctgaagatggaggactgcttgagccaggagttcaagatcagtctggacaatacagggagatcttgtctctacaaaaaatttaaaaattagttgtgtgtggcagcctaacgcacctggtctcagctacttaggaggctgaggtgggaggatcatttgagcttgggctgtagtgggctgtgactgcaccactgaactccagcctgggtgacagagcaagaccttgtcctcaaaaacaaacaagaaaagtcaagtcccaacccccaaaccccaaaagaaaacaaaaccaaaaaaccacatacttgataaaagacaaatgtgtgaagaactcttaaatctcaacaagaaaacaaacaagccaattttaaaaatgaggcaaagatctggacaggcaacttaacaaagatattcaggtatggcacca

SEQ ID NO: 660345 - DNA, 223 bp, Homo sapiens
agaagtcaagcaattaccgtagctcttgtgccagtgaggcctgcttggtctttctataagggcaagggaggccaatgggagattaatgcctgttatttccatggtgaagcagaaaaaggacagtaaacaactttactaccatagagccccttttcatgaggccttgtgggtacctgacggcgtcggatattctgtaactcgttggtcagtacgctgttttccg

SEQ ID NO: 660346 - DNA, 110 bp, Homo sapiens
actgtatcatctcattttgttggctttcttatgaagaatgcgccacagtttaaagcacatcatgctgaacttattttagctaacccgagtccagttctcatctaccagac

SEQ ID NO: 660347 - DNA, 171 bp, Homo sapiens
gtggcttctcacgcacgcccgggtatgtttccacggttcatgggacaacgcatcaagcttgaccgcgccttcggcaaatttggcgccgtcgaacggaatgcgcccgcgcagaattaccgcccaggtcttcgccggtcttgagcatctgtttgaaaatggccttggccagcg

SEQ ID NO: 660348 - DNA, 818 bp, Homo sapiens
tgtatcagaggacatgctcagcatgatccaagagatatatttggcaactttttctagaaaaggcacattgggtatcattcattacattcttgagtttttttgggtttttttttttttggaaacattctttcttgtaataggcccagggcttgacagtgtggtggcacaatcacagctcatggcatcctcaatcacccaggcctaagcaatcctcccaccttgtagctgggactacaagctcacagccacacctggttaaaattttttctttggtatgaacagggtattcttctaatatgttggcccaaggtgggtcttacagggctctcgggggctacaagatttgtcctcctctggcctacaggttatccaaggggcaacagtggccaaatgtttgtaattctttggccctcttagcccatacatggccccaaccaaaggaggtgttctctataaacctatttacatgggatattggatcttcccataaaatatgggggttattgtagggcgtggggcaatgtttcttttagactctggggacatttggtaaaatccctctacctgggacatggttttttcacatgggcagtttcacacagtgaaatcttaattatctaacaaataagagggtaatggctcttgggggttgttcacaatacatataacacacacaaataaataaacaaaaaaaacaagatcgtcggtgggcctctatttatgtaggggggggcgggaaaaaagagtgtttcttaaaaatcagtcggacatgtttcacacaatttttatccttgaccccacttttttgtttcatgggg

SEQ ID NO: 660349 - DNA, 521 bp, Homo sapiens
cgggatcctggacgtgggggatacaggcagtggatgtggtcggaagaaggagaggtatcaagcagcgcagatccccaccatccattgcagaccagacagaataccatatggtggacatccatcctcttcgagatctcccccaacctctaccaggatctcctcaccctccgcatagtcctcttaaacttcacactggatgccttccttctcgcagtgtgggcagatccacttgccctcgggagccttctccatgtcgggatccaggcagaccatgtggcacgcccggggacaggtatcaaccacggatgatctcaccgacttgctggcacacctcgcaaatagtcctggtggtctgtctcataaccatccacagcagtcacctcctcctcgcctttctttttctttttagtggttcggcaattacttgcggctgcggctactacggctggttggcaccatcagaaacagaatagctattgcatcatggcatcattcgattcagattccaaatctaagtcatc

SEQ ID NO: 660350 - DNA, 147 bp, Homo sapiens
cccccaacaatcaatccactatctccctttatactatttaaactttagtattctccagttatccatatctatgagggtccacccccctagactacagttcctccatgacagagaacaactaagtattacatatattacaaaccagta

SEQ ID NO: 660351 - DNA, 383 bp, Homo sapiens
  misc_feature (1)..(1): n is a, c, g, or t
  misc_feature (3)..(3): n is a, c, g, or t
  misc_feature (5)..(5): n is a, c, g, or t
  misc_feature (68)..(68): n is a, c, g, or t
  misc_feature (301)..(301): n is a, c, g, or t
  misc_feature (377)..(377): n is a, c, g, or t
nantnagaattgtctttgttagctttaagtattaaggttaagctgccctcaaaaagagttgagaaatntttccttctcttttttctaagagtttgtatagggttgatattctttattttttggtatttgatatacttcatcagtgaatttatgagttttctttgtgggaaaatctttgataaattgaattattttatttatttatttatttatttattttcgagacagagtcttgctccatcgccgaggctggagtgcaatggtgtgatcttgggttcactgtaacctccacctcccgggntcaagcgattctcctgcttgatgccgggagtttgagaccagcctggggcaatatagtgagaccctgatctctaccnaaaaaa

SEQ ID NO: 660352 - DNA, 137 bp, Homo sapiens
ccttgcttctgcggtcgctctagaggactcccctcatgttacgcgcgcatcccctactgacgtccccgcctatgcacacccccacaggctctgtggcaacacaacataccccgagcaggcgtgaccgctccgcttac

SEQ ID NO: 660353 - DNA, 879 bp, Homo sapiens
  misc_feature (879)..(879): n is a, c, g, or t
atggcgccgccgaacgctcgtcctgctactctcgggggctgtggtcctgatgccagacctgggtcggagctctcactgcccatggaggtatttgcttcacgatccgtgatcccaggcccgcggcccgcagggagtagcccacgacttcatcggcagtgggctaagtggacgacacgcagttcggtgcggctctcgataggcgacgcactccggagccagtacggtagtggcatgccgccgaggcggccgtgtgatagagcagagagtggtccggcgaggtattgggatctggggagtacacggaaacatgctgagaaggcgccagcgtcattacggactcaacacggatgtggcaccgctggcgagtaccctgtctgtcgtggttacatacagaacgcgaggagcgggaggccaggtctcatcgacagccgctcctcgagagggcatggtagtggctgcggactggtagaggggatctgagcacgtgtgccgctatctcctctcgctgctgttaccaagcgaaatacgctctacgcacggcaaggcgttacactcggctcctgagaaggagagatctgcgcgctctggaccgcgtgaggacatggcgtgctcagagctaccgagagcagctaatgtggggacggcggcgccccaagtgttggacggtgatcacgtgagagaagcaataacctggtagcggccaccgtgccggtgtaagtggcctccggtgggactaccgtgcgaagaaaccgcgggacatcgatgaccggctttaccagggggccacagggagagccccaccggaaaaagcgcgatagtaaacttcgaacttagtggcctggatcgtcatgaacccaattgaaaagcctacccgtggan

SEQ ID NO: 660354 - DNA, 338 bp, Homo sapiens
atatgctgtctcacgtaggtattgatgaaggtgactacacaaaaaaaaagattttcaatgtggacaacaacctgtctattggaagaagatgccatctaagactttcatagctagagaggaaatttcagtgcctggcttcaaagcttcagaggacaagctgactttctcattaggggctaatgcagctgatgtctttaagttaagccagtgctcacttatcattcccaagattttagggcccttaggaattatgctaaatctactgtgcctgtgctatataaatggaacaacaaagcctggatgacagcacatctgtttactgagtattttaagcccac

SEQ ID NO: 660355 - DNA, 121 bp, Homo sapiens
ataaaaatcttccagtgattccttttataagaggacatcaaagcctgggcaacagagtgaaaatcctgtctctataaaaataaaaaaaattggccaggtgcagtggctcacacctgtaatc

SEQ ID NO: 660356 - DNA, 123 bp, Homo sapiens
ggcacggagggaagtgtcacgccgtagataatccaactattgcagaaaaaagaataattccctgaaacatctgttcagctagcttctggcccttgtaatccatctccgtgggcctctatgaat

SEQ ID NO: 660357 - DNA, 268 bp, Homo sapiens
tttttttttcactaagggccggcaattaattgcttagaatgctaaagctgtattctattgcctctgtagatgtacgaattcaaatggtttaaagtttcagtaaaaaattcaacataactgctcacaagacatttcaaacaactttaccaccaaagcaaatacaaccttgccaaaacacaagattctcaaacaaattttaaggtaatggttataacaccatactatgtttatttaaacaccatcttaaaccttacttttatcgtcgacg

SEQ ID NO: 660358 - DNA, 360 bp, Homo sapiens
tcttctcaccctttattttgtggcctccccggggtttcttccccacccccttgttaaaccccccccccaccttttttatccccccccccaacctgcttcttggggtggggccccccccccccgggggggggggagtaaagaatttttatgccccgccccccccccgggggtttttcattccccccccccccaccttttttttcttaaagaggggagagcccccctttaaagagtaggtgaccccccggggccccgccgctctttttgtttccccatccccctttggtgcttaaaaggcctgggggggggggacgcaggtttccctcccccaaatggggctttgtttttaacaatttgaag

SEQ ID NO: 660359 - DNA, 112 bp, Homo sapiens
  misc_feature (106)..(107): n is a, c, g, or t
gcggccgcctactactactactactgctcgaattcaagcttctaacgatgtacggggacatgtaatggtaacttggactttaataaaagggaaatgagtttgaacnnaaaaa

SEQ ID NO: 660360 - DNA, 652 bp, Homo sapiens
ggccaaacgaagtcgtggaggtggcgaaacgaggaggagataacgcggccttgggctctggtgtctcccagtctgctaaagccctaagtgccatcaccatggacttccatgcatcgccccgtgtggtgcaagaccgtgtgagctgtgggtgcgtggcctcctcctccgagagcaaactgtgaccgcagggagcgcactccctgtgcaagctttggccctggagaccatcgacatcaacaaggacccgtaccttcatgaagaaccacctgggctcctatgaatgcaaaactctgcctgacacttacacaacaactgagcgggagctacctggcacatacgcaggggcaagaagcaccagaccaacctggtcccgtgcgagccagccaaggaggccaaggaggcccctgcccaaaaccgagcctgagaaggtcaaaggttggaggtgaaagagcgtcgtgtgaacgactctggacgcaccgggtctaacaaagttgagacaagacagagagactcggacgcatggggaccagcagcacggactccctcttccagactatgactcaccctgagatcacgcccgaaaaggggcagtccactagcacactctccagccgcagacccgtgttcttgcggttaacacgcaacaaaggga

SEQ ID NO: 660361 - DNA, 723 bp, Homo sapiens
aatctcagcacttgtggggctgaggcaggcagatcagttgaagccaggagtttgagaccagtttcatgtggccaacatggtgaaaccccgtctactaaaaatacaaaaataagccagatgtggtgtcatgtgcctgtagtcccagctactcaggagagtgagacaggagaatcatttgaaccctggagttggaggttgcagtgagcagagatcgtgccactgcactccagcctgggtgacagagtaaaactctgtctcaaaaaaaaaaaaaaaaaaaaggctcccagggttcccaaaggtttcaaaaattgacgggggcccaaatgggggttgccacgggggggaacttggagggctcaaagtgggagatctttctataaattacatgtggttctaccaagggaaaaggctggttaataaaggtaggggaggtatccacggcttgggaagtattaaggccaaggttaagtggctcacttggtcaggaacgggatcgggcagaggatcccaggggctcaaaaggtcaattcaaagaggtttaaccaggtgcaaaaggtcttatttaaacaatgcgtctctttcaaaaccaatttcctggtgtggaacgtggtgtttccatttgcaaaagattggaatttcaaatctttccttaaccatatggcgaaattacttaaaattgggtttggacgggaaaagtttaaaacttgtgggataaacataagg

SEQ ID NO: 660362 - DNA, 285 bp, Homo sapiens
tctcctccctgccccctgtactaatatattatttttaagaattccatatccaggccgggcatggtggctaatgcttgtaatcccagcattttggggggccgaggcaagcggatcacttgagctcagaagtttgagaccagcctggccaacacggtgaaaccctatctctactaaaaatacaaaaactagccgggcgtggtgagtatgcacctgtaatcccagctactcaggaggctgaggcagaagaattgcttgaatccaggaggcggaggttgcaattagccg

SEQ ID NO: 660363 - DNA, 249 bp, Homo sapiens
tactccacacaagtactccggtattccaaggcaaggtaatagatgcggtcaggtgcataattctctccattaggacgtcggatctcatggacaaaatgagctaacccagtagttaagctcagcagtggtgtgagagagtagatcctcttttaactttactgatttagaagattttaactcatctaataccggaagatcggcaacacaagcgcatagccagggcgcagagaggggagccggaggcacgga

SEQ ID NO: 660364 - DNA, 256 bp, Homo sapiens
tgtgtaacaaggctttatttagcaaggtgagcaggacttaatcaagaaaggccaatcccatgtcatcatctgactcgttcagactcctccttcttctcatctttcttctcctctgctgcagcaggggcagaaccagcagcagaggctgcatagcctggtgcagcagagacggctacagccccaccagcaggtacactggccagcttgccacaaccctgggcaatgacgtcttcaatcctctcaagctacggcatgc

SEQ ID NO: 660365 - DNA, 1086 bp, Homo sapiens
  misc_feature (82)..(82): n is a, c, g, or t
  misc_feature (88)..(88): n is a, c, g, or t
  misc_feature (95)..(95): n is a, c, g, or t
  misc_feature (112)..(112): n is a, c, g, or t
  misc_feature (430)..(430): n is a, c, g, or t
  misc_feature (500)..(500): n is a, c, g, or t
  misc_feature (525)..(525): n is a, c, g, or t
  misc_feature (1029)..(1029): n is a, c, g, or t
agaaagattatgacaaccgaatggtcaaccattttattgctgagtttaagcgcacgcataagaaggacatcagtgaaaaacnagaganctgtaanacgcctccgtactgctngtgaacgtgctaagcgtaccctctcttccagcacccaggccagtattgagatcgattctctctatgaaggaatcgacttctatacctccattacccgtgcccgatttgaagaactgaagtgctgacctgttccgtggcaccctggacccagtagagaaagcccttcgagatgccaaactagacaagtcacagattcatgatattgtcctggttggtggttctactcgtatccccaagattcagaagcttctccaagacttcttcaatggaaaagaactgaataagagcatcaacccctgatgaagctgttgcttatgngtgcagctgtccaggcagccatcttgtctggagacaagtctgagaatgttcaagatttgctgctcttggnatgtcattcctcttgtcccttggtnattgaaactgctggtggagtcatgactgtcctcatcaagcgtaataccaccattcctaccaagcagacacagaccttcactacctattctgacaaccagcctggtgtgcttattcaggtttatgaaggcgagcgtgccatgacaaaggataacaacctgcttggcaagtttgaactcacaggcatacctcctgcaccccgaggtgttcctcagattgaagtcacttttgacattgatgccaatggtatactcaatgtctctgctgtggacaagagtacgggaaaagagaacaagattactatcactaatgacaagggccgtttgagcaaggaagacattgaacgtatggtccaggaagctgagaagtacaaagctgaagatgagaagcagagggacaaggtgtcatccaagaattcacttgagtcctatgccttcaacatgaaagcaactgttgaagatgagaacttcaggcagattacggtgaggcaacagagttctggcagnttatgaattatcaactggctgataaggtcagcttccggaggaggatttgacatcaca

SEQ ID NO: 660366 - DNA, 292 bp, Homo sapiens
accactcccagtttgtttttcatactttaaacccggctctcagggctgggcctttctgaagctgcttcctcttataaaatagctttggccgaaacatagtttattatagcagatcccaaaatataatgaaggggatggggggatatctgtgtctgtgtacttataatatataattatccttcctgggttctcacaaaaatacataatctctttttttcgggcaactagtgtggtgtacccagttggatgtagctggggggttgagtgcagtgcatttccatgtggcggggtg

SEQ ID NO: 660367 - DNA, 176 bp, Homo sapiens
accaggcgcttgtttgggcacctcgggatataaatgccaaatgcctgattaaaattgtggaagtgagaattctttgtagatggcatctctctacacttaattcctgaccatcctgctgctttaaggtcgagtatagcttggttcctctcactctgcagtcaaccgtgtgagtacct

SEQ ID NO: 660368 - DNA, 126 bp, Homo sapiens
  misc_feature (125)..(125): n is a, c, g, or t
gttgcgggtgatctaatatccggcgagtgatggtcacactgttgatccagcactttgactggctgaggcagaaggactgtttgagcctaggggtcaaagttgcagtgagctatgatcgtgcactng

SEQ ID NO: 660369 - DNA, 967 bp, Homo sapiens
  misc_feature (478)..(478): n is a, c, g, or t
agcggagtgcggccgccgccggcacagctgcagtcagcaccgtcaccccagcagcatcctgccgcctgacaccgcgcgtgcggccgccccggtcgtgaccccgaccgcacgaatccggatgccgaacgcgatgggagcctcgtagacgcccctcgcgtacgctcgagcacacgcatcaggcgcggttacctgctgacagcggaaaccctcacctcaacgaaggacttggtctttaccctgtgtaacgtagagtacaggaattgacacattcaatggacttggtatgccaccgtgtctcttcacacagtacacggacgatccaaggttacttacgagttcgtataagagaattgttcgtagctatctgacaccttctgaggctttggcacaggagtatccttactctctatgtggagtactccataggagtatgatacatgaatgattactcatatttagtaggaagtgacgtgagcanttctgaacatttcgagatattatcagtgtacctagttggtttaatatctcgcctaactgtgcgggtcatgagcgttggccagacccatttactactgtatatgggtgattctcaggcaaagcttctacagaagtgtccgtgcttctaattgactgttatactcgagcgtaagtcgcacggagccaagtacttcgccattacacgatctcatctaaattgccagtggtccaatgaaggatagtcgatcgaaagtgccgagttaggtcgggttgaaacgtggactgggaaagaaaacccgttagttgcattatggggtttcgaggaaggcacccttttgagggtttggtgacatttgcggaaacttagttcgccattcccctttgttgagggttcaactactctcggaggctcctgaacttaatcaacgcaggcttttaggcagagaatgacgtgagatggaagttccacataaccaacgtagagtaggtc

SEQ ID NO: 660370 - DNA, 170 bp, Homo sapiens
tgtaggaatctagcactgaaataaagctcacataaaaaaataaataatagaattcccattgtggctcagtggttaacaatgtctgactagtgaaccatgaggttgtgggttcgatccctggccttgctcagtgggttaaggatccatgcattgcgtaattatgggtttcg

SEQ ID NO: 660371 - DNA, 339 bp, Homo sapiens
acaaatgcacccactgcctcctgggttcaagtgattctcctgcctcagcctcccgagtagctgggattacaggtgtgtgctaccacgcctggctaattttttgtatttttattagagatggagtttcactgtgttagccaggatggtctcgatctcctgacctcaggtgatccgcccacctaggcctcccgaagtgctaggattacaggcctgagccaccacgcatggccatcattctcatttgatcaggctgctaacaagctagttagtggagctgatgggatagagaagtactgactgatgttaaaaaaaaaaagcaaaacctcacgctctgtgcat

SEQ ID NO: 660372 - DNA, 808 bp, Homo sapiens
  misc_feature (612)..(612): n is a, c, g, or t
aaacaaggcaccacaagaaagaaccagtggaaacttccctggtaattccagagtgtttttgtatttaaagaaataaggaggatacagagtttcagttatatgagatgaataaatcctagagatgtgtacagcatagtgcctgtagttaacaatactgtatgtacacttaaaaatttgcatgctggatgcggtggctcatgcctgtaatcctagtgcttgggaggccaagagaggagtttgagactagcctgggcaaaatagcacatttcatctctacaaaaaaattttttgaaagaatttactaagaggatcttattttaagtgttcttatcacaaaaagtaataataagaggatggggggaaccttttgatgagtaggttgtggcctacattgtagtgatggttttctctccaaactcatgagttgtatgcatcagatcattagatgtgtgcagccttgtatgtcagccatacctcactaaagggtcttggttaaagataagataatcgtttatctgcagggaagaaacgaaacagttaacattgatagggggagaaaatgaagcacaatcaatgaacatttggaaattcagagaatgctgtaaatcatangcagattggcacaccagaaaagggtggaagaatgacagaaaaatgggcggaaatatgacacgacatacgtgaaagtgagaaggttggactactttaatcagtctcagaagtgttaagagagaatatgattagatgattttgggggaattcgaaattgggggaccatcctgattcagaagccaatccagaggtaata

SEQ ID NO: 660373 - DNA, 125 bp, Homo sapiens
cttgataacttaagatctccaccctggtcaataacagaggatatgacctcagttagtcttattatattttcaattctttaaccatatgcttacatttactaatatcaagactgcgtaccgagctc

SEQ ID NO: 660374 - DNA, 810 bp, Homo sapiens
gagtcacagcctcagccgcagcggcgtgctacctaggtgatagcggagcggctgggtaggaagcaatgttctcaaacttcactagccccgtcggcgcggacgctgtcgagaatgcagattcctgggtactgccagatacgaatgagcataccacaaaaaagttctcatttgtgtcctcccatcccattctcctcactaaccaaaggctaggaattatctgtgaatgtaggaccactggattgcagtcttcatctgacactgtggagagtttctaggaatgaaacagatatatggccttgggtccccttttcctttctttttttttttttaatagagacgagcatctcactatgtggcctagggtagtctggaactccgggcctcaagcaatcccaacccgattccgcctctcgaagtgacggggattacaggcataaaccaccagccgggcagaaggtgctttaacaccaaatctgaacactggttcagaagagaaacatggagcatgaacaccatctgtgcgagtcatttacttatggccttcacctctaaatctaccttgtgtactcttcttcccgtgtaagtgatggggctaggtggccctcaaagggtgcccccagacctctttaaggctgtccctgcagtctgcaaaggggcctaagacaagacgggaggaaggaaaaaatgctcgggaagcggctggaagggggtacggaccagatgctctccaaagagttccacaaggcggcccaggttaagaaggatgcaggaccggccgaaataaggcagggccccgggggcgggaaggga

SEQ ID NO: 660375 - DNA, 439 bp, Homo sapiens
ctggagttttctggtggctcggttttgtccttctcgctgatgctgatacaagtgactcggcatgcatgagactgcagtcggcggtccacagcattcagcatggactgggagatggtacaaacaggtgatccggatccatgttgggctcccagaggaactcacacattccgtacatttgttcggcgcaggtgccactgaccacaaagtcatcagtcaccatggggcagccgatgaggtctagagagcaaatgaagggcttaaaggtcttcgggtccaacccggcaatgactggctcagtgtagtaagggccaaaccgtttctcatacaagaggttggccaccatgctcatgagggtatcaggtttgatctgccgaccttccttcaactcatacaggttcagccggaacttgaggcgctgggcaactgtccggacgtcagt

SEQ ID NO: 660376 - DNA, 711 bp, Homo sapiens
ggagcagccatagctggggcgcgcgtgggcctggttggtgccgcgtctatctgctgcccctgcgccggtgcatgcctcgccgcgagcctgcaggttgtcctggagtctggcccagagacctgtgccccacagtgagtcccagcagcggtgtagctccatcccggtggacaatggaccgaagtgcgacgtgtcagtagttcatgtgcccatgcctgctggagtggaaagcgaagccatccttcatctacaccccagaggtgtccccaatcctgcctgatccacgagaagtcaccataccttcctacaagcatgcctacaactcctgctagtgatcttggtaccccataggtggacagtgaatgcctatcgaccaattgtccattgaacgtgaacaaccaaagtccagatattatcctactcacgttccgtgatataactccgaaccctagaccaacttgtgatagcccaaccgattgaagttgcggaacacgaaagcggatgtttcccctttcccccacgcaaaatagaacgcggatcgattctggggagccgggccctgtgccttcccgcgtcgccacgcggaccttctccggggacagttggttgccacaggggtaacgggaccccggaagcactctggacggacggcgccccggcatctccccgggcacacgggagcgtatccacctagcgcgccccgctggcgcagcc

SEQ ID NO: 660377 - DNA, 221 bp, Homo sapiens
ttatttgtgtacttttaaaacctcacagtaatagtatagctggcctttcacgtgtgagagagcacggtcggaatttcataacagtagatgatcaggccccctgggcttcccatagtgttgcgatggcaggggtaagccctggcgctagggagccagctagttattctatccatagcctcaggacctgacatcatgcaggcattcccttctgtcgtcttctc

SEQ ID NO: 660378 - DNA, 218 bp, Homo sapiens
  misc_feature (162)..(162): n is a, c, g, or t
  misc_feature (173)..(173): n is a, c, g, or t
  misc_feature (201)..(201): n is a, c, g, or t
ttttcctggttttcagtccccaaagtcggtagaccaggggttacgtgactggggaaaatttcccatctccttgtttgaaaacatttcccctgctgttctctttttaacatggtgtggtaaatctgttcaaaaactgctcatttgactgttttggacatgtgncaattgccttnaaacctagcccagtcctcagaaatgaanaccgtgtttcccctgga

SEQ ID NO: 660379 - DNA, 808 bp, Homo sapiens
ccggaaactcctggaattatactgtaaatgggagatacattagttgccgtaccctatcgaccgtccttcaccgccgcagaccccattcaagtatctagtcactgcgtgagtgcatctccatccacagttggccaggctggtgtccagattggcaatgcctgacctgggagctctactgcctggaacacggcatccagacccgatggccacgatgccaagtgacaatgaccattggtgggaggagatgattccttcaacaccttctctcagatgaaacagggtgctggcaagcatgatgccaccgtgagcagatagtatgtagacttggaacccacagtcattgatgaagtacgcaactggcaactaaccgcacagactactatacacccatgagacacacatcatccacatggccaggaatgatgctgccaataaactatgcccgaggcacactacacccatttggcaacggcagatcatatgaccttgtgttggaccgaattcgacaaagctggcatgaaccagtgcacccgcgtacttcagaggacatatctatgagtaaaaaccgcaagactaatgtcgtgaggagaaactgtgtatgctgagggttcaaccttcgacttgctctatgagaaccgttctactcacgttgacttaatggcaagaaagtcccacgctggcagtttcctccagttataccacgagtgacccgaggtaatccacatacttgtaagatgagcccatacaacatacatacatcatcacccagaccaccctggagcactcctatattgtgctcatgataaac

SEQ ID NO: 660380 - DNA, 145 bp, Homo sapiens
acgcataggatactaatcctttaatgtagtgtacactggagaatagttatattttatgaaggttattttgttgtatttagtattggaaaagttgtgtttccagatgcatttcacgaatgtcgcaagcacccactgtctttttatt

SEQ ID NO: 660381 - DNA, 704 bp, Homo sapiens
ggcggcggcggcggcgggggactctcacggtgacatgtttacagctgggtgtgactcagtaaagtggatttttttttcttaaaaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaacaaacagaaaaaaaaaaacaacataagagagaacacgaggaaaacaaacaagaaaagaaagaaaaacacaagcgagcagcacagacagacgagacacgagcaaacagccagggaggaaacaggagacagcgggcgaggggccaccgcgcacagcagggaaaaacgacggcccgggcgctagagaggcgagggccggagacagagagcaaagaacgaggagacggaaaagccagcgagaggaagagggacgacacacacacagagagcacggaggagagacacgcgagcggacgagagaaagacatacaaacagtaaacacaccacacccgagcgggaggggggggaaacagaaacgaacacgaacaacacacaaaagaccaacagccgcaaggggggagcgaggcagaggcgacacgacgagaaacaaaaaagaaccacccagccagcggggaggagaacaaacaaaaacacaggaaagaacgaaaagaggcaaccgggggggggggga

SEQ ID NO: 660382 - DNA, 132 bp, Homo sapiens
caggttgcggacatcttctggtgggcactgtgcggaaacttgaggataaatcagtgagctgcatgcatctttaacggcatggcctgtctcctcacttgagtgcaatgtccactcgaccaaagccctgttctg

SEQ ID NO: 660383 - DNA, 1168 bp, Homo sapiens
tggtggtgcggtgcactgcaactgtgttcagccagacacattcaccagagcacatggggatttaaggttcagcagcagacaacttggacaagttctgtgttcaggatccttgcttggcagcaattcaactttttgccaaacaggttttcatcacaccagcatattctgtcattcaacattctggcagcccatagtcgagcacagcactcgagatccatacatctggcttcatttctctgctaattttgcgcggtaacgtactggtagatttgtgcgcaacttttatttggtaaaatacagttgggggagtgttacacaactattaaagctttgacttgtacgttcaagtatcttcgtcggaactaagagtcagaacagactcttgtgggctggatccgataacgtacgtggcaaaccgctccgtaaacactcgagttggatggtccgcctcatctcacgggacttcgggtccacgacagaacaaccactccaaaaaacactcgacgaactgaacactcccttgagtggcaggccagtttactaccggtacacttattagtatacaacaaggccaacacacaacaggtggcttggccaacgcctattcacttgactggctttgtcctaaaactggcagacaacaactttgggcctggcaataccaacacttagacccctttaatggtccaggggtagatgccagtttgcaaaaacgattgtgcccgtcccgtttgggaggccacccgatatcagttaccactttgcaaggccagcaaagtttctgatggacgccatcgcttctcgccccacaaccagttgttagcccttggtccctcgactagcgagtgctcatcaaatgggataatgggcggccgccggctagcggacagcaccgaccgaccccagcgcaggcatggtcgggtccaccgactgactacacagggtcggcgctactaacaccccgcactccggcggggtcctacctatgccgtaacatctggcacatagccagaaaggtgcaccacgaaagtccccgaaaagggtaacagtgaacgcggaagggccaggcgcagacaacaagagcgccgtccatcgaaacacaagcacaaaacacgcagcacattggcgacgagaccccacgagaagacacgacacacaggggcggcca

SEQ ID NO: 660384 - DNA, 633 bp, Homo sapiens
tcaaggccaaggcagggccaagaaaaccaaggggaccaagggaaagaccaagccatccaagaccaggaaaaaggtccgcagtggaggtggcagcgggggcagtggtggccaggtgtcgctgaagaagtccaaggcggatagctgcagccaggcggcaggcaccaagggggcggaggagacttcctggtccggggaggagcgggcagccaaggttcctagcaccccgtcccccaaggcagaccgagcaaccgggtgaccgtgcactccggactcgaagaccagaggacagaaggtggagaagacagcactgacggtctcctgtcctgcccgaggaggccaggtgaggaggctggggtccgaggtggggcggaggaggaggaggaggaacgaagacgaggaggaggaagaggaagaggaggacgcgcagcagaagcctgcgtacccaccagggagcgaccagacactgcatgcagccgcccaaaagcactgacacacagagcgagagtacaaaagagcgggagaatcgcgaaagcagagggacggggccaagataaccacggtgatatacaagactggggcaacgcatggcgacccgagcgcatgagacctgggaaatgtggccagggggatgtg

SEQ ID NO: 660385 - DNA, 256 bp, Homo sapiens
aaacagctcccaaattctgccaggaagcgatcctctggtgtacacaaactgagatggtacagcctactacatatctaggacatatggtatgtcctattgctccgaggctacacacctgtacaacatgttcctgtaacaaatagtataggcaactgtaaaacaatggtaaatattggcatatctaaacatagaaaaggtacagtatacgatactataatcttatgggaccatccatatattcaggttatggttgacc

SEQ ID NO: 660386 - DNA, 936 bp, Homo sapiens
gtggagaagcagactgggaaaaaggataaagataacgtttctctaaccaagaccccaaaactggagctgtggctgatggctgggaagtgagtgtgagggagctgagccagcaagctggaagctgcccttcacctgctgggctgccaatggggagcagaatggactcggacacatggacctgcggggtccttgcttgtcctggggcagcacacgagggagccctcgtcaggagcgccatgggcctgaagctgcctgaccatctgcacgatggatgtatctttggaacaaggggcaaaaattcatgattttcttattctagcatttgacctgtgacatgacaccctggtctctggtgcctggggtgtgctctctgcagtgctgccaggcacatgcttggttccttcagcgttaggtgcttggcaccttcagtctttaccatgacagtcatgtacgttcctggtgcctacagataggagacggctgttctgcacggctcctgattccccatacctggagggaagacagacttagccaactggctcatctcgtgggagacttcttcggacctctgaacatgccaaacccttggcacagtgcctcacacggcgacacagtgtgtgaaagtctgcaccgaagcgattctcacaaccttgctcaggctgcaggtgggaccctagctgggtcagacaagaagccgagatgcaaccaaaggggtcacaggccatgagagaacacgcaagtatcatgagacatgtttacataggcagaaaacagtgaccaaccacttggtaagaccacatgaccacaaagaaagggcacttcagaccaatgcagatttagtcccgacgacaccaatacgcacaacaattaaatagttaatataaagatgtctcaccataggcactccacatagaagtaacgatttataaacaaaaa

SEQ ID NO: 660387 - DNA, 1253 bp, Homo sapiens
  misc_feature (316)..(316): n is a, c, g, or t
  misc_feature (345)..(345): n is a, c, g, or t
  misc_feature (401)..(401): n is a, c, g, or t
  misc_feature (407)..(407): n is a, c, g, or t
  misc_feature (704)..(704): n is a, c, g, or t
  misc_feature (1253)..(1253): n is a, c, g, or t
gagtgacggatggctgattcatgataggcatcgcctggctgtcagatactcggaaaccagagcgtcggcagacgtttcagggaaaggtgagagatcgttagtagatcggtcctttgctgatgagggatgcctaccaatcatggtcgctgcgtcagatctaggagatcaattgattacgtcctctatgaagctgtgtcagtcacaggctgcacaacctgcgttgacggatggcgttcacgttgtcgacatccagtcggaccaggatattgactacgggtgtcctatggagtagggatgcatgacagtgctaacgagnattcgtagatccatcatcctgggagacgntatggtcaggatcgcaatcctctgcggcgtgactgatcctatagggagtctcattntgaacngtagcccgaattgatttgttgccaagtgcaatggtcatctgattgataagacagctggtgatgcgttatatcagatccgtgtataggggcgaccctctaagactgtggcgtaaatatatacatccttacacagtgggcccatgagggtgactgagagtctgtgtaaaccctgcgtccgatatgtcccgttcagtacaggtgtccgatgcgacgtgaaaaaattcctactttactgcgctcgaagaattatttgcttcctaattcttctcgttgaagaatccaccatttccggggggntatggtttcggttatcgtttccatagcgggagagcggttccataaataggaatgggtgggtgcaacccttcggtggcgacctaaggaatacttagcgaggttcctgtgtgagaaccggattatacgctcgaccattggtacagaaattccgtaaaaagcccggtgccccccaataaaagccccgtagggggaattatcctaaaccgcggaaaagatcgcgcggtcccgccttggcggaatcaaaggggcgcgaaccaccggttgcaatttccgttacgggcttgggggggagctttacccagacgatggggaacagaggttggcccggagccatcccaattgggaatttaacaacggaagggggtccattcggcgagacatgtggtgtgtgtcgggaaaaaggtgttacatggagagttcacccaaaggcggagtccgggaaaacacgagggggaatgaaatccgcggaatataccaatcgcagtgtttgaaccgccaactattgtgggaagaccgggtttcccgttctgtgtggcaacctccacaaan

SEQ ID NO: 660388 - DNA, 718 bp, Homo sapiens
cgctatgaccacgacaagaggtgaccgggaaacaggtttaacagagaacctgtatgaccagaaggcacggataaagacgttaccacagatatgccataagacaacgctctctgggtccatcatcggccacagatcaatcctagttcaaattctatagttatcttaatattatgattttgatgaaacaacagaagattgatcatttcgtgtggtttgaagtgaactgtgactttaatgaatattgcagggttcagtctagattgtcattaaattgaagagtctacattcagaacataaaagcactaggtatacgagtttgaaatatgatttaagcacagtatgatggtgtaaatagttctctaattgtttgaaagaatcgtgccaagcaataagatttatgtatatttgtttaataataacctatttcaagtctgagtttcgaaaatttacatttcccaagtatggcattattgaggtatttaagaagattattttagagaaaaatatttctcatttgatataatttttctctgtttcactgtgtgaaaaaaagaagatatttcccataaatgggaagtttgcccattgtctcaagaaatgtgtatttcagtgacaatttcgtggtctttttagaggtatattccacaatttcttgtatttaaggtatgcactaataaactacctacatattattcgtttctacctggtatacgaatgt

SEQ ID NO: 660389 - DNA, 685 bp, Homo sapiens
  misc_feature (662)..(662): n is a, c, g, or t
ggggccctcactggcctgtccgggctgcagcgccaggacctcccggaggtagaaggcgagacgtggaggctcttcttctgccccgtctcccctcaaagatgagaaacatgttcagaacggacaacggtcgtctctcaggactgtaggctgctgagtgcaaattgcagtgggcggaaaggcgaggtgggtgtgcatgctcttgcctggcaggcgctgggccatcagcgaactgggccccgtgagagagggcggcgagtgtggaggagggctgggcactctcaccacaggctttctcggcccctactccatcagcttgacagagctggccagccccctcctgtagggggctagggcgaggagacctctgggcagacccaagaaccatgcgggactgggcgtgtggttggatggcaccaatggcagccgctgccccgcccctctcacttcaaggagggttcctcgcagctggggggtgtgcggaggcgcatggcctcccgccacggggccgtgctgtgtctatggctggcagaggcagccagcgggtgggggattactgctgctcgctcacctgcctggctcgctggtctctcgaattttcttccctctgaatcctattaagactttgtgggaatgcgttattcacactcttccttagctttgantttaagattcaaaagagcctttt

SEQ ID NO: 660390 - DNA, 147 bp, Homo sapiens
gcgtcgatgggcgcactcgcttccacgaactcctacataggtaatcactgaggattgtgaggttcagttccccctggcacattgtctcatctggggttcccagagtcctggcggttgctccctgagctgtagagtgctatgttcgct

SEQ ID NO: 660391 - DNA, 1048 bp, Homo sapiens
  misc_feature (170)..(170): n is a, c, g, or t
  misc_feature (330)..(330): n is a, c, g, or t
  misc_feature (373)..(373): n is a, c, g, or t
  misc_feature (520)..(520): n is a, c, g, or t
ctgtgtcaccgcgtgttctggtgtgaccagccggggccccaccagtggtgctgctttttgccgccgggtgctccccctgtgtggcgcacaaagctcgccccttcttgacccaccggggtccgggcaaaatggccgccaacgccgggtggagacgtgtggcccacagtctngccgcgcccacactggtgggttgcctaggaactccatatattgggtcgcccgcaggtcctcttctctgtgataggcccgcgcgcgatgggctgctcccgacacatcgtgtggtccccaccaacagtgccgctcgttgtgctgaccaaagcgttgggtggnccggacacaggaagcgacgtggactcgacacatttcgccgcgngaggggtggataccccccccggcgcgttctacgctgttctacattgcgcgcgcgtctctcccacaaggcatctctttcctcactagccgtggtgtgggagacacgcgtgttccacacacaccagggcagcatcgcagcggagcctcnctctcggttagaacgcccgcactgcagcgctctgttttggcgcaccgcggtgttccgccactgcgcgcgcaccattgtgttacaccagcagtggctctctcgcccaccccacatgttgtctccgccatgcatcacagtggcagcataggtctagcattagtgtggcgccccgccccctcgcgccgggcgcacatttccaagaagtgtattctctctggccgccgccgcgtgcagtatcccacctctctctcaagagaacagctggggcggtacaccacacagtggcaacatggtgacacgtgagagtctcgacagacacaagggtcgtggtagtgaagaagtgcgctgactcatctccacaggacacgcgtcgggcatgacaagacgaagacctcccggcctggcctcccttcgtgaccatagccgggggcccgccaccccaggtggcggcggtcccacatggtcgatcagccccccttctttcatgtgccacccccgaaagttgttagattccccccccacataaca

SEQ ID NO: 660392 - DNA, 643 bp, Homo sapiens
tgcccacgggggtcatggggccaggcgcgctccggcgcctgcagaactgatcggggatagtctcaggaggcgctagtcacgtgccccggtgatcggggatagtctcagaaggcgctagtctcctgccccggtgatcggggatagtctcaggaggcgctagtcacgtgccccggtgatcggggatagtctcagaaggcgctagtctcctgccccggtgatcggggatagtctcaggaggcacgagtcgcctgcctcggtgatgcaccgtttctcacaccggctgctctggcccgagctaaaggggaagacgtgtgcggataggagctgcacacaattttcctccatgtattgttgatttggctttttctttgggctagacattaggaatttcagttttcccaagttgtatttttccttttctattttaaaattatcatgcagggctgggtgaggtcgctcacgcctatagtctcaaaactttgggaggctgaggggggaggatggcatgagcccaggagtttaaggctgcagtgagccgagatcgctccactgtcctccagcctgcatgacagagcgagagcctatctcaggaaaaaaaaaaagaaaactatcatgcagtagtatcgaccctggaagacgagtg

SEQ ID NO: 660393 - DNA, 169 bp, Homo sapiens
tctcacatgattattaaagcttttgtgatattttagcattttgaaagactttcacagtgagagtagaaggtaaggtggggatcatgcattttagcaagtggacttgttgaaacaggcaagcaagggccttcagttgtagccctattcttgatccagcagctgttgcctg

SEQ ID NO: 660394 - DNA, 1176 bp, Homo sapiens
agcggggtgtaccatttacatggtgtgcggcagggtctctggttcacatggctcacgatggaaacctgttctcattgaagcaacgtcgttactcaggaaccatctagggtggtacttcccatgcaccaattgtatcgtatcagggtggcgtatcgaacgtgctgaaaggtcgccattggtcggtggactagccacgactctaggaactcgatgtatgtacgtggtacgggacgaaatggagattaccggtgagcttggtaatgcaggtggtgaagcgagcagggtataattgaggaggccacatttaacaaacgcaacgccgctaagcgtccgctggagccacgcttctaatggagacgacagaccgtcgccaaggacagccatgcacgtctagccatcctgtagcaatccctgaagacagaatcccgtccaggactcgagaagcgactcataaccaaggaacgattttcctatgctactcgcgctcgcatttcaggcaaaccgtcaacagggtatgcaagagtatgcatgcccaatgaaacagtctcttacctatgtctggagtcgaacaccatggcgaaagccgccgcgttggagaacgcagacgcgtttgcttgggcaaacggagaagcccctaggcgtttttgacggagcaaacagcgtccacaaattgacctcccgaggcggaggaaagtgccgaaaggcatcgcgattggtgtgtctgggtgtactctagttccgggtcattttccgcacaaagaatttccacgaaaaggctcgcttggccaatgtgacctgtgtacggtatcctttacggagacgaagaggattcctgcaaggcggaaggaaacgattgcacacccaacccggaaattcacgtgtgggcgatggggaaccaaaatcgtggcgccgcggttggggcaagcaattaagtgcagagaacgactccgcgtgcgattgcagccggggaacaaacggtaccttggcgcacatttcgattgacttgaagaacgcaatgacaatagggtttggccccttttaagatgcgaaaaccacccgaaggggatagggttggcgtgtggaatccttacgacatttttgctttcgccgatgcttggttattgaactccccaaacttggttcaaagtaggagaacttttccttccgcattccttg

SEQ ID NO: 660395 - DNA, 263 bp, Homo sapiens
  misc_feature (115)..(115): n is a, c, g, or t
  misc_feature (213)..(213): n is a, c, g, or t
catacacgcacgtgcgcggctggtacttacctgtccttccagacgcgtctccatacacgcacgtgcgcggctgtacttacctgtccttccagacgtgtctccatgcacgcacgtngcaggctgtacttacctgtccttccagacacccagacacgtctccatgcatgcacgtgcgcggctggactcacctgtccttccagacacgtctccatncccgcacgtgcgcggctggactcacctgtccttccagacacgtctccatg

SEQ ID NO: 660396 - DNA, 304 bp, Homo sapiens
gcgggcgccgacctactaataataaattcgcgggccggcgaaaatccctggggcaagaaacaaggtcccctcatccaaaaataaccccccaacttaaaggacccaaaatactagtcaaagccctatactccccctaaacatttaccacaacacaattggggctcactcacccaccacattaacaacataaaaccctcattcacacgagaaaacaccctcatgttcatacacctatcccccattctcctcctatccctcaaccccgacatcattaccgggttttcctcttaaaaaaaagtcgacg

SEQ ID NO: 660397 - DNA, 375 bp, Homo sapiens
  misc_feature (12)..(12): n is a, c, g, or t
  misc_feature (203)..(203): n is a, c, g, or t
  misc_feature (211)..(211): n is a, c, g, or t
  misc_feature (213)..(213): n is a, c, g, or t
  misc_feature (221)..(221): n is a, c, g, or t
  misc_feature (245)..(245): n is a, c, g, or t
  misc_feature (248)..(249): n is a, c, g, or t
  misc_feature (375)..(375): n is a, c, g, or t
agcggaggttgngagtggaagtggtggctgctgctccgcagtgtggggaagatggcgccgcggtggcagagagggggctaaagagcgtcgtgtggcagaagatataagccaggtttgatgacttgcagaaagagcgagggacgcttagatgacattaccaccttaagccttttggccatccagtgttgccaaaaattgaaccngaattctntnccttaganagcgaacgggtaatataacctggnttnntgatacggaacggacacactattcttttaacttaaaaaggaaaacccggttggaaaacccttggttccaggaaccaaaaatttggaaaaacaaggcctccctttttttaaattttttcccaattcn

SEQ ID NO: 660398 - DNA, 162 bp, Homo sapiens
gagtcttatctagaggatcccagcactgtgagacatacattgtagtaggcagggaatatgccaacactggccatccggaccatagcctagtaaaacattaactgtagttggaatagctagcattgcagctaacagaagtgagcactgtacgtctagttccct

SEQ ID NO: 660399 - DNA, 113 bp, Homo sapiens
cattacaaaatcttagaaaagggaactacaccattatagtgtaacaaaagcatcattcatgttaactgtttttttttgtttttgttctatttttgacgacagagtcttgctct

SEQ ID NO: 660400 - DNA, 715 bp, Homo sapiens
cggacgcgtgggcttctcactagtaaaactgccttccctttgttcctatatttctctgttttttctctagagaggtacagttgtaagtcagacgttacactatacatagggcctgtgaaaacagaggcttttgcattgtctcttgacatcagacagttacaataggcatatgggcaaaatggtgtaccaggctcactggccgtttgttattgttacagcacagttttcagcaagtttcttgatgacactggcatttcttgaattaaaaaataaatgccgagcaacccattatttatacagggttgattgcgtttcatgttgttgattgctgtacccttatagtagcctccatgagaatctggtatatcttgctgcttggaactactttgcattgattactctggttgcagtcccaagtactctcggttatagtctgagcctggaagatgtcctagaactatgcttctcccacctctgagattaggacaggaatacaatgttgaaatttcccaattacaggattatcacggtcaccatctacatcattgtgtggaacatggggtgactgtatagctgggcatggggctaagcgactgtggtcttatctgtgccacatacagcctaaaatgcctatccagaaatcccagatcgttggaaaggaaaatgggtactcctgtgccacaggggttccacgactagggaacgtccgtttacc

SEQ ID NO: 660401 - DNA, 153 bp, Homo sapiens
cacgaggttgaccccttgtccacttactctaacaggtctggaggaaattcatttaaagatggaagaagaacaagttctactttagaggcggaagggacatttacttcctatatgaaagaatgggaataactatttgcaaacaagaattacttg

SEQ ID NO: 660402 - DNA, 131 bp, Homo sapiens
gatctttgtccttgtgttggtttctgtgcatttgagaagtagtcacttcttttagtctttactaattcatttctgtgaggaaagaccttcaccagtcagcctaacctggggttctggatgggtcagctggt

SEQ ID NO: 660403 - DNA, 656 bp, Homo sapiens
  misc_feature (306)..(306): n is a, c, g, or t
  misc_feature (470)..(470): n is a, c, g, or t
gttcgccctcttcattgccagactacttgggctgtcgcgaagtctgatatgacccagcctcaccccctggaccgcctggtgaagagtgtgtagcctgggcagttgcccgaggggcacagcgccactgtgtgaggccaggtgtgagcccaccatgataagacgtgccttgagggagtcctaggaaccccggcgttgagtcacgctgtgcccctggcacagaatcggaaagtctcgtcatgacctagatccatgacaggggaggacgccgctccctggaggcagtcccagggtgagctcatggctcangctcctgagtgcccagttccgactgacggcccgtggaagggggctaatctggggcgtgtggacccaatggttggatgggcgtacgaggattgagcgcatggcatgcctacccggacgagggtgctggtgttgcccagtgcttccagacatgcgtgcttcaaggntcctgttgcaccggtccgaatgtgccgctatgtgcctcggcgctcattgtcaggcacaataccatgggagctatgtattgccagtgaacgcatggcgccaagccctgagactgggatgggacgacaacccaggatgggaaggaggccttgatcagaaaaaccaggggtaaagacgacatgagggaa

SEQ ID NO: 660404 - DNA, 1003 bp, Homo sapiens
tagatcattcgtccgtagcgctatctctgatagtaagtgaacatggtcataacagtgtcctgaagagatcttggtaatgattattgctttagttgctccaggcaattctataagcccggggagatatgtagtgtatgtgataacataatccatagatcggagttcttagaggtcaatgatctggcgatcgtatcaagcaacggagtccgagagcgagagcatcagatatctaaattaaagccccaggccgtgtgaacttggtcccattactggtgtctatagatcaatctgctatagtagtataagctgagctataagtatgatactgatagttcccacggttccgataccggtatcaatatagaaacttgctgtaccatagacattcctcgattcatttgtatgccctcagaagtattgagttcctacagagtgttgtgaaaccggagtatatacctatctatattcagttggggcctaatctttttactaattaaactattcatactccaggctttgtgtccttggcagtacatcaccacattatgtcatcctccatgatctgaataagtgggaggttagccaatcctccaatcatcagctttggcagcattgggtacagaggggctggccatagtatgtcgcaaccctggacagtcacagccatcttatcgacatgcgaatgtcataatcagccctggagacgtcaggtggcgtgcctggcgattaatttccgctggcagactaggtaggcgcgcctacctttgcggccacaacatccgtcactctacactcttttcggaatatcttaagagtaccgtccgttaacccttttacggggctacccgggcccgcgtcgagcccagggccactgccttacgggacacacgacagggagccacacacgcgggccagtccggagacgagccagacttcgcacggcactcagcatcacaccaccaccatagagtagcagacggcacggaggtgtatacaaattcat

SEQ ID NO: 660405 - DNA, 181 bp, Homo sapiens
gcatctcaggccgatccctcttgccctgcgccaagatcctcatggacggtgcccactacctcttattgggtacctgtttagccgccatctctgtcagggttccgtatgctattatgtttgatctgcgagctccttgcccaatggtcttggtcctcctacaatcaacagtgtacgtccgccg

SEQ ID NO: 660406 - DNA, 143 bp, Homo sapiens
cagatacgactcgagctcggtaccatctgaaatggtaggctcttctaatttcgagtccaaatccataaggccaaaggttatcccaaagaccaccacacacacactctctacacaccgtccttctatgtctggatgcatggaac

SEQ ID NO: 660407 - DNA, 311 bp, Homo sapiens
gctatcgggcccataccccgaaaatgttggttatacccttcccgtactaattaatcccctggcccaacccgtcatctactctaccatctttgcaggcacactcatcacagcgctaggctcgcactgattttttaacctaagtaggcctggaattaaccatgctagctttaattccagtctctaaccaaaaaatataaaccctcgttcacacagagggctgccatcagtgtattttcccatcagcgcagcgcagcccagcatacataattccttcctaatatgctactcctctacaacaactactactctcc

SEQ ID NO: 660408 - DNA, 241 bp, Homo sapiens
ggcagggcatgaggccaccaatggttgtatcaactataaaaagctcgtccgcatggggttgaaagggtgaggaccttcccagtctccccaaaggccgggcctttccctgggtgaattttgtatttagcctaaagtttccctaggctttcttgtcccaacaactttcccattttgtcttttttggaaaatgtttgccgtcagcattccccaaataaacttgctttccggccaaaaaaaaaaa

SEQ ID NO: 660409 - DNA, 155 bp, Homo sapiens
  misc_feature (126)..(126): n is a, c, g, or t
cgactgactggggaggaccggggtgggtttggtatgttcaaactgtcatttatcattttcacgtttgttcagcatcatgggcgcagtcatgtgtgcatctgcagtgtggcatgtagcattcaggcngatagtgctagcacagtcagcagtgttca

SEQ ID NO: 660410 - DNA, 144 bp, Homo sapiens
tatggagagatggagcagcaatgtaagacctggggaaaggggactccaggcccacgaacagcaaagaaacaacctctggggtggtggacagcatttgaagaacaacaacgacaaaaaaccccaccctgactggagcccagttgg

SEQ ID NO: 660411 - DNA, 735 bp, Homo sapiens
gttaagagctgccgaaatgcacagaggtgaaaatgacaaaccaaatggaatttctcttcagagttcagaatttctcagatactaaggaggaagaaaggatccactacttcttgttcttatgaatgactctagaaaaatcagaatcaagttgtgggtggaaaaatcaacgtggcctttgagttcagttgttataaaccattgtgactattgttggtcaaagtattggtacttatattgttagtaattgcatcataattacattaccagtgttggaaaaactaatgaagaaacactgtaattgctactcagcaatgttgactaaacaggtgtttgcggtataaggatgtctgtttaagttactccttttacctatcaatatactggtaatggttgtatgtgtgatgctattggccaggaatatgaagtatctgtttttggaattcactttattttaacacgataagcgcttgactgggcacgggtgccttcattgccttgtaattccttagcaacctttggagggctgagggcaggtggatccaccttaggttcaggagtttccaacaaaaaccaagccttgacccaaactattggttgaaaccccaatttcttattagaaattaccaaaaattcagccgggtcctcattggccaggccacctggttaattccatttctaattgaggccggaagaatggtttgcccaaggaaggcaagaggttgcatgaggccaaga

SEQ ID NO: 660412 - DNA, 4446 bp, Homo sapiens
  misc_feature (27)..(27): n is a, c, g, or t
  misc_feature (30)..(30): n is a, c, g, or t
gcgtagctgacgtcatcgccgtgcgcngcnacgtctgctcagctccgcggtaatggaggctagggatgggtgctgaagtatcaggctctggctctagctttagctctggcactggaactgcgtcggagtctgggtctgagtctggcagcccgaagcctggacaccttttcttgattctctaggcgggggctgcctgcgtccaagcagctggtttgcagcgttccaacgctgggagggagttcccttacctggggtccagtctgtaaagttgtcgccgctttctagggaccccgccccaccggctgggactcttccatgcagttgaaactggttgacaaccattaacctgggttgcaactacaggtggcactggaagcagactggttcctggacatgcccggtggaaggaggggccctagtcggcaacagctaagccgttcagctttaccttctttgcagactttggttggtggaggctgtggcaatggaacaggcttgagaaacaggaatggtagtgctattggccttccagtcccacctatcacagccttaatcaccccaggtcctgttcgtcattgccaaattcctgacttgcctgtggatgggagcctactctttgaattcctttttttcatctacctgttggttgctcttttcattcagtacatcaacatttataaaacagtgtggtggtatccttacaatcatcctgcttcttgtacatcactgaattttcatctcattgattatcatctggcagcattcatcacagtgatgcttgcgaggaggcttgtatgggctctcatctcagaggtctgtgtgtgtaagctctgattttcaggaaccctatttctggaagcagagtaactggaaatactaagtcaagatctgaaaaccatttgaagttaaccaaaaagcacaggctactaaggcaggtgcagcatcaatgattcactacatggttctgatatcagctcgcttggtactactcactttgtgtggatgggtactttgttggaccctcgtcaatctctttcgaagccattcagtcctcaatctccttttccttggctacccgtttggtgtttatgttcctctttgctgttttcatcaagatagtagagcacatcttcttctcacagactacaactatgtggttcagcacgaggcagtagaggaaagtgcctcgactgtgggaggcttggccaaatccaaagactttctctccttgttgctggagtcgctaaaagaacagtttaataatgccacacccatccccacccacagttgtcccctatctccagacctcattcgcaatgaagtagaatgtctgaaagcagatttcaaccacagaatcaaggaggttctcttcaactccctcttcagtgcctactatgttgcatttctccccctgtgttttgtgaagagtacccagtactatgacatgcgctggtcatgtgagcacctcattatggtgtggatcaatgcttttgtcatgctcaccacgcaactgttgccatccaaatactgtgatttgctacataaatcagctgctcacctgggcaagtggcagaagttggaacatgggtcctacagcaatgctccacagcacatttggtcagaaaatacaatatggcctcaaggggtgctggtgcggcacagcagatgtttatatagagccatggggccttacaacgtggcagtgccttcagatgtatctcatgcccgcttttatttcttatttcatcgaccattaaggctgttaaatctgctcatccttattgagggcagtgtcgtcttctatcagctctattccttgctgcggtcggagaagtggaaccacacactttccatggctctcatcctcttctgcaactactatgttttatttaaacttctccgggacagaatagtattaggcagggcatactcctacccactcaacagttatgaactcaaggcaaactaagctgcctctcaacaatgagggagaactcagataaaaatattttcatacgttctatttttttcttgtgatttttataaatatttaagatattttatattttgtatactattatgttttgaaagtcgggaagagtaagggatattaaatgtatccgtaaacaaggtgatgtgatctttcatgtgttagtatattcgaataatatacatatgagaggtatgcctgtccagtaaagagattgatttgtttgtatggctctggaataactcattcgtttatgaacacatctcatgtattacttgacacagtacctttggtatgtctgcttttctttcaatcctcattatctttagccctcagctggccagtacttattgctaaagaaagggagatcaatggagttgcctaccagcacccattctcttttagttcagctggctaatagtattggaatacattgggaaaagagtgggttaaagtcctaggtggggttctctttgttgcctaccaggagaaagcagtaggcttcctttctaagatacggactcagctggtctattttaccctgtgacatttaaatatacttttgaataagctactatcctgaggctgagggttttgctgccacttttcctgtgtttccacttctgcttccaaagattttcctcttagttgtttgaaataatactttgccagacaggaagtctttagactgcccacattcatgaagaagatgatgtgtggctggatcagtaggagaagctgagtgcaaatgccatgtgggctagagtatgggaaggttgaaaattccaagtaactgggagagtgggcaagtcctcagctgaacaatcttggatgtagtctagcagcaacccacctacaatggcgttatgtttggagttatgaggggaagtgaaagataagaattacctacagctttgtactcagataatttatatccaaaatttgtgttttaaatttcatactccagaactttcatgtttatgagtattagccttttaagttatgggaggtgatatacttagtccattgatgttgtcacttgtcatctaaacttatgagaccttgtcttagagaatctaaaatatattgtcatatgttttctgtgctgagtttggtttgttacactgtgaagcttttggtgaaacaaaataagacttatgaagtaaaaagaccaatcatgtcgttgacaagctggctctgaaaataattcttgcagaagagttcctgaaaggcttcaccaaggggaagtattgtgaggagtgtttgtaaaaccaaggtacccaatatcagttttatgtttaaatcaataattgtttctttaaatattttgatgtgtatactttttttttaagttaacattatttggcattcagtctgagtctgttcaaccattcaacaaatatatattaaccagtaggcactatattaggccctggggatatagcagtgaatgagaaatgcaaaggtcctacttgcacagagcttacaatatgcgtgggggtgggggagttaggtggtgcagaaaatacagcaaataaatttatgtgtaatataacattccctggtagtagtgataagtgtagcaaagggaaatcaggacaaggaaatagtggtaagaatagcactgctagaaggcatctttgaggagatgatttttaagcaaagaaaaagcaagactgaatcatataaatagctttggggagaattccatgttacagtagcagaaagggcagtgccctgaggtggggacaagttggtatattggaagaatagcaagaaaatatattaggttagttgctttttaaagtagttcagcctaaatatagtggttcttgaggtaggggtgggaagggtagggaatctgccatctttctattctttctgtaggatcttgaaaatatgcttctcttggcagcaacattttcatgagattactcagcagttgagagcaaaatgggtggcatgggcacagagatatctcatcaaaattgccccaacttggctccagcttgggaaagtaacccagaaaaccctgattagagataacagaccagtcttatgaactaatatgatgccccttctggcttgatctgtcttggtcctatcctaagggaatagcacagaaccagatgctggcttggctaaataagtaagtggatataagaaataaataaaaattaattttggctaatggaattgcaaagttcctcctaccctcacctccagatatggcagcatacggggcataagaccgtttagttcaacgtgttctacacattccagctgttttttgtttgtttgttttgttgttttgtttttgtaggggccacgttcatggaagagagaaaaattactagttacccggatatcctattatagttcatgtaacagaagggacactatatttgctcactgatagtagaaaaatgtgtaatcattaaagaatgacctttttt

SEQ ID NO: 660413 - DNA, 221 bp, Homo sapiens
gtattcatcttgcaggttgctcttcctccacatacgagtggggtctcgaatgaggacgggggtcggaaatcctccaggatcttaggaaattccactaccgcttctcctgctcaatggtctctttggtcggcaggatgttcttctcgctgcgtctccgtttttcttcagcgttggcctatatcgaagcgtgtcgatatcccccgatgtcgtggtttgtctgc

SEQ ID NO: 660414 - DNA, 4337 bp, Homo sapiens
  misc_feature (27)..(27): n is a, c, g, or t
  misc_feature (30)..(30): n is a, c, g, or t
gcgtagctgacgtcatcgccgtgcgcngcnacgtctgctcagctccgcggtaatggaggctagggatgggtgctgaagtatcaggctctggctctagctttagctctggcactggaactgcgtcggagtctgggtctgagtctggcagcccgaagcctggacaccttttcttgattctctaggcgggggctgcctgcgtccaagcagctggtttgcagcgttccaacgctgggagggagttcccttacctggggtccagtctgtaaagttgtcgccgctttctagggaccccgccccaccggctgggactcttccatgcagttgaaactggttgacaaccattaacctgggttgcaactacaggtggcactggaagcagactggttcctggacatgcccggtggaaggaggggccctagtcggcaacagctaagccgttcagctttaccttctttgcagactttggttggtggaggctgtggcaatggaacaggcttgagaaacaggaatggtagtgctattggccttccagtcccacctatcacagccttaatcaccccaggtcctgttcgtcattgccaaattcctgacttgcctgtggatgggagcctactctttgaattcctttttttcatctacctgttggttgctcttttcattcagtacatcaacatttataaaacagtgtggtggtatccttacaatcatcctgcttcttgtacatcactgaattttcatctcattgattatcatctggcagcattcatcacagtgatgcttgcgaggaggcttgtatgggctctcatctcagaggctactaaggcaggtgcagcatcaatgattcactacatggttctgatatcagctcgcttggtactactcactttgtgtggatgggtactttgttggaccctcgtcaatctctttcgaagccattcagtcctcaatctccttttccttggctacccgtttggtgtttatgttcctctttgctgttttcatcaagatagtagagcacatcttcttctcacagactacaactatgtggttcagcacgaggcagtagaggaaagtgcctcgactgtgggaggcttggccaaatccaaagactttctctccttgttgctggagtcgctaaaagaacagtttaataatgccacacccatccccacccacagttgtcccctatctccagacctcattcgcaatgaagtagaatgtctgaaagcagatttcaaccacagaatcaaggaggttctcttcaactccctcttcagtgcctactatgttgcatttctccccctgtgttttgtgaagagtacccagtactatgacatgcgctggtcatgtgagcacctcattatggtgtggatcaatgcttttgtcatgctcaccacgcaactgttgccatccaaatactgtgatttgctacataaatcagctgctcacctgggcaagtggcagaagttggaacatgggtcctacagcaatgctccacagcacatttggtcagaaaatacaatatggcctcaaggggtgctggtgcggcacagcagatgtttatatagagccatggggccttacaacgtggcagtgccttcagatgtatctcatgcccgcttttatttcttatttcatcgaccattaaggctgttaaatctgctcatccttattgagggcagtgtcgtcttctatcagctctattccttgctgcggtcggagaagtggaaccacacactttccatggctctcatcctcttctgcaactactatgttttatttaaacttctccgggacagaatagtattaggcagggcatactcctacccactcaacagttatgaactcaaggcaaactaagctgcctctcaacaatgagggagaactcagataaaaatattttcatacgttctatttttttcttgtgatttttataaatatttaagatattttatattttgtatactattatgttttgaaagtcgggaagagtaagggatattaaatgtatccgtaaacaaggtgatgtgatctttcatgtgttagtatattcgaataatatacatatgagaggtatgcctgtccagtaaagagattgatttgtttgtatggctctggaataactcattcgtttatgaacacatctcatgtattacttgacacagtacctttggtatgtctgcttttctttcaatcctcattatctttagccctcagctggccagtacttattgctaaagaaagggagatcaatggagttgcctaccagcacccattctcttttagttcagctggctaatagtattggaatacattgggaaaagagtgggttaaagtcctaggtggggttctctttgttgcctaccaggagaaagcagtaggcttcctttctaagatacggactcagctggtctattttaccctgtgacatttaaatatacttttgaataagctactatcctgaggctgagggttttgctgccacttttcctgtgtttccacttctgcttccaaagattttcctcttagttgtttgaaataatactttgccagacaggaagtctttagactgcccacattcatgaagaagatgatgtgtggctggatcagtaggagaagctgagtgcaaatgccatgtgggctagagtatgggaaggttgaaaattccaagtaactgggagagtgggcaagtcctcagctgaacaatcttggatgtagtctagcagcaacccacctacaatggcgttatgtttggagttatgaggggaagtgaaagataagaattacctacagctttgtactcagataatttatatccaaaatttgtgttttaaatttcatactccagaactttcatgtttatgagtattagccttttaagttatgggaggtgatatacttagtccattgatgttgtcacttgtcatctaaacttatgagaccttgtcttagagaatctaaaatatattgtcatatgttttctgtgctgagtttggtttgttacactgtgaagcttttggtgaaacaaaataagacttatgaagtaaaaagaccaatcatgtcgttgacaagctggctctgaaaataattcttgcagaagagttcctgaaaggcttcaccaaggggaagtattgtgaggagtgtttgtaaaaccaaggtacccaatatcagttttatgtttaaatcaataattgtttctttaaatattttgatgtgtatactttttttttaagttaacattatttggcattcagtctgagtctgttcaaccattcaacaaatatatattaaccagtaggcactatattaggccctggggatatagcagtgaatgagaaatgcaaaggtcctacttgcacagagcttacaatatgcgtgggggtgggggagttaggtggtgcagaaaatacagcaaataaatttatgtgtaatataacattccctggtagtagtgataagtgtagcaaagggaaatcaggacaaggaaatagtggtaagaatagcactgctagaaggcatctttgaggagatgatttttaagcaaagaaaaagcaagactgaatcatataaatagctttggggagaattccatgttacagtagcagaaagggcagtgccctgaggtggggacaagttggtatattggaagaatagcaagaaaatatattaggttagttgctttttaaagtagttcagcctaaatatagtggttcttgaggtaggggtgggaagggtagggaatctgccatctttctattctttctgtaggatcttgaaaatatgcttctcttggcagcaacattttcatgagattactcagcagttgagagcaaaatgggtggcatgggcacagagatatctcatcaaaattgccccaacttggctccagcttgggaaagtaacccagaaaaccctgattagagataacagaccagtcttatgaactaatatgatgccccttctggcttgatctgtcttggtcctatcctaagggaatagcacagaaccagatgctggcttggctaaataagtaagtggatataagaaataaataaaaattaattttggctaatggaattgcaaagttcctcctaccctcacctccagatatggcagcatacggggcataagaccgtttagttcaacgtgttctacacattccagctgttttttgtttgtttgttttgttgttttgtttttgtaggggccacgttcatggaagagagaaaaattactagttacccggatatcctattatagttcatgtaacagaagggacactatatttgctcactgatagtagaaaaatgtgtaatcattaaagaatgacctttttt

SEQ ID NO: 660415 - DNA, 4693 bp, Homo sapiens
  misc_feature (27)..(27): n is a, c, g, or t
  misc_feature (30)..(30): n is a, c, g, or t
gcgtagctgacgtcatcgccgtgcgcngcnacgtctgctcagctccgcggtaatggaggctagggatgggtgctgaagtatcaggctctggctctagctttagctctggcactggaactgcgtcggagtctgggtctgagtctggcagcccgaagcctggacaccttttcttgattctctaggcgggggctgcctgcgtccaagcagctggtttgcagcgttccaacgctgggagggagttcccttacctggggtccagtctgtaaagttgtcgccgctttctagggaccccgccccaccggctgggactcttccatgcagttgaaactggttgacaaccattaacctgggttgcaactacaggtggcactggaagcagactggttcctggacatgcccggtggaaggaggggccctagtcggcaacagctaagccgttcagctttaccttctttgcagactttggttggtggaggctgtggcaatggaacaggcttgagaaacaggaatggtagtgctattggccttccagtcccacctatcacagccttaatcaccccaggtcctgttcgtcattgccaaattcctgacttgcctgtggatgggagcctactctttgaattcctttttttcatctacctgttggttgctcttttcattcagtacatcaacatttataaaacagtgtggtggtatccttacaatcatcctgcttcttgtacatcactgaattttcatctcattgattatcatctggcagcattcatcacagtgatgcttgcgaggaggcttgtatgggctctcatctcagaggctactaaggcaggtgcagcatcaatgattcactacatggttctgatatcagctcgcttggtactactcactttgtgtggatgggtactttgttggaccctcgtcaatctctttcgaagccattcagtcctcaatctccttttccttggctacccgtttggtgtttatgttcctctttgctgttttcatcaagatagtagagcacatcttcttctcacagactacaactatgtggttcagcacgaggcagtagaggaaagtgcctcgactgtgggaggcttggccaaatccaaagactttctctccttgttgctggagtcgctaaaagaacagtttaataatgccacacccatccccacccacagttgtcccctatctccagacctcattcgcaatgaagtagaatgtctgaaagcagatttcaaccacagaatcaaggaggttctcttcaactccctcttcagtgcctactatgttgcatttctccccctgtgttttgtgaagagtacccagtactatgacatgcgctggtcatgtgagcacctcattatggtgtggatcaatgcttttgtcatgctcaccacgcaactgttgccatccaaatactgtgatttgctacataaatcagctgctcacctgggcaagtggcagaagttggaacatgggtcctacagcaatgctccacagcacatttggtcagaaaatacaatatggcctcaaggggtgctggtgcggcacagcagatgtttatatagagccatggggccttacaacgtggcagtgccttcagatgtatctcatgcccgcttttatttcttatttcatcgaccattaaggctgttaaatctgctcatccttattgagggcagtgtcgtcttctatcagctctattccttgctgcggtcggagaagtggaaccacacactttccatggctctcatcctcttctgcaactactatgttttatttaaacttctccgggacagaatagtattaggcagggcatactcctacccactcaacagttatgaactcaaggcaaactaagctgcctctcaacaatgagggagaactcagataaaaatattttcatacgttctatttttttcttgtgatttttataaatatttaagatattttatattttgtatactattatgttttgaaagtcgggaagagtaagggatattaaatgtatccgtaaacaaggtgatgtgatctttcatgtgttagtatattcgaataatatacatatgagaggtatgcctgtccagtaaagagattgatttgtttgtatggctctggaataactcattcgtttatgaacacatctcatgtattacttgacacagtacctttggtatgtctgcttttctttcaatcctcattatctttagccctcagctggccagtacttattgctaaagaaagggagatcaatggagttgcctaccagcacccattctcttttagttcagctggctaatagtattggaatacattgggaaaagagtgggttaaagtcctaggtggggttctctttgttgcctaccaggagaaagcagtaggcttcctttctaagatacggactcagctggtctattttaccctgtgacatttaaatatacttttgaataagctactatcctgaggctgagggttttgctgccacttttcctgtgtttccacttctgcttccaaagattttcctcttagttgtttgaaataatactttgccagacaggaagtctttagactgcccacattcatgaagaagatgatgtgtggctggatcagtaggagaagctgagtgcaaatgccatgtgggctagagtatgggaaggttgaaaattccaagtaactgggagagtgggcaagtcctcagctgaacaatcttggatgtagtctagcagcaacccacctacaatggcgttatgtttggagttatgaggggaagtgaaagataagaattacctacagctttgtactcagataatttatatccaaaatttgtgttttaaatttcatactccagaactttcatgtttatgagtattagccttttaagttatgggaggtgatatacttagtccattgatgttgtcacttgtcatctaaacttatgagaccttgtcttagagaatctaaaatatattgtcatatgttttctgtgctgagtttggtttgttacactgtgaagcttttggtgaaacaaaataagacttatgaagtaaaaagaccaatcatgtcgttgacaagctggctctgaaaataattcttgcagaagagttcctgaaaggcttcaccaaggggaagtattgtgaggagtgtttgtaaaaccaaggtacccaatatcagttttatgtttaaatcaataattgtttctttaaatattttgatgtgtatactttttttttaagttaacattatttggcattcagtctgagtctgttcaaccattcaacaaatatatattaaccagtaggcactatattaggccctggggatatagcagtgaatgagaaatgcaaaggtcctacttgcacagagcttacaatatgcgtgggggtgggggagttaggtggtgcagaaaatacagcaaataaatttatgtgtaatataacattccctggtagtagtgataagtgtagcaaagggaaatcaggacaaggaaatagtggtaagaatagcactgctagaaggcatctttgaggagatgatttttaagcaaagaaaaagcaagactgaatcatataaatagctttggggagaattccatgttacagtagcagaaagggcagtgccctgaggtggggacaagttggtatattggaagaatagcaagaaaatatattaggttagttgctttttaaagtagttcagcctaaatatagtggttcttgaggtaggggtgggaagggtagggaatctgccatctttctattctttctgtaggatcttgaaaatatgcttctcttggcagcaacattttcatgagattactcagcagttgagagcaaaatgggtggcatgggcacagagatatctcatcaaaattgccccaacttggctccagcttgggaaagtaacccagaaaaccctgattagagataacagaccagtcttatgaactaatatgatgccccttctggcttgatctgtcttggtcctatcctaagggaatagcacagaaccagatgctggcttggctaaataagtaagtggatataagaaataaataaaaattaattttggctaatggaattgcaaagttcctcctaccctcacctccagatatggcagcatacggggcataagaccgtttagttcaacgtgttctacacattccagctgttttttgtttgtttgttttgttgttttgtttttgtaggggccacgttcatggaagagagaaaaattactagttacccggatatcctattatagttcatgtaacagaagggacactatatttgctcactgatagtagaaaaatgtgtaatcattaaagaatgaccttttttgtaattctttgttggcaagttaaaattgtttgtggaaagcatggtatagcaaaagttcagttgggtgaactgggatactggaaaaggaaagaagatacttgactagtctgggtggtctaaggtgggtaaataaaggagtagaggagggtagttcacaggaatgagcatgacagaagttttcctcaatatcctgtttactctgattccatgtttatgttcctaatcctcctttccttcctgtcccaatcagtcaccagccactgccacctgttgtgccgtttctctctcttttttttaagtaattttttgatttcatattaagctagccagggatctcaatttctatcgactagggc

SEQ ID NO: 660416 - DNA, 4098 bp, Homo sapiens
  misc_feature (27)..(27): n is a, c, g, or t
  misc_feature (30)..(30): n is a, c, g, or t
gcgtagctgacgtcatcgccgtgcgcngcnacgtctgctcagctccgcggtaatggaggctagggatgggtgctgaagtatcaggctctggctctagctttagctctggcactggaactgcgtcggagtctgggtctgagtctggcagcccgaagcctggacaccttttcttgattctctaggcgggggctgcctgcgtccaagcagctggtttgcagcgttccaacgctgggagggagttcccttacctggggtccagtctgtaaagttgtcgccgctttctagggaccccgccccaccggctgggactcttccatgcagttgaaactggttgacaaccattaacctgggttgcaactacaggtggcactggaagcagactggttcctggacatgcccggtggaaggaggggccctagtcggcaacagctaagccgttcagctttaccttctttgcagactttggttggtggaggctgtggcaatggaacaggcttgagaaacaggaatggtagtgctattggccttccagtcccacctatcacagccttaatcaccccaggtcctgttcgtcattgccaaattcctgacttgcctgtggatgggagcctactctttgaattcctttttttcatctacctgttggttgctcttttcattcagtacatcaacatttataaaacagtgtggtggtatccttacaatcatcctgcttcttgtacatcactggtttggtgtttatgttcctctttgctgttttcatcaagatagtagagcacatcttcttctcacagactacaactatgtggttcagcacgaggcagtagaggaaagtgcctcgactgtgggaggcttggccaaatccaaagactttctctccttgttgctggagtcgctaaaagaacagtttaataatgccacacccatccccacccacagttgtcccctatctccagacctcattcgcaatgaagtagaatgtctgaaagcagatttcaaccacagaatcaaggaggttctcttcaactccctcttcagtgcctactatgttgcatttctccccctgtgttttgtgaagagtacccagtactatgacatgcgctggtcatgtgagcacctcattatggtgtggatcaatgcttttgtcatgctcaccacgcaactgttgccatccaaatactgtgatttgctacataaatcagctgctcacctgggcaagtggcagaagttggaacatgggtcctacagcaatgctccacagcacatttggtcagaaaatacaatatggcctcaaggggtgctggtgcggcacagcagatgtttatatagagccatggggccttacaacgtggcagtgccttcagatgtatctcatgcccgcttttatttcttatttcatcgaccattaaggctgttaaatctgctcatccttattgagggcagtgtcgtcttctatcagctctattccttgctgcggtcggagaagtggaaccacacactttccatggctctcatcctcttctgcaactactatgttttatttaaacttctccgggacagaatagtattaggcagggcatactcctacccactcaacagttatgaactcaaggcaaactaagctgcctctcaacaatgagggagaactcagataaaaatattttcatacgttctatttttttcttgtgatttttataaatatttaagatattttatattttgtatactattatgttttgaaagtcgggaagagtaagggatattaaatgtatccgtaaacaaggtgatgtgatctttcatgtgttagtatattcgaataatatacatatgagaggtatgcctgtccagtaaagagattgatttgtttgtatggctctggaataactcattcgtttatgaacacatctcatgtattacttgacacagtacctttggtatgtctgcttttctttcaatcctcattatctttagccctcagctggccagtacttattgctaaagaaagggagatcaatggagttgcctaccagcacccattctcttttagttcagctggctaatagtattggaatacattgggaaaagagtgggttaaagtcctaggtggggttctctttgttgcctaccaggagaaagcagtaggcttcctttctaagatacggactcagctggtctattttaccctgtgacatttaaatatacttttgaataagctactatcctgaggctgagggttttgctgccacttttcctgtgtttccacttctgcttccaaagattttcctcttagttgtttgaaataatactttgccagacaggaagtctttagactgcccacattcatgaagaagatgatgtgtggctggatcagtaggagaagctgagtgcaaatgccatgtgggctagagtatgggaaggttgaaaattccaagtaactgggagagtgggcaagtcctcagctgaacaatcttggatgtagtctagcagcaacccacctacaatggcgttatgtttggagttatgaggggaagtgaaagataagaattacctacagctttgtactcagataatttatatccaaaatttgtgttttaaatttcatactccagaactttcatgtttatgagtattagccttttaagttatgggaggtgatatacttagtccattgatgttgtcacttgtcatctaaacttatgagaccttgtcttagagaatctaaaatatattgtcatatgttttctgtgctgagtttggtttgttacactgtgaagcttttggtgaaacaaaataagacttatgaagtaaaaagaccaatcatgtcgttgacaagctggctctgaaaataattcttgcagaagagttcctgaaaggcttcaccaaggggaagtattgtgaggagtgtttgtaaaaccaaggtacccaatatcagttttatgtttaaatcaataattgtttctttaaatattttgatgtgtatactttttttttaagttaacattatttggcattcagtctgagtctgttcaaccattcaacaaatatatattaaccagtaggcactatattaggccctggggatatagcagtgaatgagaaatgcaaaggtcctacttgcacagagcttacaatatgcgtgggggtgggggagttaggtggtgcagaaaatacagcaaataaatttatgtgtaatataacattccctggtagtagtgataagtgtagcaaagggaaatcaggacaaggaaatagtggtaagaatagcactgctagaaggcatctttgaggagatgatttttaagcaaagaaaaagcaagactgaatcatataaatagctttggggagaattccatgttacagtagcagaaagggcagtgccctgaggtggggacaagttggtatattggaagaatagcaagaaaatatattaggttagttgctttttaaagtagttcagcctaaatatagtggttcttgaggtaggggtgggaagggtagggaatctgccatctttctattctttctgtaggatcttgaaaatatgcttctcttggcagcaacattttcatgagattactcagcagttgagagcaaaatgggtggcatgggcacagagatatctcatcaaaattgccccaacttggctccagcttgggaaagtaacccagaaaaccctgattagagataacagaccagtcttatgaactaatatgatgccccttctggcttgatctgtcttggtcctatcctaagggaatagcacagaaccagatgctggcttggctaaataagtaagtggatataagaaataaataaaaattaattttggctaatggaattgcaaagttcctcctaccctcacctccagatatggcagcatacggggcataagaccgtttagttcaacgtgttctacacattccagctgttttttgtttgtttgttttgttgttttgtttttgtaggggccacgttcatggaagagagaaaaattactagttacccggatatcctattatagttcatgtaacagaagggacactatatttgctcactgatagtagaaaaatgtgtaatcattaaagaatgacctttttt

SEQ ID NO: 660417 - DNA, 555 bp, Homo sapiens
  misc_feature (1)..(1): n is a, c, g, or t
  misc_feature (46)..(47): n is a, c, g, or t
  misc_feature (68)..(68): n is a, c, g, or t
  misc_feature (71)..(72): n is a, c, g, or t
  misc_feature (75)..(77): n is a, c, g, or t
  misc_feature (82)..(82): n is a, c, g, or t
  misc_feature (84)..(84): n is a, c, g, or t
  misc_feature (97)..(97): n is a, c, g, or t
  misc_feature (100)..(100): n is a, c, g, or t
  misc_feature (102)..(103): n is a, c, g, or t
  misc_feature (105)..(105): n is a, c, g, or t
  misc_feature (107)..(107): n is a, c, g, or t
  misc_feature (110)..(111): n is a, c, g, or t
  misc_feature (113)..(113): n is a, c, g, or t
  misc_feature (116)..(117): n is a, c, g, or t
  misc_feature (120)..(120): n is a, c, g, or t
  misc_feature (123)..(123): n is a, c, g, or t
  misc_feature (126)..(126): n is a, c, g, or t
  misc_feature (137)..(138): n is a, c, g, or t
  misc_feature (147)..(147): n is a, c, g, or t
  misc_feature (150)..(150): n is a, c, g, or t
  misc_feature (163)..(163): n is a, c, g, or t
  misc_feature (172)..(172): n is a, c, g, or t
  misc_feature (174)..(174): n is a, c, g, or t
  misc_feature (177)..(177): n is a, c, g, or t
  misc_feature (184)..(184): n is a, c, g, or t
  misc_feature (187)..(187): n is a, c, g, or t
  misc_feature (191)..(192): n is a, c, g, or t
  misc_feature (195)..(195): n is a, c, g, or t
  misc_feature (200)..(200): n is a, c, g, or t
  misc_feature (202)..(202): n is a, c, g, or t
  misc_feature (205)..(208): n is a, c, g, or t
  misc_feature (210)..(210): n is a, c, g, or t
  misc_feature (212)..(213): n is a, c, g, or t
  misc_feature (216)..(216): n is a, c, g, or t
  misc_feature (221)..(221): n is a, c, g, or t
  misc_feature (223)..(224): n is a, c, g, or t
  misc_feature (227)..(227): n is a, c, g, or t
  misc_feature (231)..(231): n is a, c, g, or t
  misc_feature (248)..(248): n is a, c, g, or t
  misc_feature (250)..(251): n is a, c, g, or t
  misc_feature (255)..(256): n is a, c, g, or t
  misc_feature (258)..(260): n is a, c, g, or t
  misc_feature (276)..(276): n is a, c, g, or t
  misc_feature (279)..(279): n is a, c, g, or t
  misc_feature (303)..(303): n is a, c, g, or t
  misc_feature (308)..(309): n is a, c, g, or t
  misc_feature (312)..(312): n is a, c, g, or t
  misc_feature (319)..(319): n is a, c, g, or t
  misc_feature (323)..(323): n is a, c, g, or t
  misc_feature (328)..(328): n is a, c, g, or t
  misc_feature (331)..(332): n is a, c, g, or t
  misc_feature (334)..(335): n is a, c, g, or t
  misc_feature (339)..(339): n is a, c, g, or t
  misc_feature (344)..(344): n is a, c, g, or t
  misc_feature (347)..(348): n is a, c, g, or t
  misc_feature (351)..(351): n is a, c, g, or t
  misc_feature (357)..(357): n is a, c, g, or t
  misc_feature (365)..(365): n is a, c, g, or t
  misc_feature (367)..(368): n is a, c, g, or t
  misc_feature (371)..(372): n is a, c, g, or t
  misc_feature (375)..(376): n is a, c, g, or t
  misc_feature (382)..(382): n is a, c, g, or t
  misc_feature (389)..(390): n is a, c, g, or t
  misc_feature (393)..(393): n is a, c, g, or t
  misc_feature (395)..(395): n is a, c, g, or t
  misc_feature (397)..(397): n is a, c, g, or t
  misc_feature (401)..(401): n is a, c, g, or t
  misc_feature (406)..(408): n is a, c, g, or t
  misc_feature (410)..(410): n is a, c, g, or t
  misc_feature (418)..(418): n is a, c, g, or t
  misc_feature (421)..(421): n is a, c, g, or t
  misc_feature (423)..(423): n is a, c, g, or t
  misc_feature (435)..(435): n is a, c, g, or t
  misc_feature (438)..(440): n is a, c, g, or t
  misc_feature (443)..(444): n is a, c, g, or t
  misc_feature (464)..(464): n is a, c, g, or t
  misc_feature (474)..(474): n is a, c, g, or t
  misc_feature (488)..(488): n is a, c, g, or t
  misc_feature (492)..(492): n is a, c, g, or t
  misc_feature (497)..(498): n is a, c, g, or t
  misc_feature (504)..(504): n is a, c, g, or t
  misc_feature (510)..(511): n is a, c, g, or t
  misc_feature (524)..(524): n is a, c, g, or t
  misc_feature (527)..(527): n is a, c, g, or t
  misc_feature (531)..(535): n is a, c, g, or t
  misc_feature (543)..(543): n is a, c, g, or t
  misc_feature (546)..(547): n is a, c, g, or t
  misc_feature (554)..(554): n is a, c, g, or t
ntctttggagacgtaaacatctccgagtggcgagggtgggcggggnngggcttgggaaagggcggggnggnntgnnngaggngnggaaagaccagangangnngngnagnntnggnnggngtnatngggggcgcggnngccgcggcngcncccgcaagggggngccggcagngnggncagggcnagngagnnggngcgangnggnnnnanannggncgggncnngcnaacngcaaccagggaggcgangnngggnnannngagggaccgagaccgnggnggggacggaggggggggggcaccncgagnnggnggaaggngggnagggnccnnanngggnaagangtnnggnaacccnggggaganannagnnaannagaagnggaatcnngangngnggcngaaannngngaagaagnggnancaagagcacccngannnggnnaggcgcacagcacaagaggnggaaacatanagaagaagcaaggnaatnacagnnagaggncacaanngcccgaagccagngcnaaannnnnatgaagcnaanntccctgna

SEQ ID NO: 660418 - DNA, 4281 bp, Homo sapiens
  misc_feature (27)..(27): n is a, c, g, or t
  misc_feature (30)..(30): n is a, c, g, or t
gcgtagctgacgtcatcgccgtgcgcngcnacgtctgctcagctccgcggtaatggaggctagggatgggtgctgaagtatcaggctctggctctagctttagctctggcactggaactgcgtcggagtctgggtctgagtctggcagcccgaagcctggacaccttttcttgattctctaggcgggggctgcctgcgtccaagcagctggtttgcagcgttccaacgctgggagggagttcccttacctggggtccagtctgtaaagttgtcgccgctttctagggaccccgccccaccggctgggactcttccatgcagttgaaactggttgacaaccattaacctgggttgcaactacaggtggcactggaagcagactggttcctggacatgcccggtggaaggaggggccctagtcggcaacagctaagccgttcagctttaccttctttgcagactttggttggtggaggctgtggcaatggaacaggcttgagaaacaggtcctgttcgtcattgccaaattcctgacttgcctgtggatgggagcctactctttgaattcctttttttcatctacctgttggttgctcttttcattcagtacatcaacatttataaaacagtgtggtggtatccttacaatcatcctgcttcttgtacatcactgaattttcatctcattgattatcatctggcagcattcatcacagtgatgcttgcgaggaggcttgtatgggctctcatctcagaggctactaaggcaggtgcagcatcaatgattcactacatggttctgatatcagctcgcttggtactactcactttgtgtggatgggtactttgttggaccctcgtcaatctctttcgaagccattcagtcctcaatctccttttccttggctacccgtttggtgtttatgttcctctttgctgttttcatcaagatagtagagcacatcttcttctcacagactacaactatgtggttcagcacgaggcagtagaggaaagtgcctcgactgtgggaggcttggccaaatccaaagactttctctccttgttgctggagtcgctaaaagaacagtttaataatgccacacccatccccacccacagttgtcccctatctccagacctcattcgcaatgaagtagaatgtctgaaagcagatttcaaccacagaatcaaggaggttctcttcaactccctcttcagtgcctactatgttgcatttctccccctgtgttttgtgaagagtacccagtactatgacatgcgctggtcatgtgagcacctcattatggtgtggatcaatgcttttgtcatgctcaccacgcaactgttgccatccaaatactgtgatttgctacataaatcagctgctcacctgggcaagtggcagaagttggaacatgggtcctacagcaatgctccacagcacatttggtcagaaaatacaatatggcctcaaggggtgctggtgcggcacagcagatgtttatatagagccatggggccttacaacgtggcagtgccttcagatgtatctcatgcccgcttttatttcttatttcatcgaccattaaggctgttaaatctgctcatccttattgagggcagtgtcgtcttctatcagctctattccttgctgcggtcggagaagtggaaccacacactttccatggctctcatcctcttctgcaactactatgttttatttaaacttctccgggacagaatagtattaggcagggcatactcctacccactcaacagttatgaactcaaggcaaactaagctgcctctcaacaatgagggagaactcagataaaaatattttcatacgttctatttttttcttgtgatttttataaatatttaagatattttatattttgtatactattatgttttgaaagtcgggaagagtaagggatattaaatgtatccgtaaacaaggtgatgtgatctttcatgtgttagtatattcgaataatatacatatgagaggtatgcctgtccagtaaagagattgatttgtttgtatggctctggaataactcattcgtttatgaacacatctcatgtattacttgacacagtacctttggtatgtctgcttttctttcaatcctcattatctttagccctcagctggccagtacttattgctaaagaaagggagatcaatggagttgcctaccagcacccattctcttttagttcagctggctaatagtattggaatacattgggaaaagagtgggttaaagtcctaggtggggttctctttgttgcctaccaggagaaagcagtaggcttcctttctaagatacggactcagctggtctattttaccctgtgacatttaaatatacttttgaataagctactatcctgaggctgagggttttgctgccacttttcctgtgtttccacttctgcttccaaagattttcctcttagttgtttgaaataatactttgccagacaggaagtctttagactgcccacattcatgaagaagatgatgtgtggctggatcagtaggagaagctgagtgcaaatgccatgtgggctagagtatgggaaggttgaaaattccaagtaactgggagagtgggcaagtcctcagctgaacaatcttggatgtagtctagcagcaacccacctacaatggcgttatgtttggagttatgaggggaagtgaaagataagaattacctacagctttgtactcagataatttatatccaaaatttgtgttttaaatttcatactccagaactttcatgtttatgagtattagccttttaagttatgggaggtgatatacttagtccattgatgttgtcacttgtcatctaaacttatgagaccttgtcttagagaatctaaaatatattgtcatatgttttctgtgctgagtttggtttgttacactgtgaagcttttggtgaaacaaaataagacttatgaagtaaaaagaccaatcatgtcgttgacaagctggctctgaaaataattcttgcagaagagttcctgaaaggcttcaccaaggggaagtattgtgaggagtgtttgtaaaaccaaggtacccaatatcagttttatgtttaaatcaataattgtttctttaaatattttgatgtgtatactttttttttaagttaacattatttggcattcagtctgagtctgttcaaccattcaacaaatatatattaaccagtaggcactatattaggccctggggatatagcagtgaatgagaaatgcaaaggtcctacttgcacagagcttacaatatgcgtgggggtgggggagttaggtggtgcagaaaatacagcaaataaatttatgtgtaatataacattccctggtagtagtgataagtgtagcaaagggaaatcaggacaaggaaatagtggtaagaatagcactgctagaaggcatctttgaggagatgatttttaagcaaagaaaaagcaagactgaatcatataaatagctttggggagaattccatgttacagtagcagaaagggcagtgccctgaggtggggacaagttggtatattggaagaatagcaagaaaatatattaggttagttgctttttaaagtagttcagcctaaatatagtggttcttgaggtaggggtgggaagggtagggaatctgccatctttctattctttctgtaggatcttgaaaatatgcttctcttggcagcaacattttcatgagattactcagcagttgagagcaaaatgggtggcatgggcacagagatatctcatcaaaattgccccaacttggctccagcttgggaaagtaacccagaaaaccctgattagagataacagaccagtcttatgaactaatatgatgccccttctggcttgatctgtcttggtcctatcctaagggaatagcacagaaccagatgctggcttggctaaataagtaagtggatataagaaataaataaaaattaattttggctaatggaattgcaaagttcctcctaccctcacctccagatatggcagcatacggggcataagaccgtttagttcaacgtgttctacacattccagctgttttttgtttgtttgttttgttgttttgtttttgtaggggccacgttcatggaagagagaaaaattactagttacccggatatcctattatagttcatgtaacagaagggacactatatttgctcactgatagtagaaaaatgtgtaatcattaaagaatgacctttttt

SEQ ID NO: 660419 - DNA, 240 bp, Homo sapiens
caaacatcaaataacatcagcaggatgttgcttctgtaaaagtgaaagtgatcttaagctatattaatagatgtttgcatccagatgaaggggttgttatgtattattatgtagtattatgtccagttctggataatactttttaacagaaatattgataaaacccaagggttttggcattaatgtattggattcattaattttttaggaagaaggaggaaaagtagagttgagcaggtt

SEQ ID NO: 660420 - DNA, 530 bp, Homo sapiens
ctgctgccgtccacatacaggaaatggacgatttggacaagattgcatctcgtaatgataaaagcaggccggtgcctttattccagcgctttgaggacttgaaaagagagttatcaagtcagcgagaggaagaacgtgcgtgtggcctcaagttgaactgtcttttagatattgttgacaactgaaggtgttttagtttaacataagctgctaaatggcagttcccgtctctttatttgaaacagaatgtcttttattggctgcttaattagtcagcaggtttagttttgatgttcattattttgttttattttggattcaatgaaaatgattgtcatgcatctcatccctaaatttaaatgcatgctaagtgtgtttttcttgttcttaaacatttaatttagagtttgtgcgtttgtttgtttttcaggcgtacgtgtttctgaatattaagtgtgttttgttcattgcaaatatgattttgtatttaaaatgtatattttttggcaacgataaaggtgtttttagta

SEQ ID NO: 660421 - DNA, 4293 bp, Homo sapiens
  misc_feature (27)..(27): n is a, c, g, or t
  misc_feature (30)..(30): n is a, c, g, or t
gcgtagctgacgtcatcgccgtgcgcngcnacgtctgctcagctccgcggtaatggaggctagggatgggtgctgaagtatcaggctctggctctagctttagctctggcactggaactgcgtcggagtctgggtctgagtctggcagcccgaagcctggacaccttttcttgattctctaggcgggggctgcctgcgtccaagcagctggtttgcagcgttccaacgctgggagggagttcccttacctggggtccagtctgtaaagttgtcgccgctttctagggaccccgccccaccggctgggactcttccatgcgtggcactggaagcagactggttcctggacatgcccggtggaaggaggggccctagtcggcaacagctaagccgttcagctttaccttctttgcagactttggttggtggaggctgtggcaatggaacaggcttgagaaacaggaatggtagtgctattggccttccagtcccacctatcacagccttaatcaccccaggtcctgttcgtcattgccaaattcctgacttgcctgtggatgggagcctactctttgaattcctttttttcatctacctgttggttgctcttttcattcagtacatcaacatttataaaacagtgtggtggtatccttacaatcatcctgcttcttgtacatcactgaattttcatctcattgattatcatctggcagcattcatcacagtgatgcttgcgaggaggcttgtatgggctctcatctcagaggctactaaggcaggtgcagcatcaatgattcactacatggttctgatatcagctcgcttggtactactcactttgtgtggatgggtactttgttggaccctcgtcaatctctttcgaagccattcagtcctcaatctccttttccttggctacccgtttggtgtttatgttcctctttgctgttttcatcaagatagtagagcacatcttcttctcacagactacaactatgtggttcagcacgaggcagtagaggaaagtgcctcgactgtgggaggcttggccaaatccaaagactttctctccttgttgctggagtcgctaaaagaacagtttaataatgccacacccatccccacccacagttgtcccctatctccagacctcattcgcaatgaagtagaatgtctgaaagcagatttcaaccacagaatcaaggaggttctcttcaactccctcttcagtgcctactatgttgcatttctccccctgtgttttgtgaagagtacccagtactatgacatgcgctggtcatgtgagcacctcattatggtgtggatcaatgcttttgtcatgctcaccacgcaactgttgccatccaaatactgtgatttgctacataaatcagctgctcacctgggcaagtggcagaagttggaacatgggtcctacagcaatgctccacagcacatttggtcagaaaatacaatatggcctcaaggggtgctggtgcggcacagcagatgtttatatagagccatggggccttacaacgtggcagtgccttcagatgtatctcatgcccgcttttatttcttatttcatcgaccattaaggctgttaaatctgctcatccttattgagggcagtgtcgtcttctatcagctctattccttgctgcggtcggagaagtggaaccacacactttccatggctctcatcctcttctgcaactactatgttttatttaaacttctccgggacagaatagtattaggcagggcatactcctacccactcaacagttatgaactcaaggcaaactaagctgcctctcaacaatgagggagaactcagataaaaatattttcatacgttctatttttttcttgtgatttttataaatatttaagatattttatattttgtatactattatgttttgaaagtcgggaagagtaagggatattaaatgtatccgtaaacaaggtgatgtgatctttcatgtgttagtatattcgaataatatacatatgagaggtatgcctgtccagtaaagagattgatttgtttgtatggctctggaataactcattcgtttatgaacacatctcatgtattacttgacacagtacctttggtatgtctgcttttctttcaatcctcattatctttagccctcagctggccagtacttattgctaaagaaagggagatcaatggagttgcctaccagcacccattctcttttagttcagctggctaatagtattggaatacattgggaaaagagtgggttaaagtcctaggtggggttctctttgttgcctaccaggagaaagcagtaggcttcctttctaagatacggactcagctggtctattttaccctgtgacatttaaatatacttttgaataagctactatcctgaggctgagggttttgctgccacttttcctgtgtttccacttctgcttccaaagattttcctcttagttgtttgaaataatactttgccagacaggaagtctttagactgcccacattcatgaagaagatgatgtgtggctggatcagtaggagaagctgagtgcaaatgccatgtgggctagagtatgggaaggttgaaaattccaagtaactgggagagtgggcaagtcctcagctgaacaatcttggatgtagtctagcagcaacccacctacaatggcgttatgtttggagttatgaggggaagtgaaagataagaattacctacagctttgtactcagataatttatatccaaaatttgtgttttaaatttcatactccagaactttcatgtttatgagtattagccttttaagttatgggaggtgatatacttagtccattgatgttgtcacttgtcatctaaacttatgagaccttgtcttagagaatctaaaatatattgtcatatgttttctgtgctgagtttggtttgttacactgtgaagcttttggtgaaacaaaataagacttatgaagtaaaaagaccaatcatgtcgttgacaagctggctctgaaaataattcttgcagaagagttcctgaaaggcttcaccaaggggaagtattgtgaggagtgtttgtaaaaccaaggtacccaatatcagttttatgtttaaatcaataattgtttctttaaatattttgatgtgtatactttttttttaagttaacattatttggcattcagtctgagtctgttcaaccattcaacaaatatatattaaccagtaggcactatattaggccctggggatatagcagtgaatgagaaatgcaaaggtcctacttgcacagagcttacaatatgcgtgggggtgggggagttaggtggtgcagaaaatacagcaaataaatttatgtgtaatataacattccctggtagtagtgataagtgtagcaaagggaaatcaggacaaggaaatagtggtaagaatagcactgctagaaggcatctttgaggagatgatttttaagcaaagaaaaagcaagactgaatcatataaatagctttggggagaattccatgttacagtagcagaaagggcagtgccctgaggtggggacaagttggtatattggaagaatagcaagaaaatatattaggttagttgctttttaaagtagttcagcctaaatatagtggttcttgaggtaggggtgggaagggtagggaatctgccatctttctattctttctgtaggatcttgaaaatatgcttctcttggcagcaacattttcatgagattactcagcagttgagagcaaaatgggtggcatgggcacagagatatctcatcaaaattgccccaacttggctccagcttgggaaagtaacccagaaaaccctgattagagataacagaccagtcttatgaactaatatgatgccccttctggcttgatctgtcttggtcctatcctaagggaatagcacagaaccagatgctggcttggctaaataagtaagtggatataagaaataaataaaaattaattttggctaatggaattgcaaagttcctcctaccctcacctccagatatggcagcatacggggcataagaccgtttagttcaacgtgttctacacattccagctgttttttgtttgtttgttttgttgttttgtttttgtaggggccacgttcatggaagagagaaaaattactagttacccggatatcctattatagttcatgtaacagaagggacactatatttgctcactgatagtagaaaaatgtgtaatcattaaagaatgacctttttt

SEQ ID NO: 660422 - DNA, 4116 bp, Homo sapiens
  misc_feature (1)..(1): n is a, c, g, or t
naagtggggaggataaacgaatggaccagttgcctatcctccctccctggcacccctgggaaaatggtctgcagccagaaaactgaaggtcagagaggagttgaaactggttgacaaccattaacctgggttgcaactacaggtggcactggaagcagactggttcctggacatgcccggtggaaggaggggccctagtcggcaacagctaagccgttcagctttaccttctttgcagactttggttggtggaggctgtggcaatggaacaggcttgagaaacaggaatggtagtgctattggccttccagtcccacctatcacagccttaatcaccccaggtcctgttcgtcattgccaaattcctgacttgcctgtggatgggagcctactctttgaattcctttttttcatctacctgttggttgctcttttcattcagtacatcaacatttataaaacagtgtggtggtatccttacaatcatcctgcttcttgtacatcactgaattttcatctcattgattatcatctggcagcattcatcacagtgatgcttgcgaggaggcttgtatgggctctcatctcagaggctactaaggcaggtgcagcatcaatgattcactacatggttctgatatcagctcgcttggtactactcactttgtgtggatgggtactttgttggaccctcgtcaatctctttcgaagccattcagtcctcaatctccttttccttggctacccgtttggtgtttatgttcctctttgctgttttcatcaagatagtagagcacatcttcttctcacagactacaactatgtggttcagcacgaggcagtagaggaaagtgcctcgactgtgggaggcttggccaaatccaaagactttctctccttgttgctggagtcgctaaaagaacagtttaataatgccacacccatccccacccacagttgtcccctatctccagacctcattcgcaatgaagtagaatgtctgaaagcagatttcaaccacagaatcaaggaggttctcttcaactccctcttcagtgcctactatgttgcatttctccccctgtgttttgtgaagagtacccagtactatgacatgcgctggtcatgtgagcacctcattatggtgtggatcaatgcttttgtcatgctcaccacgcaactgttgccatccaaatactgtgatttgctacataaatcagctgctcacctgggcaagtggcagaagttggaacatgggtcctacagcaatgctccacagcacatttggtcagaaaatacaatatggcctcaaggggtgctggtgcggcacagcagatgtttatatagagccatggggccttacaacgtggcagtgccttcagatgtatctcatgcccgcttttatttcttatttcatcgaccattaaggctgttaaatctgctcatccttattgagggcagtgtcgtcttctatcagctctattccttgctgcggtcggagaagtggaaccacacactttccatggctctcatcctcttctgcaactactatgttttatttaaacttctccgggacagaatagtattaggcagggcatactcctacccactcaacagttatgaactcaaggcaaactaagctgcctctcaacaatgagggagaactcagataaaaatattttcatacgttctatttttttcttgtgatttttataaatatttaagatattttatattttgtatactattatgttttgaaagtcgggaagagtaagggatattaaatgtatccgtaaacaaggtgatgtgatctttcatgtgttagtatattcgaataatatacatatgagaggtatgcctgtccagtaaagagattgatttgtttgtatggctctggaataactcattcgtttatgaacacatctcatgtattacttgacacagtacctttggtatgtctgcttttctttcaatcctcattatctttagccctcagctggccagtacttattgctaaagaaagggagatcaatggagttgcctaccagcacccattctcttttagttcagctggctaatagtattggaatacattgggaaaagagtgggttaaagtcctaggtggggttctctttgttgcctaccaggagaaagcagtaggcttcctttctaagatacggactcagctggtctattttaccctgtgacatttaaatatacttttgaataagctactatcctgaggctgagggttttgctgccacttttcctgtgtttccacttctgcttccaaagattttcctcttagttgtttgaaataatactttgccagacaggaagtctttagactgcccacattcatgaagaagatgatgtgtggctggatcagtaggagaagctgagtgcaaatgccatgtgggctagagtatgggaaggttgaaaattccaagtaactgggagagtgggcaagtcctcagctgaacaatcttggatgtagtctagcagcaacccacctacaatggcgttatgtttggagttatgaggggaagtgaaagataagaattacctacagctttgtactcagataatttatatccaaaatttgtgttttaaatttcatactccagaactttcatgtttatgagtattagccttttaagttatgggaggtgatatacttagtccattgatgttgtcacttgtcatctaaacttatgagaccttgtcttagagaatctaaaatatattgtcatatgttttctgtgctgagtttggtttgttacactgtgaagcttttggtgaaacaaaataagacttatgaagtaaaaagaccaatcatgtcgttgacaagctggctctgaaaataattcttgcagaagagttcctgaaaggcttcaccaaggggaagtattgtgaggagtgtttgtaaaaccaaggtacccaatatcagttttatgtttaaatcaataattgtttctttaaatattttgatgtgtatactttttttttaagttaacattatttggcattcagtctgagtctgttcaaccattcaacaaatatatattaaccagtaggcactatattaggccctggggatatagcagtgaatgagaaatgcaaaggtcctacttgcacagagcttacaatatgcgtgggggtgggggagttaggtggtgcagaaaatacagcaaataaatttatgtgtaatataacattccctggtagtagtgataagtgtagcaaagggaaatcaggacaaggaaatagtggtaagaatagcactgctagaaggcatctttgaggagatgatttttaagcaaagaaaaagcaagactgaatcatataaatagctttggggagaattccatgttacagtagcagaaagggcagtgccctgaggtggggacaagttggtatattggaagaatagcaagaaaatatattaggttagttgctttttaaagtagttcagcctaaatatagtggttcttgaggtaggggtgggaagggtagggaatctgccatctttctattctttctgtaggatcttgaaaatatgcttctcttggcagcaacattttcatgagattactcagcagttgagagcaaaatgggtggcatgggcacagagatatctcatcaaaattgccccaacttggctccagcttgggaaagtaacccagaaaaccctgattagagataacagaccagtcttatgaactaatatgatgccccttctggcttgatctgtcttggtcctatcctaagggaatagcacagaaccagatgctggcttggctaaataagtaagtggatataagaaataaataaaaattaattttggctaatggaattgcaaagttcctcctaccctcacctccagatatggcagcatacggggcataagaccgtttagttcaacgtgttctacacattccagctgttttttgtttgtttgttttgttgttttgtttttgtaggggccacgttcatggaagagagaaaaattactagttacccggatatcctattatagttcatgtaacagaagggacactatatttgctcactgatagtagaaaaatgtgtaatcattaaagaatgacctttttt

SEQ ID NO: 660423 - DNA, 105 bp, Homo sapiens
atattatatacctacttctattatcccacttcccctatcctatataccctataattatagagacagggtctcgcactgtcatcacccaggctggagtgcagtggc

SEQ ID NO: 660424 - DNA, 821 bp, Homo sapiens
cattgctgcccaattctatggatcccacacgacaacaaggccaccccattacatggtgaggatcaatgcatcagaatgatacccttccccgtagcgctatggcgtgcccatggccgatcccggtgccacagaattacggcagcggcagtgagaccatccacctcaatcctccctcggccccgcgctagtgccctggggtagttaacactgggcccgggagctggtcagacccatggtcccatagatccctctaatcagtgctaatttcaagttccattactccctcctcagtcagcttggtacctactgctggggaacccccatgagtgagtgtgacggatccctcgcaggtaacacccagttatgcccagtcgccgcaggattctaacaagatttccagtgactaacgatactaggcgactaattgattaatcgcagatagccagcctgcgaggcaggtggctggttccagacgtatccgcgatgggtcccggctcgaacggtccgatgggcggcatgggtggcattggagccacaccagcatgaactggcatcagttagggctcaggcgacatagacggacttccaaacaaattctcctaacgaaccgtaagtggcattagcgaatcctccaggcgccccctcgagatgacggcgagctatggagggaacttcgctccactctctttcagaacgcccattattcttcccgctgacggttagtgtgtgttcccccctttttcggggagctagagagcaggcttgaggggggagatgccgggctttgcggaggggggggccttccggctggggggccccgc

SEQ ID NO: 660425 - DNA, 3597 bp, Homo sapiens
  misc_feature (41)..(41): n is a, c, g, or t
  misc_feature (68)..(68): n is a, c, g, or t
tctgtaggttcttaataatctacaatgaatgtgcactgctnttatggaaagaaattgaagagctcccnagataatgaatttactatcagcaatgtccctcttgagttatgtttactcctgcgggtcctgactattttattgacctaagttataagttatattgacgtaagttataaggtgtgattttaggtggtatctgtggtctcattttcacactttgttttacaggtttggtgtttatgttcctctttgctgttttcatcaagatagtagagcacatcttcttctcacagactacaactatgtggttcagcacgaggcagtagaggaaagtgcctcgactgtgggaggcttggccaaatccaaagactttctctccttgttgctggagtcgctaaaagaacagtttaataatgccacacccatccccacccacagttgtcccctatctccagacctcattcgcaatgaagtagaatgtctgaaagcagatttcaaccacagaatcaaggaggttctcttcaactccctcttcagtgcctactatgttgcatttctccccctgtgttttgtgaagagtacccagtactatgacatgcgctggtcatgtgagcacctcattatggtgtggatcaatgcttttgtcatgctcaccacgcaactgttgccatccaaatactgtgatttgctacataaatcagctgctcacctgggcaagtggcagaagttggaacatgggtcctacagcaatgctccacagcacatttggtcagaaaatacaatatggcctcaaggggtgctggtgcggcacagcagatgtttatatagagccatggggccttacaacgtggcagtgccttcagatgtatctcatgcccgcttttatttcttatttcatcgaccattaaggctgttaaatctgctcatccttattgagggcagtgtcgtcttctatcagctctattccttgctgcggtcggagaagtggaaccacacactttccatggctctcatcctcttctgcaactactatgttttatttaaacttctccgggacagaatagtattaggcagggcatactcctacccactcaacagttatgaactcaaggcaaactaagctgcctctcaacaatgagggagaactcagataaaaatattttcatacgttctatttttttcttgtgatttttataaatatttaagatattttatattttgtatactattatgttttgaaagtcgggaagagtaagggatattaaatgtatccgtaaacaaggtgatgtgatctttcatgtgttagtatattcgaataatatacatatgagaggtatgcctgtccagtaaagagattgatttgtttgtatggctctggaataactcattcgtttatgaacacatctcatgtattacttgacacagtacctttggtatgtctgcttttctttcaatcctcattatctttagccctcagctggccagtacttattgctaaagaaagggagatcaatggagttgcctaccagcacccattctcttttagttcagctggctaatagtattggaatacattgggaaaagagtgggttaaagtcctaggtggggttctctttgttgcctaccaggagaaagcagtaggcttcctttctaagatacggactcagctggtctattttaccctgtgacatttaaatatacttttgaataagctactatcctgaggctgagggttttgctgccacttttcctgtgtttccacttctgcttccaaagattttcctcttagttgtttgaaataatactttgccagacaggaagtctttagactgcccacattcatgaagaagatgatgtgtggctggatcagtaggagaagctgagtgcaaatgccatgtgggctagagtatgggaaggttgaaaattccaagtaactgggagagtgggcaagtcctcagctgaacaatcttggatgtagtctagcagcaacccacctacaatggcgttatgtttggagttatgaggggaagtgaaagataagaattacctacagctttgtactcagataatttatatccaaaatttgtgttttaaatttcatactccagaactttcatgtttatgagtattagccttttaagttatgggaggtgatatacttagtccattgatgttgtcacttgtcatctaaacttatgagaccttgtcttagagaatctaaaatatattgtcatatgttttctgtgctgagtttggtttgttacactgtgaagcttttggtgaaacaaaataagacttatgaagtaaaaagaccaatcatgtcgttgacaagctggctctgaaaataattcttgcagaagagttcctgaaaggcttcaccaaggggaagtattgtgaggagtgtttgtaaaaccaaggtacccaatatcagttttatgtttaaatcaataattgtttctttaaatattttgatgtgtatactttttttttaagttaacattatttggcattcagtctgagtctgttcaaccattcaacaaatatatattaaccagtaggcactatattaggccctggggatatagcagtgaatgagaaatgcaaaggtcctacttgcacagagcttacaatatgcgtgggggtgggggagttaggtggtgcagaaaatacagcaaataaatttatgtgtaatataacattccctggtagtagtgataagtgtagcaaagggaaatcaggacaaggaaatagtggtaagaatagcactgctagaaggcatctttgaggagatgatttttaagcaaagaaaaagcaagactgaatcatataaatagctttggggagaattccatgttacagtagcagaaagggcagtgccctgaggtggggacaagttggtatattggaagaatagcaagaaaatatattaggttagttgctttttaaagtagttcagcctaaatatagtggttcttgaggtaggggtgggaagggtagggaatctgccatctttctattctttctgtaggatcttgaaaatatgcttctcttggcagcaacattttcatgagattactcagcagttgagagcaaaatgggtggcatgggcacagagatatctcatcaaaattgccccaacttggctccagcttgggaaagtaacccagaaaaccctgattagagataacagaccagtcttatgaactaatatgatgccccttctggcttgatctgtcttggtcctatcctaagggaatagcacagaaccagatgctggcttggctaaataagtaagtggatataagaaataaataaaaattaattttggctaatggaattgcaaagttcctcctaccctcacctccagatatggcagcatacggggcataagaccgtttagttcaacgtgttctacacattccagctgttttttgtttgtttgttttgttgttttgtttttgtaggggccacgttcatggaagagagaaaaattactagttacccggatatcctattatagttcatgtaacagaagggacactatatttgctcactgatagtagaaaaatgtgtaatcattaaagaatgacctttttt

SEQ ID NO: 660426 - DNA, 123 bp, Homo sapiens
attcgcggccgcgtcgactgattacttatgattagaaaggctgcctgttaggatggtagttgaggtgatcactctggcttggatgtcccatactgtggtgaataagagtggggaaagtgggca

SEQ ID NO: 660427 - DNA, 698 bp, Homo sapiens
cttaagggacacaggtcaacaagcagtaggtctttggaagctcgctctctcacatggtataaggtgagggggacacatggaatgtaaacctccaaactaattatgggggaaaaaggaatgagaaaaacaaacacaagaaggcaaaaccaaaacacctggttcaattaaaaacaacaacaaagccaaacaaaaaaaacccaaaaccaaaccacacaataaatgagaaaaaaattacataaaacagatgacatgtatagaaataaaaaaatagaatggaggaactaattccaaatatataagtaatcctaagtggactaaatttgcaaagtaaaaggcaaacattacactggattaaaaaacaaatccagggaatacagtttacagctgatacattcaaaatataaaaacagataaaatataaataaaatcggtacagtggtgtctgcctgtaatcccagctagttgggaggctgaggcaggaagaccccttgagtctaggagttagagaacagcttgggcaacaaagcgagactgtctctaaaaaaatacacacacacacacacacacacacacacacacacacacacactaagagtgaatatggaaatgagccgagatcgcgccagtgcactccagcctgggcacatagcgagactctgtctcaagaaaaaaaaaacacaaaaacaaacaaaaaagag

SEQ ID NO: 660428 - DNA, 2978 bp, Homo sapiens
  misc_feature (3)..(4): n is a, c, g, or t
ttnnccatggaattactgtattttcagaattcaggcagatgaagccttgattatttaattccttccataaaaatacagctggccttgcagatgctatcttatctgtaattgccaatatgctaacattgcatttctttctcccttagttggtcagaaaatacaatatggcctcaaggggtgctggtgcggcacagcagatgtttatatagagccatggggccttacaacgtggcagtgccttcagatgtatctcatgcccgcttttatttcttatttcatcgaccattaaggctgttaaatctgctcatccttattgagggcagtgtcgtcttctatcagctctattccttgctgcggtcggagaagtggaaccacacactttccatggctctcatcctcttctgcaactactatgttttatttaaacttctccgggacagaatagtattaggcagggcatactcctacccactcaacagttatgaactcaaggcaaactaagctgcctctcaacaatgagggagaactcagataaaaatattttcatacgttctatttttttcttgtgatttttataaatatttaagatattttatattttgtatactattatgttttgaaagtcgggaagagtaagggatattaaatgtatccgtaaacaaggtgatgtgatctttcatgtgttagtatattcgaataatatacatatgagaggtatgcctgtccagtaaagagattgatttgtttgtatggctctggaataactcattcgtttatgaacacatctcatgtattacttgacacagtacctttggtatgtctgcttttctttcaatcctcattatctttagccctcagctggccagtacttattgctaaagaaagggagatcaatggagttgcctaccagcacccattctcttttagttcagctggctaatagtattggaatacattgggaaaagagtgggttaaagtcctaggtggggttctctttgttgcctaccaggagaaagcagtaggcttcctttctaagatacggactcagctggtctattttaccctgtgacatttaaatatacttttgaataagctactatcctgaggctgagggttttgctgccacttttcctgtgtttccacttctgcttccaaagattttcctcttagttgtttgaaataatactttgccagacaggaagtctttagactgcccacattcatgaagaagatgatgtgtggctggatcagtaggagaagctgagtgcaaatgccatgtgggctagagtatgggaaggttgaaaattccaagtaactgggagagtgggcaagtcctcagctgaacaatcttggatgtagtctagcagcaacccacctacaatggcgttatgtttggagttatgaggggaagtgaaagataagaattacctacagctttgtactcagataatttatatccaaaatttgtgttttaaatttcatactccagaactttcatgtttatgagtattagccttttaagttatgggaggtgatatacttagtccattgatgttgtcacttgtcatctaaacttatgagaccttgtcttagagaatctaaaatatattgtcatatgttttctgtgctgagtttggtttgttacactgtgaagcttttggtgaaacaaaataagacttatgaagtaaaaagaccaatcatgtcgttgacaagctggctctgaaaataattcttgcagaagagttcctgaaaggcttcaccaaggggaagtattgtgaggagtgtttgtaaaaccaaggtacccaatatcagttttatgtttaaatcaataattgtttctttaaatattttgatgtgtatactttttttttaagttaacattatttggcattcagtctgagtctgttcaaccattcaacaaatatatattaaccagtaggcactatattaggccctggggatatagcagtgaatgagaaatgcaaaggtcctacttgcacagagcttacaatatgcgtgggggtgggggagttaggtggtgcagaaaatacagcaaataaatttatgtgtaatataacattccctggtagtagtgataagtgtagcaaagggaaatcaggacaaggaaatagtggtaagaatagcactgctagaaggcatctttgaggagatgatttttaagcaaagaaaaagcaagactgaatcatataaatagctttggggagaattccatgttacagtagcagaaagggcagtgccctgaggtggggacaagttggtatattggaagaatagcaagaaaatatattaggttagttgctttttaaagtagttcagcctaaatatagtggttcttgaggtaggggtgggaagggtagggaatctgccatctttctattctttctgtaggatcttgaaaatatgcttctcttggcagcaacattttcatgagattactcagcagttgagagcaaaatgggtggcatgggcacagagatatctcatcaaaattgccccaacttggctccagcttgggaaagtaacccagaaaaccctgattagagataacagaccagtcttatgaactaatatgatgccccttctggcttgatctgtcttggtcctatcctaagggaatagcacagaaccagatgctggcttggctaaataagtaagtggatataagaaataaataaaaattaattttggctaatggaattgcaaagttcctcctaccctcacctccagatatggcagcatacggggcataagaccgtttagttcaacgtgttctacacattccagctgttttttgtttgtttgttttgttgttttgtttttgtaggggccacgttcatggaagagagaaaaattactagttacccggatatcctattatagttcatgtaacagaagggacactatatttgctcactgatagtagaaaaatgtgtaatcattaaagaatgacctttttt

SEQ ID NO: 660429 - DNA, 193 bp, Homo sapiens
caagctagaaaatatatatgttatgtacacacacacagacagacacattcacatgtagggagccatctcaatttacatccatttctctctatattttaaaaaaacgatgagttactgctgacatctccagttgcaattgtacatcacaggattcattctagattttctccattttcccctatttttccctccc

SEQ ID NO: 660430 - DNA, 284 bp, Homo sapiens
gggtgacatcgagagatccaaaaaaccctccgagtgattataatctagacaaaccagtcaaaataaccataacatcactatatagatccaaaattattgatcaacggaacaagttaccctagggataacagcgcaatcctattctagagttacctatcgacaatagggatttacgaacacgatataggatcaggacacccaaatggtgcaaccgatattaaaggtacgttagttcaacgattaaagtcctacgtgatctgagttcagaccggagcaatccaagg

SEQ ID NO: 660431 - DNA, 574 bp, Homo sapiens
  misc_feature (58)..(58): n is a, c, g, or t
  misc_feature (65)..(65): n is a, c, g, or t
  misc_feature (84)..(84): n is a, c, g, or t
  misc_feature (96)..(96): n is a, c, g, or t
  misc_feature (125)..(125): n is a, c, g, or t
  misc_feature (131)..(131): n is a, c, g, or t
gttcagacagctcagtgtgcacggcatcctaagagatgttcgccagaagcaccgcctnacgctgngccatctacaagcccgtgnacgtgaggcctnagggcttgcatgactactgtgacatatcnagcacnccatggacatgagcacaacaagttctaaactggaggcccgtgagtaccgtgatgctcaggaatttggtgccgatgtccgattgatgttctctaactgctacaagtacaaccctcctgaccatgaggtggtggccatggcccgcaagctccaggatgtgttcgagatgcgctttgccaagatgccagatgagcctgaggagcctgccgtggccgtgtcctccccagtggtgccgccgcccaccaaggttgttgccccgccctcctccagtgacagcagcagcgacagctcctcagacagtgacagctccactgacgactccgaggaggagcgagcccagcggctggccgagctccaggagcagctcaaagccgtgcacgagcagcttgcagcgctttcacagccccagcagaacaaaccaaagaaaaaggagaaagacaaaaag

SEQ ID NO: 660432 - DNA, 116 bp, Homo sapiens
aattcaacttcaaggtgggctcctcagggacatagctctgcacattaatccccgcatgggctacggtgccgtggtccggaacagccttctgaatggctcgtggggatccgacggag

SEQ ID NO: 660433 - DNA, 769 bp, Homo sapiens
gtgtcttttacaggtttgtaggctggtcctctttcctcttcagtgatacttgctaagggctctacctcttgtcaccggttattgttctcttttatgtgtttgctttagttattattctgcagcgtccttatcgcccttatgtctgtatggccttacctaagttacaatttggctctttgtcgtgtctctgtgtagctgatagttagtgtctgccctggcatacgtcctcgcccattgctctattggttgaactcctcatatgtctcccagttgtgtgtcatagtatgtatcgtttactgtgtcatatgtatactttggtgcctcttacgtcttgtgtgcctatagggtacttgctatacggtcggtctgtactggttatagttctcgttgatcaggtgtaccgtatgctggtacatccgtcgtctccctaatagctccatagcgggtaagtcttgtctcgggttctatcatactactgtagcgtagttcaagataggtccctggaatgagcctggctgtaccatagagattcaaggggaagatgcataggaggtagtagcttctctgctctagtccctctggtgtctggcccactcatggcctctgtaccctatggctgctctgcggccccttcctcctcctcttccttgctccaacttctgtccaccgtggggacagtctgtgcctgtagcctcatgaccccaacccagccccaggcatggctaacccctgactgcttgcctattctttaagggctgctctagcctta

SEQ ID NO: 660434 - DNA, 922 bp, Homo sapiens
atccctacttgggccatctcaccacatccatgtctagaaactagacccacgttgaccgcacgttcacccgtcttcacaacctggtttcactctctgcctcaagtgtctagaactccaatccatatcattattctgtaattatatcaggcatggagcgaggtgatcgtgcgatctcgctcgcacgcgatatgaatccgttaaatgcaaaaaatacaactggcatatacagtttgcactatgaatgccactcgatgtagtatcaaatgtgatgagatagacgtcctccttatctatgatcacatcgcataacgtaggcctctagaagtaaatctccgagatcgtccctttctagcgagtgtcttccgtcggcatcatgaccgcgtcttacacagtggtgctcgtccgaccaataagggactcctcaccgagtctctcagggtgctatcttacttggtggcgtctacatggctctccggttccacccataaatccttgtcatctgcaatccctgcccctagagcatgaaagtaaatgtattcgagctatgtccaacgactacacaaaagatcaaatacgagcgttgtaggacatatctgagagtcccagcacaggccttggataccataggtcgatgtcagtaccgaattggacgagtctatggcaccatcatatgtgcttagttgttcgtacgtacacgaatacgtaagttgcgcgatcagacgagggtcattgtcatcatataacatagagttagaagatagcaaaaagaagctttgcgcacaacagcacagcaacagaaaggcctcgttgaacgcagcaacgcagggcagagattcccctttgggccgaaaggggcaaggatccaatgttaccttggaaacaggcattttcgacttaggaaaaggaagagtccccgggccaa

SEQ ID NO: 660435 - DNA, 163 bp, Homo sapiens
gggggggggggttgggggggggtttcccttaaatgggggggggggggtttttcccccctttttttttcccgccccccgggcccccttggggggtggaaaattttggccgggggtcccaagccccccccccccttggttttaaaaaattttttttgggggttta

SEQ ID NO: 660436 - DNA, 188 bp, Homo sapiens
gaggtgtgtgtgggacacagaactcaggtgtgtgtgtgggatacaggactgaggtgtgtgtgtgggacacaggactgaggtgtgtgtgtgggatacaggactgaggtgtgtgtgtgggacacaggactgaggtgtgtgtgtgggacacaggactgaggtgtgtgtgtgggatacaggactgagtcgac

SEQ ID NO: 660437 - DNA, 806 bp, Homo sapiens
cagtgccggcccgccgggatgcagtgggcctgttggcctggctggtgggctgttgtgcctgcttgctgctcctgtgctgtcgcagctggtgctgacccagtgtctgtctggctctggctgggtacgcagagcttcgtcttccagcgcgaagagatatgctgcatgtatttggctgctgtgcatgtacagcttgtgttgaagctgtgtgcatgatgtggcatgtggatgtgtggatgctgtgctgtgtctgtggtgatgctgttgatgcctagtgggttcctgaagtgcggccatcccctgtgacctagtgacctggtgtgccatgcccatgactcctggcctgcccctcttgcctcctgcattggcttggaccacgagcttggccttctctctggtcttgatctgttggagcttgctgggctgggcttgcacccatgtggcgcaacctgtgcttgcccagacgaaggagcttgcagtaggggttgtactggtgaattgcggggttgggattgggattgggctgccattgttgccttcttgcaacgcctcgctgtccagagtatagtgctagattcataccggcaaccgggcttttgaagcatccactggttgaacaacatctgggggcgcataactaggggctataagaatctacggaataccaattcatactcttgcaacactatacacacaagatgaagaagagggaaccaacaaaaaagattaaagacattatacaccaatgagaaaacagtagaaccgggacttggtaggccaccagatgtgaatgagagcaaaaatagtgg

SEQ ID NO: 660438 - DNA, 1172 bp, Homo sapiens
  misc_feature (1172)..(1172): n is a, c, g, or t
gagctcggggctgcgcagcgggaaggctcgccatagtcggatccgacatccgtgtcgaccacactgtcatggacaccacgaagatgccaccacgtatgggggcaaaaaggccaagaagggcatcctagatatcgtttaaatgctggagagattgtgatatggagatggagggtatagtcttagcacatggagaagagagggctacgataaagagcacggaccctggaactcactgaaagcatgactgatgagagcacccagaagacaagaaaacgaccagcattacaatcgaagaagttcctcagacgcctggctcagaaagtcatgcagaccttcaccttactatgcgagtgaagacaagctggacgaacaggggcaaactatgtcttagacgaagatatctgggacaggcaagtcaactgaagactgactagcgagaaatcgccccgacaaagcggctgatacacgggagatgcacaggcaagacagagcaggagagcagtcagacaaccctacataccatatagacgccacgagctgaacacatgaaagatcaaacagaacgtacttacaatgcaaacaaggaacgagggatctcaactgacacggaacgacacggtggacgaacataggaataggcagcagaaatacaagaaccaccgatggcacgacaggcagcgagggaccagcagcaagcccagacataagcagtgcgggtacaacactgagaaaaaaaaaaatagtggatatggaccgcatataggtataatatgcaatagcggtgacaacccagcagagatggtgagatgaacttggatgaagacacgggagacaaaacggaacataggtagtaaataggcaaatataaacgaaaatagagagttaggaacaacaaagaacagaaagagggagaagagggacaaagaaaaagggtaaggtgttagagacggagacgaggctgaaccgagacgtaggatgagagaaaggggataaagagagcgacaatcctagagagagaaaacagagcacgtagagaggtagaggtcgagaagacgctaaggggggagtaggagagagaacaaacagagggagaggatgaagagaggaacagccgatagatgagaaaatgactaggaataagtaaaggagagagggaggagggtatgtaacgn

SEQ ID NO: 660439 - DNA, 106 bp, Homo sapiens
tgtttatatcattacaatgtgtttcaccatgttcaatatttaagtttttctccacactttgaattttttctgaatttattttgaatcttttattactaataaataa

SEQ ID NO: 660440 - DNA, 469 bp, Homo sapiens
actggatatgtgttagacacagcgctgctcatcgtgctgcatagggcggttggcgatggccaccatctgaagcacgtcatagctgtggcctgccacataggcgtggatcttgccattgtagtactgggtatccatgatgattagcaggtgggcagccacgttcatgccccagcagagactccgagaagccaccaccacctggatagcccctgagctgaagagctgctccaccaggcgtcgctccatggggctgagcccctcatgcaggtagcccaccccatttagcagcgtttccttgagcgtgctgtcacttagcttctccaggtacggaatcagatccttctcggtgcagtgcaagaacctctgccgttggatgtctgctgcacaggtggtgaggatgtcaatggcagtgaggcgggtctgcttgcgagacggcacaaagacaatgacaggcttcttgggcgagtgc

SEQ ID NO: 660441 - DNA, 420 bp, Homo sapiens
acatagtctagatgcatcatgattgcattagacgggctgattccaactcacctagaaagggcagcggaaccactatgcaggcagccttcttaggaacatatcttacgaacaactcttgagaaccatccgtgattgtggacaatggctctaaggtccaaacaccttctgttctttcatctcacgagctaggctcacaggaagcattagccctgtcaggagcaagaacagcagctgtggccccacgaaaacaggacttcaataactcgcggcttgtcaatgatccgggccgtacggtttcccttttccacaatgccaacgatccacgcttggtgaccctctccgtacttggaggatttgatttcagaacaaaagcgagccgcctgttctcttggcagacaaatcagtgtctaaatgcactca

SEQ ID NO: 660442 - DNA, 220 bp, Homo sapiens
  misc_feature (220)..(220): n is a, c, g, or t
ggtggcccggtgcctgggggagctgctggctgcagcctgtgccagccgggccctgcccccgtctctcggcccctgctgcctgactcactcacccggtctgcagcagcagacatctcatgctgagacagacgatctcaccaggagtactaaatgacccatccgcatgagcagaatcgggccattacagtgttgagccgcgccctgacacagacggggactn

SEQ ID NO: 660443 - DNA, 263 bp, Homo sapiens
gtccgcccacgcgtccgatcccagcacatgacaacacttcagtagggtccccctggtgactggacagctgggaatagggcatttggacacttcatttgtaaatagtgtacattttaaacattggctcgacacttcagagataagtcatggagagcccattgcaggggagtaatgcagttcctgcctgggtatttaagaatgtgtacttctcactaccattggtatggaaaagcaaaattctgtaaataaactttttttctaac

SEQ ID NO: 660444 - DNA, 406 bp, Homo sapiens
cgcaatgctgtcatgtagatatgctcgaatgtgctgatgacacagcggacctttgtcaagtatatatgtgaaaatcaagattcgatctccactaaactgaaagaatgcgtgtgaaaaacctctgttggaaaaatcccactgtgttggcgaagtggaaaatgaagagaagcctgctgacttgccttcattatactggtgagatttgttgaaaggaaagatgtgttgcactatgctgagagctgattactctgtcgtgctggtgctgagacttgcccagacatatgaaaccactctatagaaatgctgtgccgctgcagatcctcatgaatgctatgccaaagtggtcgatgaatttaaacctcttgtggaagaacctcagaatttaatccacttgtgagcgtttttg

SEQ ID NO: 660445 - DNA, 262 bp, Homo sapiens
tacatgtgttgcatgagctccctcttgatcttgccaggcaagcaggagctgcttcgctctcatcttcatgtcttcacatgcccacaatcttgtactgccaccactttatgagtatttattattaagaatatatgccatcctcactggttatactagtaccgctcagggaacacatgcccttctatggaggaattcttagaagaagccatagaacaggcagaacctgacaatatggtggaaaatgaatctaaggctgtgaaca

SEQ ID NO: 660446 - DNA, 179 bp, Homo sapiens
  misc_feature (9)..(9): n is a, c, g, or t
gtccatggntaatccgttcatagaaattgtgtttgctaacaaggtgccctttaaccagatgctaggctgtctgcggagaaggctaggagttcatagaagggagtggggctggggaaaagggctggctgcaattgcagctcactgctgctgcctctgagacagagagttggtgaaggaaa

SEQ ID NO: 660447 - DNA, 607 bp, Homo sapiens
tcttacgcccaattcatacagacctacactcatacacacccacaaactcatacacaccacacactctcaacccttttcctccacacaagcataggctcacattctcaacagttggccatcccagaggcccactcaagaaaggtcttgatttacgaacgcatatacagttgcagctgtatgagaaggccggccaagattgtgcaaacaattaaatgggcacgaacatggcgagattttattaaccctagtcacgtcctaaatgatggcggtcaaatgtacacatttgtgcttcttcacctgcattgcttgctgtaaggggttataggctgggtttctgtacagcactttgagatatcagctaatgtacgaagggctatataaataaatttgatttgattttccatgaaggcaccacaacacggtcccccggtattgatcatattcccaagcatctccatgcagtcagacttctgattttgtgccaccagggccacaataatatacccctctctgaatatccgagtgtgaccccctccccatgggttactgcagctagtgactgagctatgttgttgatgtaaattgagaagagttaggggcgtaaaga

SEQ ID NO: 660448 - DNA, 222 bp, Homo sapiens
gtgactctagatggatcccgtcttctccccttacacgtctctcttccctcaggtttgtcgtgcctaaagggctgcctccgcgcagctcctgtgcgtgaattccacccaaacttacagacgtagctcaatgcatcacttctccaggaacgcatctccagatccgcccaggcagacagatgctcgctgactcctctgacgcctcttctagaagcctagatctca

SEQ ID NO: 660449 - DNA, 355 bp, Homo sapiens
  misc_feature (14)..(15): n is a, c, g, or t
  misc_feature (20)..(20): n is a, c, g, or t
tagccggtccgaanncttantagtgtccccaacaggaattcgcttctgtatatcagccggtattcgctgagaactactgtagctcttaactgttgaatgatctttttctggtagatcattggcttcttttgacgcaggaaaaggcccgtgtcacttcggcttagcttctttcggcgattttcaagggaagcgtctgcaccttaacgcagacaaatgacgcatgatatgcacccttaaggcggacttgatcttcagatccctcaaatggtaaatgtgccataaggtggccaaattccaactaaaaatgataaataggtaatgaattgttcactataagctttcggtaccgagccga

SEQ ID NO: 660450 - DNA, 206 bp, Homo sapiens
gtcgtctgcagagcatgatgagttcgcgggtcacgcagtttgtgcagctgacgtctcagccaaacactgatcttccctggaggcttcggctgctgctgctgaggtccccgctgccagtcccgggccctggagagcagatgctgtcttgttatgtacaggaggaccttttaaaaaaatcaagtttctattttttgcttgttccgctg

SEQ ID NO: 660451 - DNA, 455 bp, Homo sapiens
gttcatgagctcctcagatgaaggtgacacacaggttggccctctccactggtcccaagaagacaaatggctgtcacccacacactgccctccccagcgctgagaagagcacgcgagggcgtgcttgactcgcggaagcacagggacacaggcagaacggtctgtgctggtggcagatgcccagccggacctccaacgctcccgatgcccacggccctgggccttgtgtgggtggggggcagtgtgcgggagcccagtggtgctgagtgcagccacgaggccctggccctctgtcacggcccttcctgcatcgttgcccctggggcctgcaagcctccctgttcttgcctgagggcctgctgttccctggagagaggtctccatacccagacacctctgattctgtctctggtcagttgcatggggcccagccgcctttgcctctccgtggggtc

SEQ ID NO: 660452 - DNA, 348 bp, Homo sapiens
  misc_feature (1)..(1): n is a, c, g, or t
nacagtttggcttctgtgaatacccttataggaaataggggtaagaggtggcaacaagatcttctcgtgttctccattaagcatcatgtaaatctcacatagtgtggttaacaaaatggctttccccaagcacagaagtcaagagcttgtgggcccatatattatcatagtactaggccattcattatctcctagattaactcttttttttttttttttaaggtgaagtttcactcttgtcgcccaggctggactccatctctaaaaaaaaataataataaaataagcacataccactttcacaattcacattactagagcttgtgtgtgtctcaaggtatgtgtcca

SEQ ID NO: 660453 - DNA, 284 bp, Homo sapiens
ggggcccttttttcgggggccccaacatgtttttttccggcttggttggggggccgggacaccttttggggggggggcccccccccctggggttggggccccaaaataccgggggccttttttgtccctggccgggccctcccaggggaccccccccccggcttggggcctcccatgggggggtatgggacgggggcccgctttcccccccccccccccggttgtcgggtgccgggcgtgggtaaggtgtttgttttttcttcggagagaagacaaagaagata

SEQ ID NO: 660454 - DNA, 208 bp, Homo sapiens
  misc_feature (20)..(20): n is a, c, g, or t
ttgtttgtcatcccgacagntggtaagggaaggacacaacaggagaagatgctggattaaaagatgtttcctgtggaacatagggggggcagcagcaaacaggatcagttaactattgcatttatatgtaccggaggctttgtattcaaaaatcatctatagctaagtacacagtaagcgaaaacaaaaagaaaagaaaatttttgca

SEQ ID NO: 660455 - DNA, 441 bp, Homo sapiens
  misc_feature (110)..(110): n is a, c, g, or t
  misc_feature (131)..(131): n is a, c, g, or t
aggcctcaatggatactctgctctcggctggctgtgtgaggcacaggatgggggctcaagttcagtgagggagatgacagagccgcgggtcctagggtgaaaatggtgtncctgctgcggagcgatggctntgagaagaatcctttctttgctgtatcttccacacccattagatcatctttctcagcgacttcctcatactgcaccttcatgagccgccccaggtaagagcggtagtaagacaggtaaatcttgctcagcgtctccacatattcatccctgatctcctttgctgttgctcgttcattgcccagcagaaactgatagaagaacctgtacttcagcagggccgtctgggggatctgatagttggtcatgggttacctgaaggaataaatcttctggaggataaactctcggatcttcgtcactgccttgacc

SEQ ID NO: 660456 - DNA, 878 bp, Homo sapiens
  misc_feature (494)..(494): n is a, c, g, or t
  misc_feature (534)..(534): n is a, c, g, or t
  misc_feature (536)..(536): n is a, c, g, or t
  misc_feature (542)..(542): n is a, c, g, or t
  misc_feature (572)..(573): n is a, c, g, or t
  misc_feature (584)..(584): n is a, c, g, or t
  misc_feature (649)..(649): n is a, c, g, or t
  misc_feature (678)..(679): n is a, c, g, or t
  misc_feature (686)..(686): n is a, c, g, or t
gggccccgtgggctcggagtgagccccgggtggctgtccccggggagcgcgccctcgctagggccctgacgtgtggtggaggcggatcgggcctgcgagccagcgccggggccaggcgatctgggcaaggtcaatgaaggagcatgcatgtgacgtgcgaggtcggacggatgacaatgttccccgtgtgcatcctgcgaggccgtcagtccaggtgctcagcggttacgactggacgctggtgcccatgcccgtgcgctgtcaacggctgccagcaaaagcaatgccggacgtcaatgcggcccatgaacgccttcagtggtgtgggctcaggctagcgcgcaggaagcatcgcggaccagtaccctgcacctgcgacaacgctgagctcagcaagacgctgggcaagctctggaggctgctgaacgaaagtgacaagcgccccttcatcgaggaggctgagcggctccgtatgcagcacaatgaaagaccanccggactacaagtaccagcccaggcggcggaagaacgggnanggccgnccagggcgaggcggagtgccccggtggggnnggccgagcaangtgggacctgcgccatccaggcccactacaagagcgcccacttggaccaccggcacccaggagangggctcccccatgtcagatgggaaccccnnagcaccnctcaggccagagccatgggctcacaccaacccctccaagcaacccgaagacagacgctgcagtcgtgggcaatggcaggacccgaaagcggggacgggcgctccatgggcgagggcgggaagcctcaccatcgacttcggcacgtggagccttggtgagatccagccacaaggtaatgtccaaaatggagac

SEQ ID NO: 660457 - DNA, 111 bp, Homo sapiens
aagaaattcttcttcacaagtaacattccacttgtagttagtgaccaggcaatacgaacttcatgtatgtcactatctttggtatataaatgccttactgggatcttctct

SEQ ID NO: 660458 - DNA, 125 bp, Homo sapiens
cgaagaaagaaggaaggacagacttaaatctctctaaagcacgagaatctattatatagcaaacaaacttgtatcatttaatctctagcgatcacgggttctaataagcctaggtaccacataag

SEQ ID NO: 660459 - DNA, 691 bp, Homo sapiens
gagagagagagttagagagagagagatatagagatagagagagagatatatagagagagactgtctatagactgctttcctctttcttctttcttctctcctctactccttctttcttctcttctctctcctcttttccttccttctcttttttctcttcttctttttttctctttctccttcttttttcttctccccccccctccttcctttcttctctcttcttccctctctctactccttctcctttttcttttttcctccttttcctcttctcttctctttcctcctccctttttctctcctccttcttctctctcctcttcctctcctctcttcttctttcttcctctcctttttccttctcttccttcccctcccttctttcctctctcccctctttttctttttttcccttctcctcttttctcttcttctttccttttcctctttctctctctcccttcttcttctttctctttcccctcttttctccttctccctttctccctttttttccttctttctctctcttctccttctttccttcttttcctcctctctttctccctttcttccccttccttccccttcccttcctctctctctttccttcttcttcttctcttctctcttcttccttcctctcttctcctttttcttccttttttcttctttctttttcttctcc

SEQ ID NO: 660460 - DNA, 727 bp, Homo sapiens
gccaagcccggatgtggggccgaggcgcgcagactctcaacgactcgacgccaacggtggtctctcgcgatcgctggcgcgaggcaggagggtgcggggcaggcagggccgcggtcaggcccggagccggcaaagttgtcaagcagaggtcgagggccggacgtgggagccccagagcgacgctgaggtgcgttgcgggactcggagtacgttacggagcgcccgagctcatcatgcaccgccatgccgccccgggaccatcccccggagtccccgggtccgaagcatccctggttcggctcagcggtcctatctggggccagagtttcgcccgcaccactacagggccgctgggtgagtcgggtgccgcaccagaatctgaaccggctcaagtccagcgggacgtcaaacccgcctttccacggctactggagcacggcgcgagtccgcgagcccgattaccgcgggaaggctgcagggaagttgagatggacaggctcatcaccgacggaatgtgccgacggcggagctgacagagggcagtgccccgggaaggacggggaaggtgacgatgcgtggactacgcaagaaaaagcataacccaggacaggatcgcgtgcgaggcggagagcagacagagacatgctggggactgaaaccccgagaagcctgtaagcactgcacgacaggagtggcaccgtggcccccgggacgcacgggagacacc

SEQ ID NO: 660461 - DNA, 1516 bp, Homo sapiens
  misc_feature (140)..(140): n is a, c, g, or t
  misc_feature (643)..(643): n is a, c, g, or t
  misc_feature (1146)..(1146): n is a, c, g, or t
cacgagatagcctgctcccctgcgagaacgccgcctcgcgaaatcccctgtgacgagagccggaaatcgcgggggcaggactgagaagtcaatgaccgcatgttagcacgtgtccgcgtgagactttgctatcggatctntgaccataacgtatcgacacgttatttcgattcaagcccttgctatggttgcagagcgcgtctgtgtacgagagaagatcacaacgtccctttactgggagaacttgactgtcacagggcccttgtgacaggtacagctcataagctcattccaggttggtgcgccaaggtgtcctttgacaaagcggacttgcacttgtgacatttgggtgacctaacctttcacgttagattcgcgcatagcgcctgtggaggaacggcgcccagagatattgtcgttactttgaacctgtttcgactttttgggcgcggggaccggatctcccaaatttgatcaaagttggcctcccaaaggagggattggcggagattaagttgttgcgctatgaaaacaccgtatggtatatagaggggactcccattgagaaacaccgccattggtggactccgatttatgagttcctcccgcgttcgcacatctttggctcgagagcgcttaggantgtgcagtatggtcaccgcgttaagcccaagattgtgacttgcccaacttttcgatgttgtggtgggcgtgtcgcggtcaccgtttttgtgcgtcgccgtgttaggatgaggcccatacagcgtctttggcatttgggattgggcgctttttgacactttatcagcttttggtgtccccccccatggttctgtgtgcgcaaaagttttaccccgcacctcttttgaattggtgcgggtttctggggtagccggcccccccttgagggtttgtggccaatgtttccgtgtacggcttttgatgggactccgttggggagcacacgagggcctacgatggtttcctcggcgtggcacacttgagagccggcctattttcgtcggatgctgttccccatattgccttagtgtccgtttcgcatttcggttgggagttcccccagcgttttttggacccactttcagtggtccgccgccctttttcacgttgggccagtccgagttngtgccctccgcgtgggaggcatccgcttggcgcagttttacacgcggcagcgtgggcctttacattggacattttccttgggttggctcgcaactagtggtcgatcttttattagctggggggcgcacagagggactgtggatttcactattttcccgtttggtcggttggaccgttgtgcttttgtcgcagtcaaagcgatttggtattgattaacagcaaatggttgccgcccgttgtttgtgtgttgtctacttgtgggcttgtcacacccttttttgtcgtgtctccctacgccccgttctttttgtgcacttcccgcgcctgtgtggtcgcacgtggctctccggggggtcacgaaggcctttcc

SEQ ID NO: 660462 - DNA, 837 bp, Homo sapiens
  misc_feature (812)..(812): n is a, c, g, or t
gacacaacttggggccctctcctctccagcccttctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctaacctgaagaagaaccacgaggaggagatgaacgccctggaaggcaggtgggtggtgagatcaatgtggagaaggacgctgccccaggcgtggaccnaagccgcatcctcaacgagatgcgt

SEQ ID NO: 660463 - DNA, 826 bp, Homo sapiens
  misc_feature (18)..(18): n is a, c, g, or t
  misc_feature (801)..(801): n is a, c, g, or t
aggaattcggacgagctncagcccttctcctgtgtgctgctctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctaacctgaagaagaaccacgaggaggagatgaacgccctggaaggcaggtgggtggtgagatcaatgtggagaaggacgctgccccaggcgtggaccnaagccgcatcctcaacgagatgcgt

SEQ ID NO: 660464 - DNA, 676 bp, Homo sapiens
acttagagagcaccgtcctgccacagtgacacatgtgtgtaatcggccgcggtacccgtatccgtgcgtacggtagcattatcacttggttcctttaatttagggacctgtatgtatggacgtccatcgagggttcagctgtctcttactgttaagccagtgaagattcgacctgcccgtgaagttgttcgggcatgacactagcaagacgagcagaccctatggagctttaatgttattaatgcaaatcagtaccttacaaacccacaggtcctcaactaccatacctgcattataaatttcggttggggcgacctcggagctagaacccaacactccgagcagtacatgctaagacttctacccagtcaatagcgtaactactagtatctcaatgtgatccaattaacttgagcctacgggacaagttaccctagggataacagcgcaatcctattgctagagtgtcattatcaacaataagggtttacgacctcgatgttggatcaggacatccgcgatggtcgcagccgctattaacaggttcgtttgttcaacgattagagtcctactgtgatctgagttcagatccggagtaatccaggtcggtttctatctacttcaaattcctccctgtacagaaaggaacaagagaaataaggcctacttcacaaat

SEQ ID NO: 660465 - DNA, 845 bp, Homo sapiens
  misc_feature (820)..(820): n is a, c, g, or t
acatccaacccccctccccccccatggctggtcggctgcgtgtaatcggacgaggctgctctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctaacctgaagaagaaccacgaggaggagatgaacgccctggaaggcaggtgggtggtgagatcaatgtggagaaggacgctgccccaggcgtggaccnaagccgcatcctcaacgagatgcgt

SEQ ID NO: 660466 - DNA, 300 bp, Homo sapiens
  misc_feature (81)..(81): n is a, c, g, or t
agaggttgtctgctgatagttttggggaaacggcccctctttttaagggattgctttcatctaattttggcagggcctccnccaaaagatccagcctcatacctacctcagacaaaaaatcgccgttgttccttttggactaaagtattgggttttgctttggaaaccccccccccctttgcaaaaaccgggcaagatgaatgccgattcccctggttttttgtgttccaaaattggagaaaggatttaataaaacccgttaatttttatactgccaataaaaatgtttttcccgaccca

SEQ ID NO: 660467 - DNA, 104 bp, Homo sapiens
gaaatctcttgccgtcgccgccgtgcccctctcgcagcgcattgcgggcttccaactctcacctctgatgtcattcttctgctgctaatgcacaacagatccat

SEQ ID NO: 660468 - DNA, 374 bp, Homo sapiens
tccgggtcctcatggataacgtcctgtcggaacgaacagtgccgggagctccacagtgtgcccagtgtaatcatgcttgttggtgatggatacagaggaaaaacttcaccccatacacccaatgaaaagtttgaaggtgcaactgtcctgaaggcactcaaatctggttatgaaggtcgagtcccactgaagagcgctcgtctgttttatgacatcagcgaaaaggctcgaaggattgtagaatcttattttatgctgaactcaactctgtatttttcctataacacacattgtctgccgaacagccctgtctggtcagcaggatagaagaaatgacctcagtcatcccatccatgctgacaactgtttgttgg

SEQ ID NO: 660469 - DNA, 215 bp, Homo sapiens
agtaacaagtgggtatgtaaattgcaacgcagtagttgtagccgcagtattattattcactcacatgctgtaccatttgttttgtagctgaagaggaacattcattcagtcagatggatgtcgaatgagagttaccaaactgctccccgggacccgcacagcgcacacagcctagcgggggagcgcaccagagcaaggggatcctctaacagtcg

SEQ ID NO: 660470 - DNA, 141 bp, Homo sapiens
ttgatggcgcaaaactacttaacgtgatagaacttcagcaaagtctcaggatacaaaaatcagtgtgcaaaaatcacaagcattcctatacaccaataacagacaaacagagagccaaatcatgagtcagtggccatcttt

SEQ ID NO: 660471 - DNA, 717 bp, Homo sapiens
aggacattcatttcctccgtcactctagcctcatgtcaagtgcccaagaaccccatggggctagctttcatactgtacagcatgcatatatataaattcttcacagaaagttcctctggacagtgctggtgcatcaagagagggtcaaatatgatttagatacagtgctgggaaaatatcacaattaagcaaataatagatgcagtgctaggaaaatatcacaattaagccagtaataattttatattcaggattcttatgtttgtgaatttgtagagagcttggcgtagaagcctgagagctgtgctgcaagtctttttcttgtaaaaatcactggggctgacaaacaaatcctgataaagagaaagtttgtttcagaaagttcaagtgaggcagactttgggacagcttgcatgcaaaatataaaacttggtaactatgaaaaggagaaagataaatccaacatttcctacattcacgatgaataatcagcaccattttcaaataattatcaaattaggaaaagactaccttttaaaaacattgagccttctactgaccgactataaagactatatataaagtatcccacaatttatttaggtcttctgaagctaaaatgtttttaacttttattgtataaccttaattagtttaattcctaggttagctaacttttaatgttgttatgaataatcatcatgttaaattgttctt

SEQ ID NO: 660472 - DNA, 458 bp, Homo sapiens
  misc_feature (24)..(24): n is a, c, g, or t
ctttatattttttttgtccgcagnaccctctgggggctcgtgccttattaatttacaccaaccccccaatttttttaaccctaccctgggccttccccttatgaggggggcgggggatttagggtttttgtttaaaatttaaaaaggcccgggccctttttttccacaaggggccccccacttccctttcccccaaattggtttttttggaacccctcggccttttttttcacccaaaggccggggcggggggcctacccgttaacattttggggggcccccttttttggcccctatttgggggggccccccctggaaatataaccctttacccttccctttccctttttttttttcccatttttttttttttgggttttcctagaattgggggtccccttattccaggcctgggttttcccctttttggtaggcctcccccggggggcccccccata

SEQ ID NO: 660473 - DNA, 229 bp, Homo sapiens
tggggggagaaggagcaaatccaccaattcccatttcaccaaagccattaaaccaacttggaaaaaaaaaggtttttccaaattgaagggagggaaaaaaaaaaaggccaccaaccccattagaagtcctggcactttgtaacggaacgggtactacactttatcttaattcttaatttaaaaacatgtttacaagttacaaccaacttctatgaaaagttgaaaagac

SEQ ID NO: 660474 - DNA, 269 bp, Homo sapiens
tgacttagaggaccccgcagcttctcccatcagtggtgtgttgttcacgtagcactggaaagtgacgttctttcagagattgttatgggttcctgttaacatccttcaaacacagctgaaggaggatgaggagggcaaggctttcttgtgatgaatgccatgagtcagcgcctagaggcttgtggggagctgtcagtagtcctggcagggagctcctccccctcactagaatttcttctccatgtttggaagggtggccaagaatcagc

SEQ ID NO: 660475 - DNA, 382 bp, Homo sapiens
gctctaatcatgctctaagtctgctagagtatatgttgcaattctagtcactctctcactgaacagacatgtacactgatccgagagtaacaactaggttctgtatgagcaaacactgtacttgtcaggttatcaccattatcaggcctaacagtctagttggaagttgtcgtctgactggagttaaaactgggtgactgaaaaggaactgtttgtccttttcaagcacttgtgagagagctatgcctgttagaagcagctgtgagatcttggtaatggggaagggagaggtctacggacaagcaggaaatgtcccttatggttttcagtcattggatgaatagcttgactattatagtgtgatgatgtctgactgaatatg

SEQ ID NO: 660476 - DNA, 543 bp, Homo sapiens
  misc_feature (86)..(87): n is a, c, g, or t
  misc_feature (90)..(90): n is a, c, g, or t
  misc_feature (92)..(92): n is a, c, g, or t
  misc_feature (94)..(94): n is a, c, g, or t
  misc_feature (96)..(99): n is a, c, g, or t
tctggtcatgattgtggtgaattttataactctgcttttgctttaatcatttgaagccacttagcatcacagaggttcatggctannatncngnannnnctttatgtgtttttatttacttttattaaatacacagtatcttcacccttgcaaatgctttttttacttgaattctagtttgcatacagtaataatgccatatctacatttcttttgttagccaagacctattttattttcctgtttatttcaaccattggtgtttaattttagattgtcttctataacagcattaagtggattttttaactgactctgataatgtcctttattattaccacttttaaattattcctgccatattattgacattttaattacaaattgttattgaatataggctgggcgcagtgacacacgcctgtaatcccagctactcaggagactgaggcacaaatattgcttgaactgggaggcagaggctgcagcaagtggagatcgagccactgcatgcagcctgggtgacagtgagactgtctcaaa

SEQ ID NO: 660477 - DNA, 218 bp, Homo sapiens
actgtggaattcgggaggggcgggccatgacttccagcgagatcgccatgcggggcagaggtgaaggccgaccccgccgcgctcatggtctcgttgatgctcctgccgtctgccacgcccaagctcgagatcaagtacaccaagatctttattcaccctgactggcagaactcagcgagtggcagaggtgtaccctgtctgtaaatccagccacaggc

SEQ ID NO: 660478 - DNA, 772 bp, Homo sapiens
  misc_feature (24)..(24): n is a, c, g, or t
  misc_feature (125)..(125): n is a, c, g, or t
  misc_feature (143)..(143): n is a, c, g, or t
  misc_feature (447)..(447): n is a, c, g, or t
  misc_feature (453)..(453): n is a, c, g, or t
  misc_feature (597)..(597): n is a, c, g, or t
  misc_feature (634)..(634): n is a, c, g, or t
  misc_feature (648)..(648): n is a, c, g, or t
  misc_feature (763)..(763): n is a, c, g, or t
gaagtttggtaaggtttggtaganagatctaaaggtgggggtggtaaggggaattgcacatgagaattcttgggagagagcaggctccaggcagcaaggtgattttggttggttctttgtaagtnaatcgttcacagggagcnaagggttcttttgattggttggacaagagggtaagggcgctggttggaggatttgggagtgaagtgatccatgtgaatagagcagatgatgggtcctcccaggtttaaattttttaagaattgaactttggttttcatattttttatattatcatagctgatttattggttttttttgattgtgtagggaattgttgattttggagcttggtgatgttggttgttttaggaattgggagatgtgataataggggaggaagcttgaagattgtgtgatgggtggagtagttccagggcgagaggnaggggnggccacggtggtttctgcagaggccagtttgaaggagtgcccatatgtggggatgcccatgaccaccttctctgatggcattcccttatgtatccagtaccccacagcatattccacattgtagtaggagcttggccctctgtnctgccaccccttgctcagagggctgttgtggccagtnataaggggcttttnccaagacccatggaagttaaaggacaggaggttgatgaaatccagatcttttgccagtttctcaacttgatagctgttatcaatcatttgcctccctgcagatacgcccgcagtnaagagaagc

SEQ ID NO: 660479 - DNA, 1238 bp, Homo sapiens
ctgccataccctgacctgcaggaatttgtgcgctgacgtaaatgtgctgatggccctgattatcaatggccccataaagtcattctgctaccgccggctgcacgtacccagacccacccaggcccccagacgcatgtgctactcaatgacgactgaaggagctggccgcccagcaagacaagtgccacaccgagataactacaacatccgccaggtggacacccacatccatgcctcgtcctgcatgaaccagaagcatctgctgcgcttcatcaagcgggcaatgaagcggcacctggagcgagatcgtgcacgtggagcagggacgtgaacagacgctgcgggaggtctctgagagcatgaatctcacggccctacgacctgagtgtggacacgctggatgtgcacgcggacaggaaccactttccatcgactttgacaagatctaatgccaaatacaaccctatagcggagtccgtactccgagagatcttcatcaagacggacaacagggtatctgggaagtacttagctcacatccatcaaggcacggtgaacgctccagcaccctggcagcacgagcaccataccacacacgcacacaccgccacgccccacacaccacggccgcacccacgcgactcacccccgaccaacccaggccccaaacagaacccgcacacgcccccgcgagacacacccacacaacagaacaacccagccccggccccaacagaaggaccccgccccacacaacaaacaacgcgcacaacaggacaccaaacgccgccaaaactgaccgccaaagaccccaacacagaacaaaatcacaccaacaaacaacaaacaccacaaccacaacagcgaaaagaaagccaccaccccaacaccaccacccccaaccacagcacccacacccccgcaaaacccacccaagaacacacaacaatcagccaagcacaaccgctgccaccacgcaccacaacagcccaacacgccacgagaaaacagaaacagcgacccacaaaaggcacacactgcacaacaacgaacaaggagcccccgacaaacaccaacggacaacaccacccacacaggaccgagaacgagaacaaaataactggaccttgccacggaacagccaacacacaaacacaccaccccagcaccccacaaacacacacagaggcagaacacaacaaccaccacacccgccacaaatacgagacaaaagccag

SEQ ID NO: 660480 - DNA, 503 bp, Homo sapiens
  misc_feature (28)..(28): n is a, c, g, or t
  misc_feature (282)..(282): n is a, c, g, or t
cgggccacgtggggggagacaaccttanccaaaccatttacccaaataaaggataggcgatagaaattgaaacctgcgccaatagatataggaccggaagggaaagatgaaaaattataaccaagcataatatagcaaggactaacccctataccttggggggaaggaattaactagaaataactttggaaggggaggcaaagctaacaccccgaaccgagcactactaaacagtaaaaccacccgtatgacaatagggaaatataggaggcacaacctacnacctgggatagctggttggccaagatagaatcttaggtcaactttaaatttgcccacagaaccctctaaatccccttggaaatttaactggtaggccaaaggagaacaggtctttggacactaggaaaaaccttggagagagaggaaaaaatttaacacccataggaggcctaaaagcaggcaccaattaagaaaggggtcaagctcaacacccactacct

SEQ ID NO: 660481 - DNA, 283 bp, Homo sapiens
cgccccccccggggggggggaccccccgggccccagggggccccaaccgggggggggccacccggccctcctgggccccccgggttcccccaaggccccggggttcccttgggggcccccccccggggggggccccccgggccgggggaaaagggaaaatcccccaaagggcccgggggggggtggggccggggacccccggggggggggtttaggcccccgggcccccccgggggggggggagggcccggtttcccccccaaaaaaccggggccgggccttt

SEQ ID NO: 660482 - DNA, 882 bp, Homo sapiens
gccggaggatacacacgcagatgaattgagtcttctgcgcacgacaggtgtagagaggtctccacaagccttgtctctcctgtgtcaaaatggtgactcttaacgaatagaactcattgtaccagttgcgaacagaataggcaacagttccaaacaataagatcacgtgtaggtgggtgttgaagacaagttggtatggcgtgtgcttatcgagcatgctgggaacaggtcatcgtgggtgatgcaagtctgcgttgttgctgagatgtcctcgggaagataaggctaaagagggagaaatgatggatcgtgcgagagagtgggaaaccttatttacgttcggagacagcatagtaagttgaggtagataaagattatatcttggtgaccagtcaattgtaagatcgtactggtaagttggagggactccgggcgaacgacgaggggggacagtcggcctcaatgcgggttgggacatgcaaaatgggtaatgttctatcaacactgtgcaattatatatcgctcagagtcggtacagatacagtcgcgacttgcgtcagtacttgtggcttctgcaactccaggtgtgagcaattcttgtgtagtgtaccatgcaatagtaagagtggaattagcccagaacgaaggtgttgatgggacagtggatgtaggtctgtagtgctgttgagatttggatgacgatgatggtttcaagagagtgggcattcattctggtggatgcgaggctggttttggggggaaatggagattaagtgtgggtggttaatgtagaaagagacggtggtggcctgggaatgatccgatgggatgggggaatggatcgaggatgcgaaaggtttccttttgtgtgaccgaaaatgg

SEQ ID NO: 660483 - DNA, 582 bp, Homo sapiens
ttgctgtcttttataatcgtcggtgacttgagtggcgtactatagtgagaacagcggtgttgttttgtccttgcgatagtttgctgagaatgatggttccagcttcatccatgtccctacaaaggacatgaactcatccttttttatggctgaatagtattccatggtgtatatgtgccacattttcttaatccagtctatcattgttggacatttgggttggttccaagtctttgctattgtgaatagtgccacaataaacatacgtgtgcatgtgtctttatagcagcatgatttataatcctttgggtatatactcagtaatgggatggctgggtcaaatggtatttctagttctagatccctgaggaatcgccacactgacttccacaatggttgaactagtttacagtcccactaacagtgtaaaagtgttcctgtttctccacatcctctccagcacctgttgtttcctgacttttaaatgatcgccattctaactggtgtgagatggtatctcatagtggttttgatttgcatttctctgatggccagtgatgatgagcattttttcatgtgtct

SEQ ID NO: 660484 - DNA, 543 bp, Homo sapiens
agaaaaaaagttgggctcccccatccgccaaagcccaaaaggagaaaggggggggaaattcaccagctcttgtaatttcgaaccacctactcggggggggtgtggcagtgacaacattggcagttggatttttcaggccatgggctggaaaaagggcaccggcctgggccgcaaaaaacagggcattgtaaccccttttaaggcccaaacccgggtggggggttccggcctgggtgcccggggcagctccttcggggtcccctcaaccgagtcctacaaggagaccctgcccaaaacaatggtggcccgcttcaacaaggcccagtgaacagcttcaaaagcaacttttccccatgttgggtgtccctcctggggcagggaaggacaaaatgttggatggttgggacggggccttgtttttgtgggccagccccctccccagccaaaaaggggttgacccaatcaaatttagggggggccttttgttggaaaattggggtggggtcccgtcctgttttgtaataaaaactgaaaagtttgcca

SEQ ID NO: 660485 - DNA, 143 bp, Homo sapiens
  misc_feature (16)..(16): n is a, c, g, or t
  misc_feature (106)..(106): n is a, c, g, or t
gaattcgagctcggtncccctatcaactgcggcgattccgtaagagggctaggagggagccggcacatgcgttgcagatccgctatccgtcgacggatagcggatntgcctcagttgatagccggaatcgcctcagttgatag

SEQ ID NO: 660486 - DNA, 957 bp, Homo sapiens
  misc_feature (1)..(1): n is a, c, g, or t
  misc_feature (4)..(5): n is a, c, g, or t
ntcnntttctttgtcgtcgcgttgtgctgtcgagacagcgttacggaccgccgtgcctgctttcattatggcccgactgcctgtcgcggttttcacgtcgggatgtctcataccagatgttgcgtgctctccacgcgtgagtttttcgggcgtggaagtctctctcggtgaggctgtttacccccggccagagctattgtggacgcgggccacgagtttctggtagagaggcccccatgggtatatttctggttaccaaaaaggttgttcttcccagagtccccttgagccttcctgtgcaacgggcagcccccagcaggttctgctggcccagatccccacggagagtctctcggctccatacctcttatgaaggtctttcttccgccgggcccctactatgtgcgtgtcctacgcagttattgtcttgcagatgggccccaatatccgccaggcacttttggtggtctggccgacatcctcgcgggcacgagcggctttttagcccccgttatagttgttgtggttcgcgcgcgtttgtcccacctccgcggacgccctttatatgtccacgcgtgtgcccgcgtctgttgcctccccccgtgtgcttgctcctgccccaaggcttcctgggcttcacagtgcatgcatgtctttgtgcccgcgtgggcgcccccccgtatcaattctgggcccaataagctgtcctcgcgctggccacacgagtgagtgctttgggagccccccatggtgtaaaactcgcgcccctcccacccccacttttcggcaactcacaaaggggctggcgtaccccgacgtaccgcctcttcaatgcgcgcctcagcctcttgcccactacccatttaagcacggctttcttccttcctcttggattttgggtttgggattttttctctctgaaacccctgaaaaaaaaatgttccaaagaaaaataac

SEQ ID NO: 660487 - DNA, 131 bp, Homo sapiens
  misc_feature (51)..(51): n is a, c, g, or t
  misc_feature (91)..(91): n is a, c, g, or t
ctccggcacattgtgctggcaaaagaagtgagctggagattggatcacagncgaaggagtaaggtgctgcaatgatgttagctgtggccantgtggatttttcgcaagaacattaataaactaaaaacttc

SEQ ID NO: 660488 - DNA, 1102 bp, Homo sapiens
  misc_feature (120)..(120): n is a, c, g, or t
gctcccggcgccaccgagacgcgcagaggacggctagagcgttgctcgccgagagacttcctcttcgttaagtcggccttcccaacatggcgcagtctattaacatcacggagctgaatntgccgcagctagaaatgctcaatgaaccagtttggaccaggaacgtgggagtccttgtccaacgttccatttggctcgagctcaaagtgggtacagacccacgtatgtggacagccaaggactgtctgaacgttgctgaacaagagcaacgagggggaacagaattactcgtaccactgaacgagtcctatgtatgtccctgggcaagctgcattgactgtgcaaccggtgctcatcgactgtggggacctgggtacctatgtagcagaagaacagctgaggatgccaaggcactcctttcaaggaggacggatagattttctaaccaaggcacgatggcgaaaatccaaaccagttcttcaggagacagcacgccattgaaacagggcgtcattggaaatgatcgagtcagacagattcagccagttcacagtcctgggggccagcctcaggcttactgctagggcccgaagagttcttcggccgcaacttgggggcagcagggacccccctttgggccgtggctaccctggtgctgcgcacgggtctagaggtatgaatgtgccacttcactgtttgccaagggtggggctacatacacaactgtaatccaacgatgtaaccaaaagacagttgcagagcagacacgctacctcatgcaagaacgtttctaagcaacaatgcgatatggaggagtgcggctccaacggatactaacacctgtgcccctaaggatgctgttcacaacgagaaacccgtgccgccactacaatgacgctgggtttctcacccacattaaaacatgcgcccgtgggacacagacatcttgttagaaacatccgctagatggtcagcgacgcttacggcatatttaccaggaccacgcagcgattaatagacgcccaacgcagctgaatcacacatccctccgacactatcactactactaagcaccgcgactcctccactcaccggtcccgac

SEQ ID NO: 660489 - DNA, 382 bp, Homo sapiens
  misc_feature (340)..(340): n is a, c, g, or t
  misc_feature (372)..(372): n is a, c, g, or t
  misc_feature (377)..(377): n is a, c, g, or t
cctttcgccaactgactaccacttctgctagcatcttgacaactttttgcagggaaaacacttcagcatggtgcagaaaatgctttccaagagttcgtcaaatcctgaagcacggatttttatgctacaggaataaacaaacatttctcattggcaaaaatgtgttgattgtaatggttcctgttttgattaataggaatatgttttaggcgtagttacaatgatttaaaattcggcagtctgggaaatttaatttttgcatcaacctaatatttctatggggtaaatccttggcaaacagggggaacaatggcattgggccccagtggctttgtggggntgtgtacttcttttttcctttgttttttttantaggnggggc

SEQ ID NO: 660490 - DNA, 698 bp, Homo sapiens
caggagaatcatttgaacctgggagggggaagttgccatgagcagagattgtgccactgctttccagcctgggcaacagccagactcagtctcaaaaaaaaaaaaaaaaaaaagtaaattttcctctcctcaaaaatttagtaggcaagccatttcaacgggaaccagtatttcagtttatattttaatttgggtttccccatacttctcaatagacctaatccttaagtttggtcttctaaaattggatatacgcttatcaacatggttgttcactggcttcaatggaccaatcccactggtggtttttttggagatgggagtctccgcttggtgccactggttttccaagcctggggcaaccagccagactccagtctcaaaaaaaaaaaaaacaaaaaaaggtaaatttccctctcttaccaacatttatgatcggggggaacgcaatatattaaacggcgaacagggatatttcagcaagtttattatgtctaatttggggttgcacaacgtttaagtaaagaacataatctcctaaaggtgggcgatataaaagtggttggaaacacaaatgaaaaaaaaaaaaggggggcgcgataaaagatatcactgtagaggggccaaaagtaaacatacccaagtttttgtaaaacggggccaaataggaggggatataaagaaggacaggggtgtta

SEQ ID NO: 660491 - DNA, 231 bp, Homo sapiens
ttttttttaaaaaaattttggacaaaactgatttaatttttcaatcctggttcaaggggtgggctgggggtgggaaaatgggattttgggccaatggattttccctaaatttgtcccccctttactttccctttatttttttttccttagaatccctcaaacctggaaccaggtttgggttttttttcctttttttttttttaaaccatgcattaaaactttgaaaccaaa

SEQ ID NO: 660492 - DNA, 158 bp, Homo sapiens
ctctcaattcagaatcccccctcctctctcctacttgtgtattccgcctggttccatctgatctgtctcccatttaatgcgtattatccattggtttgtagtgtcttcacagaacttgtgcaacaattgccatactctagtaccaggacatttcatct

SEQ ID NO: 660493 - DNA, 436 bp, Homo sapiens
  misc_feature (27)..(27): n is a, c, g, or t
  misc_feature (57)..(57): n is a, c, g, or t
  misc_feature (71)..(71): n is a, c, g, or t
  misc_feature (83)..(83): n is a, c, g, or t
  misc_feature (101)..(101): n is a, c, g, or t
  misc_feature (104)..(104): n is a, c, g, or t
  misc_feature (120)..(120): n is a, c, g, or t
  misc_feature (136)..(136): n is a, c, g, or t
  misc_feature (146)..(146): n is a, c, g, or t
  misc_feature (215)..(215): n is a, c, g, or t
  misc_feature (228)..(228): n is a, c, g, or t
  misc_feature (241)..(241): n is a, c, g, or t
  misc_feature (258)..(258): n is a, c, g, or t
  misc_feature (280)..(280): n is a, c, g, or t
  misc_feature (361)..(361): n is a, c, g, or t
  misc_feature (366)..(366): n is a, c, g, or t
  misc_feature (381)..(381): n is a, c, g, or t
  misc_feature (393)..(393): n is a, c, g, or t
tgtctccctcttcttaactggaaagcncacttgtgaggtatggtatccattatcaanagtggagtcatgantgacttcatagnttgtgtatctggttatanggntgtatagcatttaagncggcacttaatataangccatttganttgaatagtgtgtgtgtgtacatggtgtgtgtgtgtgtgtgcactttagtttcgtgagccttgggaagntgattctacaaanagcttatataganataaatgtagcaggcanttttttgcaaagcgatatatanattcctcttatttattaaagcactggctttggtgttatgtagagatatttgtagatctcagaacagaattaaaatattgtnaaaantacagcttaataaangtttattgtaantttgttgtatggacttttaaaatatatctcatcacttctaacc

SEQ ID NO: 660494 - DNA, 626 bp, Homo sapiens
tagaggttcctcacagcttcgggctaacctgccgcgtagcgtttcgcgcgcagctggcgaacatcgccaccttgcttgccgtcccatgagatgagcgcaatgcagatgaagctggcgcgtgcgcaggctgtggacatgctcgaccggttcaccgaaaccgtttcggtgctggtgcctgtgtggcgtcagaacacattggcccttatcaccaccaagaacattagccccgagctgattgcctcggcgacgaaggcgcaccaggaactgatgcgcaaattgtacagcagtctggacacccacagtcattgaaggcagggagaacgacactgaataaccagctgcagacctccaacaacgtcgcccggacgcgatctgctggccacagtggattacgaaggccttggcctgagcgcccacaccgacgccatggcagttgcgccagcttggcggaccgcatccagccgagtgaccccgccacagtggccgaatatggtcgtgacgtaggcgcgatcaccagagagttcacagcgatagcctgctggaacaggtccggaatagcgatctggacgatgccggcgaccagctgacgcaggtggtcaacgtcgctcgaaatctgaacgtgggac

SEQ ID NO: 660495 - DNA, 343 bp, Homo sapiens
cagcgggcgtcatgttaatgtgcgcgctcggtattggacatgagaggttgttacatcctcaccagaggctgtgccagtgcagtccctgtgacagacagagggcaaggcagctgggccagatctcaggccagccgtttgtgctcctagcagggttgctgtgctggccacacggagaggccctatagagcctcatggctcgtccctcacagaagaaacggttccttttggttttttgaaacagctgatttttccagtcccgttttttacaccgttctctcggtacttttttataacgctaagtcagcattgtcttccagtgttcaaggcacccatcagcctctgt

SEQ ID NO: 660496 - DNA, 1239 bp, Homo sapiens
gaactttaaaaaaaaaaaaaaaacttcatgggcttgtccgagttgtgaaatgcacatttaggaaggttacatgtcagaccctttggttaaggataacccgtggactctggggcatgtggcctctttggtgggaggcaagcacattctgggcttctggttggaggggaaggtagaggtgaaagaagagagggcccagctttctaacagggttggagcaaattgagaccaagaaattcactgggtaacgatgatggtatagtctgaccagttttcactggttagtaaattcactgggtcctggggaagcagatttaagctagcagaaagtccagggaaagaaaagaccagaaaggagctaagtgagcacaaggtgatggcgtcggggcaagctgaagtggttgcagggcagcggtggcacggaagggaggcagcatgagccaggtgctcagctaaactacgtggtgcattcagctagaacagttgtgaagaaatcatgggttagcaagccatttcccaacacacaacacactaagccaacaagggccacacttaggccttcatctctggacatggcatcttgtaaccttcacgaaacgactgtactacctcggtcgggggatgcctagacgtcaggcggacgctgaccccaggggctgggaacagatggccacgctgcccagggacccatgtgctgtggcccaggctatgtcctcgtgagcagcgtacgggggtcccacggcatatgatcgtcgcaggggcacgacaagtcaccgtcggcgacgtcctccaaaagtccagccagtcacaccgacatcacgtccacctcggacattcgggacgcctaaaatagccccggcaaaatcttcacactgcaaactctcaagggccttaaagcaatcaaactagggcaggggcgaaaactaaaatcacacacaatgggggaatgcaaccccccgggggttagacccacaaaatgcaacaggggccccgcggacaacgacggggcgcgaagcgctcaacaccgtaaagtgtagcccctggaacacgggcgacgcaccacagcccgcccactaacaacacgtggtacaaagcactaagggggccccaggcgacacaacacggcggcctatccaacgaccagtagcagcacacacgaccatcaacgacgacacacagagacgctgccacaccacagccgacgcacccacgccagcagcgcacgccaaacacagaacgcaa

SEQ ID NO: 660497 - DNA, 401 bp, Homo sapiens
  misc_feature (401)..(401): n is a, c, g, or t
atgttacctctctgagccccaaactttgtttacagtttgtctttgacagagtttctctcttgttgcccaggctggagtgcattggtcgcggtcttggcatccctgcaacctctgtctcccgggttcgtgcatttctcctgcctcatgcctcccgagtaggtgggagtttcaggcttgtgtccatcatgcccagctaattttgtatgtttggtatagatggggtttctccatgttgatcaggctggtcttgacctcctgacctcaggtgatctgcctgccttgtgctaccaaagtgctgagatacatgcgtgagccatcactcccgtccaacttttttattttttacctggtccgggtacttgatgtttctgttgcttctaagatttcttaactgtccaagn

SEQ ID NO: 660498 - DNA, 139 bp, Homo sapiens
  misc_feature (44)..(44): n is a, c, g, or t
gcgcgtttagaggatcccagactgtgacactccttgtatatcantcaccacgatgaggcaacagccagaatgcctgaacgcaggacatacttcctattctacaccctagtaggctcccttccccatactcatctgcact

SEQ ID NO: 660499 - DNA, 640 bp, Homo sapiens
atatcgacacctccctgtcgcgtgggcgatagatgttgtagtgaatgccgtcaacgacgatatcgttgtagtgttgtgtgatggggttggctctgttcctcctggatggaaagtggggtattaccattgtgcttctccctaacctgggctgatggtttggtttgctgcctgggcagacacaactttgtggcctttatacttgtacaagagcaactaccccagcaggttgtccgttaaccaccaggacaatctgtagtccttgacggtcctcagctccttctcgtatcagtcgttgttggcagagaggctggagttcacctcgtaaaaccacagcactatggacctcagcagcccgatgcagacaacctctacgaagtacctgcggactaccctgacctcacggtggcccttctggagttatgggtggttgccgaacactgcctgttactctttgattgatttgttgccaccctgggccaggtactaaccttacagccctatggcctagcagtactgccgcactaactcttgaaagacagataagggtaaacagggcagacacaactagtagactcacactgccagcactattgcctgggtgtaggctggttcctagactgagccctttgactagctgtgg

SEQ ID NO: 660500 - DNA, 414 bp, Homo sapiens
  misc_feature (49)..(49): n is a, c, g, or t
  misc_feature (119)..(120): n is a, c, g, or t
  misc_feature (125)..(125): n is a, c, g, or t
  misc_feature (135)..(135): n is a, c, g, or t
  misc_feature (139)..(139): n is a, c, g, or t
gtgggggtgggtgtgggtattggtgggggtggggtggcggggggggggnggagggggggggggcggggggggggggggggggggggggggggggggggggggggggggggggggggggnnggggngggggggggngcanaggttggaaaacttgtgcccttgtatagtgtccccatgggctcccactgcagcctcgagggcccctgtcccccctggctccccctgctggtgtctagtgtttttttccctctcctgtccttgtgttgaaggcagtaaactaagggtgtcaagccccattccctctctactcttgacagcaggattggatgttgggtattggggtttattttatttttttcattttgttttgaaattaaagtatgcaaaataaagaatatgccgtttttatacaaa

SEQ ID NO: 660501 - DNA, 2598 bp, Homo sapiens
  misc_feature (35)..(35): n is a, c, g, or t
  misc_feature (39)..(39): n is a, c, g, or t
aagcagtggtatcaacgcagagtgcccattacggncggnggagtcactccggcgcagtgttgggactgtctgggtatcggaaagcaagcctacgttgctcactattacgtataatccttttcttttcaagatgcctgaggaagtgcaccatggagaggaggaggtggagacttttgcctttcaggcagaaattgcccaactcatgtccctcatcatcaataccttctattccaacaaggagattttccttcgggagttgatctctaatgcttctgatgccttggacaagattcgctatgagagcctgacagacccttcgaagttggacagtggtaaagagctgaaaattgacatcatccccaaccctcaggaacgtaccctgactttggtagacacaggcattggcatgaccaaagctgatctcataaataatttgggaaccattgccaagtctggtactaaagcattcatggaggctcttcaggctggtgcagacatctccatgattgggcagtttggtgttggcttttattctgcctacttggtggcagagaaagtggttgtgatcacaaagcacaacgatgatgaacagtatgcttgggagtcttctgctggaggttccttcactgtgcgtgctgaccatggtgagcccattggcaggggtaccaaagtgatcctccatcttaaagaagatcagacagagtacctagaagagaggcgggtcaaagaagtagtgaagaagcattctcagttcataggctatcccatcaccctttatttggagaaggaacgagagaaggaaattagtgatgatgaggcagaggaagagaaaggtgagaaagaagaggaagataaagatgatgaagaaaagcccaagatcgaagatgtgggttcagatgaggaggatgacagcggtaagggataagaagaagaacaactaagaagatcaaagagaaatacattgatcaggaagaactaaacaagaccaagcctatttggaccagaaaccctgatgacatcacccaagaggagtatggagaattctacaagagcctcactaatgactgggaagaccacttggcagtcaagcacttttctgtagaaggtcagttggaattcagggcattgctatttattcctcgtcgggctccctttgacctttttgagaacaagaagaaaaagaacaacatcaaactctatgtccgccgtgtgttcatcatggacagctgtgatgagttgataccagagtatctcaattttatccgtggtgtggttgactctgaggatctgcccctgaacatctcccgagaaatgctccagcagagcaaaatcttgaaagtcattcgcaaaacacattgttaagaagtgccttgagctcttctctgagctggcagaagacaagggagaattacaagaaattctatgaggcattctctaaaaatctcaagcttggaatccacgaagactccactaaccgccgccgcctgtctgagctgctgcgctatcatacctcccagtctggagatgagatgacatctctgtcagagtatgtttctcgcatgaaggagacacagaagtccatctattacatcactggtgagagcaaagagcaggtggccaactcagcttttgtggagcgagtgcggaaacggggcttcgaggtggtatatatgaccgagcccattgacgagtactgtgtgcagcagctcaaggaatttgatgggaagagcctggtctcagttaccaaggagggtctggagctgcctgaggatgaggaggagaagaagaagatggaagagagcaaggcaaagtttgagaaacctctgcaagctcatgaaagaaatcttagataagaaggttgagaaggtgacaatctccaatagacttgtgtcttcaccttgctgcattgtgaccagcacctacggctggacagccaatatggagcggatcatgaaagcccaggcacttcgggacaactccaccatgggctatatgatggccaaaaagcacctggagatcaaccctgaccaccccattgtggagacgctgcggcagaaggctgaggccgacaagaatgataaggcagttaaggacctggtggtgctgctgtttgaaaccgccctgctatctttctggcttttcccttgaggatccccagacccactccaaccgcatctatcgcatgatcaagctaggtctaggtattgatgaagatgaagtggcagcagaggaacccaatgctgcagttcctgatgagatcccccctctcgagggcgatgaggatgcgtctcgcatggaagaagtcgattaggttaggagttcatagttggaaaacttgtgcccttgtatagtgtccccatgggctcccactgcagcctcgagggcccctgtcccccctggctccccctgctggtgtctagtgtttttttccctctcctgtccttgtgttgaaggcagtaaactaagggtgtcaagccccattccctctctactcttgacagcaggattggatgttgggtattggggtttattttatttttttcattttgttttgaaattaaagtatgcaaaataaagaatatgccgtttttatacaaa

SEQ ID NO: 660502 - DNA, 269 bp, Homo sapiens
  misc_feature (137)..(137): n is a, c, g, or t
  misc_feature (241)..(241): n is a, c, g, or t
tgtcatgtcgcggcgcacgacgcgtatgatggcgcactgcaggcggcgccatatgcatctaggctataagtatccggatatacgtagccgcaacgtaacaaccggtactctagaactatagctagcatgcgcagatnaggagcgctgatatcgatcgcgcgcagatctgtcatgatgatccattgcattggctccatatatagggcccgtgttataataacctcaggtcgactgtccatgnccattcagaattcggaatcatgtcatag

SEQ ID NO: 660503 - DNA, 223 bp, Homo sapiens
aagaacaacagagaaactacaccacctcgagacacccaaagtgctgggataacagatatgagccactgcagcccagctgcaaggatgtatttactatcagatattctacaaaagcgatatcctatgtctcttcttgactgatttcttctcctacgatcctatcaatgaacaagcctactgtaggaaaaggaatgttgtccactttatcatgagatacatttga

SEQ ID NO: 660504 - DNA, 2594 bp, Homo sapiens
  misc_feature (35)..(35): n is a, c, g, or t
  misc_feature (39)..(39): n is a, c, g, or t
aagcagtggtatcaacgcagagtgcccattacggncggnggagtcactccggcgcagtgttgggactgtctgggtatcggaaagcaagcctacgttgctcactattacgtataatccttttcttttcaagatgcctgaggaagtgcaccatggagaggaggaggtggagacttttgcctttcaggcagaaattgcccaactcatgtccctcatcatcaataccttctattccaacaaggagattttccttcgggagttgatctctaatgcttctgatgccttggacaagattcgctatgagagcctgacagacccttcgaagttggacagtggtaaagagctgaaaattgacatcatccccaaccctcaggaacgtaccctgactttggtagacacaggcattggcatgaccaaagctgatctcataaataatttgggaaccattgccaagtctggtactaaagcattcatggaggctcttcaggctggtgcagacatctccatgattgggcagtttggtgttggcttttattctgcctacttggtggcagagaaagtggttgtgatcacaaagcacaacgatgatgaacagtatgcttgggagtcttctgctggaggttccttcactgtgcgtgctgaccatggtgagcccattggcaggggtaccaaagtgatcctccatcttaaagaagatcagacagagtacctagaagagaggcgggtcaaagaagtagtgaagaagcattctcagttcataggctatcccatcaccctttatttggagaaggaacgagagaaggaaattagtgatgatgaggcagaggaagagaaaggtgagaaagaagaggaagataaagatgatgaagaaaagcccaagatcgaagatgtgggttcagatgaggaggatgacagcggtaagggataagaagaagaacaactaagaagatcaaagagaaatacattgatcaggaagaactaaacaagaccaagcctatttggaccagaaaccctgatgacatcacccaagaggagtatggagaattctacaagagcctcactaatgactgggaagaccacttggcagtcaagcacttttctgtagaaggtcagttggaattcagggcattgctatttattcctcgtcgggctccctttgacctttttgagaacaagaagaaaaagaacaacatcaaactctatgtccgccgtgtgttcatcatggacagctgtgatgagttgataccagagtatctcaattttatccgtggtgtggttgactctgaggatctgcccctgaacatctcccgagaaatgctccagcagagcaaaatcttgaaagtcattcgcaaaacacattgttaagaagtgccttgagctcttctctgagctggcagaagacaagggagaattacaagaaattctatgaggcattctctaaaaatctcaagcttggaatccacgaagactccactaaccgccgccgcctgtctgagctgctgcgctatcatacctcccagtctggagatgagatgacatctctgtcagagtatgtttctcgcatgaaggagacacagaagtccatctattacatcactggtgagagcaaagagcaggtggccaactcagcttttgtggagcgagtgcggaaacggggcttcgaggtggtatatatgaccgagcccattgacgagtactgtgtgcagcagctcaaggaatttgatgggaagagcctggtctcagttaccaaggagggtctggagctgcctgaggatgaggaggagaagaagaagatggaagagagcaaggcaaagtttgagaaacctctgcaagctcatgaaagaaatcttagataagaaggttgagaaggtgacaatctccaatagacttgtgtcttcaccttgctgcattgtgaccagcacctacggctggacagccaatatggagcggatcatgaaagcccaggcacttcgggacaactccaccatgggctatatgatggccaaaaagcacctggagatcaaccctgaccaccccattgtggagacgctgcggcagaaggctgaggccgacaagaatgataaggcagttaaggacctggtggtgctgctgtttgaaaccgccctgctatctttctggcttttcccttgaggatccccagacccactccaaccgcatctatcgcatgatcaagctaggtctaggtattgatgaagatgaagtggcagcagaggaacccaatgctgcagttcctgatgagatcccccctctcgagggcgatgaggatgcgtctcgcatggaagaagtcgattaggttaggagttcatagttggaaaacttgtgcccttgtatagtgtccccatgggctcccactgcagcctcgagggcccctgtcccccctggctccccctgctggtgtctagtgtttttttccctctcctgtccttgtgttgaaggcagtaaactaagggtgtcaagccccattccctctctactcttgacagcaggattggatgttgggtattggggtttattttattccgcatttgttctgaataaatgcacgggggccgctggggtggtgtgggggtgggggg

SEQ ID NO: 660505 - DNA, 1932 bp, Homo sapiens
  misc_feature (35)..(35): n is a, c, g, or t
  misc_feature (39)..(39): n is a, c, g, or t
  misc_feature (1786)..(1786): n is a, c, g, or t
aagcagtggtatcaacgcagagtgcccattacggncggnggagtcactccggcgcagtgttgggactgtctgggtatcggaaagcaagcctacgttgctcactattacgtataatccttttcttttcaagatgcctgaggaagtgcaccatggagaggaggaggtggagacttttgcctttcaggcagaaattgcccaactcatgtccctcatcatcaataccttctattccaacaaggagattttccttcgggagttgatctctaatgcttctgatgccttggacaagattcgctatgagagcctgacagacccttcgaagttggacagtggtaaagagctgaaaattgacatcatccccaaccctcaggaacgtaccctgactttggtagacacaggcattggcatgaccaaagctgatctcataaataatttgggaaccattgccaagtctggtactaaagcattcatggaggctcttcaggctggtgcagacatctccatgattgggcagtttggtgttggcttttattctgcctacttggtggcagagaaagtggttgtgatcacaaagcacaacgatgatgaacagtatgcttgggagtcttctgctggaggttccttcactgtgcgtgctgaccatggtgagcccattggcaggggtaccaaagtgatcctccatcttaaagaagatcagacagagtacctagaagagaggcgggtcaaagaagtagtgaagaagcattctcagttcataggctatcccatcaccctttatttggagaaggaacgagagaaggaaattagtgatgatgaggcagaggaagagaaaggtgagaaagaagaggaagataaagatgatgaagaaaagcccaagatcgaagatgtgggttcagatgaggaggatgacagcggtaagggataagaagaagaacaactaagaagatcaaagagaaatacattgatcaggaagaactaaacaagaccaagcctatttggaccagaaaccctgatgacatcacccaagaggagtatggagaattctacaagagcctcactaatgactgggaagaccacttggcagtcaagcacttttctgtagaaggtcagttggaattcagggcattgctatttattcctcgtcgggctccctttgacctttttgagaacaagaagaaaaagaacaacatcaaactctatgtccgccgtgtgttcatcatggacagctgtgatgagttgataccagagtatctcaattttatccgtggtgtggttgactctgaggatctgcccctgaacatctcccgagaaatgctccagcagagcaaaatcttgaaagtcattcgcaaaacacattgttaagaagtgccttgagctcttctctgagctggcagaagacaagggagaattacaagaaattctatgaggcattctctaaaaatctcaagcttggaatccacgaagactccactaaccgccgccgcctgtctgagctgctgcgctatcatacctcccagtctggagatgagatgacatctctgtcagagtatgtttctcgcatgaaggagacacagaagtccatctattacatcactggtgagagcaaagagcaggtggccaactcagcttttgtggagcgagtgcggaaacggggcttcgaggtggtatatatgaccgagcccattgacgagtactgtgtgcagcagctcaaggaatttgatgggaagagcctggtctcagttaccaaggagggtctggagctgcctgaggatgaggaggagaaganagaacgtaatttggggcaacgcaggagccaaagtgcaaagtttgagaacctctgcaatggcctccaattggaaaaaacggaaaaatcttgagatacagaaggttgagaatgtgtgaccacattctttcccaaattaagacttttgt

SEQ ID NO: 660506 - DNA, 305 bp, Homo sapiens
cctttggaccgaatttttttgtaataagccatcaagggtataattttttttaaaatagaaattttgtaagaaggccatatttacctaatccccatggaagccctctggatgatggattccccaaaacttggttttatgggtacttcttctcttagattcttaattcatgaggagggggggggagggaggtggagggagggaagggtttctctattaaaatgccttcgttgtgttttttaagataggggaacctgcttaaatttcttatggggccttaaccaataaaaaagctcttttaattttga

SEQ ID NO: 660507 - DNA, 1860 bp, Homo sapiens
  misc_feature (35)..(35): n is a, c, g, or t
  misc_feature (39)..(39): n is a, c, g, or t
aagcagtggtatcaacgcagagtgcccattacggncggnggagtcactccggcgcagtgttgggactgtctgggtatcggaaagcaagcctacgttgctcactattacgtataatccttttcttttcaagatgcctgaggaagtgcaccatggagaggaggaggtggagacttttgcctttcaggcagaaattgcccaactcatgtccctcatcatcaataccttctattccaacaaggagattttccttcgggagttgatctctaatgcttctgatgccttggacaagattcgctatgagagcctgacagacccttcgaagttggacagtggtaaagagctgaaaattgacatcatccccaaccctcaggaacgtaccctgactttggtagacacaggcattggcatgaccaaagctgatctcataaataatttgggaaccattgccaagtctggtactaaagcattcatggaggctcttcaggctggtgcagacatctccatgattgggcagtttggtgttggcttttattctgcctacttggtggcagagaaagtggttgtgatcacaaagcacaacgatgatgaacagtatgcttgggagtcttctgctggaggttccttcactgtgcgtgctgaccatggtgagcccattggcaggggtaccaaagtgatcctccatcttaaagaagatcagacagagtacctagaagagaggcgggtcaaagaagtagtgaagaagcattctcagttcataggctatcccatcaccctttatttggagaaggaacgagagaaggaaattagtgatgatgaggcagaggaagagaaaggtgagaaagaagaggaagataaagatgatgaagaaaagcccaagatcgaagatgtgggttcagatgaggaggatgacagcggtaagggataagaagaagaacaactaagaagatcaaagagaaatacattgatcaggaagaactaaacaagaccaagcctatttggaccagaaaccctgatgacatcacccaagaggagtatggagaattctacaagagcctcactaatgactgggaagaccacttggcagtcaagcacttttctgtagaaggtcagttggaattcagggcattgctatttattcctcgtcgggctccctttgacctttttgagaacaagaagaaaaagaacaacatcaaactctatgtccgccgtgtgttcatcatggacagctgtgatgagttgataccagagtatctcaattttatccgtggtgtggttgactctgaggatctgcccctgaacatctcccgagaaatgctccagcagagcaaaatcttgaaagtcattcgcaaaacacattgttaagaagtgccttgagctcttctctgagctggcagaagacaagggagaattacaagaaattctatgaggcattctctaaaaatctcaagcttggaatccacgaagactccactaaccgccgccgcctgtctgagctgctgcgctatcatacctcccagtctggagatgagatgacatctctgtcagagtatgtttctcgcatgaaggagacacagaagtccatctattacatcactggtgagagcaaagagcaggtggccaactcagcttttgtggagcgagtgccgagggcccctgtcccccctggctccccctgctggtgtctagtgtttttttccctctcctgtccttgtgttgaaggcagtaaactaagggtgtcaagccccattccctctctactcttgacagcaggattggatgttgggtattggggtttattttattccgcatttgttctgaataaatgcacgggggccgctggggtggtgtgggggtgggggg

SEQ ID NO: 660508 - DNA, 418 bp, Homo sapiens
  misc_feature (13)..(13): n is a, c, g, or t
  misc_feature (32)..(32): n is a, c, g, or t
  misc_feature (41)..(41): n is a, c, g, or t
  misc_feature (65)..(65): n is a, c, g, or t
  misc_feature (106)..(106): n is a, c, g, or t
cctggataaaggnattccggccaatggtttcngggatatangattaatggtacacaaatccggtngctccttcctatacccccaacagtgacccaagcatagaatnaaatcaagaactcaactcccttttacaatagctgcaaaaacaaacaaacaaacaaacaaacaaaaaaaacttaagaatataccaaacaaaggagttgaaagactgctgcaagggaaactacaaaacactgctgaaagaaatcatagatgacacaaacaaatggaaacgcatgccatgcccatgaatgggtagaatcaatattgtgaaaatgaccatactgccaaaagcaatctacaaattcaatgcaatccccatcaagataccaccatcattcttcacagagttagaaaaatcaattcaaaaattcatatg

SEQ ID NO: 660509 - DNA, 1169 bp, Homo sapiens
acgccaacggctgcgctagggattccgacgtagagactccactcaacggcttcggcggtctgagctgctgcgctatcatacctcccagtctggagatgagatgacatctctgtcagagtatgtttctcgcatgaaggagacacagaagtccatctattacatcactggtgagagcaaagagcaggtggccaactcagcttttgtggagcgagtgcggaaacggggcttcgaggtggtatatatgaccgagcccattgacgagtactgtgtgcagcagctcaaggaatttgatgggaagagcctggtctcagttaccaaggagggtctggagctgcctgaggatgaggaggagaagaagaagatggaagagagcaaggcaaagtttgagaaacctctgcaagctcatgaaagaaatcttagataagaaggttgagaaggtgacaatctccaatagacttgtgtcttcaccttgctgcattgtgaccagcacctacggctggacagccaatatggagcggatcatgaaagcccaggcacttcgggacaactccaccatgggctatatgatggccaaaaagcacctggagatcaaccctgaccaccccattgtggagacgctgcggcagaaggctgaggccgacaagaatgataaggcagttaaggacctggtggtgctgctgtttgaaaccgccctgctatctttctggcttttcccttgaggatccccagacccactccaaccgcatctatcgcatgatcaagctaggtctaggtattgatgaagatgaagtggcagcagaggaacccaatgctgcagttcctgatgagatcccccctctcgagggcgatgaggatgcgtctcgcatggaagaagtcgattaggttaggagttcatagttggaaaacttgtgcccttgtatagtgtccccatgggctcccactgcagcctcgagggcccctgtcccccctggctccccctgctggtgtctagtgtttttttccctctcctgtccttgtgttgaaggcagtaaactaagggtgtcaagccccattccctctctactcttgacagcaggattggatgttgggtattggggtttattttatttttttcattttgttttgaaattaaagtatgcaaaataaagaatatgccgtttttatacaaa

SEQ ID NO: 660510 - DNA, 232 bp, Homo sapiens
  misc_feature (73)..(73): n is a, c, g, or t
  misc_feature (98)..(98): n is a, c, g, or t
gtcactcatagaaaagttcttcctttatttctctttggaagtactttagtgaacttccccccattataacaantgcttgttcaatatggaaagatggnaaagttaaaaaaaaggtgtttagggtcttaggaatgggcttttgagaaaagaagtcgtctagagggaggttctgggtgtgcttaagagctttttttcagtaccaagcacacctggctcacaccttctcatccca

SEQ ID NO: 660511 - DNA, 735 bp, Homo sapiens
gctgaatcagctcgtaccacactggggtggtcagtgattgatctccaggtgctttttggccattatatagccaatatggagcggatcatgaaagcccaggcacttcgggacaactccaccatgggctatatgatggccaaaaagcacctggagatcaaccctgaccaccccattgtggagacgctgcggcagaaggctgaggccgacaagaatgataaggcagttaaggacctggtggtgctgctgtttgaaaccgccctgctatctttctggcttttcccttgaggatccccagacccactccaaccgcatctatcgcatgatcaagctaggtctaggtattgatgaagatgaagtggcagcagaggaacccaatgctgcagttcctgatgagatcccccctctcgagggcgatgaggatgcgtctcgcatggaagaagtcgattaggttaggagttcatagttggaaaacttgtgcccttgtatagtgtccccatgggctcccactgcagcctcgagggcccctgtcccccctggctccccctgctggtgtctagtgtttttttccctctcctgtccttgtgttgaaggcagtaaactaagggtgtcaagccccattccctctctactcttgacagcaggattggatgttgggtattggggtttattttatttttttcattttgttttgaaattaaagtatgcaaaataaagaatatgccgtttttatacaaa

SEQ ID NO: 660512 - DNA, 187 bp, Homo sapiens
  misc_feature (17)..(17): n is a, c, g, or t
  misc_feature (29)..(29): n is a, c, g, or t
  misc_feature (82)..(82): n is a, c, g, or t
  misc_feature (127)..(127): n is a, c, g, or t
  misc_feature (181)..(181): n is a, c, g, or t
gtcccccggggcaaggnctccttactctnagcccaggccgttccccttggtttcctccgtccacccaggctgcactgcagtnatggcgcgggaggcaccagctctgtggcctgtttccagcaactgngggtctgaaggaatagccagagaggagcacctgaaccccatgggcttggacttnctgggg

SEQ ID NO: 660513 - DNA, 671 bp, Homo sapiens
  misc_feature (319)..(319): n is a, c, g, or t
  misc_feature (634)..(634): n is a, c, g, or t
gctctcggttttcggctcggaggaggccaaggtgcaacttccttcggtcgtcccgaatccgggttcatccgactacctaggcgtcctccaccatgccgacgtaatgttcgacccctaacggagatctaaagtcgtatacctgaggtgctgcaggaggtgaagtcggtgccatttctgtcctggtccccaagatcgggcccctggtgtctgtctccaagaaagaaatgttggtgatgacattgccaaggcaacgggtgacttggaaggggcctgacggattaccagggacatattgatccacttcaagaagcagcatganggtccagagttagacggtggagtcgcgcatatcatgtcctctgtcgcctggagtacatgcaataagcgcacatcaatggtaatggcaccaatgagacatgaaagaaaatcaggaataaatagttatagatcacgagctgggaatgatctactttttgatagagcatttgtccaatcataggctcgacgagatgcggctagcgatccttagtccagaggaactcctctggtaaccattagagagattcctggggactgtccagtcagtgggctgtaacgttgatggtcgccatcctcgtgacatcatcgatgcatntcaactgtggtgctgtggaatgcccagcggttaagcc

SEQ ID NO: 660514 - DNA, 229 bp, Homo sapiens
  misc_feature (1)..(1): n is a, c, g, or t
  misc_feature (4)..(4): n is a, c, g, or t
ntgntcattcatcgaaaaggcaccaagcctgtatgggtcagtgtgctgtataccccggatgcaccagatggcgttgccttccgggagctgaccaaggggctggtggagctggacacgccgaaagcaaaaccggaatggcagacctatttcacttcccagatggccactaaggatacgaaagagatcacacggatcttcaacgatacgcgcagtgtgtaccgctatacct

SEQ ID NO: 660515 - DNA, 982 bp, Homo sapiens
tcacaaaagcatttttaattggaggcaaaaaaaagtctggctgaaaggtattccagttccaagcagtcaaaattcaaccgttaggggactatttggacctgggtaagatttcggcttctcttgggtcaagaaaaggggtatccagggttggtactttccccagcagggtaagaaaagaaggggcacaagcaacactgggaaagaagacttctactctactggacagggctcttgagatccaacatcaaagtcttaagaacacgccctcgttgggccatcctctaccgggtgttggtcttgccccatctggtctgatgtgacacagggccatatctacttttggcaagggaaaaaatattgagggcaaagaaacacagggtaataggtcacttgggggacagagcagggcaaccacagcgtttcaaaacctctttcatggagaaggggagtaactcctttggtggcgagagggtcacacgctcaacaagggcacaagacccttccagttcctggttggtacgctagagataaggggggtcaatatccgggctggcctcagtctcaaaggtcaacagaccttaaaggttctcacgcaatggctgtatctgggtggtcacaagatttgggcggatccaccaccaatgttcctctcgcttggggagaaccgggatcaggaccggggctgggtaagttcacattgggagctgggctgcgatccgccttagcccctgggagatcctccaggacaagaaggggtccctcgggcttgggcccaggcctgtcccggagaaccctgaggggcgctttgtagcggggtccaccacagattgcctttgggacctggcgcagtacgggatttaaccttctccctgacgtcacactatggcggggacctcaatctcggtacacctggcaggcttaatacttccacggccacgttttgttaaagaccattccccacctggaaatgcgtcacatttgg

SEQ ID NO: 660516 - DNA, 435 bp, Homo sapiens
ggacagagactctggatagtgtcgacttgacactgattccaccatgaatgggattgaaggatcagttctgctcactcaacatctgtactcatgtctgaactatgggttctagacagtccaaggactcttatggtgagagcctgaactctcatgagctgcagacctggactgactatgctaaggacctgatagatacaggcactagcccagagctacaagcccatgccagaagttactgtgacatgtccttgtagcagattgcatcctgatcaagacgctatgccgatagccgtgaacgtcttgacctagtacatggatgttgcaactcagtctatcacgtagtgacgtgttcagaccaatgactctcaagcgtatctaggctttataacgagctattgggccgttcgtcggttcatacccacgtagacctacgat

SEQ ID NO: 660517 - DNA, 224 bp, Homo sapiens
cgacgaatcttctcaatgggaaaacggctgagctccagccaccccgtagtcacttgctttgttacagcttccgttggtgccatcggatacttacacagtgtgtataacgtggtacatacattaacttatggcctcattttgttatttttcgaaacaaagccctgtggaagaaaatggaaaacttgaagaagcattaaagtcattctgttaagctgcgatgggga

SEQ ID NO: 660518 - DNA, 495 bp, Homo sapiens
cccggggggggcccctttaaaaaaaggggatcccccggggggcaggaatttggcccaaggggcaactttaaaagattggccccccaggggttttaaacgggtattgggggggggcccccggcaaaaccaggcaaatttcaaaaagggaaaaaaaaaagcttcaaaaaaaaaaaaagcccccccgggaaattgttaaaaaaattgcaaaaaaaattttcaaaggccatgccaaagttaaggaaaaagctttttaaaaaaaaaccaaggggggggggggattaaaaaaaggaaaacatgaaatttttcccaaaaaaaaaaaaaaaaaaacaaaaaaattttttaaggaattttttaaagaaaaaaataaatcaaatgatgaaaaaatgtaaaaatttcccccgcctttattgttttttaaatttttacccccggccaaaggaaatatttaacccggggttaaaaaaacgggccaattttcattaaatttttgtttta

SEQ ID NO: 660519 - DNA, 124 bp, Homo sapiens
gggggaaggaaagtatggaactgggggtgggtctggcctactggctgacattaactacaattatgggaaatgcaaaagtggttgggatatggtagtgtgtggttctctttgggaatttttttca

SEQ ID NO: 660520 - DNA, 421 bp, Homo sapiens
  misc_feature (90)..(90): n is a, c, g, or t
  misc_feature (250)..(250): n is a, c, g, or t
atctccataaccaagatctttagttccttccagtgtaagaagccggggtactgactctcttcttaaagacacagagggatacgataccanagcctgtctggctcccagggtgtggcacctcactggctgggtaagccctgctgcacagcccagtaactgttggctcgcaagaagcgggctaggatgggtccctgcctcccagcctgcctctctggaccctgctcctcgagtgtagaacctctcagccccntcatgggtcttgggtcccaggcagcccatgactccaggaaagagtctaagttagaagccccccacccccaattcttattattcccattacttgtgccacatgttcccaggacccatccaataattaattaaatccttaagaaagccaggccagctccaggaaaggaaagga

SEQ ID NO: 660521 - DNA, 331 bp, Homo sapiens
aggttgactctgggatccccagcgaccgcggtcaatgcaggcgatcctgaggacgccatccctagagagtggcgataggacgaaagacccttacaagcgcatctcgatctgtcctctacaaacgaattgcctgtgaggaagagttctccgattctgaagaggagggagacggggggccgcaaggaactcttccaacttcaaaaaagccaagagagtctaaacagaggatgaaaaagagaaagacccagaggagaagaaagaagtcaccgaagaggagaaaaccaaggaggagaagccatgaagccaaaggggctcaacggacggaggtcaa

SEQ ID NO: 660522 - DNA, 124 bp, Homo sapiens
gactctagtaggatccacgagtgtcttcagagtgtgatgttgttcttttcttcttgtcctcaaaaaggtcaagagggagaccgacgaagaataagatagcaatgccctgcaattccaactgacc

SEQ ID NO: 660523 - DNA, 93 bp, Homo sapiens
  misc_feature (90)..(90): n is a, c, g, or t
ccagaccaagagcaagatgccatcactcgtaatgagaaagcaggggacatcgcactcctgtatatacaagcgatagaaaggacaatactncgc

SEQ ID NO: 660524 - DNA, 152 bp, Homo sapiens
tacatagagtaagataagagctatataatcaatctgcttcatagggcgttatcgagttagcacaccatcatatgtacagtagaatagacgctagacacacagagcatatttactcctcctcgtatcatagtcatcgcttatgcctaacctgg

SEQ ID NO: 660525 - DNA, 881 bp, Homo sapiens
  misc_feature (159)..(159): n is a, c, g, or t
tggaatgctggattccaagttattcccggggctacctgggtggaacccatagtttggtggattgtgtattcccatttctgaatctcagggggtgtggcaggttgggtttccagaaaatgtgctctccatatatagctcgtggaggcccctcttaggganctcgtgacatgtgttatttaccaaagccaaagaggtaaccttgagagggcgtggcatgtggaccgtggggtgttttatctctgtgggcgtggtgggaccatctgcgggttctcttctttcctccagtgtggcaaatgtgacagaccttccgagctgggtagacgtagacgtgggtgggagggttctccatggggcgtgtgcaaggtctctttcaaccaaggagaccccagtgttgtgttacccaacaagcccctcgtggcgtgagccgtgagggggaacaccatgtggtcccccccgtgggcttttcccacaaaaaaccccacccaaacctttggggatttcaccaacaaaatgtgtgggtccctctataggagcccgtgggggggccgttgcccccttataacctgctggtattatacccaccccgtgtggcgttggcctctcccctgtttatagatctccaacaggacaatttctcatagagaaaaatctcccacatatttgtgcgcacgtggtgtggagacatatacccgccgaaaaaaaacttccctattatgtgtgctacgcccaatttcccccaatagatgtggtgtggaccaacactcccccacactttactatatacaacgagagactcctctgttttactaccaaaaacaatttacccgtgggagagatttcatcgtagtgatatgttggcagaaaccccgttagaaaaacgc

SEQ ID NO: 660526 - DNA, 461 bp, Homo sapiens
cacgaggactcggccaccgccgaatccagtgacgcctgtgcggacgctctgcaatcggtgatggaagataccgattcagcaatggaagacgctgtcgatctattcacgacggtggtggagacgggattgcccttgatcctgcctctgcctccgccggcgaaaaagatcgctatgcatgcgctgacgcaggtggggaacgcagcgggtttgctcctgttgaaccaggtgaaggcgcatgatcgtgccctcggtgaagcgttgggaacactatcgacacattgctcggaacaggtcagtgtgtgtggagcgtgcccggtcgagccgccgaaacctctgcagcactgtgatgccgtgacatcacgaggtaaggatgcggtgccgagtgttgtgccgaggaacgaatcgtcaccgatagtgagtgtttgtccttcaccggcgacgccggtctcgccggggacatc

SEQ ID NO: 660527 - DNA, 357 bp, Homo sapiens
ttgcagtattttaccgtcaagtcaaggcaccctcccctcttttagaaaatgaatccttgccaagtgtgtatccgtttaagctcttattttgggttgtgtgtatccggcacaggaaggttggtcctttgcctccccgagatttattgatcctttctttaaggccctattcatcagagcactggcagccagggacaggttggcagtgttcgccaaatagacatgtatttatagaaacatattttcatgcgttaggcaaaggtccagttatcagaagcgattatccttttatctgtatttgattgtatatatgaatgagcaacattttaaaggctcagatccctttgaaagagtccatag

SEQ ID NO: 660528 - DNA, 447 bp, Homo sapiens
  misc_feature (8)..(8): n is a, c, g, or t
tcatcccnccccccccccccccatcaataccatggcattttttgggaatgtcccaaagagaaggctcgcaccctgccagagaactggccaaccggttggcaccatgctgcaactgaatgagcatggaccacagtgtggcttccattgccactgcttgctaacacatgcaaatgaggatggatcctgctgccaccaccccacaaagtgctttggctgggacctcccatcagagtgttgtgacctttggtctgggagcaccacagcccctccagcacagcaggttcctaacgtcaaggagccagagaacaaagctagggcctgatataagtcccccagagttagagcatgcagtccaggagtcctgaggtgagtcttggccccctaaaatcttccagtaacgaagccagtcaactcaacccaccttatgccacaatcaaacccataagg

SEQ ID NO: 660529 - DNA, 178 bp, Homo sapiens
gcatacctccgcctcctctagaatattgatccatgatccagagttcctatattaacccactcccttgtttcttctgagcttcagcctagagatcaaaatagtttctgaattctagagaaaccagcagaggaacaaatactctccatattttgttcactggagtataccttactcaatt

SEQ ID NO: 660530 - DNA, 723 bp, Homo sapiens
  misc_feature (536)..(536): n is a, c, g, or t
  misc_feature (560)..(560): n is a, c, g, or t
  misc_feature (617)..(617): n is a, c, g, or t
aaaaaactaagtaataactggagcctctaaatttattatccattatccagtgatgggataggttggtatttcttctatcatggtttaggggccaaaataggtatattgtgtcacagagggcagcatctccttagtcccagctcaggctctctgccttccagaggccgcttctccagtgactaaacctcctccttctggcttcttcttgcagaccgttattcccttgtttagaacacgaatttccatttacctggtgggaacacgaaacaggagtctcttctgttctgcaagtttgatgggtaagaggtagccttttttcaaagtaggatttcctttttcaactgttccaggaaagaatctctaagactgggtagctcacagccagcccaaggcagctaccatttcaccagaagcccgtcccgtgcctccgtggcttctccagccattgaactggtcccacacgcaccccaggccccactcctcggcagtttcaggtgtagctgtggggccccgttctaggtctgtactcactttanggaggcttcactgactaggctttnctcctgcatgttgaatttccttcagctttagagggagaagtgaataaatttcctagngatttaatgcactttgacttgataaactttcctgggtagcgacggatctattagccttttacgacgatggatctgagctctctttcatgttgtagggtgtttcttg

SEQ ID NO: 660531 - DNA, 288 bp, Homo sapiens
  misc_feature (14)..(14): n is a, c, g, or t
  misc_feature (23)..(23): n is a, c, g, or t
  misc_feature (260)..(260): n is a, c, g, or t
  misc_feature (279)..(279): n is a, c, g, or t
aagaaaggaagggnccctggtgnaagtggctcatgcctgtaatcctcagcatttggggaggtttaggcgggcagatcgcctgaacctaggagttcgagacccgcctgggcaacgtggtgaaacctcatctctacaaaaattagctgagcatggttgtgtgcacgtgtggtcccagctgctcgggaggctgaagtgggaggatggtgtgagcccaggagtggaaggttgcagtgagccatgattgtgtcattggactccancctggatgacagaatgagntcctgtcat

SEQ ID NO: 660532 - DNA, 150 bp, Homo sapiens
tgccaggcatatactgcagctttcagtcgtcgagatgatcattatttcctgtctttatatctcttccgattatcagtctttctttagatcttcatggagaccatccattaggaacagaagcatttcttgtgaatctggctgactgtatcc

SEQ ID NO: 660533 - DNA, 301 bp, Homo sapiens
tgaataaactcaagctttcaattcttcatcaaaaggtgcatgtccaaatagtgagatgtattccaatatggaactcccatccaatggctaggagatgagacagcagcagacatggaagagaaaccttagaaaattctgctgagaatatatatttttttcataatgctcatgtttcttgtgctgagagtagctgtgcacttcgtttagagagaaatttgtttaaggggagtatttttggttgacttgatcaatctttcatctaatctaagttttttcttaagatgctttgaacttctttttt

SEQ ID NO: 660534 - DNA, 759 bp, Homo sapiens
  misc_feature (326)..(326): n is a, c, g, or t
tcagtcccgggaaaaggtgacctgattctctgagggtccttgtgtagtcgtgaaattgtccccgcagttttcaatcatgtctgagaccaatcagagtccttgtgactgagagcatgctgttcaaattgcatggttcagctgctgtacacgtatgaatatgagatctgtcttggggaaggatcagcctataattctgtgctgtgggatatcagccccatgatgggtgtcctggacgggtcctagatggaggtgcaagattgtgcccttacccttcctgagaagatgtcatcgcaacagactatagaacgacgttcgccttcaaagancctggatgtggcccattcttgttggtgctccatgccagagcagggaaccgcatggagagaaacagatttactgaaagcaaatgtgaaaatcttcaaatcccaggtgcagccttagataaatacgccaagaagtcagttaaggttattgtgtgggtaatccagccaataccaatgcctgactgttccaagtcagctccatccatccccaaggagaacttcagtgtgcttgacctcgttggggatccacaaccgagctaaagctcaaatgtggtctttaaacctttggtgtgactggctaatgattgtcacagaattgtccttattcttggggaaaccatttcctcgaatcaggatccacgttgtcaccatgccaggtggcacattgccggaacgaatggggttatgagctctgaagatacagcgggtcccggga

SEQ ID NO: 660535 - DNA, 630 bp, Homo sapiens
tgaatacggcacgaggagagagagagagagacgagacgagagagagagagagagacgagagagagagagagagacgagagagagcgagagagagacgagagacgagagacaaccacaacgagcaagagcatacgagagcacgatcagacaacaagaacgacgattagatccgcatccagaggtgttaatgcaaactcatcgactattcgccacctgtagactcgacaatcgtatgtgtatctaatgtgcacggcattgatctggtgtctcctgcgctcctaactctcccagctgatcactttcctgacctcttatcatgtttcaactataattatactacatgtatcctaggtccctcttacatgttctcccttctcccttctgtacgagcttatcgactcagggatatcaagctctgtaatgttatcttgatgacgaagagctcgtccgatgcctatcctccttatgctttggtgctgtctgttgagttgtgcaaccatatcgaagcacgatgggacgagtacctgtgacgtgtctctgtctggtctatcatgcacaatagcggcaagtacactgtgtgtcatgcgataacatactactggggtcacgatagtctgtgatcgatggatg

SEQ ID NO: 660536 - DNA, 361 bp, Homo sapiens
  misc_feature (320)..(320): n is a, c, g, or t
ttccaaaacatgccaagaattccacaatatttacattgtaaagtactcctgtaatactggagttaatttaaaatacattcaaagcaggatgcagtggctcatgccatataatcccagcactttgggaggccgaggagggtggatcacttgagataaggtgtttaagaccaacctggctaacatggtgaaaccctgtctctattaaaaatacaaaaattagcaaggcatggtggcaaacgcctgtaatcccatctactgcggaggttgaagcagaagaatcagctgaacccaggaggtggaggttgcagtgagccgagatntgtgcccctgcactccagcctgggaaaaagagcaagactcc

SEQ ID NO: 660537 - DNA, 156 bp, Homo sapiens
atattgcccaggctggtctcaaactcccgggctcacgcgatcctccagccccggccacccaaagtgctgggattacaggcctggccatgagttctagaattagatgctcctgggctcagggaggcactcaggggaatgccagagaggggcggagca

SEQ ID NO: 660538 - DNA, 172 bp, Homo sapiens
catctggatccttcatgaaatattaagcactgtagagtcagaaggcagctgagagtagatgcgcagcacagccaggtcaggcgcgttctcgaggtgcctccagatgctccacaactctggatctgacggtcaccgtcaactgtacctctatggcccaggacatgacagactc

SEQ ID NO: 660539 - DNA, 659 bp, Homo sapiens
  misc_feature (382)..(382): n is a, c, g, or t
tgtaatcccaacattttgggaggcaaggtgggaggattgcttgagcccaggagtttgagaccagcctgggcaaaacagtgggacccccatctaccaaaaaaaaaaaaaacaaaatttacccgggcgtggtggcgtactcctgtgttggtcccagcttactcaggaggctttgcagtttttagacaggcgttactcagaagaaaagcctcactgagtgtgacattctgcagaagggcctgaaggaggggagggcaagggaggagcagagtgggtattaggaagagcatttccgagaagcaggatgagccagttgcaaaggcccagaaggttaggcttggtccccttttctccttgggaacccccttcccttccttcctttgcntgcctccttaaaaccacaattaggtcgaggagctctggaactgacccaggtacagtctggaaatctgtgctttgaggaacagaggaggtatagagaatatgagatttgtgaaaaggaaagcgtcatcgtgatcgttgattgccccagcgcttgagagttgataggtgtgcatttagactctcggctcaacgtgcaggccttataacctccgtggctcaagacaagcccccttgccttttgcctaccaagtacctgagactacaggacccttaccacg

SEQ ID NO: 660540 - DNA, 1217 bp, Homo sapiens
cgctgtttttatctgcagttcctttttaggtattgtacaaatgtttcttgaagatttttaaatacaataacgtttaaaagatgaattaacgttcaattatgcaaattaacaagtgagaagtgggttgcctttgtcttcagttatcgaagagatggttgcagtcataaatactaaaggagcgtgaagttataaagagataatagagagagagttggctgctaaaatgaatctgagcaatatggaactattttgtgccacacgacagaacaagcactctggcacaactgtttctcgtttaggtattggtttggtgttgtacaagagagcaggatcttgctatgtttcgccagactggtctcgagaacgtcctggtctcaagtcatcctcgtcaccttggcctcccaaagcattaggattacatgacagtgagacatcactaccacagatccctagatagctaatgttgaagtgtactgacagatttaccccccaaaatacagaattgtcaatgatgacaataaagcgtaactgatatcaaacaagcagcagtccttgctgctactggtcatcatgcgtaacaggggtgcgtgaaggagccagagcattgccgatcttattctacaaagatgatcctgaggaacttgttatgcggttggcagtgaacatttggacctggcaagttatggagcagctcattgctgcgtacaatttgtccaagcaactgacggtggtgccacttacgcacgaatgttccctattattgggcaagccgaaaccctgtgaaaacatgggccgaatattccctaagggacattcacaatttttcagacaatggcacgcattcgagaacacttatgagagtccaagcggggtacacctgagacaacccacggcagtgacagtggaaggagcaatccatacgtcacgcccgtgtacactgacacccgtatccaaaaaaccactcgcgacccgtcagcgcactgccataatgataagacgtcggtcaagacacacaacagatcaaagagagataacacgagcccacaccaccaactctaacaaaacgacaactacaacagataataaagcactgcgcacaacggcggaccagactgaaggtaaacatagaaagtagagatcctctatgatcattaaagaccacggaatagaccacagagatggagatatgaacatacaacatcacactgccgcaagct

SEQ ID NO: 660541 - DNA, 791 bp, Homo sapiens
  misc_feature (29)..(29): n is a, c, g, or t
  misc_feature (483)..(483): n is a, c, g, or t
  misc_feature (499)..(499): n is a, c, g, or t
  misc_feature (556)..(556): n is a, c, g, or t
  misc_feature (562)..(562): n is a, c, g, or t
  misc_feature (571)..(571): n is a, c, g, or t
  misc_feature (579)..(579): n is a, c, g, or t
  misc_feature (619)..(619): n is a, c, g, or t
  misc_feature (728)..(728): n is a, c, g, or t
  misc_feature (769)..(769): n is a, c, g, or t
gccggtacgaccacccagtgcgaactcgnctatctgtactcctgcggttaccgggccggtcatctgcatggcagtgactgtccgaacgctttctgtttatataacaaacgcactatacgtggcgtcccggctccaccggacgacttgatgtcccactgtatagaataaacaactcgggaggtctttataaactatacgccatgccaccctgtcacctagtgttttctcaagcgcacttacgttaaacggggacgtacggcgcacgtggaattaatatctataccatgaccgtatttaatatttgcatcctaacaatacgacacgctattttctgggtgtagagatgggggcaagtacggatttatactaaacagcggaactctttacgcatctacactggggcgcccatttggcacctcaaacgatttaccgggacgcggtaaatgaggatttaacacgtgacttgtgaaaatggtttcttgngcagcgcgcctggtgntgcattttcaaccgtctcatgattgaccactttggttccaccggacagtaatgacangaaatnactgaattnccaattgntttactcaccacactgtttttctgcgatacgcttgggtanccgtggttggggaccgtggatggggacccgatcacgcttccaccactatacgacccgaccttgtttcgcgtcacggtatttttacgcctggcgtatattcgtgtattanatttatctgtcgcacacgtccacgtatgctatatatttatnttaaatcactctaaacttttag

SEQ ID NO: 660542 - DNA, 261 bp, Homo sapiens
agcaaacacaaaatataagtctctgatctagctgatgagaaaaataaagcaggtgagtgagattaagctattaccaaagggggtggcactcccatttacagtggggaggaaggaaagatctcaagaaaagggaaattgcggttagattaaatgaattggggccaggcatggtggctcatgcctgtaatcccagcaccttgggaggctgatgtgggaggactgcttgattctagcagttcgagaccagcgcggtaaaagctt

SEQ ID NO: 660543 - DNA, 644 bp, Homo sapiens
ccttctaagccacaagaacgttattggaggcatacgccacctgacttcaagctgtagtacaaggcactacagtaacaatacacagcatggtactggtaccaaaacagagatatagatcaatggaacagaacagagccctcagaaataataccacacatctacaaccatctgatctttgacaaacctaacaaaaacaagaaactggggaaaggattcccatttaactaaactggctgctgggaaaactggcctagccatatgtacaaagctgaaactggatcccttccttacaccttatacaaccaactcaattcaagactggacttaaagacttacatgttagacccaaaaccataaaaaccctagaagaaaacctaaggcaacgccattgaggacataagcaccaggcaaggacttcactgcactaacacaccaaaagcaatggcccaccacaaggacaaaattgacaaatgggatctaactaaactagagagctctgcacagcaaaagaaactacccactcaggagtgaacaggcaaccacagaatggcagaaaatttttgcaatccactcattcttgacaagggctactatccgaacctacaagaacgtagccaattttcaagaacaaacaacaaccccat

SEQ ID NO: 660544 - DNA, 567 bp, Homo sapiens
tcccccccccccctttttttttgccgttttgcaaaaccttttccaaaagggtgtaaaaaaaaaaaaaaaaaaaaaaaaaaaaaaacaaaacacaaaacaacaaatcatatttctaccacccccgcacgtacttgtgttttgttcccgcatgtgtgtccccccgcggcgcccccccccccgtggtgtgtgttcgcaccgccgtctattgtaccccagtgctgtctaattagataataaaacacacgagcgtcataataaaatttattattctatcattatgtggtagcgacctctgtatttgcgcgagggtgtgagcccaccagacatacacagagaaagaagcttctcgagcaccaaacatatgagtgtgacacacccaattcctataacacggcggtgtggcgaatatacatcatctatatatgagatatagaatgaatagcactatataaaagcactctcttactccaaaccaagagcggctaataaaaaatcaacccgcccccacgtactctccgcgcgatgagtatcacagatgttattatcatatcccccgcgaggtgggga

SEQ ID NO: 660545 - DNA, 576 bp, Homo sapiens
ggtgtttattgactgaaattgacgccattgggacaaaaagatatgactccaattctggtggtgagagagaaattcagcgcaacaatgttggacactgctgaaccagttggatggattctgattctagcgcgcgagatgtgacacagttatcatggccacaaaccgaactagaaactcttggatccagcacttatcagaccaggaccgcattgacaggacagcattgagtaccccctgaactgatgaaacagacgaacgaagcgcactctcccacactcacacaacgcagggatgacgccggcatgaatcactataaaccctgcacagaccctcactcattagcataacaccatgacccacgtcctaccataacattacaatacaaccgcaacccatcaaccacccacccaagacacatcaatccgcccccaccaccacaccctaccactccaccatccacacatcaaacaccactcaccacaacccaccacaccaacctcacctcccacaacccaccgcacccaccaccccacccccctcccccccacccaaccctacacacatacacccccaccc

SEQ ID NO: 660546 - DNA, 749 bp, Homo sapiens
gctctgatccggatctgcagttcctggagagccagcgtgggacaggtgagcctccatgtgacgtgacctggaggatgcacgaaaatgcagcttattcaggacgaagagcatctcaatcaataggtgggtatgctcgcagcggtttgctgggccgccttggaccaagaatcgtgccagtggcagtgtgagaggaatgagagctcgctgtgtcccttgttgaactccagatcgtgctaataggcctgggggaaagccagagggaggagtcaaagtgggccttgctaggaggcacgatgttagacgataccaaggtgcatgagggcatgccaggtaggaatgagcgtccgcgcaggccatcagggagctggagaaggagctacagaatgtggtcgtggcgtaactcagctcctggagggcaacgctgcaagccctgacaggcctgattaccatggtctttgcagcagcgggaatcagtcatccagggctccttgggccgtccctggaggccgagcaggtcagcatccggtacttgggtgaccaggatggaggtgagcttgctggctgtaaggaaggccaaggaggccatgaaagcccagatggcagagaaggaggccattctacagagcaaggagggcgagtgtcagcagctgcgggaggaggtggagcagggcagcaacgtggcagaagcccggcacagagagcttagggctctcgagagccagtgcagcagcagatccagctgaatttgg

SEQ ID NO: 660547 - DNA, 231 bp, Homo sapiens
  misc_feature (21)..(21): n is a, c, g, or t
  misc_feature (173)..(173): n is a, c, g, or t
  misc_feature (186)..(186): n is a, c, g, or t
cccctctgagcctcagattgnccttggcaaatgctgggcctggacgagccgccttagcagccgtcacacacccgtgtcaccgcgcacagactcagtcttactgaaccgatgggaggacgccgggcgaagaagcctatagaagcaaggttcgcagcccctttttaggttcccancacagtctctcgntctctaccacgatctagaagatcccctggagactatacacatcct

SEQ ID NO: 660548 - DNA, 348 bp, Homo sapiens
caaataaatatataataggaggggaggtgaagatcagtgctatgcagagaactaaaacaagttcaggagggctgagagtggtggttcacacctgtaatcccatcactttgggaggccaaggcaggtggattgcatgagctcaggagttcaagaccagactggccaacatggcaaaacccccgtctctgccaaaaaaaaatagaaaaaaaaaatagccaggcgcttgtagtcccagctagttgggaggctgaggcaggagaatcacttgaacctgggaggcagaggaagcaggtgagctgacattgtgccactgcaccccagcctgggtgacagagtgagacattctca

SEQ ID NO: 660549 - DNA, 412 bp, Homo sapiens
tgaattcccccgagtcaccctgttctcttatcatcacagtacttggcaccccatgaaatttcctggtttgtctattctccaccctcctgctggaatgtccgtcccgggagaataggagtcttgtcagatggattcattgctagcacagtgcctggcaggtagcaagtgtttactttgcaactccaggggaaagtgggattctcagacccatgaaatccaactaggatcagctcaagccctttccacatatacttaaaagcctcaaaccccaccacgcccccaggattttagcagaatctagagtggctcctgttctccagggcacctctgccctggagcagcttatctattgatccagacacgaatcttagcctgttcctcagctcccacaagaaagcccgtccttacagta

SEQ ID NO: 660550 - DNA, 432 bp, Homo sapiens
  misc_feature (82)..(82): n is a, c, g, or t
  misc_feature (136)..(136): n is a, c, g, or t
aatgtcccatcataaagacaaaggaaaactattgcctgtaatcccagcacttcaaagccccacggtgggaggatcctcgagncttaggagttcaagaccaacccgggcaacatagtgagacctcatctgtactaanattcaaaaaattagccaagcatggtagtgcacacctgtagtcccagctactccagggctgaggtgggaggatcacttgagcccaggaggtcgaggtggcagtgagccctcatcgcaccactgtactccagcccaggccacaagagcacgaccctgtctcaaaaaattataaaaattttaaaagccagacatggtggctttttatcccagcactttgggaggctgaggcaggcagatcacctgaggtcaggagtttgagactggcctggccaacatggcaaaaaccccatccctact

SEQ ID NO: 660551 - DNA, 246 bp, Homo sapiens
  misc_feature (136)..(136): n is a, c, g, or t
  misc_feature (236)..(236): n is a, c, g, or t
ccgtagttttagaagttcatagcacataatatatgcgtctgtttactaacggggtactatgtttaataatgtggggggtcactggtgatcttgacaacagcacaggactctgggtctttagtggctgaatccattnttttactgtagctccaggatctggcggttgccatttagttgttagaagtttcaatcagcaccgtagcgtcataaaaccccgaggcagcaatgccccaggncagcaagtgg

SEQ ID NO: 660552 - DNA, 381 bp, Homo sapiens
  misc_feature (251)..(251): n is a, c, g, or t
  misc_feature (257)..(257): n is a, c, g, or t
  misc_feature (282)..(282): n is a, c, g, or t
  misc_feature (337)..(337): n is a, c, g, or t
  misc_feature (366)..(366): n is a, c, g, or t
  misc_feature (381)..(381): n is a, c, g, or t
ttaactaattgtttaaaagtagcctcacaaattatatcaggctgtcctcgcattgctataaagaaatacccaaaactgagtaatttataaagaaagatttaattgtctcacagttctgcaggctttgcaggaagcatgatgctagcatctgcccagcttctgatgaagcctcagggagctttcagtcatgtcagaaggcaatatgggagcaggcatttcacatggcaaaagcaggagcaagcaacgttccngggttntggggaggggtgccacacacttttnaaatggaccagaactcatgagaactcagtatggcaaagaaaagcaccaagccatngagtcttggacccagacatctccccaccnggcccccaccttcan

SEQ ID NO: 660553 - DNA, 416 bp, Homo sapiens
cactttatatattcaatctcctccaacattagcataatttccaaggatgatgaggtggcagaggttgtatatgctcaggatgtccttatttgcttcagggacactgtgtcacgacgcgtgctgttttagacttatgcgggactactaacctgtcacagcagctatgacaccctacattcgttgatataccagggcagtgcttcattcattacactctagacgtgctgaaccgctgtcatgtccctatgtgtggccatacccactctgacagcatgaagccgatcatgacggagtctatgcgctcccctgtctactactacttcacctcagtacttgttgtgatcctacgctatctaagggctacgttctttccgcgtattgctaaggcggatgatcgatatctctattgcagaccg

SEQ ID NO: 660554 - DNA, 508 bp, Homo sapiens
  misc_feature (14)..(14): n is a, c, g, or t
  misc_feature (36)..(36): n is a, c, g, or t
  misc_feature (101)..(101): n is a, c, g, or t
  misc_feature (188)..(188): n is a, c, g, or t
  misc_feature (229)..(229): n is a, c, g, or t
  misc_feature (291)..(291): n is a, c, g, or t
  misc_feature (327)..(327): n is a, c, g, or t
aatggggaatttanggccccaagttgaaaaaaattncggggacccctgaggctcccttatggaaaatgaaaccctcctccccatttgttaacccctatcanattttgccactggccttatttatttatttgaccaaattctgcctgtttgtgacccagttcaccttagacccacagatgttaaattcnagttgctaaatgacagtgctattcagactcctttaaaaagnaggcccaggtgcagtggctcgcacctgtaatcccagcactttggaaggccaaggcaagaggntcacctgaggttaggagctcgagaccagactggccnacatggtgaaacaccatctctactaaaactacaaaaattagccagacatggtggtgtgtgcatgtagtcccagctagtcggaaggctgaggcaggagaatcacttcaatttgggaggcggaggctacagtgagtcgagatcgcgcaactgcacttcagcctgggtgacagagcaaggcatg

SEQ ID NO: 660555 - DNA, 81 bp, Homo sapiens
gccgaggacacggccgtatattactgtgcgaaagatccgaacggtgattatttaggggcctttgactgctggggccaggga

SEQ ID NO: 660556 - DNA, 386 bp, Homo sapiens
tttcagtaaaactttttttaaaaaaaaagggggtaggccaaatttgggttgcaacctgtaaaaatgtggtttaaattttatttaaaaactttttttggaaaaaaagggggaggattgttccctttacaggattatttttttttaaaaaacggggttttaaatttttggcggggaacttttttctgaaaaaaaaaaaattttggatgggatttggatttccgaaattagggagcccccgtcaggaaatgttgttttaacaggggtaattttgttggaacccttttaaattttgaaacaggtaaaatggtggggtttatttttaaaaatttttggagggttgggttgcctgtgaattttgggaaaaaaaaaaaagccttttgaaatta

SEQ ID NO: 660557 - DNA, 122 bp, Homo sapiens
  misc_feature (55)..(55): n is a, c, g, or t
cgaagatatcaagagagcttggccatccctgggccacttccattccactatctcntagagagactcccccaacttcctccatccattcattatgttaccctctgtgttccgggccactgtgc

SEQ ID NO: 660558 - DNA, 1251 bp, Homo sapiens
ttttgttttgtgccgtttgcgcattgtgtgtttgctttcgttgggtggtggctcgggttgttcgctttcgcgggtgtacgtggagtctttttgtgcctttggtcacatgattagttggtccatgtggtggtcgttgttatgtggtccgttcccttagtagtgggtataattgcgggatgggtcggtcgtgcggtgtgaagcgtgggcgtgggggggtggcagggcccaagtttagggtggtggcaggtctccgccgtcgtgtatctttgcggtgtgttcatggcggtggggtggcgccgcgcgtaggactggggtgccgcagtgaggggtgtgtgtaggtaggcgggagggccgcttccgtgtggggtcaggtccgtagcgaggtcccggttgatgccctgcttgtttatgggacttggaatgctctatgtttgcttttttggcatcttgccttgacagtctgagctggtggggtttgggttgcatagggtagctctagggttgtgcgtgggcagtaggccgggtagggtgtggtaaggggaggtgtggtgccgtttggctgcgtggaggaggagttgcgaggagtaagtaaagaagtgttgatagcaggtgagagtcacgcgtgtgggtgataatagcttagtttagagctgtcgcagttgttaggtctattaggctgtgtagcgtcatgcaagtgatctggtagagtatagggatagggcagggcggaatcatagttcaattgggaggccttgaagtgtaatcagtgtgtggtaaaatagtagagtgtgagcgcagagggcgcgtgcgcgcgttcgtagcgttggtgaggttgttgacgagttgcttcgtttgtctattctttcagtgggagtgacccgggttcggactggtggagtgattagtgagcttctggtgctggcacctcaggtgttattgtcgcgctaccctcgccagtgctgcaggccccagtgtgtgttcgtgttgtgtagttgtcagatacgctggtgaggtgtgattttgtcacagagagctgttattttcgcccttcctgtaagagcgatgtgactggcaacaagacgcactgcagtcgctttttcattaataaacttgtgaactatagacactgagacaggtcaaattttaattgtatcaatgggcaagatctggtgctgtttattaaaaaagacaaatcaattgagtaattttagattttacccggtatgtaaataattacgctctttggccgct

SEQ ID NO: 660559 - DNA, 131 bp, Homo sapiens
cgcgagaatcgcacggaggcagaccccccacaaggagcggctggcgccgcatggagacgatgcccactagcggcatgaggcgatcttggagagcttccacgtgaatctgcagaagagtgctggccgacgcc

SEQ ID NO: 660560 - DNA, 286 bp, Homo sapiens
tatatgtttctccctagcacaacagccatccccaggcatctcctctccgtgtgtgtatgcgtctagctctcttcgatggtccatgatgccagctgcaggttggtcagttccatgcaaccaacctggcgggctggcccccgattattctgccatttttccaggtctttgcgttgcacgtcaaatctggggctgatcaccccacactatgtttagcctgcctgtgaggttcacaacaattttcccagctactgtggtcatcaatgatttcaaattcgccaatgtaacc

SEQ ID NO: 660561 - DNA, 426 bp, Homo sapiens
  misc_feature (200)..(200): n is a, c, g, or t
  misc_feature (317)..(317): n is a, c, g, or t
  misc_feature (319)..(319): n is a, c, g, or t
  misc_feature (328)..(328): n is a, c, g, or t
  misc_feature (357)..(358): n is a, c, g, or t
  misc_feature (375)..(375): n is a, c, g, or t
  misc_feature (381)..(381): n is a, c, g, or t
  misc_feature (423)..(423): n is a, c, g, or t
cagcgtggataaaccttcaaaacagatgaaagatcacattctacatgatttcattcagatggaaatctatagaaataggaagtcgattagtggttgcttagggctggtaggggcatgggaggatgggggtgttagctaaatggtatgaggtttctttttgaggtcatgaaatgttctaaaattgactggtaatgtttgcntatatctctgaatatattaaaaaccattgaaatgtaaaaaatgcaaagaaaaaacagcccaagttgcaattttattcaacacttgattgctttaaaaatagattccaggctgggcangntggctcacncctgaaatcccagtgctttgggaggctgnngtgggaggattgcttgnggccangagttccaggccagccttggcaacatggcaagaccctgtctntac

SEQ ID NO: 660562 - DNA, 854 bp, Homo sapiens
ggttcctggggccttacccatatgcgggcgctgaagaagtggatctcactcaccaacttcatcagcgtaagccacacgtggcagaagctactagctcgcgagaatctgagcagatcttgtgcctatttactcgatggtgctacactgtgcatctcgcatgaagcacaccaaaggcacagcgctggggcacgaattctaccccggctgttggcattgtagtgtcaaaaggctaaccaaagagaggcactgagcgccggtcgtaaccaagagactgaaggcccaagatgccagggatcaagaggactcacgcgttcatcatgagactgtcccagcgacagtactgttcccatgaggggtgccagcgccaagcatgatgataagccaagcactatgctatggaaccttgaggctatggaccctgagacgcctggtgcatcaatctaagccagtatacccgcagacagggcccctcgacggatagtagctatggagtgaaactcgcgagttgtgcgttcttagttgatgcattctcgtagcttggggcaaatgctggtacggatgagcatttttgaagcgatatgcgaaggacggcgtctctggaagccttcgcatgtgctcggatcaagaagctaggcccatgagtgaaggtcaccaacagagcctcgtactatacaactctcatgctcctattccatggtaccgacgcagtctatgcgtgacgagtccccgagtgaacttccttgcgtaagaacataagtctacccaagtgacaagcttcactcagccaagacaccttgacacggttgcactctttcctcttgccctgcatagcatctgcacgtcggatagccgaa

SEQ ID NO: 660563 - DNA, 664 bp, Homo sapiens
tctcgggggcccggggggtttttttttgggaaacaaaaaccccggggggtttccccggggggccccccgggaaataaccggcgaggccccctagcgacccataacaccggggggagaaagctcaggcggcgaaaaaacccacgaggaggggccgcccctaccacaactcctgcaaccacaacacgccaccactagtgccctccgggggaccgcgcgtctcggcaaactctcacagagagaacgggatcacacccccagcgggggggggcccatacactacgggccccccctaaatgtggtcgcccggggagcccccagcagctcgcacgacgcggcccccaggggggggtgtttttgtgtccccccggtggtgcccaggtgtctcgtctccccaccgctttttgcgcagcggggtgttcttagatctccgcggcggaaacttatctccttggtcgcctagtctctttcacatctaaagggcgcggtctgattgcggccagcgcgtccacaatctcggcggggggaccacagtttgactcctcgcatgagggacaccccacaacacagtgacgagagaagggttttctagtcccccccaagagagagaaccctatatggccccccacttttggcgggcggcactttttgcgcgctagaaaatcag

SEQ ID NO: 660564 - DNA, 167 bp, Homo sapiens
ctaaggaagtagtgcgcacagaggcgaatcttgtctggctccacacgtccagactgtgaaagagatgttctatatattccactgtctcgacattagaagcctatggttggtgatggtaggtgacaatctctccccaacttcagtttgtacaggattgtggtcttgcc

SEQ ID NO: 660565 - DNA, 394 bp, Homo sapiens
cacgagggacacagtcatattagtacagatgagaaaagagtgaaagaacgaataaatgacttgactgaagttcattcaagcgttcatgaatatattctgtagctccctgggacgtattaatagatcaaggccaggcatggtggttcacgcctataatcccagcactttgggaggccgaggtgggctaatcatgaggtcaggagatcaagaccatcctgaacaacatggtgaaagcccgtctctactaaatataaaaaattagccgggcatggtggcccactacttgggaggctgaagcaggggaatcccttgaacctgggaggtggagattgaagcgagccaagattgcaccactgcactccagcctggcgacaagagtgaaactcttatctcc

SEQ ID NO: 660566 - DNA, 355 bp, Homo sapiens
gtcgacatccagaatatataaagaattcttactcctcaatgagatgacctacaacccaatttaaaaatggtctaaaggaaagcagtttgttgattgctgaaagaacttaaaacagaattaccattcaaaccagcaatcccattattgggcatatagccaaaggaatgtaaattgtactaccataaagacacatgcacatgtatgttcatcacaacactagtcacaatagcaaagacatggaatcaacctaaatgcccatcaatggtagactggataaagaaaatgtagcacatatgcaccatgggatactatgcagccatcatgctcggccaatctcattcttttttatggctgg

SEQ ID NO: 660567 - DNA, 394 bp, Homo sapiens
cttgagcggcaactacaagttctatgacgaattttgatattttgaaacgcctgaatagattggaaaaagaagtttttggtaaacaaattttagataactcagatttctaagtagttatttgagatgtgcaatttttggataatcgcgtgaggagagttgcttctcatgaggaaagtccatgctagcacaggctgtgatgcctgtagtgtttgtgctaggcgaaaccataagcctagggacgagaaatcgttacggcagttgaaatggctaagttcttggataggccagagtaggcttgaaagtgccacagtgacggagtctttctggaaacggagagagtggaacgcggtaaacccctcaagctagcaacccaaattttggtgggtaccgagct

SEQ ID NO: 660568 - DNA, 349 bp, Homo sapiens
  misc_feature (37)..(37): n is a, c, g, or t
  misc_feature (89)..(89): n is a, c, g, or t
  misc_feature (133)..(133): n is a, c, g, or t
  misc_feature (150)..(150): n is a, c, g, or t
  misc_feature (159)..(159): n is a, c, g, or t
  misc_feature (162)..(163): n is a, c, g, or t
  misc_feature (165)..(165): n is a, c, g, or t
  misc_feature (178)..(178): n is a, c, g, or t
  misc_feature (219)..(219): n is a, c, g, or t
  misc_feature (222)..(222): n is a, c, g, or t
  misc_feature (247)..(247): n is a, c, g, or t
  misc_feature (257)..(259): n is a, c, g, or t
  misc_feature (305)..(305): n is a, c, g, or t
  misc_feature (308)..(309): n is a, c, g, or t
  misc_feature (326)..(326): n is a, c, g, or t
aaacattgtgtcagcttcaaagcattgtgcatatggnagacattattgctattgttaatactgtaatagaattgcctctgcggattaanaatgtagatgtttatgtacaacatagcagcaataagtaaaagangaaattatttatatggnttctattanatnncncgggagtactgtnttcagtactttgtgtaatgcagattgctactcatgccattnaantctctgacattgtcttaccatttgntcatgcttgnnngacctgtgtccacttagtctgatttcactggtaaaataaattaggnaanncacaaaaacaaaacggnacagtgaacagatgtaacggttg

SEQ ID NO: 660569 - DNA, 243 bp, Homo sapiens
  misc_feature (31)..(31): n is a, c, g, or t
  misc_feature (48)..(48): n is a, c, g, or t
  misc_feature (134)..(134): n is a, c, g, or t
  misc_feature (180)..(180): n is a, c, g, or t
  misc_feature (198)..(198): n is a, c, g, or t
  misc_feature (228)..(229): n is a, c, g, or t
ctggccaggcgtcagtgcacttacgcctgtnatctcagcactttgggnggccaaggcaggcagatcacgaggtcaggagttcgagaccatcctggccaacatggtgaaccccgtctctactaaaaatataaaanttagctgggtgtggtggcaggagcctgtaatcccagctacacaggnggctgaggcacgagaatnactttaactcaggcgatggaggtttcagtnngccaaggtcacacc

SEQ ID NO: 660570 - DNA, 322 bp, Homo sapiens
  misc_feature (253)..(253): n is a, c, g, or t
tgagccggtacagtatgacatgaggagttcagagacaactttgaatcctgttcagcggagaccagcaccagaggaatctacaaggaaactcccatatatttgcttcccccaagatagcggcccctagagactcaaaggtctttttcttcgttttgtggtttctctaaaaatttactgtgctttgtcgatgctagtataagccagggagttcgtaagacgccagcgtctttgaggatttgctcagttccccggntagtttcctcacatatattattactatatacctcgctgataaattttatgttgtgtgtttctcatgtca

SEQ ID NO: 660571 - DNA, 1010 bp, Homo sapiens
ttcaattttagcaataggtggaaactgcagtactttacagaggtgcctcatttgagacagagcttgtttttacagcatcataaacttcatctttcatttttgaagcttttgcaaataggaataggcagatctaaggagtaaatgtaacttccacaaaatgaattgaaatagatttttttctgttttttcttctttgcatgaaatgcctgttttgaaaaggactacatggaggtaactttttaatcacaccttgttttaaaacccctagcttagttaacatgtcatttgataagaggtgttgcttacgatctagaactagaaagttttcatttattttgaaatgatgaagtgtagtgattgccacagcatttagaagaacatttattgaagtgtatgtatatatatatgcacatcatatgtgctcaataaatttttatgtgtgtaaccagcacccagatcaaaagacagaatacgtcaaacagactcatccgtgctcccttctaggtactacatgagccgcgagacgcgtgacaccatgtgccgggggtaagcgaggggtacaagagtaccactgtgaaacacgcatagcgatcaggaaaaaagcactggaagaggaagcaacgaaaataatacagatagaacacacaaaaccacactgatataataataacgagcaacacacaaaaaggacaatcatcatactaatgcaacacgatgcaataaacgctgaaacgaacgaacaacagactgggcccaaggatcaggaaacgacaaacagatgggatgaaaaactagcaacacgggaggatgaactcagacacgatagtggaattcgacacgatagagaaaggcacacagcgtcgagaaggaacacatcacaatcacatggacagacatgaaaaaacagcgagggaagacatcaggcacccagctaaagagaagaaatacagacaacgaggaagcgggaagaacacaatgtgataacacggtcacaaaagacgtgaggacgg

SEQ ID NO: 660572 - DNA, 467 bp, Homo sapiens
gtttgtttctttgttcagcctggctgacagagtaagaccctatctcaaaaaacaaaaagcagaaagaacaaagaagtaaacaaaagcttaaaagtaaatcagccaggtgcagtagctcatgcctgtaatcccagtactttgggaggcctaggcaggcagattactgcaggtcaagagtttgagaccagcctggccaacatgatgaaaccctgtctctactaaaactacaaaaattagccaggcatggtggtgcgcacctgtagtcccagctactccggaggctgagacaagagaatcgcttgaacctaggaagtggaggttgcagtggcagtgagccaagatagcgccactgcactccagcctgggcaacagagcaagactccatatatggagatcccttgagatcaggagttcgagaccagcctggccaacacggcaaaaccctgcctctacaaaaaaaaaataat

SEQ ID NO: 660573 - DNA, 1117 bp, Homo sapiens
  misc_feature (432)..(432): n is a, c, g, or t
  misc_feature (734)..(734): n is a, c, g, or t
  misc_feature (881)..(881): n is a, c, g, or t
  misc_feature (915)..(915): n is a, c, g, or t
  misc_feature (990)..(990): n is a, c, g, or t
  misc_feature (993)..(993): n is a, c, g, or t
  misc_feature (997)..(997): n is a, c, g, or t
  misc_feature (1071)..(1071): n is a, c, g, or t
  misc_feature (1077)..(1077): n is a, c, g, or t
gatgcgacagcggtgtactgcgctcgtggctgctgccgggaaccagatgcgctgcagtatgtgagggtgggcggttgcctggatccgctaccgtgcagtgtgtcacgagatgctggcccagacagccagagcactgagaccgtatacgccaatgaagtggcgtaaccttgtgctccccgtggcacacaggaaatgggctccactgaagtcagacactcgacccgtagtacagaggaagctctgcaagagtgggcagagaagtctctcgcctccagagacacgaaactctgtcaccgtgttcgacttctcacatgcgagtatcattgaactatgtgtctcatatagactggtacggaagagtccaactcagatgaaaacggcatgtagtgtgtgcgatgggtccacccgggtataggaacgtcgattcccagnaagtatcggagggtcgcgagggtaggcttgtgctagtgtctgtatagtttacctacctaagttgccctccggtcgtactaaccaacggaaattaaggcacgaggacgttccgaatgccgacttctcgttgcgggtgcttctcttctcgtcgtaggagtcccaggaaacagcaacttcagagtgtcacagcgactatctcgtagtcttatcacacatagcactgtggacgcgacgggagatacaccgctaggcgtccgcacactgatttattcgtccctacatgttcctcccacttagacagnagagccaaaaaggtctgctaggttcgtttgtgcctcgctcatgttggtcgatggaaagagacctggagaacgtccgaagcgcgtttgattggtatgcaccctatctaggtctgctccgtcgtatgctcgtgtagaggagaccccgangccaccgctttgtacctataaggggcgcacctgngggcacagtcagtgtgcattgtaatttggcttcaccttggcccacccttgtgacttcgtacccggagtagctgtngantccncaagcctcttgtgcgtctgggatgcgacctcgctctgtggcccgttcctattttcggtggcccgtctccgaatngcgtcntagcttgggtttccgaaaccgccgtgaccttcattggggg

SEQ ID NO: 660574 - DNA, 125 bp, Homo sapiens
gaaattgcggtccgggtggccgtccttctcattcattctaatcatcgtatgttgcttcactactggggggagaaggaaacgttgagcctcatgtttcccctttcccggcaggagtgagagggctc

SEQ ID NO: 660575 - DNA, 1060 bp, Homo sapiens
  misc_feature (418)..(418): n is a, c, g, or t
  misc_feature (499)..(499): n is a, c, g, or t
  misc_feature (503)..(503): n is a, c, g, or t
  misc_feature (522)..(522): n is a, c, g, or t
  misc_feature (524)..(524): n is a, c, g, or t
  misc_feature (529)..(529): n is a, c, g, or t
  misc_feature (534)..(534): n is a, c, g, or t
  misc_feature (577)..(579): n is a, c, g, or t
  misc_feature (587)..(587): n is a, c, g, or t
  misc_feature (610)..(610): n is a, c, g, or t
aaagtcctagagccagaaatatattctctcatccctcttagcattctcttgctccctcattcactagggcaaatgtctaaatgaagaaaagtctctctcaacacctcgttcatgcaatcagcattagaattgtaaggaaggaaggggggtggcatgaaaatttccattcttggggtatatgactgtcctgtttcccccaggccactttttttttttttttcctttggagaacaggggtcttggctctggcccaggcagggagtacagtatgtggcaatcacagctggactggcagccttgacctccagggctcaagggatcctccggcctcagtctcccaactaaggggggactacgggcaggtgccaccatactcagctttttttggtttggttttagacaagagtctcgcttggtnggcccaggtgggtctggaatcctggggctcaaggcaatttcttccacctcagcctcccaaagtgctggagattactgggtnttgnagccattggacccaccctncnagatnacttnaaatggtctcggctcggactggaatggagggaatggtaatgtnnncagtggcnggaatatatcagtatatctgganctcggatctttaattccctaattttgggggttccttacttaatttaataacagtctggtctatatttaagggttcctggggagtagtttggtctatatttaatccatagatgtgcctcctagtcatcagtcttatttcagtaaaaccattcttttctggccaaatctctaacacgtttttaacttcagtagtgagggcaatgaagaagatttattaggaaagatccttattaaagggctaattggggtattgaaagcatgctgatataaagtccagtattggaggatataaaggagggtgtgccctgaactgtgctgaattgttccagcatttattatactctaaggggcataaggggttttgtggaccttttttggaaccacaaatggtgaagggggtgaataacggattgacacagaacttgaatttaaaatcctcttgaattggaaa

SEQ ID NO: 660576 - DNA, 125 bp, Homo sapiens
aaggaatatatgacatctattcgcttgcattggtgacttggagagactgtctgttcaggccactgaataaacaaggtaaccaaatgcttgtttaaaggctgattgaaagggaagggattgtggaa

SEQ ID NO: 660577 - DNA, 890 bp, Homo sapiens
  misc_feature (37)..(37): n is a, c, g, or t
  misc_feature (80)..(80): n is a, c, g, or t
  misc_feature (148)..(148): n is a, c, g, or t
  misc_feature (156)..(156): n is a, c, g, or t
  misc_feature (160)..(160): n is a, c, g, or t
  misc_feature (165)..(165): n is a, c, g, or t
  misc_feature (167)..(167): n is a, c, g, or t
  misc_feature (169)..(169): n is a, c, g, or t
  misc_feature (172)..(172): n is a, c, g, or t
  misc_feature (175)..(175): n is a, c, g, or t
  misc_feature (177)..(178): n is a, c, g, or t
  misc_feature (180)..(180): n is a, c, g, or t
  misc_feature (192)..(192): n is a, c, g, or t
  misc_feature (202)..(202): n is a, c, g, or t
  misc_feature (219)..(219): n is a, c, g, or t
  misc_feature (225)..(226): n is a, c, g, or t
  misc_feature (239)..(239): n is a, c, g, or t
  misc_feature (249)..(249): n is a, c, g, or t
  misc_feature (255)..(255): n is a, c, g, or t
  misc_feature (259)..(259): n is a, c, g, or t
  misc_feature (268)..(268): n is a, c, g, or t
  misc_feature (277)..(277): n is a, c, g, or t
  misc_feature (298)..(298): n is a, c, g, or t
  misc_feature (300)..(300): n is a, c, g, or t
  misc_feature (308)..(309): n is a, c, g, or t
  misc_feature (316)..(316): n is a, c, g, or t
  misc_feature (345)..(346): n is a, c, g, or t
  misc_feature (348)..(348): n is a, c, g, or t
  misc_feature (352)..(352): n is a, c, g, or t
  misc_feature (358)..(359): n is a, c, g, or t
  misc_feature (362)..(362): n is a, c, g, or t
  misc_feature (364)..(364): n is a, c, g, or t
  misc_feature (368)..(368): n is a, c, g, or t
  misc_feature (371)..(371): n is a, c, g, or t
  misc_feature (430)..(430): n is a, c, g, or t
  misc_feature (472)..(472): n is a, c, g, or t
  misc_feature (475)..(475): n is a, c, g, or t
  misc_feature (477)..(477): n is a, c, g, or t
  misc_feature (481)..(481): n is a, c, g, or t
  misc_feature (486)..(486): n is a, c, g, or t
  misc_feature (492)..(492): n is a, c, g, or t
  misc_feature (496)..(496): n is a, c, g, or t
  misc_feature (499)..(499): n is a, c, g, or t
  misc_feature (511)..(511): n is a, c, g, or t
  misc_feature (515)..(515): n is a, c, g, or t
  misc_feature (528)..(528): n is a, c, g, or t
  misc_feature (540)..(540): n is a, c, g, or t
  misc_feature (562)..(562): n is a, c, g, or t
  misc_feature (566)..(566): n is a, c, g, or t
  misc_feature (583)..(583): n is a, c, g, or t
  misc_feature (587)..(587): n is a, c, g, or t
  misc_feature (613)..(613): n is a, c, g, or t
  misc_feature (802)..(802): n is a, c, g, or t
  misc_feature (872)..(872): n is a, c, g, or t
tcagagctatgtagtaaatataaataaaccacaatanacaacatccaatcctgctgtcaagagtagagagggaatggggnttgatacccttagtttattgttttcaacacaaggacaggagagggaaaaaaacactagacaccagccnggggagcnaggnggggntngnggnctngnngntgctgtgggggntcatgggganactatacaagggcacangttttnnaactatgatctcntaacctaatngttttnttcnatgcgagtngcatcctcntcgccctgggggggggggatntnatcaggtnntgctgcnttgggttcctctgctgccacttcatcttnntnaatncctagnnctngnttgnttntgcgatagatgcggttggtgtgggtctggggttttttaagggaaaagccagaagatagnaggggggtttcaaacagcagcaccaccaggtccttaactgcnttntntttnttgtnggcctntgtnttntgccgctgcgtntccncaatggggtggtnagggttgatctncaggtgttttttggttttcatntagnccatggtggtagttgtnccgnagtgcctgggctttcatgattcgctncatattggctgttcagttgtagtgttggttataatgcagcaaggtgaagacacaagtctattggagattgtcaccttctcaaccttcttatctaagatttctttcatgagcttgcagaggttctcaaactttgccttgctctcttccatcttcttcttctcctcctccatcctcaggcagctccagacnctcctttggtaactgagaccaggctcttcccatcaaattccttgagctgctgcacacagtactcgtcaangggctcggtcatatatac

SEQ ID NO: 660578 - DNA, 195 bp, Homo sapiens
catgctggtcctacaaatgctggtctatgtagatctatgtctttgggtaggggggggggggggcggctatttagttccatgggtgtatttcttttttctggccccattttctggctttttttttttttttttttttttttttttttttttttttttttttttggggttatgtgggtgtcatgtgacggagggggg

SEQ ID NO: 660579 - DNA, 894 bp, Homo sapiens
  misc_feature (894)..(894): n is a, c, g, or t
ccgcgcgcgagtcagactcgggtgggggtcctgccgcctttgccgcccgtgctgcccggggccgagggcggcggtggaccgcgggttgggagacctggcctggctgcccaaggacaaatgtgagcaactttcgacccctacctgtgccttggatgctgctgcctgtcaatgtgcggatgcgctgagcttggagcactcgcgttatgccagggacgccctgaatctggcacagatgcaggagcagacgctgcagttggagcaacagtccaagctcaaagagtatgaggccgccgtggagcagctcaagagcgagcagatccgggctgcagggctgaggagaggcggaatgaccctgagcgaggagacccggtagcaccaggccagggcccagtatcaaggacaagctggcccggcagcggctacggaaggacccagttgagccgacgcgcgaaattctcctcaagtgcagggcgaatcagcgggaagcaggaggagtccgtgcagaaagcgaggaagccatgcggcgagccaaccgtggagcgggagatggagctggggtaccaaggaatgagatgctgcgagtggaggcctgaggcccgtgggcgcgcgcccaggccgagcgggagaatgcagacatcatccgcgagcagatccgctgaaggctggcgagccccgtcagagcgtctgggagtccatcaggacggcttggaccttgttgggcgacggatccgggcctttgtgaccgactgggacaaagtgactggcccggtggctgggttgaggctgctggctggagggtctactcagcaaaatggcacgcttgtgccggcggttatcgaggacggctggggaaaccgctattgaggggactccgctcacgcgctaagacctcgn

SEQ ID NO: 660580 - DNA, 196 bp, Homo sapiens
tcgggtgactctagacggactcccgtactacttgtagtatcccgtgagtacctgtgtactaagtggtgtagttacacacaaaagtgtgtaaatatgtaacctgttacacactatcattcgctcaatccaaccccgtcctatacaatatcacctcctccccttctcttcatcttatttgatcttaacctcaattcaa

SEQ ID NO: 660581 - DNA, 294 bp, Homo sapiens
acggatgttgagatgacccttcttcatggagtataaaatgtttttcccaaaaaattgagagaaaggactacagagcccggaattattaccaatacaagggcaatgcttttaggtcaaaatgaaggtgacttaaacaccttaaagtttactttaaaagttgtaggtgattaaaataatttgaaggcgatcttttaaaaagagataaaaccgaaggtgattaaaagaccttgaaatccatgacgcagggagaattgcctcatttaatgcctacttgacgcatttactaaacgcaga

SEQ ID NO: 660582 - DNA, 831 bp, Homo sapiens
  misc_feature (487)..(487): n is a, c, g, or t
  misc_feature (490)..(490): n is a, c, g, or t
  misc_feature (494)..(494): n is a, c, g, or t
  misc_feature (518)..(518): n is a, c, g, or t
  misc_feature (532)..(532): n is a, c, g, or t
  misc_feature (536)..(536): n is a, c, g, or t
  misc_feature (541)..(541): n is a, c, g, or t
ggctttcttagccttctgctccgaggaccgcgcaggtttctgagcccagtgcccggcgggctaccaacccagagtgtccagggtaatgtcatcaataatatggaacaaggcagtagaacccatctcagcacacgccttgcagcggcccgtctccaccctccctctggcaagaccaggagctccttggccaactttaggtcctgaggatgaatcccgcctgccaggcctgcaaaggagaccccaagagcacggagaggagatcacgcgtcttctgtcttcccaaggatgaacttgcggtaaaagagctgggcttccaacggctgctaagatgcagggccgtttttggggaggcggtcctctgatcccacgaacgcttctgcaatccgatgccagtggcgaaggtacaagacagaagaggggatctcaataggtattatggccccgatcaaagtgggctccggaagctagaaggcgcggaacccagcgnccngtancagacgcgcggggcaactgggcanggcgcacgggggtncacngggcngacgccattctggggcgcacggcttggactctgctcatcaccggcctctccatcgccctcgactccgccgcagcctggaccgtcctcgcgtcttcccgacacccacgatggtttacaacacacatgcacgtcgctgaaggatgtctgggcaatcccgcctcccgctcggcgtccttggcgacgctctgcaccagacctgccccgaggtcacgcagaaaagacaaagggcatccggccgcacgcagccaggcagaaatatccactagtcagcatccgggaggaactccaag

SEQ ID NO: 660583 - DNA, 436 bp, Homo sapiens
catacgggggggcatacggtgcggcatgcagtgtgtgtggtaagtccaggacaatcgaaaatggtaaggacagaaaggattcaaacagaagcacaccttgaagtagattttaaacagctggttcaccagaaacagcatgccccacttcttagaggcctctataccagcacggctatggggaaataattttttttaagttacataggaaataaaaattttatttataaatcacaaaataaactgcctaaacaaattaatatcttgaggtaagtcccaaagctcaagtcatattcatatcaacttattcatatcaagtcatattcatcaaacaaaataacattatgaaaaaagatgtcttacctgatgggtaaaaataaaagagaaaacaaaccaggaaaatcccaattaactacttgaggaacatccttcccccgca

SEQ ID NO: 660584 - DNA, 582 bp, Homo sapiens
  misc_feature (438)..(438): n is a, c, g, or t
  misc_feature (489)..(489): n is a, c, g, or t
  misc_feature (560)..(560): n is a, c, g, or t
ctctaaaaggatattttgaggattaaagaaataatgccttactaagtgaacagcatcctggcacatttaataagttctcattaaatgttaactgataagatgatgataattttgtattatagcatattagtatttggtaggattatatttcaaaatgcttttagttattcttacatattgagtttctggatttaactttagatttttttttcattctctcaaaaactatttatataggattataagttaatttgggggaaaactgacaataatacttaatgttcccatacagaaacttggtatttcttaccatttatacaagttttccttttgtttttgcaagatttactgatgtttcccttttaaatgtcctgtatgtggttttggtaaaactattttttaggtattttttgttaatatgtatagaaatttttttgntattattttttagcgagttgttgctggtagttacatatttttaacacctgntggctattttatttggtctaaattattcataaattctcagatatttgggtgtttttgctcttttctaactncttgcttatgcattatctcctt

SEQ ID NO: 660585 - DNA, 278 bp, Homo sapiens
aaaaaagagaagaaaaaagagaaacccgtggcactatgtaaataaagtatgcatactttgtttgttagtaaatagatgatgcatgcctgggaaatgctcccttgggcataaatagcaatcaattataattagtaaacaggtttaccaataaaaatgaatttacatgataggttaacaaggaccaggaaagttgagtttccttgaaggagttctttgttcctgaatcacagaaatttgatacctgttagcattcactggcaccatattttaaggagaaa

SEQ ID NO: 660586 - DNA, 418 bp, Homo sapiens
aatgatgtgggcaaaatgaaatacttttcaagttgaaaaaatgagcattttagccacggaccagacaagggagttattagctttcattttcttctgagttacatctactttgtgtctgtgatcatggaattgcccaatggatacttgaaactaatgtgctaagggactctaaaattataggctaggctgcattaaaaacaactcttagtgctttaaaaattgcatgtcatccacattcctcatgaaaatgaacattgaaatgttcttataaaagtacatctggtaacatgcactcacgtatgcctaaattaggtttaaagtcacttgaattttccctgtttttaacaaaagttttggggcttcatgcttttggtttattggtgtacaatttgcattacatgcctacaaaactaaattt

SEQ ID NO: 660587 - DNA, 107 bp, Homo sapiens
taccatctacaacctgaagtgttgatatcacagaggaactctgcattctcgcttcctggagggtgtcgcaatgttgccattgtcgaacacctgctggatgaccagcc

SEQ ID NO: 660588 - DNA, 505 bp, Homo sapiens
acttggaaacaaagcagcacacttctcaataatccatggagcaaaaaataaattaatcagagtgaaaataaaaatacaacatatcaaaatttgtgggacacagctaaaggagtattgagagggaaacaaatagcagtaaatgcttatatcagaaaaagggaaagatacactaagatcagaaacaaggcaaggatagctgctctcatcactcttattcaatgtagtatagtactagaaattctagccagtataataaggcaagaaaaagaaatgatgggcacttgaattggaaaagacaaaataaagccctcccaatttgcaggtggcatgattgtctatgtagaaaatcccaaagaatctacaataaaacttctagagttaataattgagtttagtaaggttgcaagacacaatgtcaacccacaaaaatcaactacattttcaaatactgtgaacacatcaaaaccaaaattcaaaacacaataccatttacagttgctacaaa

SEQ ID NO: 660589 - DNA, 695 bp, Homo sapiens
  misc_feature (306)..(307): n is a, c, g, or t
gatcaggtttgaaacgaagcaggtcaaaactcccgtgctgatcagtagtgggatcgcgcctgtgaatagccactgcactccagcctgggctcaagctgtccacttgcttcagccttccaaagtgctgggattacaggcgtgaaccactgtgcccagccaacttaaaataattaacctaatgatgcatcttaaagaactagaaaagcaagagcaaagcaaacacaaaagtagtagaagaaaagaagtaataaagatcactgcagaagaaacaaaagatcaatgaaatgaaaagttagtttttttaannataaagcaaacatttatgcagactatgaaaaagaacacctcagaaattcgaagcatcctttgtggctactatgagcaactttgtaggccaataaattggaaaatctagaggaaatggatccattcctaggcacatacaactacaaagattgaaccattaagaaatcaaaaactgaacagaccagtaaaaagtaatggacataaaagccgtaataaaacatgtgccagcaaagaaaagcctgcgccctagtggcttcactgctgaattctactggaacatttaaagaagtaataccaatcctactgaaatcatttcgacaacatagatgaggaggtaatacttccaaactcattccatgaggttacccaataccaaaacaaacagatac

SEQ ID NO: 660590 - DNA, 234 bp, Homo sapiens
actcgagctcgagtaccctcgatgaaggggccaagggggcgcaggttataggtggatttaaagattttttgatttctgattggttaaggaagtgaagctttatctaaaaatttgggatccgcagaagagaatgtgagttctggctcatgggtgtgacctcctccaggcccctgtagaaatgtgcaatggtcagattagtcctgagcttccccttatctgaagtccatgtgccag

SEQ ID NO: 660591 - DNA, 630 bp, Homo sapiens
cacgcctgtaatcctagcactttgggaggctgaggcgggcagatcacctgaggtcaggaggtgcgaaaccagccttaccaacatggcaaaacccatctctattaaaaatacaaaaattagccgggtgtggtggcacgtgcctgtaatcccagctactcgggaggctgaggcaggagaatcacttgaaccctggaggtggtggttgcaatgagccgagattgcgccattgcactctagcctgggtgacagagcgagactccgtctcaaaaaaaaaaaaaatcgcatcccgtctaaagcaagctacaaaacggtgattatttatgtcacgatatgacccagccataaattgtacttcaggtaagaagggaccctgacatgatatcttacggatcaaattgcagtcagtaggtatatatgaccttttttctctgtgaagaaaagctattaataagttggacttaataggcctatagtatgcccatactggccaagaattctaaatggatcatccagcggtccgtgtaccgtggaggtgcttattctcatttctccaaagccttaagatcgctgggaatagaggaaatgttgctgccaccagctttgcgggccacattcagagagaataggtgt

SEQ ID NO: 660592 - DNA, 161 bp, Homo sapiens
ctcgagaggcgtcaatccagaggcctccaatcagaggctggttcctctctgggtcatctctcggtcttctctctgggtcgtctgtgtctcctctcggggtcatctctcttggtcctctctgggtcgtctctctgtctcctctcgggggggtaccgagctcg

SEQ ID NO: 660593 - DNA, 836 bp, Homo sapiens
  misc_feature (50)..(50): n is a, c, g, or t
  misc_feature (300)..(300): n is a, c, g, or t
  misc_feature (313)..(313): n is a, c, g, or t
  misc_feature (324)..(324): n is a, c, g, or t
  misc_feature (327)..(327): n is a, c, g, or t
  misc_feature (333)..(333): n is a, c, g, or t
  misc_feature (335)..(335): n is a, c, g, or t
  misc_feature (345)..(345): n is a, c, g, or t
  misc_feature (352)..(352): n is a, c, g, or t
  misc_feature (354)..(354): n is a, c, g, or t
  misc_feature (365)..(365): n is a, c, g, or t
  misc_feature (370)..(370): n is a, c, g, or t
  misc_feature (378)..(379): n is a, c, g, or t
  misc_feature (383)..(383): n is a, c, g, or t
  misc_feature (386)..(387): n is a, c, g, or t
  misc_feature (395)..(395): n is a, c, g, or t
  misc_feature (412)..(412): n is a, c, g, or t
  misc_feature (417)..(417): n is a, c, g, or t
  misc_feature (423)..(424): n is a, c, g, or t
  misc_feature (428)..(428): n is a, c, g, or t
  misc_feature (436)..(436): n is a, c, g, or t
  misc_feature (457)..(457): n is a, c, g, or t
  misc_feature (467)..(467): n is a, c, g, or t
  misc_feature (485)..(485): n is a, c, g, or t
  misc_feature (490)..(491): n is a, c, g, or t
  misc_feature (516)..(517): n is a, c, g, or t
  misc_feature (534)..(534): n is a, c, g, or t
agcggagagggactaccggccaccgcggcgccgccgccgcgagctgtccntgcggcgcgtctgccttggcggagccgaccgcagtgcgctcaggcgtccggtgcgtccccagcctccgccccggcgcgggggcgacggactcgcgcgtgcgcagcgccggagtgggcgcgggctgggaccccctagccagcgcgtgcgccgatcgagcgcagggcgatgggtgggcgccgggcgccgggcgccaggcagtgatgggccttcccgcgctgcggccccactgaggaggaggctcggggacangcaggagcacggngcttgcccgcngcnggtgcngnaccatggcgntcctggncngggccgcgccntgctngacttggnnccanctnngccgccgnacctgcagttcaataangttcngtgctnnaccngggtaccnggcccgccagcagcggctcgnggctgcctgngcagcctcttctacctgnacaanngaacttgggcaacatctacacgcanngggctggccctgctggngcttcctggtgcttggtgccaatgaccatgccctggtggtcagctgggcaaggatggctggctgggaggcacacattgcgtggcctgccttgcaccccctgcaggctccgtgctctatcacctctttatgtgccaccaaggtgggcatgcgctgtgtacgcccgggctcctcgccctggacatgtgtgggtgtctgccttgtcaacacccttggggccctgcccatcatccactgcaccctggcctgcatgcctggctgcgccggtgcctggtgggctacctgtgttgtcggttttgccgga

SEQ ID NO: 660594 - DNA, 146 bp, Homo sapiens
tccgtcccgccgaggcacatactcgcggcgttatggacattcggaggtcagtatggacgaagttgttgcaggtccgagtggacgaagttgttgccaacttcgtccattgtgaccttaagtaagtgtctggtcactcggcgtgtgca

SEQ ID NO: 660595 - DNA, 248 bp, Homo sapiens
tctgtatatctctattaaagtcagatagcatcattatcataatctgccaagaatcacccaggcagttattctgggcaaagtcctttcttcccagggtcttaaaaaagtttgggataggccaggcacggtcactcacacctgtaatcccagcactttgggaggccgaggcgggtggatcgcctgaggtcaggagttcaggaccggcctggccaacatggtgaaaacctgtctctagtaaaaatccaaaa

SEQ ID NO: 660596 - DNA, 450 bp, Homo sapiens
  misc_feature (411)..(411): n is a, c, g, or t
  misc_feature (418)..(418): n is a, c, g, or t
  misc_feature (425)..(425): n is a, c, g, or t
  misc_feature (431)..(431): n is a, c, g, or t
  misc_feature (434)..(434): n is a, c, g, or t
acaacatatttgtatttaatgcaaattactttttgctcatttgcaaaattcattttaacagcctcttgatcatgttggtgtgcataccaccctaaactctttcccagacttcatgaaattcaaatcggtccatttgtggatagctgtagtcaaagccaaaaggctttccctgaaaagattacttggaaagaaagttatagcttcaagccagaacataagtttgcggctttctttacttctccatatcatacggagggtgtctgacgctgatgtttatcaagcaccccatgaatgttagccttcacagtagtcccctcagaagggcattcattgatttcattgtggctgctgctgggtaacagaactccattttaaatccccaggctgggtacgtggctcacacttgtaatnccgcacnttggggnccagcnggnaatcgcttgaacctgg

SEQ ID NO: 660597 - DNA, 426 bp, Homo sapiens
  misc_feature (50)..(50): n is a, c, g, or t
  misc_feature (300)..(300): n is a, c, g, or t
  misc_feature (425)..(425): n is a, c, g, or t
agcggagagggactaccggccaccgcggcgccgccgccgcgagctgtccntgcggcgcgtctgccttggcggagccgaccgcagtgcgctcaggcgtccggtgcgtccccagcctccgccccggcgcgggggcgacggactcgcgcgtgcgcagcgccggagtgggcgcgggctgggaccccctagccagcgcgtgcgccgatcgagcgcagggcgatgggtgggcgccgggcgccgggcgccaggcagtgatgggccttcccgcgctgcggccccactgaggaggaggctcggggacangcaggagaaagggatgaaagagaggtgaggaaaatggagttaatggaagggaagagaatgatggaatgggaaagatagaagaagaaaatgaagttaaataagttagtgatgaaagggtaaagaang

SEQ ID NO: 660598 - DNA, 115 bp, Homo sapiens
tgctttcacctgccccgcctatgcggtgactgagcactgcaacctgcctcagagccatgcctagctggtgcgaactggtgctagtgggctggaagtgtgaacttcagcctgttcc

SEQ ID NO: 660599 - DNA, 145 bp, Homo sapiens
cgggtggatcacaaggtcaggagtttgagaccagcctgggcaatatattagtagaaggaaagaaataataaagatcagagcagaaatgaatgaatttgagactaaaaaaaattacaaaagatcaccctgaaactattgctattga

SEQ ID NO: 660600 - DNA, 86 bp, Homo sapiens
cgccggtcttgatcttgatctgtctcatgcgaggatcggccatggtccctcgagcgccgcgagaaggttgggcggagagccggggt

SEQ ID NO: 660601 - DNA, 114 bp, Homo sapiens
cggcggaccgtatacacaggtatgtgcagaagctccttagtttattagatcccatttgtcacatttggctttagtgccattgctttggtgttctagtgatgaggtctcgcccat

SEQ ID NO: 660602 - DNA, 140 bp, Homo sapiens
gaccaggggcaggcagtctatagctgtgtctccatacacaggtctggggaaactaaatctagaaactattctctcttaagtttcgtgaaactacctgaacaaagcttaggagcccttagttaggctctggggatcctcta

SEQ ID NO: 660603 - DNA, 863 bp, Homo sapiens
atataacgcgtaggaaccgcaggacttttcatcccctgtggtcccactggtcctcaactgcgccccggaggacggacagacccgctcggacgctcgtttggccctaaccctgccgccatggcttcacctggacgacccatctgcgcgcagatcatatggtaaagtgaaccagtggacgacacagatccctagcactttatcctttaatatgtcagacaaggtatcccattcaagatacggaactccctaaagctgaagaatgtgatacaagttactttgaactgcccacgaaattcaagatatgaacaactcagggagaagaaaatggctttccagagtagcactggagatcctcttccagagatcagcaaggacaactcctgcaaagaaaactgtacttgtacctcctgcttgctccgggctcccaccataagtgacttgctcaatgatcaggacttactagcacgtgatcaggcataaagctggatccgtgtcagccaacggtgaccgactggcggaactattgcgagcaaatggcgggatgtcctatgacgaattgtgcttcctggagtaagaggccacagatgccccaccttggaagttctatgactccggaacagtcagaggacggtgggccacgctgagtggagctctgaaggctctaccaccagggccgacgtggaagacggttatgcgcacggtggcgtggacgaggagtggccaagcgggagcgtgacgaagaccatccaggcacttctagaagcctcaatcttacttcactttacttggcctctcggcaatgtgaaacaacccagggtcacagaagggaatgtgactcagtagcacataagagttaggacaag

SEQ ID NO: 660604 - DNA, 422 bp, Homo sapiens
tacgatctctgatctatacgaacccttgagctgtcagagactttatttttgccttctactcgcgctgaaatcgaaaccaaaccaggccatcggcctccacaagtcactatatgttggatgatgatactgttgccttattgggaactgtgagacttatctggtatgggaagccagtaataaacctttgacctgtatcaaccaatgaagattatgaatatgttactatgatgtaaattgctatttaagtgtaacgcagttctaagttttcagtatatgggggattggtttttattatttctttcctaaaagaacaaatactgagggatcttttgataaagttagtaatgcatgtaagattttagtttagcaagcatgttgtatttcaaatatatcaagtatagaaaaaggtaaaacagttaaga

SEQ ID NO: 660605 - DNA, 1019 bp, Homo sapiens
ggtggagcctcctgggtgggcactggtacactgagcccccttggacaagtcagcaggggagtgtataaggccactgtcccggcctgtgcttctggggacagtggttgttccccagcaagtcctgagggcggaggggtggggtatggcgtacgggtctcctcgaggtgtcaggaggcgtgctcgtgacggaccaccggagggggctcctggcctggtccttgatgctggccgcgtagtgcgtagaggggctcagcgtgggtgctttaaactagatggtgttccatcctgctggggcctcggtgggccgtcctttccgtcatcgcttgcatgtgaatcccttccgcctctccctcggttgatcttctttccctgacctattgagtcatcctgtcttgtctccatggggtcccgtagctctgtgcggacctctcgcgcgcgctatgtggagcgtgaaggccagtgggaacgttaggagcagcgtcagaggcgtagtctcgacgctccgacagcatagatcagttgccatgctctagccgagtctaccaggtttgcttgtggccccggcggccctccggcgtctaggtgatagccaatatgatgctcgctcgccgcgcggcttcctagcgcgctgcagtgcagggaactctggcctccgggaggtggacctcgtggcccttcgtgtgccccccactcactcgcccccctgtcggcctccccggctacgtgtctagaggcctcgacagcttcctgctagtctgcgtgatccggggcgtggcagtgaacccgcgggcgattgtccaggtcaagtcccggtctgccgctaatggtccgtctgcccctccctgtcctgggcctgccactttggtcaaagtcccgcgccatttgccttttcgcgccccttgcggcatcaaaggcgcgcccagcccgcggtcgccaaccccacgtgttgcccccggtaggatctcccacgcccctggccctgacacccgggcattcgccctcccccccgcgccgcccca

SEQ ID NO: 660606 - DNA, 237 bp, Homo sapiens
ccgcacatacgcccactggccgagaggatctgttgagcacattgcagctcttattattggtgtatgtatgtatatttaaggttggacataaagactcagaagcaaagatattacactcttattagaaaaaaatacaaaaaaaaagccaaagcatgatgcgtcttgtcagccttttgtggtctctacaccatgtgctgtgctgtgaccgccctgcccgcagagctgcgggaggatgga

SEQ ID NO: 660607 - DNA, 1016 bp, Homo sapiens
ggagagagagaactagtctcgagttattttatattattttttttggggaacatctgttttaattagaggcaccaaaaaaaaaggagggctccaatgtgggggtgggctggaggcagaaatggactaggattgggggcagggcctaaaccgcggaattggcagaaacccacaaccccaaaaggtctagcccttgaaagtgctatgcagcatgtgaccagagaacagggggtctaacggggaactgagagatctaacaggctgctgagacaacactgccactccaccaaaaaagtggaccccccagaaaaccatcacaggatggctactcaggttggcacgtgaaacacaccagcagtacaacgagaccaggaacaaaacttacgcataattgaacagcggtactcaccgtgaggagaacccgtgatagaagacatgtacacagtggagaacatatgagacacacgatagaagtgattaggaaacccgtataaaagaaacatcacgaggggataaaaccaccttgcgaaatcaccattatgcgcagaaaggattcacccccaaaagggaaagagagtctcacacattacattcaacagcccccacaaaaaagtatgacagagataacacgtattaggtgacccccaccaccattgagggggcacagaaaggaacagagggaacaaatgagagaaacaacagagggtgtagaaaaagggtattgacaagagaagaattagtagagacacaaagaagaaaagaaaagagacaccaaacaggaagaacaacaaacaaacacacacaagccacacacagtaaaccgaggacgcccaaggagaggaggaacacaaaaaaacacagagaggagagaagaaacacaagccaaaaacaagagggcacaacgagaacaagccaacacaaaacaatgaaaagacgagaagaaggaaaacaacacaagaaagacaaacaacaaacaaaaaagatgggaaaaaggaaaagagaaggagaacggcatagac

SEQ ID NO: 660608 - DNA, 223 bp, Homo sapiens
agtgagaagaaggaatacagcgtggcgccaaatgtgagctttaagtgcaagtgggaacgcggtgcagttcattgaaaaaaaatcagttcagccgggcgcggtggccatgtgatttctttgacaattacaaaaagcagaaagacaaacaaaaaaaaaaacgcaaggcaatggcagggaaaggacagttggagaagagcggcaagcctccagcggctccttctcg

SEQ ID NO: 660609 - DNA, 6792 bp, Homo sapiens
ctccagtccgcatgctcagtagctgctgccggccgggctgcggggcggcgtccgctgcgcgcctacgggctgcggtggcggccgccgcggcacccggcagggcccgccagtccccgcttccctgctccagagccgccgcctgggccggggcagggcgggcccggggctcctccatgctgccagccgccgggctgcggagccgaccaagtggctcctgcgatggcggcggaagaggaggctgcggcgggaggtaaagtgttgagagaggagaaccagtgcattgctcctgtggtttccagccgcgtgagtccagggacaagaccaacagctatggggtctttcagctcacacatgacagagtttccacgaaaacgcaaaggaagtgattcagacccatcccaagtggaagatggtgaacaccaagttaaaatgaaggccttcagagaagctcatagccaaactgaaaagcggaggagagataaaatgaataacctgattgaagaactgtctgcaatgatccctcagtgcaaccccatggcgcgtaaactggacaaacttacagttttaagaatggctgttcaacacttgagatctttaaaaggcttgacaaattcttatgtgggaagtaattatagaccatcatttcttcaggataatgagctcagacatttaatccttaagactgcagaaggcttcttatttgtggttggatgtgaaagaggaaaaattctcttcgtttctaagtcagtctccaaaatacttaattatgatcaggctagtttgactggacaaagcttatttgacttcttacatccaaaagatgttgccaaagtaaaggaacaactttcttcttttgatatttcaccaagagaaaagctaatagatgccaaaactggtttgcaagttcacagtaatctccacgctggaaggacacgtgtgtattctggctcaagacgatcttttttctgtcggataaagagttgtaaaatctctgtcaaagaagagcatggatgcttacccaactcaaagaagaaagagcacagaaaattctatactatccattgcactggttacttgagaagctggcctccaaatattgttggaatggaagaagaaaggaacagtaagaaagacaacagtaattttacctgccttgtggccattggaagattacagccatatattgttccacagaacagtggagagattaatgtgaaaccaactgaatttataacccggtttgcagtgaatggaaaatttgtctatgtagatcaaagggcaacagcgattttaggatatctgcctcaggaacttttgggaacttcttgttatgaatattttcatcaagatgaccacaataatttgactgacaagcacaaagcagttctacagagtaaggagaaaatacttacagattcctacaaattcagagcaaaagatggctcttttgtaactttaaaaagccaatggtttagtttcacaaatccttggacaaaagaactggaatatattgtatctgtcaacactttagttttgggacatagtgagcctggagaagcatcatttttaccttgtagctctcaatcatcagaagaatcctctagacagtcctgtatgagtgtacctggaatgtctactggaacagtacttggtgctggtagtattggaacagatattgcaaatgaaattctggatttacagaggttacagtcttcttcataccttgatgattcgagtccaacaggtttaatgaaagatactcatactgtaaactgcaggagtatgtcaaataaggagttgtttccaccaagtccttctgaaatgggggagctagaggctaccaggcaaaaccagagtactgttgctgtccacagccatgagccactcctcagtgatggtgcacagttggatttcgatgccctatgtgacaatgatgacacagccatggctgcatttatgaattacttagaagcagaggggggcctgggagaccctggggacttcagtgacatccagtggaccctctagcctttgatttttaactccaaaaatgagaaacattttaaagcattatttacgaaaaaactgtctcaactattcttaagtactgtattgatattgtttgtatcttttattaatgttctaccactttttatagatttgcatcttcctgtcacagggatgtggggaaatacgttttcctcccaagagaaccaagtttattatagactcctttattcagtgaaatggcttataatccactagttgccatatttttgctaaaatatttctaaccaagaatactacttacatattgttttggctttgttttatttttgatgcagttttttttagttgaggtaatgtaatatattgatgttttcctttgtgtctaagattgatttataatagtaggtttgtataatttggaacattttccatgccttgcgaatttccttaattgaggatagggcttacacactttaagaaaacagtgagtacttgaacatttaaagggacagtgcaatttatagtcataatcacattgaatactgtatttgatctttggagacttaggcaagcacagagctgggatatttatgctcagttgagcactttaagatgaattttaagtgagatgatttcttgcttaaaactcagaaagtcaaaagagtttcagctttccttacagaaaaggaaggatcttgggccctagatcttggggattaacctctgcatataagatttactcttaataggccagacgtggtgctcacgcctgtaatcccagtactttgggaggctgagacgggcagatcacttgaggtcaggagttcaagaccagcctggccaatatggtgaaaccccgtttctactaaaaatacaaaaaaaattacccaggcactcactcttgaggtaactaaccaactcccacgataatgacagtccattcatgagcgcaaaggcctcatgacctaatggcacacacctgtaatcccaactgcttgggaggctgaggcgagaggattgcttgaacctgggaggcagaggttgcagtgagccgagatcgcaccactgcactccagtctgggcaacagagtgagacttcatctcaaaaaaagtaaaaaaaaagatttaatataatcactgaagatctctattatagatagattaggtttttgacattggaaacatacttagggatagatttgtcctaaaggaaaaaagtaggcccgggcagattaaatgtcttgtgtaaagtcacacattaaattcagtcacacattaaattcatagagttttaaatgtttaatgtatataaaccagtttctttatacacatttgggaaaacattggtctcacagattaaatgattaactaactgacccaggaactagttgtagctttctaagtaattaggcaattacagttattgcctgtaaccaaaggtaataaaacaaaatgacaagtacatgtttaaaattatgaggcaatgagaaataatttaaaaaccaattttctagttataatttaaaatttggagagcatttttaacagtaattaatccagaggtggctcaaattgagtataagaattaagattatttaaaatactgcatgtctaccttctcggggatcatactttataacactttctgcttcagtagctcttcatagcttgccaagtatgctcccatattttctctctcgtgcctcgcaaatgaaagtcagataggctgggaactcatggggcagccctcagacttcaatgtgggcttcaaatccagtttcctgttctatatggtgctacatctttccagaaaatttccctcagagcccctcgccaaaacaaagcattattttgaccctgcatgctatttctttagctgtaggtgatagattagaacttctgtcagacatgttaatgacaaacataccaacagacaataaccaaagcaaatgtttccttcaagtgtgaaatgtgcaggggctcgtgggcaaggatgtattggcacactgtcctcttgaactgatagtgtcccagcaatgttggaggttggcaccattcctggtccgacacttgaggacctgagagacatcaggtttagaatgagccaaagaaatcctacaagatggggagaattggtgtgcagcagcctaagtgttatagttaagtctaaagaagtatgaaagatcccctgtgttctctaaattgagcagaggggcctgcctaccaatatcactttttaggggactgaaccattgcaggttagacttggcttccaaagagtctgcctaagccaggggtggcagggtaggccatcatagctggatggcctcaaaagcagatgggggcagacttgccctcgtgatgccaggatttgagaggcagagtttctagagggagaccagtgctgcctctcacagtggcagttttttctctttgcaagaggaggggctgttcaattccatagaccagtgggcagatagccagttgaatactctgtgcatggtttgatcctttattagttcgctctaatatttttctgtagatccttttgtcctggactcaaaatctaatccatgcattgtatgataccgtagctctcctaaggtttgtgtttccttcaaaatgttttagttttcttcaactaaatttgatttttgctgttagaagtgacatatttttatggtatacactatgttccttttttctactgcgagtcaattttttgaattttcgtgagaaagaatatatctacaaattgcacgaaagtatcataaaaacagtactctagagcagcgctgtccaatagaaatataatctgagccacatgtataattttattttcttctagccacattaaagaagtaaaaagatacaagtagaactaattttaatgttttaattcagtatatccaaaatatcatttgaacatgtaattaatataaaattattaatgtgatattttacattcttttggtaatactagtcttcaaaatctggtatgtatcttacattgatagcacatctcactttgtactagccacattgcaagtgctcagtagccacatgtggctagtggctactgcactggacagcacagttctaggttccaccctaacacccaagtcctgtggattagaatcccagaatcagagctggaagtaaacatagagatcaaacctccttttaaaaatgaggacgctgaggcacagagtttaaatggcttgcatgaggtcatacagctaaattcagcctcaacagggtcttctgattccaggcactcttcccactccactacattactgtagtggtaattcttagggttaaaaaaagtgtagagtaggccgggcgcagtggctcatgcctgtaatcccagcactttgggaggccgaagtgggcggatcacgaggtcaggagatcgagaccatcctggccaacatggtgaaaccccgtctctactgaaaatacaaagcaaaattagccaggtgtggtggcgggcgcctgtggtcccagctgctctggaggctgaggcagaatggcgtgaacccaggaggcagagatggcagtgagccaagatcgcgccactgcaccccagcctgggcgacagagcgagactccatctcaaaaaaaaaaaaaaaaaaaaaagaaaagaaaagaaaagtctagagaacattatattaagtggttattattgaagtagaccaaagtttataccataaggatatttttccttaaataccatgtttgaagaacaattatttattgatccttgaatctgtaagatcaaataacaagtctctatccatgttaccaaatttaaccttttgaaaataataaactttaaaatatcagatgtgttattacaggatgatacttggaatcaagtgaaatgagttatatggtcatcactaaatttagaaatctattgtgaaacaaagacaaacaggaaagtacagaatagagacttttagtaaataaatggaatttaaaagaaagtgtttatttacagtgtcacgacagaaaaggatgtctttgttgtcatagtctttgagggatctccgtaaaatctggggcacaggtacaagaaatagccaatatttagttcccagaccatgtttagtagtgtccagtttcagatcatgctgccaagaggtatctccccctcaggtgggtcatcactgagccctggaattggagactcatacttgcccagcacaatgttacgggcagacaggccgacatctatgattagctagaagccataaagaaaagctgctaagtggccactaggtgccacttttctgtttttgtaatgctttcattagcagatcttttttttccaagctccatggggcctatgagaggcatttatgatttttgtgcctacaataagtcagcctgtctggtgtgagttgttttatgagaaatgctttccaagggaggtctaggaagatcctgacacataagaactttggcttagagagctttccaggtgtagtgccaataaaaactgacctggaaagaaaacctgcccagcacggaacatgctttctgaactcacttgagagtgtatggtgtatgtcacttctcatatattcttgagtttagatttgtcttttatacaatttttagctcttttccagttcacttgtgctcgtctgtatattggtatttttaaatttttgtggtaaataatgaaaagagtgaaattatattttataattactcatttgtagtttttttttttaatttaataaacttcctccaaaaagtgctcccttaaaa

SEQ ID NO: 660610 - DNA, 767 bp, Homo sapiens
agcggaccggccgcggtaccctagccgtgcaaaggtgaccataatcacttgttcctaaacttagggacctgtatgactggctccactgagggttcgggctgtctcttactccttgaccggtgacaattgtcctgcccgtggagaggcgggcgtaactacagcgagacgacgaagaccctagtggagctgctaattgtataaagtgcaagagcagtagctaacaggatccacgatgtcctaaacgtaccaaagctgcgattaaacaatttcgcgtaggggcgatcttcggagcagaacccagagctccgaggcagtgcacatgctaaggagcttcacctaggtcaaagcgaacgtagctatacgtcatatggcatccaattaaccttgacgcaacaggacacaagattacacctagggactaacgagcgcaactccgtatatctatagtccagtatacaatcaactacgggtggactgaccatcgattggttggatcatggacagtccacaagtggtgcatgccacgcgtattgaaaggttcagtatgattcacacgagttacaagtcctacgatgatcgtggagttcgagaccgggagtaactccagggtcgcgtggcatatcgtaccttgcagaatgccgtccgctgtacggagtaggacacggagaagataagtgcctgacttcacgatgagcgccgttgcctgcgtagaatgcatatcgatctcaaccttagtcattagtacccaggaccagcgcaataaacag

SEQ ID NO: 660611 - DNA, 345 bp, Homo sapiens
gatcacgtgcatgtggtatatactatatgatatattatcatgtgactctaattagaaaatgtatccaaagcaaacagcagatatacaaattaaagaaaagaaaaagacattaacagaaaggcaattatacattgagaatccaatccaatacatttaaacatttgggaaatgagggggacaaatggaagccagatcaaatttgtgtaaaactattcagtatgtttcccttgcttcatgtctgagaaggctctcccttcaatggggatgacaaactccaaatgccacacaaatgttaacagaatactagattcacaatggcacgtggatccacaatggcacgtggat

SEQ ID NO: 660612 - DNA, 123 bp, Homo sapiens
tgagtctcatggctgggagaaggcgagggctcccgcttgcatcatgactgagatcccttccgacagtccgcgctatatgtgagggccgtgctcagctcttgtaaggctgaaggtgagaatcat

SEQ ID NO: 660613 - DNA, 204 bp, Homo sapiens
agggtaggcttgagcagcaaggccgtgtagatccagcaaatctctcttcaggtcctctgtgctcttgttactggtagagctatctgtgcttctggggccctacggcataaggactttaagttatgtagtcaagtcctcagtctcactttacaactacctgcttaccaggttgaagaccccactaaagtaagactaacccacctg

SEQ ID NO: 660614 - DNA, 1388 bp, Homo sapiens
  misc_feature (846)..(846): n is a, c, g, or t
ggtgggtgcgcggaggtgaagcggaacgggttcctcgggcggtgactgaatgcagtgcgggacggggaggacgggaagatctatgccggtgttggcactgcgtcctactctgttacctgaccatgatgaccgctgagagacccctgcttttcttctcgagggctccgttgacctcgtactagtgtcccgggctgtgtggtgcttatcccggcgtgggtcgcagtggagtgtgctcgtggcgtggcgtgttagggtctgcgctttcgccctctggcgtctgctatgaggacagccattgagccaccgtggtctgttggacagtgcctggtagcatcagctggagattgtagttggcgtcgctacgaagagcgttccacgaaaggatagggaacgaaacgctctggaggtcggagcgtcgttgtcgtgcttgtgcacaaaactcgtgcatggcggccatgggatcctcccaagccgagatcgagcgtgtcctttgctggggcatccccgggtacaattctcggaaggttacaattcttgaacttttctagacttcaccaaaaatcgagctcttggaaggggacgcgatcgttgcattctgaaggcatgcgttgcgaggacatccatgctaggcactatttcagccaggagcttaaaaaagcgcatggtgggggcgcaacggtacccgcacgagttcaacttgaagttaatagggatgcttcctatggtgtttccataggagcttttgcaggctgcagtgaaccaacaagctacaaggagggcacacaagagggggcaccatcaaggatatgatgacaaacacctttgtttcccccacccaattgcatncgattctacggacccggccttcacaggtagcagaaatcggacaacgcgcaaatcgacaggcggtgaccctgcgcggcaagtgggggctctgggcagggggcgaccacaaacaataaccatcaacgaactttttgtaaatcccatagcgcgtcctgaagcaattgcccgtggaattgctatgatgcccatggtgtttctcccattgtctgtcacaagagaaaggggtcctgttccaaggcgtaggcctttaggttacacctttgattggccctgggagggcattcgcccgaaaggcactttgcgggaaggagggtgctgggaagtccccgtatgggacacgtgttgatggcgcaactgctccagcatgtgtgtgccttcggaacgcattaagctttggtgagacccacccattcttgtggtgttgggcctcagaggagcgaaggacatttgaaacagcaaaggaggtcttccgcctatggagggcctcagaggcgccttcacaaagaccgggagaaagcacgaggagagaagcgccttaaccg

SEQ ID NO: 660615 - DNA, 237 bp, Homo sapiens
aggtttgtagaatcaattggcagaagctcagctctgtgaaatagctcccgtgatttttcttgggaccctacttagttccgtgggcttcccattgggagctgattaatttctgacaatcagaacccatcgctaacacatcagatgatagtggctttgacctagggaagaagaagttgagcgaataacccccagcaggtatggtttgagagtctttagttgagggttaatttgggcgga

SEQ ID NO: 660616 - DNA, 398 bp, Homo sapiens
  misc_feature (114)..(114): n is a, c, g, or t
  misc_feature (117)..(117): n is a, c, g, or t
ttcagctgccgccaggcgaccagggcgtagtcctccacctgctcctcgcggcgcgagcagtcggcttggcgcaccttgcggctataggcgtaggcgaacaccggctcgacgccngangacacgttgccggccagcagcgaggtagtgccggtgggggcgatggaggtgaggcagccgttgcgcaggccatgggcctcgatcaggctgcgggtttcgtcgtccaggcccttgaggttcggcgcatcgaggatggtcttgtcatagagcgggaaggtccccttctcggcggcgagatgggccgaggcgcgataggccgcgcgcttcatggtctccagccaggactccatcagcgccacggcttcatccgaaccgtagcgcgcgccgcagaacacgagggc

SEQ ID NO: 660617 - DNA, 652 bp, Homo sapiens
  misc_feature (33)..(33): n is a, c, g, or t
  misc_feature (35)..(35): n is a, c, g, or t
  misc_feature (42)..(42): n is a, c, g, or t
  misc_feature (46)..(46): n is a, c, g, or t
  misc_feature (49)..(49): n is a, c, g, or t
  misc_feature (51)..(51): n is a, c, g, or t
  misc_feature (60)..(60): n is a, c, g, or t
  misc_feature (81)..(81): n is a, c, g, or t
  misc_feature (83)..(83): n is a, c, g, or t
  misc_feature (85)..(85): n is a, c, g, or t
  misc_feature (91)..(91): n is a, c, g, or t
  misc_feature (119)..(119): n is a, c, g, or t
  misc_feature (130)..(130): n is a, c, g, or t
  misc_feature (135)..(135): n is a, c, g, or t
  misc_feature (139)..(139): n is a, c, g, or t
  misc_feature (145)..(145): n is a, c, g, or t
  misc_feature (151)..(151): n is a, c, g, or t
  misc_feature (158)..(158): n is a, c, g, or t
  misc_feature (173)..(173): n is a, c, g, or t
  misc_feature (186)..(186): n is a, c, g, or t
  misc_feature (188)..(188): n is a, c, g, or t
  misc_feature (214)..(214): n is a, c, g, or t
  misc_feature (233)..(233): n is a, c, g, or t
  misc_feature (239)..(239): n is a, c, g, or t
  misc_feature (255)..(255): n is a, c, g, or t
  misc_feature (305)..(305): n is a, c, g, or t
  misc_feature (308)..(308): n is a, c, g, or t
  misc_feature (341)..(341): n is a, c, g, or t
  misc_feature (346)..(346): n is a, c, g, or t
  misc_feature (395)..(395): n is a, c, g, or t
  misc_feature (404)..(404): n is a, c, g, or t
  misc_feature (408)..(408): n is a, c, g, or t
  misc_feature (424)..(424): n is a, c, g, or t
  misc_feature (426)..(426): n is a, c, g, or t
  misc_feature (428)..(428): n is a, c, g, or t
  misc_feature (477)..(477): n is a, c, g, or t
  misc_feature (491)..(491): n is a, c, g, or t
  misc_feature (498)..(498): n is a, c, g, or t
  misc_feature (553)..(553): n is a, c, g, or t
  misc_feature (580)..(580): n is a, c, g, or t
  misc_feature (649)..(649): n is a, c, g, or t
tgaggggtgtacattttattggaaaccttaaanantgttcanaaanaananatcttcaancaaggctcttgtgcagcctanananaaaaangaagcttttgggttaggggcaaggaganaaaaagtacanagganaaanaccccncacgangaatgcncttcagccagcttancagcttttgccanancttcttcaatgggtcccaccaaaaanaaggcctgttctgggaganggtcanattcacctgccaaaanctgctggaatcctttgatggtctccttcaggggtaccagcttccccaaanganctgtgaagacctcagcaacctggaatggctganaaaanaaacgctgtattttccgtgcacgggacaaggtcaacttgtcttcctcanaaagttcanccanacccaggatggcaatnanancctggagggacttgtagtcctgcaggatcttttgcaccccacgggcaanaacgtaatgctcantgccaanaatgttgggatccatgaaacgagagggggagtctagaggatccacagctggatanatgcccagctcagcaatggcacgcganaattcagtggtagcatccaaatgggcaaacgtagtagcaggggcagggtcagttaagttatcagcaggnaca

SEQ ID NO: 660618 - DNA, 294 bp, Homo sapiens
cgcttttctatatctactaggagtaactcccctattttagcaataagataggtaatagctctctttgcatttagatcttcaagagcctgttcttcagtagctatatatacttctttctttactctttagctatttgcctgtcttctatttcttatatagtacttcagtaaatgctttattcatcaacaatcagaatcatcagaaagcactgtaaccagccccaggcagccagcagaagcagctatcagaagagtgtagatatagacgagtgcctgtcgatatagaagagtgcag

SEQ ID NO: 660619 - DNA, 110 bp, Homo sapiens
catactggaccttctgtctgcctgcatggtccagccagcccaatacctcacctcctccaggaagcctctggagagcactccagaggcttcctggagaaggtccaggtatg

SEQ ID NO: 660620 - DNA, 237 bp, Homo sapiens
  misc_feature (63)..(63): n is a, c, g, or t
  misc_feature (71)..(71): n is a, c, g, or t
  misc_feature (99)..(100): n is a, c, g, or t
aggaccagctccacagatgtactatgatcaactttcactttcagaaatgtgtatcagcataanctttgttnagatacttgagaaatcagatgtatctgnngcggtaaggatcccggttagacatcatgttcagtgtgagggcaataacccgatttggaacatgagcgtcattccgaggaaacgcttttttttgcccgatagtagtttgtcaaaagttaaaatcttgttggggagctt

SEQ ID NO: 660621 - DNA, 339 bp, Homo sapiens
gtcgactgggagaatggtaggaggaacacagggttagatcaggccaagtttattgatacgggctcactaagcagagattccgcatttagaaagggctctaattggttggttggctgtttggctgaaacatgggccaaaacatggccaccatgggataactggacatgcctggccgcccatggttagtgtagaagaagggattcaaaggcttagggagattggaatgctagagtggatttgtctgccccatgctgctttcgttcccctgctagagtggatttgtcctccctattctcctcttcctcctcctctgcagccctccactaccctcctcctaca

SEQ ID NO: 660622 - DNA, 311 bp, Homo sapiens
aaacattttcccccctttcaagggaaatattttaatttttttttctctttcccaaaatttaggaaagtttaggggaattgggttttgccaacagttcccccccctaagttttgaaattcaaaatttgaaaaaaacccggcatttttggtcatttaaaatttgtttacaaaagggcaaattatttaaagcaaagactttaaaagccttaaaaaaaactaatggggggaaaccccaaaagcgatgggaaaaaattttagggttgaacccggagggggatttttattttaaaaaacttttgggttcccgattga

SEQ ID NO: 660623 - DNA, 1767 bp, Homo sapiens
  misc_feature (192)..(192): n is a, c, g, or t
  misc_feature (224)..(224): n is a, c, g, or t
  misc_feature (335)..(335): n is a, c, g, or t
  misc_feature (665)..(665): n is a, c, g, or t
  misc_feature (771)..(771): n is a, c, g, or t
tgtgctcttcctcgggtcgcccgttttactgtttattggccgctttattttggtgcctgctttccccccccgttgtgtgtagggggtccccgccgctggtggtgtgtgtgcgaccttgcttgttctggagcgtgggggcggtgcccgccaccacgacggcggtagtatgtgtcggtgccagcacacgatagngcgtcttttgtgtgtgcgatcttagagttgcngtctcgcgatgcccgcccgtgttgtgccacaccgcagctggagcacgctcctgtctggggggggggacctaccaaccgggatgcacccgtcctttagcagtgagtgtgtcngccagccaaagctgcgggagaaaattttctctgctgctgtgaaaggggggagcggggggtcatataacgtacctttcctgccccgcgtggttgaggagacgcgacacgacggggggtgtgctcgccccgacacggccgccctctcgttgtgctaagcacccgacggcgccgcgagtttgttttgctgctcgcttgtgtgacggcacgcagcgtcgtgtgtgttgcgcagcgcgctctggttgtgcgatgcttgctcgtgtggtggggcagcgcgcggccgtgttgtgcggccacggagtatgtgaaggttgttggggcggacgaacgganccgcactctcccttattgttgggttccaagctgtagcatactgctgtgtggcgcccgcgacccgcgtttgcctccccttgatgtgtgttgttcgctgtcttgggcngcccacagtcggcgactaataaccttccggccgggaggatggttcaccagccatgtgcgtccacgagctgtcccccccctcttccttattgtggggtaggattttttctatccgctccttcttgcgccgcgacctgttgttccgccgccactgtgttgagagagagttgtgccagccccgccgtgttgtgcgacgacccgccgcccccgtcgttgattagcgttgatcgagccaccccagccagtggtgtgccccaaagtgatgtccggcgcccctcctcgtcagcggcgcttttatatcctgttgttcttgtcgtggtccgcccgtctggtgcgtgttcgttccccccgtcgtaggatgtgtggaggcacaccttgtgtggagcccgcccccttatggtgttgtgctgtcagcccccagcggagctcgcctctctcttatggtgcgcgcagcaccccccacgcacccacactttatataccccccctatgggccacacacccccgccttataacacacaccccgttccgcacacacactccacatgcgcccgcagcatatgaatatatgttcccctatatgtcgcgcctatacaccacactttttctcgcaatctcgcgtccgctatacaccacactctataggagaggcgctccccttggcgcgctatattatactatatccacatccctcacatctctatcgcacaatataatcccccactctcctccacataatatatcccacaccacaccacacaagcacatataatattttctgcgccacctaagcccacatcacctttatttgagctcctagccccacgaacctcctcacttttaaccctgaatccgcgagggaccacacccacgtaagctacccttttacccaccccattggaccacgtagcactccgtactatacttcccccaccatcctaatcctaatacccactatctccctaattggaacaccaaatactccaatgggcctata

SEQ ID NO: 660624 - DNA, 1320 bp, Homo sapiens
atatattcaatgtcagtttgcacagacctccaataacacagcaacaggcacacaaaggcaaatcatacaccccacttcaccatgtgccacagcatactcacagaatgtgcagtttgtattgcatgctgtcaaccagcatgtcaatccatcacaacaacatcaatactcaacacagcattagtaggtctacttatatcaagttatatagcagattccatcggtcaacaatgccatttatcacaacccaaatgcagtcacttcatcatcatgcgatcatctgtcagaactcagcagtctgtagcagcacacacagcaactgtacatcataaggcaaactgcactctgaggacattgacccaacagttgatactgttataggtacatatattataacctgcacaagtaaccagacaggacactttacattaacagtgtgacagcattggttccctgccagtgatgcaaactgcacagagacaagatggctacaaccagctgaggcatcatagctaatcatctggcatcggcatctacctggcatcacagttgtcaacatcaatgcgacacaatggtcaatgtacatcaccatcgctcaattcaatcgaactccttcaagatttatcagcacacaattactcaagcatcacgaggtctatccaacgacgttggaccaacaacataagagaatacaaacggcgtgccattgagccttatgcggacaacatacaacaattgacagtaataccccttggttcggtgcacctggaccacgcacgtaatatacctcacaatcatggaccacagtttaacacagacacgcgtttatcctctacagtggtaaccacatgtgtctctttgaataaaagataagagaaagagtccatggatactcacaatactctacgcaaaagcactttacaagacgccataactatagacctaaactaggaatccatgagactaaaacacacacgatctcaacatagaagcagacacagcagaagagacacaaaataacgaaacgcgtcacacaacactagagccatatgacacgagagcgagggagagaaaaaggaggaggccgacacagtagaggtaggcgagcggccagagggtaagggaaggggaagctagagcagacagcaacacacaaggacgagagagagaacgcacacgataagcgacggcaataaaggaaaacaacagaggagcagaaggcaaagtaaccaaccaactcaacacaacgagcaagcaaggagaaaggacagacaagagcaaaaggaggacaagaacaaagccagaagatgggaagcataagag

SEQ ID NO: 660625 - DNA, 109 bp, Homo sapiens
ttgagctcggtacccttcgtactcgagccgtcagcgcgaaggttcgtagccctccagtgccggcacgctggtcaattggccgtcgacaatggcctcgcatgggttgcag

SEQ ID NO: 660626 - DNA, 152 bp, Homo sapiens
tgtgcacgcagagacctttgctttgatatcatcaactgaagagaatgctgtatgatgggagtgctggaacgcagaaactttgtctatcggaaaaactatactggtatgcgtgagactcaacatcaggatccacagtcttcgcctggggtacc

SEQ ID NO: 660627 - DNA, 154 bp, Homo sapiens
gctcacccgacggggtggcccggggaggcgcgggcggcggccccagcggagactaggccagaactgagcattttcaaatgttcccgaggtagagatggactgccgcgatccccgttcgcatgcgacgatgacttccctgtccgtgtttcgtgac

SEQ ID NO: 660628 - DNA, 462 bp, Homo sapiens
actacgcgttggcctggcgagcagataaagtcgatccggcaggatctgacggggcaggcatccgcaccgagttcacggggggaggtgtacgagacccaggcccggatcgccttggagaggggtgaccatgaagagtttaaccagtgccagacgcagctcaagtcgctggtacgcagagaattggccgggcaatggggggcgagtttatggcctacggaatcctctattacatcttcaccaagaagtcgggagacatcaccagggagtgggcatacctcacaggagaatggaaggagtatccttgggtggcccacgcctgggcattaaggacaggcggggcccggggcaactaccaccgctttgtccggctctatgggcatgcaccctgtatgtctggctacctcggggacaagtttgcagatcgggagcgcaaggttcgcctcaggggcatgatcaaaatgt

SEQ ID NO: 660629 - DNA, 1529 bp, Homo sapiens
  misc_feature (297)..(297): n is a, c, g, or t
tcccttccaaaatggaacaattttttttttaaattccaacaaaactccttttccccaagcccccaacccgtggcgagggcagcccctccctctctctcccatcctcctctccaccccccctctcttaagcccagggctgaagagggaatagtggaaaatgtgaagaaagcccaggagaggagcccctctgtccaggggaaaggtctgccccacaatattgtggtggttgaagccaccagcccacgtgcgccagctgtggtggctgtggggcacagcacaggtgtcccccacagaggntctcctctccctcttattaagtataaagcatttatcctctgcacagcacccaccagctgtgtgtggagaacaagagctctctaaatctgtgtgacagaaacaggcacagagcggccaccagtatccacaggctactctcacaagagaggcacagagaggcgcgcacgcactctcagagagaagactactctcccccaacaccccccgtgtgaggagcaagtgacaacacggtgaggagaggccacaacacagagaagactctgctccagaagagaagaccaccagaccactacagtagagtcgcccagcagggcgcggcgacacaaaacagaggcgggagagacgaactagaaaagtagagcggccggaggggcacaagtatcgcgggcgggagaacaggagagcactcgtgagcgcgccccccaaatacaaacatgactgggcgctcccaccaggcggggcacacaccagagcagaaacatagggcgctccagcgtagtgtgacgccccacacaattttgtagcagagagcagcgctcatatgcgagaagaagaacaggggacgacagggtggcgtactctaacacagacacaaccgacagtggtggggggcgcagccactaagaccgctaactctcgaccactactaacgagcggcgggccaccccattcatccaagaaaccacgtgacgttaccccacagagtcggttcacacgaagctgcctgtcagataacaaccccgccccactcccaacacacacgcccgctgggtggatgatgcaggcgagaccacctaggacgcgagcgcacctcctgactgatagacaacagaacgacacaccctgccgcgtgggaggacagccaccacccatgctcacggaggtcggacacgcaacgcttgctccgtccgccacgtcgcgtcgggcgtacaccacggagcatcactatcatctgctctcctctcctcgcgcctcacccaccttactcgtgctactctactgtcttaccgaccaccgcccgactcgctcgccgccgctgctcgcgcaggccgagcatggatgcacgccacactcgctgtgcgtctcgaccctcagtcgtgtcgctccccctcgcctgtgcgctctgtggctggagcgtacacatcactctcaccgacaggagcgtgcgacaaccttctcccgtggtcgcgctgctcagtcggtcaccgcacctccttctcctgccgcgacgt

SEQ ID NO: 660630 - DNA, 335 bp, Homo sapiens
atgctggtcgaaagccttttttgtcttcccatcgcaggtgtgctcgggattaggactcttagcaggagagttcttacctgtagcctgtgctggaatctctacttctgcattatctgtagtcttctctcctattgctaccagctgtgtcatctcgcctacggataccttcgttgctataacttgtgctaatcctctggcaggtttatacttcccatgctctgaggtctgttccttctttgattcaggtttcttcactgtagtatcagcactttcaggtgccacatcatctttactaagaacatgatgccgattcctagcctgatgcctcttcttct

SEQ ID NO: 660631 - DNA, 913 bp, Homo sapiens
tccctatatgtattcgttggcttgtgatactcatgtcatcgatattgtagtgcaaggctctggcttacgtagtcgcctgcatagtcctcctgcgatgtacacgtccagaagaggagcacttaaaagcgtacgtacccagaaagatattggattctactagcccgatgtcatcttctcggtaacagagtcgtgcttgccagtctttggtctctttttgcagatcctgacctatataaatctcggtgaagcaatctatttagatccagaaggataggaatcatattatgggcccatttcttcaagaatatttttcctgatcagggcgtccagtggtccagaatcttttactgtctagcattacaatggattggaagcagtcgaattatatatgaaccggtcatgtaggtagaaagggactgcagttgtggatgggttatgaatgatcttcatgctatagacggatgacatcgtattaaacgctgtctgaagacaaatggcatacattgagttaatctggaccaagattgtctccttcagtaaattaattgtctaagtatttatacggacgatcttactaaccggatgttgcccgaaggagtccagactggcaattgggttggattaagcctaaacactggtatccctggattacctgtaattaccattaacaacctcattttcccggttcctggatatgttcacgttggtgtggtcctcacggctaatgttagggattgtctatttaccctttgagtgaaattactagccaagtacgctttcatcaccattacacctttggcttcgatcttgtctatccccgctgacgcgacagcacgcgttttttatcttctcacgccactcgacacaccgggcggtcatcagcacacccatgtggacgagccgggataacaac

SEQ ID NO: 660632 - DNA, 978 bp, Homo sapiens
agcggagtgtgtcttttatgagttaaactaaaatggaggctggtttcttgccttaaggagcccattgcctttcccgctgaagtctagatgtggacatgtaataaagcgggcagcaggatggtggtggatgcggccaactccaatgggcctttccagcccgtggtccttctccatattcgagattgcaaatgcacaagattcgagacctatgtatacaagagggccaactttacatacgcacgggttctgcgggccgactgtgggacttgaactatgcgtggattgggcatgttcctcctgctgatcaagagaagcttaaatccagaagttacgtcagtgttgcgtcctcgttggactttgcttctgatccactaagtgacctaaagtggcaaggacgtcaacacgagctgcttcacagtgcaccatggtagcactatatccaccataatcggcaatgtgatcacagagcctatgtacccagaagtagtccatatgttgcagttaacatgtttcggaacattaaccacttcctccaatcctaagggagcgcacattggaccggaggcactgcatgagccaacggttagcaacgcaggcctggactcaatctacagctggttatgactatcatcctaacggacttacgcagttcccagatttccaacctaatatagcgcagcactatattgagcccgaagcctggccttgcgcggcgtttacgagcccttgtgacccctgacaaccctcgggcagacacaccctccttaaaaaacaacccctttaccgaattccattggggacaccccccacgtttggaagagatcctcccgagaacgcacataagtaactagcatacaagctgtatcttataaagcccgcaccacaatgccggacacgccacacgaccaatctatcgggaatactacgcgggacggctcccaccaatagcgcgacacttcatacggtagaacccctcac

SEQ ID NO: 660633 - DNA, 518 bp, Homo sapiens
ctaaaacaccaaagcgaatagcaacgaaggccagaattgacaaatgggatctaattaaactaaagagctttgcacagcaaaggaaactatcatcagagtgaacaggcaacctactgaatgggacgaaaatttttgttgttgacttgttagactgctgaattaatctaagtagtgttgttacttaccttgcgtagagctgccagaaggaatcattgaagaacattattagtcagaccacatgattcctctggttgaaaccctgcagtgatagctttcattgcagttagtgtggcgcctgcgaagctcccatcttgtctgtgactgaacttcagacccgtggcttctttcagttccttcgtggagctcttctcgcggcgccagcacacattgctcgcccctccctcacaatgcttgccctgccactgttcacctcctgctcttcgcctcagtgtcccagtcgcatcctcttggccttcctcccccagcgggcgcccctacccactcgccctctagcgagt

SEQ ID NO: 660634 - DNA, 896 bp, Homo sapiens
ggttagtctgtgaaggagctatggtggggccaatgggaagtgctcccttctggcatctgacgctgccctgcaagtgggtactgctgggcagagaacctgaaaaaggcgggcagactgtgggctactcaaatcagatggggcccatcccatggacaagatagccatgttctgtccagctccatcagtgaacaaaagtcaaaccacctggaggagcttggcaagccttggcggatgggtgtccctagccagtgctccacctcagctgttccatgccaaaccttctggtctcatcacaagctagagttctgtccctgccacctctccaaacagctctgtcagctcaaatgtccacgagggtcgtgggctctcctgcaactacgaggttcttggtgagagtgggccactcctcgcctgtttaactcaaaccatgcaaaggagtcgctgggggtcaggaatgagttctggtgctctgtagtccggtgcagggttcccagcttccttccccttcagcccagagtttatgtcttccttcggtacactctcaatgcctttcttatttgatctgctgggagtgtactggtctgcttgatggtcttgtcttgtggtgggagatgctctcctggcagtgactagttgaccaccttggctttttcctgaatcaaagttcaagactttgactacatctatgtgagtttctaggagggaataccttaaagagttgctcgaactaaggggaggagaaggggacagctagctgaagaagcagactgaggatcgcagaggctctctggggactggacagggaccggtatactaccttgggaactcttagtctaccattcctgcatgtgtctaacctgaacttcgaatttcttacacattcactggagaacatt

SEQ ID NO: 660635 - DNA, 895 bp, Homo sapiens
accatggcggctggagaccctgtacacgtatcctgataagaactggatgggccttcaaggctctcatcgcctgctcagtacacgcggtgggctcaggttcccgtgtgccttctccggatagcacacccacattccaattgtgtgcgccgaaaccaaatcggcaaaccggcctgaatcttcgtcccgcaaaatttccttgctcaggcagagagggtcccgagcaattggagggtgatgactggaatgcgtgtgtgttttggagagcaacagccattagaactaactcatgtgagctagatgagggagcttggggggtgaacagtacctcttagaagggctagtcgaggaccacgacgtgtgggtgcgaccttggggtgaaactcctggtctgaattccggatattaggtgctcccgcgaccgacaaataccctgggatgtttcactcaaaccttgggcgtctatctatggcattcacatataaaaggaggcctatctgtatgactgtcacattggacgcgaatgtgaggcttaagttctggtgcgctactggatgtgccgtttacgtggcaagacgaatgtgacgtctatcatgggtgacgcgaaataatgtgacatttgttttgatcttcgaccaaggttcgtaattgtaatccttgttagtgcgctctaatgacagcagggtctacagagccctaacttatacgcatagtctgtttcccaaatagcaaccgctgtgttcccccacatggattaacacagcccagtatccgcgggtgtgttgggcagagtgacatgtgtgacacatggccgagttgggcgagaactttgaaaaaccacctaaatgcgtactgaaaagacggttcggaagagaccaaccctgtacgggggaacagg

SEQ ID NO: 660636 - DNA, 319 bp, Homo sapiens
  misc_feature (176)..(177): n is a, c, g, or t
agctcacaaacatgatttcgcagggttctacgctgagagagaaagagggaacacagagcatttgacctactctgaagttccttgaccagaagtggcacaaagtcactttcacttgctttccattggttagaaacagtcatgtgactccacctacctgcgagatacctgtgagtatnnccatgtgcctaggaaggagcagagagccacagataggtgaacactgtactcttagccacagtcactgtattcagagattgacatgtgcaagaggctattaaaagagctatttacagatgaggtgacctttactactatctag

SEQ ID NO: 660637 - DNA, 117 bp, Homo sapiens
gaaacggcaagcccaagaaaaaagggaaaaaaaaacccccgggaaaaattgttaaaccacacccccagaaaaaaaaaaaagagagctttccaagaaaaaaaaaaaaccccccccccg

SEQ ID NO: 660638 - DNA, 425 bp, Homo sapiens
gtgggaggccatgacggacagatcacttcagcccaagagtctgagaccagcctgggaacatagtgagatcccacctctacaaaaaatacaaaaattagccaggcatggtggcacacgcctgtagtcccagctacttgggaggcagaggcagaatgatcgcttgagctcagaaggccgaggctgcagagagccaagatcacaccactgtactccagcctgggtgagagtgagatcctgtcagtcagtcagtcagtcaatcaactaacaaacgaatcaagaggatctatggaccaggcatggtggctcacacgtgtaatcccagcactttgagaggtcaaggcaggaggatctcatgagctcaggaatttgagacctgcttggggaacatagtgagactccatctctacaaaaaattaaaattaaaa

SEQ ID NO: 660639 - DNA, 127 bp, Homo sapiens
gtgaagtcaagatgaagaaccattttgcttttcttggggagtcctcggcggttttttattaaggctgttcatgtgaaaagcccaagaagatgaaaggattgttcttgttgacaacaaatgtaagtgt

SEQ ID NO: 660640 - DNA, 124 bp, Homo sapiens
gatacggtataacatagctaggcttgaatgaaggttccagcccgtttagttctgagtgtatgtgtagcttcattcaaagcctagctatgttataccttatcccagcctgaggttgagctacagg

SEQ ID NO: 660641 - DNA, 174 bp, Homo sapiens
gtgtgttttcccacgcgcatctagtgtgtgtgcttgtgtgtgtgtgtgtgtgtgccgtgctcatctgtgtacctgcacgtgtgtgcttgtgggtgtgtgtgtgtacccgtgctcatctgtgtgtgtccctgcatgtgtgtgcgtgggtgtgcgtgtgtgtacccatgctcatca

SEQ ID NO: 660642 - DNA, 486 bp, Homo sapiens
  misc_feature (13)..(13): n is a, c, g, or t
  misc_feature (16)..(17): n is a, c, g, or t
  misc_feature (21)..(21): n is a, c, g, or t
  misc_feature (65)..(65): n is a, c, g, or t
  misc_feature (171)..(171): n is a, c, g, or t
  misc_feature (410)..(410): n is a, c, g, or t
agagttgagcttnganngagnaaccaacatggaaaacaggaagatggaacaaagaattcccaaantgggggtgcgccagacctcatggtgcaattgttgaaataagcagtattaaagccagatcataagagcagagcagatcgaagaagcaagagcctgggcatttttgcnaattgaggcccttaggagaaaatgggggaaagggccaaagtaactggggttacagagagggcatcaggaatcactgcacatgaagacagcacctccacagaaaccaccggcaggaactcagggacttggtgatggactcatatcgtttgagtccagcatgtggggagaaagatgcttataaaatggcagaggagggactgctaagcaatgcacagaagacaatttgcagtaatcacttnatccttggttttgctatccaagagtgggagaaagatatggaggtgcagctttcgaagcaaaatatccacagatgtc

SEQ ID NO: 660643 - DNA, 446 bp, Homo sapiens
  misc_feature (15)..(15): n is a, c, g, or t
  misc_feature (24)..(24): n is a, c, g, or t
  misc_feature (31)..(31): n is a, c, g, or t
  misc_feature (126)..(126): n is a, c, g, or t
  misc_feature (176)..(176): n is a, c, g, or t
  misc_feature (437)..(437): n is a, c, g, or t
  misc_feature (440)..(440): n is a, c, g, or t
atgtatgccccaaanaaaggttangcctgcntgtttttcttttgtgcctttgtttaccccctaattgagataagcagtttgacttacctagattacaactttggcagttcaaagtctttgttgaanactttgaggaaaaagatttggaaaaattgttgactttcggccgggcatgnatgtcacgcctgtaatcccagcactttgggaggccgaggtggcggatcacctgaggtcaggagttcgagaccagcctggccaacatggtgaaatcccgtctctactaaaaatacaaaaattagccaggcgtggtggtgggcgcctgtaatcccagctatgcgagaggctgaggcaggagaatcagttgaacccgggaggcggggattgcagtgagccgagaccatgccattgcactccagcctgggcaacaggagcaaatntcngtctca

SEQ ID NO: 660644 - DNA, 327 bp, Homo sapiens
  misc_feature (262)..(262): n is a, c, g, or t
  misc_feature (289)..(289): n is a, c, g, or t
tttaacaaaacaatgtctacagagcattttgctttgtatgcaaatggagcagtactagaatttttagttccttgttttcttcaatactggaatgtaactttttacaatgccttttactgattattattttttggatgtctcccacccatataggtgagcttctcttacaaggccctgtatttatcaaagaacccagcaacagcattttccctgttggttcagaagataaaaaaataactttgcattgtgaagcaagaggcantccatcacctcattacaggtacagtgnaaagtttgaaaattcaaataaaaaaaactaaacacaca

SEQ ID NO: 660645 - DNA, 166 bp, Homo sapiens
  misc_feature (159)..(159): n is a, c, g, or t
atccccctttccaacaacctcaggaacgtacccttgtactttggtatacacaggctttggcattaccaaatcttatctcattataattactttcgttgaaccacttgccaacgtctgtctactatagcattcattgatgctcttcatctctggtgcatnacctctc

SEQ ID NO: 660646 - DNA, 209 bp, Homo sapiens
tgctacttggaaaggctgaggcacaagaatccctcgagtctgggaggcggaggctgcagtgagccaagatcgtgccacttccctccagcctgtgtgacagagcaagactctggaaaaaaaaaaaggagaaaaagaaggagagaaagagaaagggaaagaggaaaaggaaaaggaaagaaacaagagctcaccttcaaaggaaatttgga

SEQ ID NO: 660647 - DNA, 239 bp, Homo sapiens
tctgatgacaggcatgcgccaccatgcccagctaaatttttttttggtatttttagtagagacgggtttcaccatgttggtcaggctggtctcgagctcctgacctcgtggtccatccgcctcggcctcccaaagtgtcgggattacaggcgtgagccaccgcgcctggccactggtgtgtagttcttgaagagcagttatcactgttccctgccttgtggtgtcatcagacaatgtat

SEQ ID NO: 660648 - DNA, 629 bp, Homo sapiens
gcctggtgtgattccgtcctgcgcggttgttctctgtgagcagggtcttttatctccgtgccgacttcgtctcctagctaagtgcgtgtcgcatccgagtggaaggattcgatggaacatggaccatgagcccccatgtaggtgcccagaatcgtatcttttcggtctgtgaactaagaggccgaaaaagattgatcactttagagggtggatagatgatgaaaattgaggcacgcaggttattcttttagatgaagccgtggcacgtcttagggtggcttggtggccaaatgggattgagtgttagcagcatgttgtttgacaagccagatggtcaatccgacatgtagcggaattgccgggtgcacacatttcacaagggtaaccaatcgttggcagacttctttgagaaaagttgtccttgtgaagcacggcacgaacggcggtttttactcccatttggagggtgggtcgatatctggacagattgaacatattgatcccatggttgttggtctttgaaggggttgttgcaaaggaaggttggggcatacgaatgggtccgaagtgttgtcaattaattataggtgtgggaccaaggtaagtttaattcacgctggtgttgagga

SEQ ID NO: 660649 - DNA, 103 bp, Homo sapiens
caggcgcccttcttaaaggcagcaggtccccattgtcgttgcgagtaccctcgggatagatccacactttgaggttctccctgagcatgcgctcgcccaggtc

SEQ ID NO: 660650 - DNA, 326 bp, Homo sapiens
gttcacaaacagctaactcacttagccagcacctgggttatttaatgggcaaatgctcggattctgttcgttgtccttgccttaaactgttcccacttgatcactccttagaatattacgtcaaaaatatacctatcctttgaactaacttaggattcgggatcaacaaaatactttccggaggccatgcagaggccgctagatcggttgtcatcttgacggcaaaatctagataaggcaagtaagcaacaaaatggttatgatataacctgacatttctgtgtattttacaacagctttgtgatataaatcacataccataaaaa

SEQ ID NO: 660651 - DNA, 355 bp, Homo sapiens
cccctcctatcatgcagttagtggttgggttttgccatcttatcaactgtgtcgttgtgtgaagaaggaggtaagggggcctttgatgtgtaggaggtgggggctctatgggcgctcctcactgcttgacgctcctcacggctctttggggctcttcaaagcctcataagtagaggcttggtctctcccagcgctctgcctcacacactacacgcacttccgggaactcaacgccaacaactctgcgcctggctggctcatgcttgtaatccctgcacctttacgaggccaaggctggaaggagcacttgacgccacaagcttccagcactagattggcccaccatggcgagacc

SEQ ID NO: 660652 - DNA, 262 bp, Homo sapiens
tctggatagggtccccaagaaagaattaagatttgttttaatcctgtctggttaatttgaattctaatgccatctgcaaacgtggttttctgcatggtcatttatttccaaaggcagcccccagtgttgccttttctatgttgggcactctttccttctgtctagagggggtttagcttttgaggctattcatctatccttttttccttaaaacaaatctaattaacattcttgctagttataccttttaaaaaaaaaacaa

SEQ ID NO: 660653 - DNA, 339 bp, Homo sapiens
  misc_feature (2)..(2): n is a, c, g, or t
gngcacccggccccatactcacggagtagaataagttttcttaagattgcgatccctctgactattccggtgggccacctgggatcttcaggggcgggtgaggggcatcaggagcaccaccgaggccccggacccgggttactacagcagtggagggagaccctggaactctcactgctgctgccgccgcggctgtgcaggcttaggagcggcatggtgcggctggcgtggatggtggcgctgggtttatccccttccttctctctggcgaagcagtggcttttgaggattcgctgtagggaggatttcaccatccgggccttctggggctgcactggg

SEQ ID NO: 660654 - DNA, 435 bp, Homo sapiens
  misc_feature (33)..(33): n is a, c, g, or t
  misc_feature (45)..(45): n is a, c, g, or t
  misc_feature (99)..(99): n is a, c, g, or t
  misc_feature (146)..(146): n is a, c, g, or t
  misc_feature (164)..(164): n is a, c, g, or t
  misc_feature (169)..(169): n is a, c, g, or t
  misc_feature (180)..(180): n is a, c, g, or t
  misc_feature (307)..(307): n is a, c, g, or t
  misc_feature (364)..(364): n is a, c, g, or t
  misc_feature (390)..(390): n is a, c, g, or t
gtggctgccccctgagataagcatcctactgtntgtgtccatcgncctttcaggaggactagggcttctggggagctaagaaccccaaggaaacaagtntgggatgtgaggcatcccctgcacatgcaggagaagacaagattgtnttcagctggctgctaatnacctngaggggcgcanaagggtgacttgggatcagaggcttcgctcactccgctctcttcccaggtgcacgtcggcgacggagggactttcgtacaactgcgaagtgtttccaatttttcccttcatgaaaacaagcccttgnaccttatctaactaccagaccaacaaagccaagcatgattgagcttacctatttttngaccctgactttggacaaggcccttnagccagaggattgacaagtaatccttcgtttacccgagggtgcaa

SEQ ID NO: 660655 - DNA, 302 bp, Homo sapiens
gttcttgttgcctgcacttcgacgcttacaagctggacatcttctgatgagtatttggaagtgatcaaggctctgaagaaccatgaggacaagatccgcgtggggctgaacatgtgagaccatatcgagacgcagcagctgatgcgagtgtacgtatccctcatgtggtccctgggcaagatcattaacactcccgaggtggtgagtggctacataggatccttctggtgccaccagctctttatacacgacaaccgcatgctctttgaggccgaggagcaggaccttttgaaggacatcca

SEQ ID NO: 660656 - DNA, 94 bp, Homo sapiens
gggcccgccccccgggggggggccccttttcttttgttgggggggggaaaaaacccaaagaaacaaaagaaaaaacaagaaagaaaataaagca

SEQ ID NO: 660657 - DNA, 371 bp, Homo sapiens
gacaaaaatcagatctcaggatggattaacaacttagatgtaatacctaaaactataaaaccctagaagaaaacctaggaaataccactccagacataggccctggcaaagatttcatgatgaagactccaaaggcaacggcaacaaaaacaaaaagtgacaagtgagacctaattaaactaaagagctctgcacagcacaaaaaaaaaaaaaacttatcaggggggtaaattggacaacctaaaagccaggcagggggaggctcgggctggtaatcccagcattggggaaaccccgggcgggaggatcattggagcccaagagatcacgatgagccggggcaacatagagagacccggtctccacaaaag

SEQ ID NO: 660658 - DNA, 337 bp, Homo sapiens
ggcccgtgcactgaggcaagatccttctaaaaacaatacgaggatagaaatagaacatctatagaaacttttttttaaaaaagttgcttgaatgtaaagtccaatcaattaagagattaatcaaaataaacataaataagaagaaaagggcagggtctgatccttgaatctatttaaatagagttagtaataaataactaaactactatgaattatgattacagaatagaatgtgaatattacaaagctggacaatgtaaaaataataagataatgtgaacactggaacactgaatgtgaactggaatactgtccttatttttcaaagcagtgagcc

SEQ ID NO: 660659 - DNA, 327 bp, Homo sapiens
gctaccggtgattccttgatctcatctcaccgaagacataaaaaaaagagagagagagaaagataccattggtttatgcagcaggaccaggcctaaaagcaactaacactaaccagagaaagttttcaaacctcaggaagaatggacccaagcccttatcactggccttcttattcgaggggaaacttttgatatttttttctccctttaacttaaactcttttgtgggccacccttgttggacgtgtaagtgagccgacagacgtgcgtttatatcgggtgggaaattgaactttggcaagtgaatttacctccaagaaaattgat

SEQ ID NO: 660660 - DNA, 383 bp, Homo sapiens
tgtccgtactcaccagatacttacaaaggcagtactatcacaccttcaagatggggaaaccacggaaatacacagaaacacatattttccctcaacatggatgcttatatcatatctataccatagtaagagtagagagtcacaaacacatgaccatatattaaccagacggtgagaaaagcaatagagacaaactgattaatccaagaaatatccttaaagaaacaaaaaagaacagaagcatacaagggaagccctctcttccaccctctttctcatcacagtttggccctaatcagctaagacaggtaggggtaccagggctgtaaagctcatggggtatatcattaggaccagcactgtacatggaacagctcaaagaa

SEQ ID NO: 660661 - DNA, 330 bp, Homo sapiens
gagttgagacagagagtaaatgggccctgtggtgtggcagtgaggctgaggagggagcctggggagagcaccagtgacggggcatcagtgccagtgcctggaaggtgtggccaaaggggtctctagcttgctgctctgctgctcctgctcatggatgagtttggcgatggggccggtgatgccgcctatcaaggtccagtactcatcgaagctgatgcgcccatcatgattgggatacaggttctggatgagcttatccgcaggcttccggttccctgtgtccgacagcatgtggttcagctctttctggagcatctcgcggaagctgat

SEQ ID NO: 660662 - DNA, 884 bp, Homo sapiens
  misc_feature (884)..(884): n is a, c, g, or t
gtccttacctgtgagagagaatagggcagggtggcatggatactggatcgctggagccagaaggcaagatgttcattgggttgactcctcctgaggatgaggagtctgatcggaccacacattcggccctgggcggtctgagcggatcaaggacagtacaaggagagttgcacgtgaaggatcatagattagtggtctcccaccaagatgactaactggtggtgtgttagttacgccggggctccctgcgattgctgcctcgcgcttacgcctcttggctcgggtgacgtggagtgtcctggatggggtctgtcggctatctggctggaacgcacgagggccagtctccactatagcagcagtgggagccttcttgttggctatgagagacctacctgaagggagcgccatcttagggctgtggccccattgggtggcgaactagaacggtgtggagggcgccccaagggggaatacccttggtgtgaacggcaaccggggcaccacaaaccgaagagggccctcggatttggggtgcggtttcgctacagggaaggggagcccatcgagaagggggccatccgattgaggcgagggccggttggctcgtagaaacggatttgggatcgcctcgtttgatatcagctagcgatcgagcagatgtacgtgagttgcgcaaatcccaaggagggcttgtgggctagagcgggcgttgaacgccgtgtcgattgttaggtgtctaagagccccccacttaggccgtgatccagggcatagcagccctgtacttagttcacgagacctcccatggattgcggcgaggcccgttgggaacaacaagcgggatgcaaagacccctacttggcttcaattggaggtagggn

SEQ ID NO: 660663 - DNA, 257 bp, Homo sapiens
ggtgatctagaggatcccgggacgggagaggtgtgaggatctccaatggcttagaaccgggtacttttattaattggatgttttaaaaaatatgtttatacagatgctggcggtggggcaatcaaggtgggcaaactttaggtgtggggatttaagaagtagaagatcctcataaagccaaaggtacaacactgactcatcataagggtggggcggctattcgacaaaccagtttaagcagggatagcgggggtacc

SEQ ID NO: 660664 - DNA, 434 bp, Homo sapiens
gcaaacagcacaatcagctcttgcgaaaggcctgcaccacctggagccttcagctttggcagtgtggccactggagctttttaaagctgtgcacatgaatgccagagatgccacttctgttttctttaacaaatcatcgcgtagaagccagtggcagtggtttgcagtagagctatgatgttaccagattgcctcatggacaaaactctgcttctgaggggttgaaacacacgagggacagtagtaaacggagaaccaaagtaccctttagttatgattgttagctgggattgtggcccaaacaccgctgatgagttctctgggaatctagggaagaccaggtgggcaagggcaatgtgaaagggcccttctctctttctaagcccaaatcaagtatttgggatttgatgatcatcttgctataggcctcaatg

SEQ ID NO: 660665 - DNA, 125 bp, Homo sapiens
  misc_feature (9)..(9): n is a, c, g, or t
actctacangactcacacgtacgcttcattaagacttctaattaactcttctgtatcaagaacttacaatgtctcagacagtaatggtgtagcagtgtaagagaagtaaagtctgctaggggaaa

SEQ ID NO: 660666 - DNA, 158 bp, Homo sapiens
  misc_feature (25)..(25): n is a, c, g, or t
ccagctgttcccatactgtctagtntaaattatggctgttaaggccgggcgggtgactcaggcaggtaatcccagaactttgggaggcccagacagaaggatcgcttgaggtcaggaatttgagacctggccaacatggtgaaaccctgtctctacta

SEQ ID NO: 660667 - DNA, 393 bp, Homo sapiens
atatagctggcgtgcgagattatcatactaggagcccgcgtgagtggtgatgagcatcaatggtctaccctgttgtattccctcgaccattcggtggtctagagcctcatctatctggtgtcctggatgatgagcatgctgctaacccaagacctcagtcaagtcggtccgaggctcatcatttgagcaacatggaacttccaatcgtctgctcttcgaatctctgatactctctcggttcccagagcctcatactcggggccgcacttgtgccgccgtcattccatagagatgggacgatgggcgatgcacagttggttctaggccttctgacccagattgcccagactgtagactttactgacatcttaactctggggcccaaagcctgct

SEQ ID NO: 660668 - DNA, 470 bp, Homo sapiens
  misc_feature (299)..(299): n is a, c, g, or t
caaaaccccccggaaagcttcttaaaaaccttcttaacttttgggagccagaaaattagaggagtgtaatccttttggatgaacctctcggggcccaaaaatgtggctggcgggggccattctttaaccggttaaccagccgtaaaataggtttgtagatttttgcccccgaaggtggcccccgggggaaatccggcccccttaaaaaaagggtggttttccccccttaaaaatgccggggaccagggggccccctggagccaaaggttggttttttttttttttttcctaaaaaaacnccggttattttccccccccttccttgtaaaaaaacccgttttcccctttgggatttttgggggcccaccaattttcccggtttaccccctttgccggttttatcccggttttttttttttccctttttttggggtaaaaggggaaaaaattaaaaaaaccgggttttttta

SEQ ID NO: 660669 - DNA, 249 bp, Homo sapiens
gaaatagaagggcggagaataaagatacagaggtggtagtaaacacacacacacgcacacgagggaaacacgtgatagaccaccgcaacaagagcgggcgcaccacaccgcttgagtggtcaccagcgtgttcgtacgaacgagtcggaggtaaggaggccgcttgcgtggatgcccgcagcaccaccccccgccgctgccccccggcgggataataaagagggaagacccccgttcccacaaatataa

SEQ ID NO: 660670 - DNA, 175 bp, Homo sapiens
ctttgcttcttgagaccggggtgtgtgtggctcagcttccacggcgttatatggttcggtccatgtgtgtgcgtgtatatacttgaagagacctgtcgtgtctgatatgcactattggaggaggactaaagttcgcctgacaactttatgtgttatgccagatctctgagggcaa

SEQ ID NO: 660671 - DNA, 211 bp, Homo sapiens
gacagccagttcaggtgaactccatagccactgctctgggtcctgcgctgtcgagcactcagaacggcgactgaccctgcaaggacacgcaccaccacagtatggtccctgtgagcaagggaagatgcacagtccaggtgctgcgcagagaaagccacaggaaccttcagaagtgtgctctgggtcatgacatacaggtgctcaaaggtcc

SEQ ID NO: 660672 - DNA, 410 bp, Homo sapiens
ggagagcccacgcagtagaatggctaaattcaaaacaacaatgccaaaagttgtcaaagatgtgaagaaactggaacccttatagactgctcgtaaaatgtaaaacaggtacaacaatcacactgaaatacagtttggtagtttcttaaaaagttaagacacaaatttaccatagaaaccagcaaaattctactcctaggaacctacctaaagagaaataaaaacatatccacacagaaaaacgtatgtgaatgtgcacagcagcatgattcctaatggccaaaaattagacacaatccaaatgtccattaattggtgagtagataaacaaaatgtatattcatgtaatggagttcagcaatttaaaggaataaagtattggtacatgccacaacatggatgaacttcca

SEQ ID NO: 660673 - DNA, 296 bp, Homo sapiens
aacactaaacaggtttgaataacatggccactagaacattaaaaataccaccagtactgttaagtgtctctgcttcctggtccctggttgactgaccaaagcagtcaatattgggaaactcctcatttttttatctgaaatgtttgtggtgtctcttgaaattctgttattatgaaagaatttcaagaactctcatgtttttattcaaagtgtattttgtaattgctttgtatatactatgttgtttatatagactgttaaggttataatgaaatcaaataaatttatttttaaac

SEQ ID NO: 660674 - DNA, 282 bp, Homo sapiens
ctgaccctgacatccattaggctcggcagcttacctgggctgtgctgccgcaaggttccagggacagccctcattacttcagccaagctctttctcatgatctactttctttccacccctccacttctcaccttattcaatatattgatgaccttcttctttgtagcccctcctttgaatcttctcaacaagacatacttctgctccttcaccatttccaacggcatccacggctcaacattttttgtagccacaggcttccacggacttcacgtcattatt

SEQ ID NO: 660675 - DNA, 359 bp, Homo sapiens
aattaattgttttcaaaaagccaattcctgggttattgatcctctgaatgactttatgtagtcgtcagttgtacttcatatttagctctgatttttgttatttctcgtcttctgttacctttggggttgatttgttcttgcttctctaattcttttgctttgtgaagttaggttgttaatttgagatattcctaactttttgatgtggacatttagtgctatgtattcttctcttaacactgctttagctgtgtcccagggattctggtatgttgtattattgttgtcattaattttaaagaacttctttatttctgcctcaatttcattatttaccccaaaatcactcaggagcatgt

SEQ ID NO: 660676 - DNA, 461 bp, Homo sapiens
tcatctaagcttacatcttaaacataatccagattccaagtcgattatcatcagtcaggttcttctgtgttacttttgtccaagttgtgacaaatgttatatgaactgtgtagcgattaaaaagctcactgcagccatataaaatgtgttagccttgtttcccctttatgtagtcaacaagatactgatatacaatgtagatgcctcctcccaccacaaaaacaatggcctcttggaatggatttttatttctagggaactgagctgtcatatgccccgcagaattttgggatcacaatatctatagtcatcagtaacggggttagacttcatctccataagattgtccaaaatacgagtaacaggtcgattcagtggaaaagtatggtgtccagatattagaatcttacgcccaaagttctcctctataaccaacaagctgatcattcttaacagtaaca

SEQ ID NO: 660677 - DNA, 431 bp, Homo sapiens
ttacacttaggagatttcaacttaacttgaccgctctgaccaaaaaaaaaaaaaaaaaaaaaaaaaaaaaaattgggggcggcccgggcccccgaaaagagcctttataaaacaccatgcgcggtgggggcgcgcgcggggccccagagaggtcagaggacaacacggggcccaaagcgcggtatcccagagagaaaaccggggccacaggaaccaagggcgcggggatattttcctaccccataataacaaaagcgccgcgcgggggaaaaccgcggaggcgttccgtgaaacaaacacccaagagaggggaggtctgcgaaggaggaccaaatagaggggaactctatcacaaagagggggacccacaaaggagagaacgagcaaaattccaaaataagacgccccagcccgcgggaagaaaaagacaa

SEQ ID NO: 660678 - DNA, 810 bp, Homo sapiens
gccgatctccgagcggcaatcatgatgccactgtgatacgtggggggcctgcatgagacggtaagtgaaggcgctgctgtgggaactgtttgctcctcgctgtaccagtagtcaatcacccacgtgccaccaggatagagtcactggccagcaccaaggactatggctttgtgtgaattcttgagtgaggaagatgctgactatgccattaatgatcatgaacatgatcaaactctatgggaagccaatacgggtgaacaaagcatcagactcgacaatcaaaaaccgtggatgtaggggccaacattttcattgggaacctggaccctgagattgatgagaagttgctttatgatactttcagtcgccgtttggggtcatcgttacaagacccccaaaattatgcgggagcctatacagcaggcaactccaaaggttatgccgttgagttaattttgctatcatttgatgccttcggatgcagcaattcgaagccgatgaatgggcagtacctctgtaagccgtcctatcaccgtcatcttattgccttcaagaaggactccgagggtagatgcgccattggctcagcaaggcgaacgacttctggcgagctccagaaccctgttcttcccaggggttgattcgccctcatcaggttgtcttgcagatgcacctgctccagccttttgctcccaatctctgttggtatcatcacttggggtctgtggttccatccaccagggtgcctcctctgggcccctttccacaccccggtggcccctccttaggccttccccccgtgtttccctc

SEQ ID NO: 660679 - DNA, 530 bp, Homo sapiens
ggcaggcaggtctggaatccgtgcactcataatccacccgacttgggcagaaatctgaggggatccacagtatctgatagcattaaaagtaatgaaaagccatttactgttatgtgtcgctataaaatctactgtttgtccagatgcctaaactgatgtgcttagtgtagtaaacacactgatggtcacaccttgagatcatgaggtacagtctttgtagaaggtgctggcaacttagtttatcctacctcagaaaacggaatctgcctgcttaggggactcgcagaacacaggaagcctgggttagtggtaggtctcatctctcacatgatttcagcctcgtcgttcgtgctacctctttccacacaccttctctgcagaggagatggacgttgcggttcaggcttttcagtccgagtgggtaagtgtgtgtgagagtttcttaaggaaaacaaccctagcatgtgagaaagggcaggattccaacaaagctctctggctagcgtaagaaattctattactctcataga

SEQ ID NO: 660680 - DNA, 218 bp, Homo sapiens
ctctccaagctgctatctaattcaaacacgagccctaaatccccgggagcaaccaacattggatgtggtgcctacctcagcaccaaagacccacctgccaggtggagagtggcttcaggacaatgggtgggccccctctgtcctgaccgatgcaacggtagacgcctgcattccgtggccggacttgggtcagcagcagagagccattggcaaacagg

SEQ ID NO: 660681 - DNA, 301 bp, Homo sapiens
gtcgagccctggatatagagagagtcctcatgaagtgtactagcaggacttgagggaccaatcggacctaggtgtatcagggacagggcagacccagggctgtagtcagtgccatgggggcaactggacttatctgaaagtcacttctctgataatctcagttccccaggacatagctgagaaccacgaggaaggccaaggagcctctgaagacccacaataggtgccagaaagtacagtcaccagaggccaagtgtgcactgtggacatcatttggttacggcctgggaacctgcttctg

SEQ ID NO: 660682 - DNA, 306 bp, Homo sapiens
  misc_feature (156)..(156): n is a, c, g, or t
  misc_feature (306)..(306): n is a, c, g, or t
gaaggacctgctcatccactgtgttcggcctgcgtcgtgccgttcgcggtgacccttcactgtgccagtcgtgacttgccataaccctggcgggccctgcagcagctagcttttcccgaggcaaggccttcagctaggccacgacatagtggccantagctctagatcctagcttgtttatggtcaactgtccttgctcatccgtagtgccacaccatccggcgatatctttggcagttatcagggtccacctacagcccccagccgtcatcttcatcctcccgcagcatctccggctttggaaan

SEQ ID NO: 660683 - DNA, 892 bp, Homo sapiens
gagatacacagcacggcatgtgtgccgagtgcttgagcgagctccatgagcctgcgtgggtgttgtacacctttgacccggcgcgtgggaacgaacgccaacagcgcgtacgcgatggtccccaccggagtatgcgccgctcccggcctagtagttgcgccgccgtgtaccccttgcaccacggtactagcggtggatccgtgcattgcttccgctctcgcacgctgagtcttagggtgtcgtgctcgtgagcgggtccggccgtcgtgctctgtggcgctcacatcgtcttgctggggatccagagggcttcatcgtggcgcattttgcgagttgccttcgttctgatacgaaacgtttctggtctgtctttgtgccctagggcagatgctcattctactccaaatgtgctgcttttgggaatccgtggggggcgcctacgacttcttgcgggcttcattggttcgggcttgcagtacagccgctgtatcgtgccccggtctgtcacgggcaatagtggttgtccgcaggttatgctcggcggaagatgcgtagcctcttggccttcgagctggtggctgcgagtgaggccccggttggaccaaccccggtctgtgtcgtttggcggattgattcctgttgcactggtgctttgcttgcctggtgagtcctcgtagggttcggcgctttcgttgctgctttgccggctgacctgtcggggaggaggagtaatccgggctggcatcaaccccacaggtggtggggtccccctgttggaaccgtgatggttcccatccttggtgctccatctttgaggcttctgcacttccggtcgatcgtgtggtgacctcccgtgggtccccacctccggcagcctcaggtggggtttcca

SEQ ID NO: 660684 - DNA, 1454 bp, Homo sapiens
  misc_feature (202)..(202): n is a, c, g, or t
gacaccgatatctggtgtatgacgtccggtgcagggcggggtggccctggggcgcccttgtggccctgtgatgggaaaccggggtgggttactgggcgcggagggtctcgggcgcggcgatccgcgggtccgcgtcggtcgcggctcgtcggaccgtcgttcggggcccgcagagccgccgtcgacgtcagcgtggaggccntttgggccgaagccgtgattggcgcaggtggtatgtccccgtcaactcaagtttgcggccgccttggatcgcggacgtgaccggatcgagacgttctcacatgggtatgggagcagtcttatcatcatatcatcatcgttctcgcgaattcatgggaagtgcacgaagaatcaatctggatttcatttcccttggattgcgcccatcctcctcaaaatggagtgcatcggttttgtggagagcaatctaatttgcccacggtggcagaaatacggctaggtatcccttggttgaccttgagtcaagacggttacctcagaggatatcagaagagcacgtataggtttggcttaattccaggtgagaacccgtaaccacaagttgtggcaccagctggattcgtgtggtccattgggaggttcgttctaaatcaggtttgcctttcccaaatgggaaggatgttgtggcccaatccctgggccaagtacccggattggggggtggcccgattcctaattcccctgtgggtcaccaataagggctttgcctttccccaattcgggggtcacacccgcctggattggcctgctaaggcagaggaggctcttagcagtggcggaggggtgaatagcgcacatggaagttcttgcgggcgcgaaaaggagcacaccgcctagagtatacttgggtacgcccgcttttggccgagatggtgagtcgaaaccaatggaggcgccggtctttggccttgcgaccttccctttggttagcgcttggggcgttacccaggccgctctctagttcagcgcgtagacctaagcctccaatagtgtggaggcccacccttagggggcgaactcagagaatcagtgaccccggctgaagccccttggtttggcccgttaaaatggaaaaagaccttggcgttccaatttgtactttgggcttgagggttaattcggaacactaggaaccttgggcgtttaaacgaaacgcgttccacagatacccctgtgggtggcctctatggtgaacatttgtctccaatcacccctttgtgaggtgggctaacccttttctcggctcgaaagagggcgccaaccccgtttttttgggatttgcccccattttttctttagacagaaaccctttaacaagagcttaagccctttggaatccccccccggaagcccttcctcgcgaaatcgtgacggcacctttggtactttcacacgaaaaggtccttcccctg

SEQ ID NO: 660685 - DNA, 1481 bp, Homo sapiens
gctgcattggcgagatgttgcaggagatggggtgggctctactgaacctcctttcgcgctgccgggcatcttcgacctgcttctctgctgggatctcgcttaagttaacccttccctgggacgccttcctgccgactccacctgactctgacggagactcctgtgacctgtacgcgtgttttatgacgcctttactggcagacgggtaccgccgggtattgaaggattcgtaggagttcgcacagggaacgtgggacacgagcccctcttgtaaaacccggagccaggcacagaggtctccgtctctccaccgggggctatcatcctatccagggcagcgagaagagggactccaagacatgggctgaggaagaaagcaagcctggacagcatcagacaccaacctggagactagcacctacgggaagatcccaccgaaaacgggtggacagagcctggcaaatccccatgcggccattccgcacacaagaaatacacagagacagggacagaaccactagaacaaaaacttagactacacacgggcactgacagcgcataggcactcgggacagactcacacagaacacccagtgcgaggaacacaagccagggaaaagacaaagcaaacacaacaacgcaagaaaggaaacaacattcatggaacaataaccccgacacacactaagaacaacgccgttcacaagagagcaacacgtcgaatcacagggaaagagccaacacagacacataagatgacgacagcaaaccccaaacggcacaccaccaagcaggcaacgaatcagacaagttcaccccaactaaaacacacgcgccacagacacagggaaccatccccagggaaatggcgagacggaggcccacggggaggccaggacgatagaacgcacccaacgtacagcgaaccgcgaaggcaacaacgggaaggggaaatacaggcacactagcagtgagaaagacaagacacagacactcgacaagtcgaaacgtacaacaccacactcgagcaatgcaacagccacggcagcggatatcgaccagccagcgagcgacacacgagctacatgaacaccaataacacaaacagacacaacaacctgcagaggcgcgaagcgccgcaaacaatcacgaaagggggcaacagcgccaaaacgagcgacaaaggacaacaccgcgcccccgacacagagacacccccaaggacaacacgacagaagacatcaccatcaaccaaggagacgaacgcagccacgacaaccggaaccgcacacagaccagacaccgcgcaagaacaagccaccagatcaaccacgcagcccagagcgcagaacgaacgacaggagcgacgacgacgcagacaggtgacacaacgcacgagaaccacaccagtacgaacagaggaccaaacacagacagtcgcaagacagacagaacacaccacagacaacaaagcagcaaac

SEQ ID NO: 660686 - DNA, 299 bp, Homo sapiens
cgcacgatattcggacaagataacagaagtgggcgggaccactttttgtcagacaaaagcagaatgtacctcatatgagggaataaaaagtaaggtataggctagcaagggagccgcacttcaagctcagaattctgccaagaccctagagcggttatgcgagacagcggagcatgactgccagaggtcagcgctacccaaacccctggaggtaccctttgttactgctggcgcccctgctgctgcgggggaaagacgggacctcaaggctgcttcctgccatctgaccgaatatcgcg

SEQ ID NO: 660687 - DNA, 126 bp, Homo sapiens
ccgtgggagtatgtttttgccttagcgccgtgcaggtttgggcattatatcaactatttacaggcttgctgaaagggcaatggtgccctcgcatgctaggtttccacctgatggtggacaatctca

SEQ ID NO: 660688 - DNA, 392 bp, Homo sapiens
tcccttgaaaaggtcagattttgaccaaagtccttgactgattcagaagcatgccctgaccattagcccttgaaacctacagttttttttatttgtagccaggtctgatgacaccctaattttcttgataactgagctggggtattggcaggtggcaacggcctgcctctcctgaactcttccatttgttgaatcaggaccaggtgatgccatggactccagcctattccctagaagtaggacagaattcgtttgaactctcagaatcaaaccatttcatgctttctctgtttcataccccttcttcccttgggctctatttttttttctgggatttgcttacaaaatatggttttcaactttataaattgggagagcaaacagacgtctgg

SEQ ID NO: 660689 - DNA, 222 bp, Homo sapiens
cacgttgcgcaggctggtccgatctcctgacctcaccaaagcattgagattacaggcatgagccaccgtgtcctgccgatctgatttctaaaatatattaagcgacaaaaatgaggggcacgagcagtataatatatcgtctatttaattttcaaaaatgcgtggaatgttacgtgttgctatgacatagatgcacttcgcatgcgagaggcatcctcgtag

SEQ ID NO: 660690 - DNA, 2378 bp, Homo sapiens
aagcttgcggccgcggggctgggcggcggggacagcggggacggcacggcgcgcgcagcttctaagtgccagatgatggaggagcgtgccaacctgatgcacatgatgaaactcagcatcaaggtgttgctccagtcggctctgagcctgggccgcagcctggatgcggaccatgcccccttgcagcagttctttgtagtgatggagcactgcctcaaacatgggctgaaagttaagaagagttttattggccaaaataaatcattctttggtcctttggagctggtggagaaactttgtccagaagcatcagatatagcgactagtgtcagaaatcttccagaattaaagacagctgtgggaagaggccgagcgtggctttatcttgcactcatgcaaaagaaactggcagattatctgaaagtgcttatagacaataaacatctcttaagcgagttctatgagcctgaggctttaatgatggaggaagaagggatggtgattgttggtctgctggtgggactcaatgttctcgatgccaatctctgcttgaaaggagaagacttggattctcaggttggagtaatagatttttccctctaccttaaggatgtgcaggatcttgatggtggcaaggagcatgaaagaattactgatgtccttgatcaaaaaaattatgtggaagaacttaaccggcacttgagctgcacagttggggatcttcaaaccaagatagatggcttggaaaagactaactcaaagcttcaagaagagctttcagctgcaacagaccgaatttgctcacttcaagaagaacagcagcagttaagagaacaaaatgaattaattcgagaaagaagtgaaaagagtgtagagataacaaaacaggataccaaagttgagctggagacttacaagcaaactcggcaaggtctggatgaaatgtacagtgatgtgtggaagcagctaaaagaggagaagaaagtccggttggaactggaaaaagaactggagttacaaattggaatgaaaaccgaaatggaaattgcaatgaagttactggaaaaggacacccacgagaagcaggacacactagttgccctccgccagcagctggaagaagtcaaagcgattaatttacagatgtttcacaaagctcagaatgcagagagcagtttgcagcagaagaatgaagccatcacatcctttgaaggaaaaaccaaccaagttatgtccagcatgaaacaaatggaagaaaggttgcagcactcggagcgggcgaggcagggggctgaggagcggagccacaagctgcagcaggagctgggcgggaggatcggcgccctgcagctgcagctctcccagctgcacgagcaatgctcaagcctggagaaagaattgaaatcagaaaaagagcaaagacaggctcttcagcgcgaattacagcacgagaaagacacttcctctctactcaggatggagctgcaacaagtggaaggactgaaaaaggagttgcgggagcttcaggacgagaaggcagagctgcagaagatctgcgaggagcaggaacaagccctccaggaaatgggcctgcacctcagccagtccaagctgaagatggaagatataaaagaagtgaaccaggcactgaagggccacgcctggctgaaagatgacgaagcgacacactgtaggcagtgtgagaaggagttctccatttcccggagaaagcaccactgccggaactgtggccacatcttctgcaacacctgctccagcaacgagctggccctgccctcctaccccaagccggtgcgagtgtgcgacagctgccacaccctgctcctgcagcgctgctcctccacggcctcctgaacgtccgtcctcaggagcacagcctcacggacagtgccaaaccctgtgggtctccaggggcttgggaaatgtgttctttcccaagagaatcaaaggaaagaatcaaatttcttgcccggtcactggcactccagaagacagcgtgccggaaccggcagctctcacctttctgtgacttgttcggaattaactcctctggatggaaacttccatcttacttggttacatcacggctctggttcagatacaacttcatgattttgctactatcatttttcacttttcaaagaatttaacctattttacagcagttcagttctgctagtgagtagttttcctctcctaccttccttctaaaaacctgattcatgcacagcgtttgacacacatggagtctgccagtgtgccttctctgcttcagacaagagatctgccatttcatgcccttgtgactacctatcattggccctgcaataaaatcatttatttttcaaaaaaaaaaa

SEQ ID NO: 660691 - DNA, 345 bp, Homo sapiens
tttgcaggagatcacgtattttataaatgtatttatgctgctagactagtagatcaaatgtaccattttcaaattattaagaattcttatgagtctataaaattagtaaatttctaaatccaatcatgtaaaatgaaactgttgctccattggagtagtctcccacctaaatatcaagatggctatatgctaaaaagagaaaatatggtcaagtctcccatggctaattgtcctatgatgctattatcatagactaatgacatttatcttcaaaacaccaaattgtctatagaaaaattaatgtgattacaggtagaggccttctaggtgagacacttttaaggt

SEQ ID NO: 660692 - DNA, 489 bp, Homo sapiens
tttgcgtgtggcaagttggtgttttcaccttgcttgctcatcctgaaaccttggtctgcagggagcccactctcctggcagcctggccctggagacgctgactactgtgacccaggctggctttctctctgtactctgggaagtggatgttactgagctctggctgtctcttggtttcttgaagacattggtacttctacaaggtgattggaatattggggaacagttacaaagtattaaccattaataaaaaaaagttcttccttcttatgctccttttaaaaggcatgaaagaattactgatgtccttgatcaaaaaaattatgtggaagaacttaaccggcacttgaggtaagactcctttttttttcaatgtgacagttacatactcggtatcctgtcattgcttcatggaacttcgagttgtcacgtatttataaataactttttcctaaccaagacaaagcgtacccggatcctctagaacag

SEQ ID NO: 660693 - DNA, 2383 bp, Homo sapiens
ctgggagaggcctctggagcaggaggcccagtggctcttctgacccaaggccccgccgtccagcttctaagtgccagatgatggaggagcgtgccaacctgatgcacatgatgaaactcagcatcaaggtgttgctccagtcggctctgagcctgggccgcagcctggatgcggaccatgcccccttgcagcagttctttgtagtgatggagcactgcctcaaacatgggctgaaagttaagaagagttttattggccaaaataaatcattctttggtcctttggagctggtggagaaactttgtccagaagcatcagatatagcgactagtgtcagaaatcttccagaattaaagacagctgtgggaagaggccgagcgtggctttatcttgcactcatgcaaaagaaactggcagattatctgaaagtgcttatagacaataaacatctcttaagcgagttctatgagcctgaggctttaatgatggaggaagaagggatggtgattgttggtctgctggtgggactcaatgttctcgatgccaatctctgcttgaaaggagaagacttggattctcaggttggagtaatagatttttccctctaccttaaggatgtgcaggatcttgatggtggcaaggagcatgaaagaattactgatgtccttgatcaaaaaaattatgtggaagaacttaaccggcacttgagctgcacagttggggatcttcaaaccaagatagatggcttggaaaagactaactcaaagcttcaagaagagctttcagctgcaacagaccgaatttgctcacttcaagaagaacagcagcagttaagagaacaaaatgaattaattcgagaaagaagtgaaaagagtgtagagataacaaaacaggataccaaagttgagctggagacttacaagcaaactcggcaaggtctggatgaaatgtacagtgatgtgtggaagcagctaaaagaggagaagaaagtccggttggaactggaaaaagaactggagttacaaattggaatgaaaaccgaaatggaaattgcaatgaagttactggaaaaggacacccacgagaagcaggacacactagttgccctccgccagcagctggaagaagtcaaagcgattaatttacagatgtttcacaaagctcagaatgcagagagcagtttgcagcagaagaatgaagccatcacatcctttgaaggaaaaaccaaccaagttatgtccagcatgaaacaaatggaagaaaggttgcagcactcggagcgggcgaggcagggggctgaggagcggagccacaagctgcagcaggagctgggcgggaggatcggcgccctgcagctgcagctctcccagctgcacgagcaatgctcaagcctggagaaagaattgaaatcagaaaaagagcaaagacaggctcttcagcgcgaattacagcacgagaaagacacttcctctctactcaggatggagctgcaacaagtggaaggactgaaaaaggagttgcgggagcttcaggacgagaaggcagagctgcagaagatctgcgaggagcaggaacaagccctccaggaaatgggcctgcacctcagccagtccaagctgaagatggaagatataaaagaagtgaaccaggcactgaagggccacgcctggctgaaagatgacgaagcgacacactgtaggcagtgtgagaaggagttctccatttcccggagaaagcaccactgccggaactgtggccacatcttctgcaacacctgctccagcaacgagctggccctgccctcctaccccaagccggtgcgagtgtgcgacagctgccacaccctgctcctgcagcgctgctcctccacggcctcctgaacgtccgtcctcaggagcacagcctcacggacagtgccaaaccctgtgggtctccaggggcttgggaaatgtgttctttcccaagagaatcaaaggaaagaatcaaatttcttgcccggtcactggcactccagaagacagcgtgccggaaccggcagctctcacctttctgtgacttgttcggaattaactcctctggatggaaacttccatcttacttggttacatcacggctctggttcagatacaacttcatgattttgctactatcatttttcacttttcaaagaatttaacctattttacagcagttcagttctgctagtgagtagttttcctctcctaccttccttctaaaaacctgattcatgcacagcgtttgacacacatggagtctgccagtgtgccttctctgcttcagacaagagatctgccatttcatgcccttgtgactacctatcattggccctgcaataaaatcatttatttttcaaaaaaaaaaa

SEQ ID NO: 660694 - DNA, 580 bp, Homo sapiens
cgtacataagcgcgtactggtagctgggactacaggcgcccgcacacgcccagctaattttttttttggtatttttagtaaagatagggtttcactgtcctagccaggatggtctcaatctcctgaccccgtgatccgcccgcttcggcctcccaaagtgctgggattacaggtgtgagccactgcgcccggcccagagtccacatctttaaaatgagaacataggataagacgattgccaaagtgtctaggtttcgatgtactgtttctgggggttaaatatagtacaaacattaccattttcttaaaaccactgagaattctcattctaagacactcacatttaagagcagagagtgcagcacgattaacatgcttgcatttagagtctgtccaatacactgtgatcttagaccatgaactcaatttccttaccctgcaaaacgaggtttcgcatgcctgtcttcaccgggcagagaggggcaaagtgaaagcctttagataactcttaagggaagacaagacgccgtgcaaattctaagcaggattaggacaaagctctctgcatacaaaggtaaga

SEQ ID NO: 660695 - DNA, 347 bp, Homo sapiens
gcgcactaggcatagcatctgatttaatagaactataagtctgtgaataagccttagtgttcccgactggtacttcggtcacagcatctctagagaacagacttgcagcttagataaacactaaaggcaaaatagacgcttagctgctgatctacagagaactacttgtaattaaaagatttcacttcatagcaaactggtgttgtaaactattgcagtagctggaacttcttagggtaaccagcattaatgggagaagtgaatcacaaggaaataaagatgagtaaaagcaaagatgatgctcctcacgaactggagagccagtatatcttacgtctgcctccaga

SEQ ID NO: 660696 - DNA, 2523 bp, Homo sapiens
gccccggcgtccaggtagggggctgtggcctctagggatcagggactacttacctgcgaatcccggttgcccgcccgccagcacgtccgttccctaagcagaccgcctggcctcctgcctgacccgtcttctcaccgttgcccggagtctgacctccccacgcttagtccactaacgaagctatccctgctcctgccccacagcttctaagtgccagatgatggaggagcgtgccaacctgatgcacatgatgaaactcagcatcaaggtgttgctccagtcggctctgagcctgggccgcagcctggatgcggaccatgcccccttgcagcagttctttgtagtgatggagcactgcctcaaacatgggctgaaagttaagaagagttttattggccaaaataaatcattctttggtcctttggagctggtggagaaactttgtccagaagcatcagatatagcgactagtgtcagaaatcttccagaattaaagacagctgtgggaagaggccgagcgtggctttatcttgcactcatgcaaaagaaactggcagattatctgaaagtgcttatagacaataaacatctcttaagcgagttctatgagcctgaggctttaatgatggaggaagaagggatggtgattgttggtctgctggtgggactcaatgttctcgatgccaatctctgcttgaaaggagaagacttggattctcaggttggagtaatagatttttccctctaccttaaggatgtgcaggatcttgatggtggcaaggagcatgaaagaattactgatgtccttgatcaaaaaaattatgtggaagaacttaaccggcacttgagctgcacagttggggatcttcaaaccaagatagatggcttggaaaagactaactcaaagcttcaagaagagctttcagctgcaacagaccgaatttgctcacttcaagaagaacagcagcagttaagagaacaaaatgaattaattcgagaaagaagtgaaaagagtgtagagataacaaaacaggataccaaagttgagctggagacttacaagcaaactcggcaaggtctggatgaaatgtacagtgatgtgtggaagcagctaaaagaggagaagaaagtccggttggaactggaaaaagaactggagttacaaattggaatgaaaaccgaaatggaaattgcaatgaagttactggaaaaggacacccacgagaagcaggacacactagttgccctccgccagcagctggaagaagtcaaagcgattaatttacagatgtttcacaaagctcagaatgcagagagcagtttgcagcagaagaatgaagccatcacatcctttgaaggaaaaaccaaccaagttatgtccagcatgaaacaaatggaagaaaggttgcagcactcggagcgggcgaggcagggggctgaggagcggagccacaagctgcagcaggagctgggcgggaggatcggcgccctgcagctgcagctctcccagctgcacgagcaatgctcaagcctggagaaagaattgaaatcagaaaaagagcaaagacaggctcttcagcgcgaattacagcacgagaaagacacttcctctctactcaggatggagctgcaacaagtggaaggactgaaaaaggagttgcgggagcttcaggacgagaaggcagagctgcagaagatctgcgaggagcaggaacaagccctccaggaaatgggcctgcacctcagccagtccaagctgaagatggaagatataaaagaagtgaaccaggcactgaagggccacgcctggctgaaagatgacgaagcgacacactgtaggcagtgtgagaaggagttctccatttcccggagaaagcaccactgccggaactgtggccacatcttctgcaacacctgctccagcaacgagctggccctgccctcctaccccaagccggtgcgagtgtgcgacagctgccacaccctgctcctgcagcgctgctcctccacggcctcctgaacgtccgtcctcaggagcacagcctcacggacagtgccaaaccctgtgggtctccaggggcttgggaaatgtgttctttcccaagagaatcaaaggaaagaatcaaatttcttgcccggtcactggcactccagaagacagcgtgccggaaccggcagctctcacctttctgtgacttgttcggaattaactcctctggatggaaacttccatcttacttggttacatcacggctctggttcagatacaacttcatgattttgctactatcatttttcacttttcaaagaatttaacctattttacagcagttcagttctgctagtgagtagttttcctctcctaccttccttctaaaaacctgattcatgcacagcgtttgacacacatggagtctgccagtgtgccttctctgcttcagacaagagatctgccatttcatgcccttgtgactacctatcattggccctgcaataaaatcatttatttttcaaaaaaaaaaa

SEQ ID NO: 660697 - DNA, 341 bp, Homo sapiens
actgactattcaagaacacaccgggtcacctcatcattgactgctagagacacaactactgtctcctcctggctgatgccaaggctgcctttctgcacctcaagctcctcggtactcaccattgatgggtcaatggccgcgatatttggttcccatggacctggggcatatgtatcactatggcaacagttatacatgcttagtgcagataccgggtgtaaagacgataaccatcagatcctacttcccagagatagagagaaccggtgagcctgacgaacctgaaggaatcggccggctgacgggtgctgataccactgactataccagaacacaccggg

SEQ ID NO: 660698 - DNA, 4035 bp, Homo sapiens
aagcttgcggccgcggggctgggcggcggggacagcggggacggcacggcgcgcgcagcttctaagtgccagatgatggaggagcgtgccaacctgatgcacatgatgaaactcagcatcaaggtgttgctccagtcggctctgagcctgggccgcagcctggatgcggaccatgcccccttgcagcagttctttgtagtgatggagcactgcctcaaacatgggctgaaagttaagaagagttttattggccaaaataaatcattctttggtcctttggagctggtggagaaactttgtccagaagcatcagatatagcgactagtgtcagaaatcttccagaattaaagacagctgtgggaagaggccgagcgtggctttatcttgcactcatgcaaaagaaactggcagattatctgaaagtgcttatagacaataaacatctcttaagcgagttctatgagcctgaggctttaatgatggaggaagaagggatggtgattgttggtctgctggtgggactcaatgttctcgatgccaatctctgcttgaaaggagaagacttggattctcaggttggagtaatagatttttccctctaccttaaggatgtgcaggatcttgatggtggcaaggagcatgaaagaattactgatgtccttgatcaaaaaaattatgtggaagaacttaaccggcacttgagctgcacagttggggatcttcaaaccaagatagatggcttggaaaagactaactcaaagcttcaagaagagctttcagctgcaacagaccgaatttgctcacttcaagaagaacagcagcagttaagagaacaaaatgaattaattcgagaaagaagtgaaaagagtgtagagataacaaaacaggataccaaagttgagctggagacttacaagcaaactcggcaaggtctggatgaaatgtacagtgatgtgtggaagcagctaaaagaggagaagaaagtccggttggaactggaaaaagaactggagttacaaattggaatgaaaaccgaaatggaaattgcaatgaagttactggaaaaggacacccacgagaagcaggacacactagttgccctccgccagcagctggaagaagtcaaagcgattaatttacagatgtttcacaaagctcagaatgcagagagcagtttgcagcagaagaatgaagccatcacatcctttgaaggaaaaaccaaccaagttatgtccagcatgaaacaaatggaagaaaggttgcagcactcggagcgggcgaggcagggggctgaggagcggagccacaagctgcagcaggagctgggcgggaggatcggcgccctgcagctgcagctctcccagctgcacgagcaatgctcaagcctggagaaagaattgaaatcagaaaaagagcaaagacaggctcttcagcgcgaattacagcacgagaaagacacttcctctctactcaggatggagctgcaacaagtggaaggactgaaaaaggagttgcgggagcttcaggacgagaaggcagagctgcagaagatctgcgaggagcaggaacaagccctccaggaaatgggcctgcacctcagccagtccaagctgaagatggaagatataaaagaagtgaaccaggcactgaaggtactgccttgctaagaaccacttctttgctgtcagcttgtgctgactgcccgtgtgctcgtacgtttaagtatcccaacagtcaggtgagagcgtgtggttgaggcagtggtgatgacgtattgacagagaagccaaacgctgctcagaaacgtgtccctcggctgagggcgatgctgacaggtggccgaagctgagcctaggtcttccgactccagttcctccaccatcagctgtgctttcaaaataggcctgatgggcattccctaagggggaagcaggtggcggagaggagggacccgcggatatctttaaacagtggaaaacaggcccttctgttgaagtgaggggccagaggccagccagccccactgcagtgccctgtgccattgctagggaccactcaagccaagccctgagttgggccaggtttccgcaccctggtggggagggcagaatgacacattccaccgaagagcaggagtttgcaggtggcccggtgtgggtgcgggtgccaggctgagctgcagggcggagagtgtgggagaggaggcagacattcgggggcacggcagcctggccttcaagacagccttgcctgcaggagcaccccgcttcggcctcagctgtgccgtggcagcaatgcaaaagcagtccctttgcacactgttccacgtggtgcagagcagggaccctgatgtctctgggcatctaacttccaagtgccaggtcaggggcagcaactaacagcagccgggacttctaggtaatatcagtttcacagcatcagaggatagaaatcataaaacaggactctagagccgccagagctctttgatgtcaggatgaatgtcctgggcacacactggcagccccaagggtatatggctctagctcagtctgtgaggatctatttgtcagcaagaaaatcttgtccagcagatgttaacaggccagaaaagtacctcatgcctttgacttctctggaacaccccagtccctaagcccaaataaatcacaggtgctgcttcgccccgagaaagccctctgaggggccacctttcaaagcctcagccgcctcccctgtggaatggagtccgtgtgctccccagggctggtgaagaatcagggctttggcccgcacggagaagggcttcctcaggcctgtgggacgcagtgcccgctgtcagtcaccttctgtctctccacaaggatcagcgtcagcaagtgtcttagtctcactcagatttggcccttcttccgcgcctgccagttcagctagcacttcggccagtgtctcaggcagggtctagggttgcaggcaccagaagctcgctctgcttacttcagccaaagggaactgattgaaagtgggagtgtgcctgagtgagcaggtgctggagaccgcctggaggccccagggcagcctgcagaggccaagaggtggagcacggagctaggatgcagaaatcccggctgcggccagacggggaaagagccccttgatgacagtcctgtgaggccccatctgatggagaaacagtgcctcactaggaaacaggtgctatgagggacaatggatgtggccagaacgcagctacccactcatcaggggcttagacagaaagtggattctagaatgtcctttcctcttcagggccacgcctggctgaaagatgacgaagcgacacactgtaggcagtgtgagaaggagttctccatttcccggagaaagcaccactgccggaactgtggccacatcttctgcaacacctgctccagcaacgagctggccctgccctcctaccccaagccggtgcgagtgtgcgacagctgccacaccctgctcctgcagcgctgctcctccacggcctcctgaacgtccgtcctcaggagcacagcctcacggacagtgccaaaccctgtgggtctccaggggcttgggaaatgtgttctttcccaagagaatcaaaggaaagaatcaaatttcttgcccggtcactggcactccagaagacagcgtgccggaaccggcagctctcacctttctgtgacttgttcggaattaactcctctggatggaaacttccatcttacttggttacatcacggctctggttcagatacaacttcatgattttgctactatcatttttcacttttcaaagaatttaacctattttacagcagttcagttctgctagtgagtagttttcctctcctaccttccttctaaaaacctgattcatgcacagcgtttgacacacatggagtctgccagtgtgccttctctgcttcagacaagagatctgccatttcatgcccttgtgactacctatcattggccctgcaataaaatcatttatttttcaaaaaaaaaaa

SEQ ID NO: 660699 - DNA, 296 bp, Homo sapiens
tgatctagaggatcccatctcaggcaggacgatacggtaagcacgtattttttttggagacaggatctcacggtggcccaagcgggagtgcaggggcacgatctcagctcaggggagcctcgacctccggggttcaagcgatgcttccacctcagcctaagaccaatctccggggttcaagtgatccctctgcttcaggctcccgggtagtggggactatgggtgtgtgccgccatttctcagcttatttttaaaatttttcgtgtagaagaacaagttctcactatagggctcaa

SEQ ID NO: 660700 - DNA, 105 bp, Homo sapiens
  misc_feature (86)..(86): n is a, c, g, or t
  misc_feature (96)..(96): n is a, c, g, or t
ggtactgctacctagtgggtcttggggaccttcgaaatcgccgccgctctcactatggcttgagaacaaaaaaacaccctacatancggttttcgngggccctcg

SEQ ID NO: 660701 - DNA, 3969 bp, Homo sapiens
aagcttgcggccgcggggctgggcggcggggacagcggggacggcacggcgcgcgcagcttctaagtgccagatgatggaggagcgtgccaacctgatgcacatgatgaaactcagcatcaaggtgttgctccagtcggctctgagcctgggccgcagcctggatgcggaccatgcccccttgcagcagttctttgtagtgatggagcactgcctcaaacatgggctgaaagttaagaagagttttattggccaaaataaatcattctttggtcctttggagctggtggagaaactttgtccagaagcatcagatatagcgactagtgtcagaaatcttccagaattaaagacagctgtgggaagaggccgagcgtggctttatcttgcactcatgcaaaagaaactggcagattatctgaaagtgcttatagacaataaacatctcttaagcgagttctatgagcctgaggctttaatgatggaggaagaagggatggtgattgttggtctgctggtgggactcaatgttctcgatgccaatctctgcttgaaaggagaagacttggattctcaggttggagtaatagatttttccctctaccttaaggatgtgcaggatcttgatggtggcaaggactgcacagttggggatcttcaaaccaagatagatggcttggaaaagactaactcaaagcttcaagaagagctttcagctgcaacagaccgaatttgctcacttcaagaagaacagcagcagttaagagaacaaaatgaattaattcgagaaagaagtgaaaagagtgtagagataacaaaacaggataccaaagttgagctggagacttacaagcaaactcggcaaggtctggatgaaatgtacagtgatgtgtggaagcagctaaaagaggagaagaaagtccggttggaactggaaaaagaactggagttacaaattggaatgaaaaccgaaatggaaattgcaatgaagttactggaaaaggacacccacgagaagcaggacacactagttgccctccgccagcagctggaagaagtcaaagcgattaatttacagatgtttcacaaagctcagaatgcagagagcagtttgcagcagaagaatgaagccatcacatcctttgaaggaaaaaccaaccaagttatgtccagcatgaaacaaatggaagaaaggttgcagcactcggagcgggcgaggcagggggctgaggagcggagccacaagctgcagcaggagctgggcgggaggatcggcgccctgcagctgcagctctcccagctgcacgagcaatgctcaagcctggagaaagaattgaaatcagaaaaagagcaaagacaggctcttcagcgcgaattacagcacgagaaagacacttcctctctactcaggatggagctgcaacaagtggaaggactgaaaaaggagttgcgggagcttcaggacgagaaggcagagctgcagaagatctgcgaggagcaggaacaagccctccaggaaatgggcctgcacctcagccagtccaagctgaagatggaagatataaaagaagtgaaccaggcactgaaggtactgccttgctaagaaccacttctttgctgtcagcttgtgctgactgcccgtgtgctcgtacgtttaagtatcccaacagtcaggtgagagcgtgtggttgaggcagtggtgatgacgtattgacagagaagccaaacgctgctcagaaacgtgtccctcggctgagggcgatgctgacaggtggccgaagctgagcctaggtcttccgactccagttcctccaccatcagctgtgctttcaaaataggcctgatgggcattccctaagggggaagcaggtggcggagaggagggacccgcggatatctttaaacagtggaaaacaggcccttctgttgaagtgaggggccagaggccagccagccccactgcagtgccctgtgccattgctagggaccactcaagccaagccctgagttgggccaggtttccgcaccctggtggggagggcagaatgacacattccaccgaagagcaggagtttgcaggtggcccggtgtgggtgcgggtgccaggctgagctgcagggcggagagtgtgggagaggaggcagacattcgggggcacggcagcctggccttcaagacagccttgcctgcaggagcaccccgcttcggcctcagctgtgccgtggcagcaatgcaaaagcagtccctttgcacactgttccacgtggtgcagagcagggaccctgatgtctctgggcatctaacttccaagtgccaggtcaggggcagcaactaacagcagccgggacttctaggtaatatcagtttcacagcatcagaggatagaaatcataaaacaggactctagagccgccagagctctttgatgtcaggatgaatgtcctgggcacacactggcagccccaagggtatatggctctagctcagtctgtgaggatctatttgtcagcaagaaaatcttgtccagcagatgttaacaggccagaaaagtacctcatgcctttgacttctctggaacaccccagtccctaagcccaaataaatcacaggtgctgcttcgccccgagaaagccctctgaggggccacctttcaaagcctcagccgcctcccctgtggaatggagtccgtgtgctccccagggctggtgaagaatcagggctttggcccgcacggagaagggcttcctcaggcctgtgggacgcagtgcccgctgtcagtcaccttctgtctctccacaaggatcagcgtcagcaagtgtcttagtctcactcagatttggcccttcttccgcgcctgccagttcagctagcacttcggccagtgtctcaggcagggtctagggttgcaggcaccagaagctcgctctgcttacttcagccaaagggaactgattgaaagtgggagtgtgcctgagtgagcaggtgctggagaccgcctggaggccccagggcagcctgcagaggccaagaggtggagcacggagctaggatgcagaaatcccggctgcggccagacggggaaagagccccttgatgacagtcctgtgaggccccatctgatggagaaacagtgcctcactaggaaacaggtgctatgagggacaatggatgtggccagaacgcagctacccactcatcaggggcttagacagaaagtggattctagaatgtcctttcctcttcagggccacgcctggctgaaagatgacgaagcgacacactgtaggcagtgtgagaaggagttctccatttcccggagaaagcaccactgccggaactgtggccacatcttctgcaacacctgctccagcaacgagctggccctgccctcctaccccaagccggtgcgagtgtgcgacagctgccacaccctgctcctgcagcgctgctcctccacggcctcctgaacgtccgtcctcaggagcacagcctcacggacagtgccaaaccctgtgggtctccaggggcttgggaaatgtgttctttcccaagagaatcaaaggaaagaatcaaatttcttgcccggtcactggcactccagaagacagcgtgccggaaccggcagctctcacctttctgtgacttgttcggaattaactcctctggatggaaacttccatcttacttggttacatcacggctctggttcagatacaacttcatgattttgctactatcatttttcacttttcaaagaatttaacctattttacagcagttcagttctgctagtgagtagttttcctctcctaccttccttctaaaaacctgattcatgcacagcgtttgacacacatggagtctgccagtgtgccttctctgcttcagacaagagatctgccatttcatgcccttgtgactacctatcattggccctgcaataaaatcatttatttttcaaaaaaaaaaa

SEQ ID NO: 660702 - DNA, 133 bp, Homo sapiens
gaccaacactcctatagacagtagtaaaaccttttcatcattcgcccagaatgattaggctttcatagacatacatacgcacacacacacacacacacacacgctgtccttatactgatctataggagtggtg

SEQ ID NO: 660703 - DNA, 4123 bp, Homo sapiens
aagcttgcggccgcggggctgggcggcggggacagcggggacggcacggcgcgcgcagcttctaagtgccagatgatggaggagcgtgccaacctgatgcacatgatgaaactcagcatcaaggtgttgctccagtcggctctgagcctgggccgcagcctggatgcggaccatgcccccttgcagcagttctttgtagtgatggagcactgcctcaaacatgggctgaaagttaagaagagttttattggccaaaataaatcattctttggtcctttggagctggtggagaaactttgtccagaagcatcagatatagcgactagtgtcagaaatcttccagaattaaagacagctgtgggaagaggccgagcgtggctttatcttgcactcatgcaaaagaaactggcagattatctgaaagtgcttatagacaataaacatctcttaagcgagttctatgagcctgaggctttaatgatggaggaagaagggatggtgattgttggtctgctggtgggactcaatgttctcgatgccaatctctgcttgaaaggagaagacttggattctcaggttggagtaatagatttttccctctaccttaaggatgtgcaggatcttgatggtggcaaggagcatgaaagaattactgatgtccttgatcaaaaaaattatgtggaagaacttaaccggcacttgagctgcacagttggggatcttcaaaccaagatagatggcttggaaaagactaactcaaagcttcaagaagagctttcagctgcaacagaccgaatttgctcacttcaagaagaacagcagcagttaagagaacaaaatgaattaattcgagaaagaagtgaaaagagtgtagagataacaaaacaggataccaaagttgagctggagacttacaagcaaactcggcaaggtctggatgaaatgtacagtgatgtgtggaagcagctaaaagaggagaagaaagtccggttggaactggaaaaagaactggagttacaaattggaatgaaaaccgaaatggaaattgcaatgaagttactggaaaaggacacccacgagaagcaggacacactagttgccctccgccagcagctggaagaagtcaaagcgattaatttacagatgtttcacaaagctcagaatgcagagagcagtttgcagcagaagaatgaagccatcacatcctttgaaggaaaaaccaaccaagttatgtccagcatgaaacaaatggaagaaaggttgcagcactcggagcgggcgaggcagggggctgaggagcggagccacaagctgcagcaggagctgggcgggaggatcggcgccctgcagctgcagctctcccagctgcacgagcaatgctcaagcctggagaaagaattgaaatcagaaaaagagcaaagacaggctcttcagcgcgaattacagcacgagaaagacacttcctctctactcaggatggagctgcaacaagtggaaggactgaaaaaggagttgcgggagcttcaggacgagaaggcagagctgcagaagatctgcgaggagcaggaacaagccctccaggaaatgggcctgcacctcagccagtccaagctgaagatggaagatataaaagaagtgaaccaggcactgaaggtactgccttgctaagaaccacttctttgctgtcagcttgtgctgactgcccgtgtgctcgtacgtttaagtatcccaacagtcaggtgagagcgtgtggttgaggcagtggtgatgacgtattgacagagaagccaaacgctgctcagaaacgtgtccctcggctgagggcgatgctgacaggtggccgaagctgagcctaggtcttccgactccagttcctccaccatcagctgtgctttcaaaataggcctgatgggcattccctaagggggaagcaggtggcggagaggagggacccgcggatatctttaaacagtggaaaacaggcccttctgttgaagtgaggggccagaggccagccagccccactgcagtgccctgtgccattgctagggaccactcaagccaagccctgagttgggccaggtttccgcaccctggtggggagggcagaatgacacattccaccgaagagcaggagtttgcaggtggcccggtgtgggtgcgggtgccaggctgagctgcagggcggagagtgtgggagaggaggcagacattcgggggcacggcagcctggccttcaagacagccttgcctgcaggagcaccccgcttcggcctcagctgtgccgtggcagcaatgcaaaagcagtccctttgcacactgttccacgtggtgcagagcagggaccctgatgtctctgggcatctaacttccaagtgccaggtcaggggcagcaactaacagcagccgggacttctaggtaatatcagtttcacagcatcagaggatagaaatcataaaacaggactctagagccgccagagctctttgatgtcaggatgaatgtcctgggcacacactggcagccccaagggtatatggctctagctcagtctgtgaggatctatttgtcagcaagaaaatcttgtccagcagatgttaacaggccagaaaagtacctcatgcctttgacttctctggaacaccccagtccctaagcccaaataaatcacaggtgctgcttcgccccgagaaagccctctgaggggccacctttcaaagcctcagccgcctcccctgtggaatggagtccgtgtgctccccagggctggtgaagaatcagggctttggcccgcacggagaagggcttcctcaggcctgtgggacgcagtgcccgctgtcagtcaccttctgtctctccacaaggatcagcgtcagcaagtgtcttagtctcactcagatttggcccttcttccgcgcctgccagttcagctagcacttcggccagtgtctcaggcagggtctagggttgcaggcaccagaagctcgctctgcttacttcagccaaagggaactgattgaaagtgggagtgtgcctgagtgagcaggtgctggagaccgcctggaggccccagggcagcctgcagaggccaagaggtggagcacggagctaggatgcagaaatcccggctgcggccagacggggaaagagccccttgatgacagtcctgtgaggccccatctgatggagaaacagtgcctcactaggaaacaggagggccacgcctggctgaaagatgacgaagcgacacactgtaggcagtgtgagaaggagttctccatttcccggagaaagcctagctctgtggaagagaggaagccacagctaccccacccgctccccaacccgagtttcaggcagtgccttgcagtaagctcagagctagaaaccacgtcctgaggctgcctttgagatcacatgtgtctacaaggcctggctgtccccatctgtggagtcagaagcagaggctgcacagcaccactgccggaactgtggccacatcttctgcaacacctgctccagcaacgagctggccctgccctcctaccccaagccggtgcgagtgtgcgacagctgccacaccctgctcctgcagcgctgctcctccacggcctcctgaacgtccgtcctcaggagcacagcctcacggacagtgccaaaccctgtgggtctccaggggcttgggaaatgtgttctttcccaagagaatcaaaggaaagaatcaaatttcttgcccggtcactggcactccagaagacagcgtgccggaaccggcagctctcacctttctgtgacttgttcggaattaactcctctggatggaaacttccatcttacttggttacatcacggctctggttcagatacaacttcatgattttgctactatcatttttcacttttcaaagaatttaacctattttacagcagttcagttctgctagtgagtagttttcctctcctaccttccttctaaaaacctgattcatgcacagcgtttgacacacatggagtctgccagtgtgccttctctgcttcagacaagagatctgccatttcatgcccttgtgactacctatcattggccctgcaataaaatcatttatttttcaaaaaaaaaaa

SEQ ID NO: 660704 - DNA, 4470 bp, Homo sapiens
aagcttgcggccgcggggctgggcggcggggacagcggggacggcacggcgcgcgcagcttctaagtgccagatgatggaggagcgtgccaacctgatgcacatgatgaaactcagcatcaaggtgttgctccagtcggctctgagcctgggccgcagcctggatgcggaccatgcccccttgcagcagttctttgtagtgatggagcactgcctcaaacatgggctgaaagttaagaagagttttattggccaaaataaatcattctttggtcctttggagctggtggagaaactttgtccagaagcatcagatatagcgactagtgtcagaaatcttccagaattaaagacagctgtgggaagaggccgagcgtggctttatcttgcactcatgcaaaagaaactggcagattatctgaaagtgcttatagacaataaacatctcttaagcgagttctatgagcctgaggctttaatgatggaggaagaagggatggtgattgttggtctgctggtgggactcaatgttctcgatgccaatctctgcttgaaaggagaagacttggattctcaggttggagtaatagatttttccctctaccttaaggatgtgcaggatcttgatggtggcaaggagcatgaaagaattactgatgtccttgatcaaaaaaattatgtggaagaacttaaccggcacttgagctgcacagttggggatcttcaaaccaagatagatggcttggaaaagactaactcaaagcttcaagaagagctttcagctgcaacagaccgaatttgctcacttcaagaagaacagcagcagttaagagaacaaaatgaattaattcgagaaagaagtgaaaagagtgtagagataacaaaacaggataccaaagttgagctggagacttacaagcaaactcggcaaggtctggatgaaatgtacagtgatgtgtggaagcagctaaaagaggagaagaaagtccggttggaactggaaaaagaactggagttacaaattggaatgaaaaccgaaatggaaattgcaatgaagttactggaaaaggacacccacgagaagcaggacacactagttgccctccgccagcagctggaagaagtcaaagcgattaatttacagatgtttcacaaagctcagaatgcagagagcagtttgcagcagaagaatgaagccatcacatcctttgaaggaaaaaccaaccaagttatgtccagcatgaaacaaatggaagaaaggttgcagcactcggagcgggcgaggcagggggctgaggagcggagccacaagctgcagcaggagctgggcgggaggatcggcgccctgcagctgcagctctcccagctgcacgagcaatgctcaagcctggagaaagaattgaaatcagaaaaagagcaaagacaggctcttcagcgcgaattacagcacgagaaagacacttcctctctactcaggatggagctgcaacaagtggaaggactgaaaaaggagttgcgggagcttcaggacgagaaggcagagctgcagaagatctgcgaggagcaggaacaagccctccaggaaatgggcctgcacctcagccagtccaagctgaagatggaagatataaaagaagtgaaccaggcactgaaggtactgccttgctaagaaccacttctttgctgtcagcttgtgctgactgcccgtgtgctcgtacgtttaagtatcccaacagtcaggtgagagcgtgtggttgaggcagtggtgatgacgtattgacagagaagccaaacgctgctcagaaacgtgtccctcggctgagggcgatgctgacaggtggccgaagctgagcctaggtcttccgactccagttcctccaccatcagctgtgctttcaaaataggcctgatgggcattccctaagggggaagcaggtggcggagaggagggacccgcggatatctttaaacagtggaaaacaggcccttctgttgaagtgaggggccagaggccagccagccccactgcagtgccctgtgccattgctagggaccactcaagccaagccctgagttgggccaggtttccgcaccctggtggggagggcagaatgacacattccaccgaagagcaggagtttgcaggtggcccggtgtgggtgcgggtgccaggctgagctgcagggcggagagtgtgggagaggaggcagacattcgggggcacggcagcctggccttcaagacagccttgcctgcaggagcaccccgcttcggcctcagctgtgccgtggcagcaatgcaaaagcagtccctttgcacactgttccacgtggtgcagagcagggaccctgatgtctctgggcatctaacttccaagtgccaggtcaggggcagcaactaacagcagccgggacttctaggtaatatcagtttcacagcatcagaggatagaaatcataaaacaggactctagagccgccagagctctttgatgtcaggatgaatgtcctgggcacacactggcagccccaagggtatatggctctagctcagtctgtgaggatctatttgtcagcaagaaaatcttgtccagcagatgttaacaggccagaaaagtacctcatgcctttgacttctctggaacaccccagtccctaagcccaaataaatcacaggtgctgcttcgccccgagaaagccctctgaggggccacctttcaaagcctcagccgcctcccctgtggaatggagtccgtgtgctccccagggctggtgaagaatcagggctttggcccgcacggagaagggcttcctcaggcctgtgggacgcagtgcccgctgtcagtcaccttctgtctctccacaaggatcagcgtcagcaagtgtcttagtctcactcagatttggcccttcttccgcgcctgccagttcagctagcacttcggccagtgtctcaggcagggtctagggttgcaggcaccagaagctcgctctgcttacttcagccaaagggaactgattgaaagtgggagtgtgcctgagtgagcaggtgctggagaccgcctggaggccccagggcagcctgcagaggccaagaggtggagcacggagctaggatgcagaaatcccggctgcggccagacggggaaagagccccttgatgacagtcctgtgaggccccatctgatggagaaacagtgcctcactaggaaacaggtgctatgagggacaatggatgtggccagaacgcagctacccactcatcaggggcttagacagaaagtggattctagaatgtcctttcctcttcagggccacgcctggctgaaagatgacgaagcgacacactgtaggcagtgtgagaaggagttctccatttcccggagaaagcaccactgccggaactgtggccacatcttctgcaacacctgctccagcaacgagctggccctgccctcctaccccaagccggtgcgagtgtgcgacagctgccacaccctgctcctgcagcgctgctcctccacggcctcctgaacgtccgtcctcaggagcacagcctcacggacagtgccaaaccctgtgggtctccaggggcttgggaaatgtgttctttcccaagagaatcaaaggaaagaatcaaatttcttgcccggtcactggcactccagaagacagcgtgccggaaccggcagctctcacctttctgtgacttgttcggaattaactcctctggatggaaacttccatcttacttggttacatcacggctctggttcagatacaacttcatgattttgctactatcatttttcacttttcaaagaatttaacctattttacagcagttcagttctgctagtgagtagttttcctctcctaccttccttctaaaaacctgattcatgcacagcgtttgacacacatggagtctgccagtgtgccttctctgcttcagacaagagatctgccatttcatgcccttgtgactacctatcattggccctgcaataaaatcatttatttttcaaaaaaaaaaattaaaaaagaaaaaagaaaaaaaaaaaaaaaaaaaaagggggggggggcgcaaaaatgtaacccccgcgggggcgcacctgtaagcgcacaccagcgtttgtgggaacaaaaggaggggcgccccgaaagagaggaggcgtgattaatatgtaagcacgaacagaggtgggcccgaggggttaaaaaagcaccgtgtaacggcagtggggggaagaaacaacggttgttgcttgtgggagcatctttgtgtaggaagacaccccattcgttgggggggtgcaccgttgttgggaagcaccctctccgttagaaagtattaagcggcagtgcggggaaatataaacgttgacgtgtgattttggtgtgacacccacgatcgttataggtaggcggtgaaaaaatttggtggcccaagtagttttttaagaatttac

SEQ ID NO: 660705 - DNA, 3955 bp, Homo sapiens
aagcttgcggccgcggggctgggcggcggggacagcggggacggcacggcgcgcgcagcttctaagtgccagatgatggaggagcgtgccaacctgatgcacatgatgaaactcagcatcaaggtgttgctccagtcggctctgagcctgggccgcagcctggatgcggaccatgcccccttgcagcagttctttgtagtgatggagcactgcctcaaacatgggctgaaagttaagaagagttttattggccaaaataaatcattctttggtcctttggagctggtggagaaactttgtccagaagcatcagatatagcgactagtgtcagaaatcttccagaattaaagacagctgtgggaagaggccgagcgtggctttatcttgcactcatgcaaaagaaactggcagattatctgaaagtgcttatagacaataaacatctcttaagcgagttctatgagcctgaggctttaatgatggaggaagaagggatggtgattgttggtctgctggtgggactcaatgttctcgatgccaatctctgcttgaaaggagaagacttggattctcaggttggagtaatagatttttccctctaccttaaggatgtgcaggatcttgatggtggcaaggagcatgaaagaattactgatgtccttgatcaaaaaaattatgtggaagaacttaaccggcacttgagctgcacagttggggatcttcaaaccaagatagatggcttggaaaagactaactcaaagcttcaagaagagctttcagctgcaacagaccgaatttgctcacttcaagaagaacagcagcagttaagagaacaaaatgaattaattcgagaaagaagtgaaaagagtgtagagataacaaaacaggataccaaagttgagctggagacttacaagcaaactcggcaaggtctggatgaaatgtacagtgatgtgtggaagcagctaaaagaggagaagaaagtccggttggaactggaaaaagaactggagttacaaattggaatgaaaaccgaaatggaaattgcaatgaagttactggaaaaggacacccacgagaagcaggacacactagttgccctccgccagcagctggaagaagtcaaagcgattaatttacagatgtttcacaaagctcagaatgcagagagcagtttgcagcagaagaatgaagccatcacatcctttgaaggaaaaaccaaccaagttatgtccagcatgaaacaaatggaagaaaggttgcagcactcggagcgggcgaggcagggggctgaggagcggagccacaagctgcagcaggagctgggcgggaggatcggcgccctgcagctgcagctctcccagctgcacgagcaatgctcaagcctggagaaagaattgaaatcagaaaaagagcaaagacaggctcttcagcgcgaattacagcacgagaaagacacttcctctctactcaggatggagctgcaacaagtggaaggactgaaaaaggagttgcgggagcttcaggacgagaaggcagagctgcagaagatctgcgaggagcaggaacaagccctccaggaaatgggcctgcacctcagccagtccaagctgaagatggaagatataaaagaagtgaaccaggcactgaaggtactgccttgctaagaaccacttctttgctgtcagcttgtgctgactgcccgtgtgctcgtacgtttaagtatcccaacagtcaggtgagagcgtgtggttgaggcagtggtgatgacgtattgacagagaagccaaacgctgctcagaaacgtgtccctcggctgagggcgatgctgacaggtggccgaagctgagcctaggtcttccgactccagttcctccaccatcagctgtgctttcaaaataggcctgatgggcattccctaagggggaagcaggtggcggagaggagggacccgcggatatctttaaacagtggaaaacaggcccttctgttgaagtgaggggccagaggccagccagccccactgcagtgccctgtgccattgctagggaccactcaagccaagccctgagttgggccaggtttccgcaccctggtggggagggcagaatgacacattccaccgaagagcaggagtttgcaggtggcccggtgtgggtgcgggtgccaggctgagctgcagggcggagagtgtgggagaggaggcagacattcgggggcacggcagcctggccttcaagacagccttgcctgcaggagcaccccgcttcggcctcagctgtgccgtggcagcaatgcaaaagcagtccctttgcacactgttccacgtggtgcagagcagggaccctgatgtctctgggcatctaacttccaagtgccaggtcaggggcagcaactaacagcagccgggacttctaggtaatatcagtttcacagcatcagaggatagaaatcataaaacaggactctagagccgccagagctctttgatgtcaggatgaatgtcctgggcacacactggcagccccaagggtatatggctctagctcagtctgtgaggatctatttgtcagcaagaaaatcttgtccagcagatgttaacaggccagaaaagtacctcatgcctttgacttctctggaacaccccagtccctaagcccaaataaatcacaggtgctgcttcgccccgagaaagccctctgaggggccacctttcaaagcctcagccgcctcccctgtggaatggagtccgtgtgctccccagggctggtgaagaatcagggctttggcccgcacggagaagggcttcctcaggcctgtgggacgcagtgcccgctgtcagtcaccttctgtctctccacaaggatcagcgtcagcaagtgtcttagtctcactcagatttggcccttcttccgcgcctgccagttcagctagcacttcggccagtgtctcaggcagggtctagggttgcaggcaccagaagctcgctctgcttacttcagccaaagggaactgattgaaagtgggagtgtgcctgagtgagcaggtgctggagaccgcctggaggccccagggcagcctgcagaggccaagaggtggagcacggagctaggatgcagaaatcccggctgcggccagacggggaaagagccccttgatgacagtcctgtgaggccccatctgatggagaaacagtgcctcactaggaaacaggtgctatgagggacaatggatgtggccagaacgcagctacccactcatcaggggcttagacagaaagtggattctagaatgtcctttcctcttcagggccacgcctggctgaaagatgacgaagcgacacactgtaggcagtgtgagaaggagttctccatttcccggagaaagcaccactgccggaactgtggccacatcttctgcaacacctgctccagcaacgagctggccctgccctcctaccccaagccggtgcgagtgtgcgacagctgccacaccctgctcctgcagcgctgctcctccacggcctcctgaacgtccgtcctcaggagcacagcctcacggacagtgccaaaccctgtgggtctccaggggcttgggaaatgtgttctttcccaagagaatcaaaggaaagaatcaaatttcttgcccggtcactggcactccagaagacagcgtgccggaaccggcagctctcacctttctgtgacttgttcggaattaactcctctggatggaaacttccatcttacttggttacatcacggctctggttcagatacaacttcatgattttgctactatcatttttcacttttcaaagaatttaacctattttacagcagttcagttctgctagtgagtagttttcctctcctaccttccttctaaaaacctgattcatgcacagcgtttgacacacatggagtctgccagctgctccgcgcgggatctcaa

SEQ ID NO: 660706 - DNA, 124 bp, Homo sapiens
  misc_feature (63)..(63): n is a, c, g, or t
tgctctagaggtcccgattatccccaacactgaacaaatagttagaaagttagagatttacangattttgtcctacaggaagtgaaaacctaaggccttactatagtgttgggcgataacatca

SEQ ID NO: 660707 - DNA, 2519 bp, Homo sapiens
aagcttgcggccgcggggctgggcggcggggacagcggggacggcacggcgcgcgcagcttctaagtgccagatgatggaggagcgtgccaacctgatgcacatgatgaaactcagcatcaaggtgttgctccagtcggctctgagcctgggccgcagcctggatgcggaccatgcccccttgcagcagttctttgtagtgatggagcactgcctcaaacatgggctgaaagttaagaagagttttattggccaaaataaatcattctttggtcctttggagctggtggagaaactttgtccagaagcatcagatatagcgactagtgtcagaaatcttccagaattaaagacagctgtgggaagaggccgagcgtggctttatcttgcactcatgcaaaagaaactggcagattatctgaaagtgcttatagacaataaacatctcttaagcgagttctatgagcctgaggctttaatgatggaggaagaagggatggtgattgttggtctgctggtgggactcaatgttctcgatgccaatctctgcttgaaaggagaagacttggattctcaggttggagtaatagatttttccctctaccttaaggatgtgcaggatcttgatggtggcaaggagcatgaaagaattactgatgtccttgatcaaaaaaattatgtggaagaacttaaccggcacttgagctgcacagttggggatcttcaaaccaagatagatggcttggaaaagactaactcaaagcttcaagaagagctttcagctgcaacagaccgaatttgctcacttcaagaagaacagcagcagttaagagaacaaaatgaattaattcgagaaagaagtgaaaagagtgtagagataacaaaacaggataccaaagttgagctggagacttacaagcaaactcggcaaggtctggatgaaatgtacagtgatgtgtggaagcagctaaaagaggagaagaaagtccggttggaactggaaaaagaactggagttacaaattggaatgaaaaccgaaatggaaattgcaatgaagttactggaaaaggacacccacgagaagcaggacacactagttgccctccgccagcagctggaagaagtcaaagcgattaatttacagatgtttcacaaagctcagaatgcagagagcagtttgcagcagaagaatgaagccatcacatcctttgaaggaaaaaccaaccaagttatgtccagcatgaaacaaatggaagaaaggttgcagcactcggagcgggcgaggcagggggctgaggagcggagccacaagctgcagcaggagctgggcgggaggatcggcgccctgcagctgcagctctcccagctgcacgagcaatgctcaagcctggagaaagaattgaaatcagaaaaagagcaaagacaggctcttcagcgcgaattacagcacgagaaagacacttcctctctactcaggatggagctgcaacaagtggaaggactgaaaaaggagttgcgggagcttcaggacgagaaggcagagctgcagaagatctgcgaggagcaggaacaagccctccaggaaatgggcctgcacctcagccagtccaagctgaagatggaagatataaaagaagtgaaccaggcactgaagggccacgcctggctgaaagatgacgaagcgacacactgtaggcagtgtgagaaggagttctccatttcccggagaaagcaccactgccggaactgtggccacatcttctgcaacacctgctccagcaacgagctggccctgccctcctaccccaagccggtgcgagtgtgcgacagctgccacaccctgctcctgcagcgctgctcctccacggcctcctgaacgtccgtcctcaggagcacagcctcacggacagtgccaaaccctgtgggtctccaggggcttgggaaatgtgttctttcccaagagaatcaaaggaaagaatcaaatttcttgcccggtcactggcactccagaagacagcgtgccggaaccggcagctctcacctttctgtgacttgttcggaattaactcctctggatggaaacttccatcttacttggttacatcacggctctggttcagatacaacttcatgattttgctactatcatttttcacttttcaaagaatttaacctattttacagcagttcagttctgctagtgagtagttttcctctcctaccttccttctaaaaacctgattcatgcacagcgtttgacacacatggagtctgccagtgtgccttctctgcttcagacaagagatctgccatttcatgcccttgtgactacctatcattggccctgcaataaaatcatttatttttcaaaaaaaaaaaggggggggctaaatttccccgggggccagttaccgcccgttttggcaaggcccaggggggataaaaagacgcggtaccggggagaacgccggctgggacccccgggggtgggaccccccaacggaaaagtgggccacgaga

SEQ ID NO: 660708 - DNA, 579 bp, Homo sapiens
aaaactccaaaatataactacgttttgaagcaaagtgaaaggtttctaaatgccagaattaccaaaagtcacgaaacacaaacagcaaataaagtgtaatgttacagctataacaactcacataaagtatgcagaaacaactaggaaacactgagaattttaaatctgattaaggagctagtagagattacccagcattcagctcaccatttgaaaccagccaaatgaatatgtgacaagtctcttttaaaaatcttgcactttgaaaaggaaatgtgttataagtgttactcaatctggaagttgcaatgagcttgacaatgtcaaaacatggatttagagattctcaatgaacctctaatgttttaccttcaataaaatctcttttcataaaaggaaaaaaaagattacccaaattctaccatcattttgccactgggattattttcctttcaaacaatttggatgaccattattattcctggacttgaatgtacacgattctcataaacccaatgtcacactaagtaaaactgcaaaaatcatatacgtcttataattaaagttattatttctttc

SEQ ID NO: 660709 - DNA, 733 bp, Homo sapiens
ttcatttggaggtgggcagatcacctgaggcaggagttgagaccagcctggccaacatggcaaaacctcatctctactaaaatgggaatatttcagattttggatatttggactggggatgctcaacctttaatatgtgcttaatatattatgcaacatgtatgtctgtatacaaacaaacacacatgtatattaaatataataagtaggtcctttatttttacctatatgttatactacctatgttttcattctttcctgcagatttgagcttctatcatgtatcatattctttcagcctgcatttctttaagcatttcttggagcacaggttttttggctaaaaaaatctctgagttcttctctagctgaaaatgtctttacttagctttcattttcttaaactgatacatattagatgtccatatcttcaggatacatgtgattttttgaagcattcatatcaagtgtaaagatcaaatcaaggtaattgagatatctatcaccttgaatattcatattttatttatgagaagaatatttgaattgctctcttctatagcttttatttttttatttatactttgactaaatgtagaattcaatgtagaattctatgtcgacagtttttttcagcatttgaattttatccattgtgaggaccatccatcatctttcatacttccctaattacaggctatttctgctatttagattcttcatttttcttaga

SEQ ID NO: 660710 - DNA, 679 bp, Homo sapiens
gctccgcgagaatcagctcaatgccgataggagatcaaccccgagatgctgaacaaatgtgctgtccctggctgggtggtcgcctgtgccagtggcagcttcgtggacagtgctggtgtgctgtgaagatggcagtctcgtgtgtgctctgtgtgccagctgcctgcctgctgctgctgctgctgcatgtttcccctcactggcccagcatgatgaacttcagtgaaaaatgcatgattgaagatgctgaatgtgtgacaatgaagttagtcctaaagtgtacttcatgaatgcagaccattgtggaattcctgtggcacaatcggacttattcacgcagtggccaataatcaatgacaaacttggcgatttgaggatggatcagttctgaaacagtttctatatctgaaacagatgaaaatgtcccctgaatgacatgagcaaaatgcttttgaaaatgaatgattgccatacaggcaagcccatgatgccgtggcacaggacaggccaatgtcgggtagatagaccatggtgaatttccattttattctgtttaacaacgttgtcatggccacctctatgaacttgcatggacgaatgccttttccggtgaaccatgttcgccagtttcagacgacaccctgctgattgacgctgccactggctgcacagaattcac

SEQ ID NO: 660711 - DNA, 160 bp, Homo sapiens
caatatgactcaagcattagctccagcaattgccagtggttgtctccatggcccgtgcatggattcgatgcagcttttatatagctgcttacactagggcagcaccatccaggggccatgaggataagcactgtctagtgacagcagccagtttctggac

SEQ ID NO: 660712 - DNA, 132 bp, Homo sapiens
  misc_feature (131)..(131): n is a, c, g, or t
ttacgactcgagctcggtaccggacagaatgcgtcggttcagctggaggtattttctgcggtcatcgaacggtggctcgcatcggacggggtagacagagactgccagcataccccgtatgggatctgatng

SEQ ID NO: 660713 - DNA, 233 bp, Homo sapiens
tgctgggattataggcatgagccgtcgcacccggccagttacttctttaaaaaaataatttttcgttgtggtacaatacatattacattaaaattaccattttaacatcccccccccccctttttttttttgggcggacagcgtctctcacctggggcgggagtgcaggggtgctatcacagttcactggagcctcaacctccggggctaaagtaatcctcctatttaagcct

SEQ ID NO: 660714 - DNA, 411 bp, Homo sapiens
gctcttgttgcccagcctggagtgcaatagcgtgatctcagctcaccacaacctccgccttccgggttcaatcggttttcctgcctcagcctcccaagtagggtgggattacaggcatgcgccaccacgcctggctaattttgtatttttttagtagagatggggtttctcatattgggcaggctgggtcttgaactcctgacctcaggtgatctgcccacctcgggcctccaaactgctgggattacagcgtagcaccaaacctggctaccctttcagttttaggccatataaaaattacatgaaattgggctgggcacgatggctcgctcctgctatccagtgctttgggaggctgaggcaggaggatcacttgaggccaggaggtccagaccagcctgggaaatgagc

SEQ ID NO: 660715 - DNA, 477 bp, Homo sapiens
ctgtgtgaaacctgcaatatacggtcctactaggaaaccccctagcggtactatagtatcacattccaacgctactcacaaaattcttttctcttgtttgctttatagtgtacttagctatagataatttccgaatacaaagcctacggtacatataaatgcaatagttaactgatcctgtaagctgatgtcctttttatgttccacaggtgacatcttttaatccagcatcttctcctgtctctagccttccctttttcttcttcttagattctgcttgaggtctgggctcggtgagtgttttagtgggggttagcgatggaggtaggattggtgctgtgggtaaaagaagtatagaaggggtaggaaggttggtggaaactattaatagtgtaggaagctgaataatttatgaacggagaggggacagggttgattcgggaggatccttattggtgcgggggctttgtctgaatt

SEQ ID NO: 660716 - DNA, 216 bp, Homo sapiens
ccccctcccccccagcacccacaattttcagtcccctcccctttgccctgttttgtatacccctcccctgaccctgctcctatcccccagtatttaatgccctgtcagtcccttttagtttgactcaatggtaacctgctgtatttgaattttttataaatgtataaacagggtggggggagtgggcggttttcattaaacgtccccctttcatta

SEQ ID NO: 660717 - DNA, 309 bp, Homo sapiens
aaagggggtttttttggttggccccccccctccccaaatgtcccccgccgattttttgggggggcccctttgggcctgtttgccatttttccggggggattttaatgggtttggggggaaaagcttttggccgggggttttttttaaaaaaaaaaaaaatcctttttttttcccccggggggacgggccccggggtttttcccgttttttgggccaatttttcccaacccgattttttccccttcccgggggggcccctggggttggttttttatggcccccgcccccccttaaaaaaactgggtttta

SEQ ID NO: 660718 - DNA, 132 bp, Homo sapiens
  misc_feature (124)..(124): n is a, c, g, or t
gagctctctctgtggggcgcaggagctcatcccttgtgttctgccaggtggggtacggggttggacactgaggagggtaacctgctggctggagcggcagagcagtggccttgatttggtcttntgggaaga

SEQ ID NO: 660719 - DNA, 1661 bp, Homo sapiens
gcaggtggcgaggacgtgggcgcagactatgcccctagggtgagctgaggagagctctgtgacacatctccattgacaagtcactcttcgaaatcacgtatggtttccatcacatagcccgatgtcagtagtcacgtcggcatggtttagctgtctactagtccgctctcgtcttgctccgtccgattcgcgaagtgtcttccttgggccagacatctcgccttccgaggctcactgttaccttgactactattctgcatggaatgaaaagttatacgtattgggctgggcacatcttacaactatgtaacacatctcataatatgatgcatacacgacacttatacgcgctctggtgtcctccctcactgcgctcatctgtggagtagtcattccggtaactctgtggttagtgacttacccccctcacacaagacaccgtcttccgtcctgtgtgtcccaggagaagagcccgtgcgtgctcctgaccgctccccgcgttcgtgcgtgccctggattgttgcttccaagcacgaagggcggcaggaccggttgcgactcgtttttggttgcccccacttggggacggccccggactccaggcacgacgatgtggggaggcgtgatcttagctttgctcgagcgctaacgccttgcgtgcgtgcgtgtgcgctctacgaaagacaccagaccgggcgccacttcggtggccccttgcgccactcctcgttggtatcggggtggcggttcaggcgcgttgaccacggtccctgtaactcgttgcggttcatcaaagttcccgagccatgttgtgccgataggcgtgtttgctgatgaatcgttgatggaagcgcattggagaaggcagctttaacattgagtttttagtggaaccacgaattggtccacgcttaaatgggcgatccgtttgttctaacaactcttacgaattttgcgtatttgtcctctggaagggacaatgttataatgcacgagttatccccccatgttagcctcttgtgttgtgttgcatggcccgagagccaagtacgcagtttgaaccccctccttggggcagaaccaccggggcatgaaccaaatagaatggcccaagggcagggctggtgcacaaccggcctaagttaattccggcgtctccatcttgtgggagtccttggagagcccctgtgctacggcatgggggcgttatccaggacaattaaattgggccaagccatgtggtaagcggggatgaagcccctgttcaggccccgggggtaacaaggggcctgggttaaaacagggcccttcagaaccctgggttgggccttgggtgaaggtccagaggcagagcagcagagattcctgtgtccccgccacgggagattccctccaagaaacaccggtgggtgccagacattaatggcctcagcgggacttgcgggaaacaaaaagtaatggcgctgtggccacaacagaactctgtcctctacaatcgagacacactctggagaacgaaaaagagcgggtgtcacaccacagtcatcattggaacagaagaagagggtgattcgaacgacgtgatccgacttcctgatgcatctctgcagaagacaagaatcaagaggaatatgatatgcggctcttgttgtattgatggc

SEQ ID NO: 660720 - DNA, 478 bp, Homo sapiens
cgtagttctgccttatccagactgtctgtatagataaggaattacaagtatatagcatattcagatgggcttcacttgatctgcatctactgatgctctatgtctttttatggtgagatagctcatttcttttcagtgctgactaatattccattgtctagatgtgccactgatgattaatccatacgatttactgaaagacatcttggttgtttccaagttttggcaattatggatacagctgctataaacatctgtgcggccgagcacaggtggctaacgcctgtaaatctcagcactttggggagctgcggcgggcagatcacctgaagtcaggagttcgagaccagcctggccaacatcgcgaaactgtgtctctactaaaaatacaacaaatagccgggcatggtggcacacacctgtagtcccagctacttgggaagctggggcagacgcacttgaatctgggaggcagcga

SEQ ID NO: 660721 - DNA, 376 bp, Homo sapiens
  misc_feature (35)..(35): n is a, c, g, or t
  misc_feature (319)..(319): n is a, c, g, or t
agatatggacaagttctgctggagcaggtctgtgnccacgctcatgggcacagaatacctgggtctgttgaagagcctctttcccacagtctggttcttcttccaccagtcatatacaggcacgcccggtccagaagccacaggcactaatactcactaagggactcacccctttggttgggaacattctccaccagtacagccacagaggggtcagagatgccagaaccaccagaatccacacacccaagagcatggcctgaagggttctgaacaaggccttcagcatgtccatgaaggaggtacataggtgtagccntctgacttcttctgcactctgagtgggggctagagtgttacagtctctctcgtgccg

SEQ ID NO: 660722 - DNA, 796 bp, Homo sapiens
gcagtcagccgcatcttctttagcgtcgccagccgagccacatcgctgagacaccatggggaaggtgaaggtcggagtcaacggattggtcgtatgggcgctggtcaccagagctgcttttaactctggtaaagtggatactgttgccatcaatgaccccttcattgagctcaactacatggttacatgttccaatatgattaccacccactggcatattccatggcaccgtcaaggctgagaacgggaagcttgtccagcatggaaatcccatcacatcttccaggagcgagatcactccacaaatcaagtggggcgatgctgggcgctgagatacgtcgtggagtccactggcgttttcaccacatggagaaggctggggctcatttgcaggggggagccagaagggtcatcatctctggcccctctggtgacgcccccatgttcgtccatgggtgtgaaccatgagaacgtatgacaacagcctcaagatcatcagcaatgcctcctgtacacacaaaattgagttagcacacctggcaaggtcatccatgacaactttggtatcgtggaaggactcatgacacagtccatgccatcacatgcaccagaagactgtggatggccctccgggaaacttgtggtgtgatggccgcgggcactccagaaaatcatccctgtctctactggcgcatgcaaagatgtggggaaggaaatccctgagctgcacgggaacatcactgggatgaccgaccgggtcccactgccaacgtagcgcggggaccgcactggcgcc

SEQ ID NO: 660723 - DNA, 247 bp, Homo sapiens
gaagcagcgttacccatgcagagcaaggggaacaaccactcccagtctcagagcgagtgacgtttgaaactctattagcgcacaccccgctaactagctagccatttcacattggttacaccagcctaatctcgggagttgataggcttgaagtcataaacagcgcaatgcttgacgcacatcgaagagctgctggcaaaacgcttgaaagtgctgtttgaatgaaagcttacgagcctgcgtcgac

SEQ ID NO: 660724 - DNA, 456 bp, Homo sapiens
  misc_feature (111)..(111): n is a, c, g, or t
  misc_feature (140)..(140): n is a, c, g, or t
actttttgtttcctaatcttaaaaaaatttttcagggcagtacatttttctcaagttatgtataaagaatgcattgaaaatcttcggggttcaacggcaattaacaaattnttccccccacggcaacaaaccccttttcntctcacgttctttagggatggactaaatagctggtatcatcacttacaaaagtgtcttgcatgctatagagctaatgttcaaaaatatagtttatattttttatcttttaaccatttttccacaaactttttgaagtctccttgaatatgtaccatttataaaggggaaaaattctgtgactgctcatgttgacttaatgctgacttaattttctgttttgtaaatatatacaaacaagttgatacaaattttgtttatagcccttaaacaaatttgtgaaataaatgcattcagaaacaaactaaaacaatgaaa

SEQ ID NO: 660725 - DNA, 533 bp, Homo sapiens
  misc_feature (29)..(29): n is a, c, g, or t
  misc_feature (122)..(122): n is a, c, g, or t
  misc_feature (125)..(125): n is a, c, g, or t
  misc_feature (158)..(158): n is a, c, g, or t
  misc_feature (191)..(191): n is a, c, g, or t
  misc_feature (214)..(214): n is a, c, g, or t
tattccaaaggaagtcccagggccttatnaaccagaggaagatagggtacccatgtgcgattggcagatttgcaagattttttttggttcttaagatgaagtttcgcgcttgttgcccaggntgnaatgcaatggcgtgatcttggctcactgcaacntccggcttcctgggttcgggtgattctcctgcntcagccttcccgagtagctgggnccgcggggtgtgtgccaccacaccaggctaatttttttgtatttttttgtagagacggggttttgtctcattgcccaggctggtctcaaactcctgagcacaagcaatacgcttgccttagccacccaaagtgctggaattacatgggtgagctaccgtgtccagcctcaatttaaaaataaagagcataattgcattgtttgtaacacaaagaataaatgcttgaggggatggataccccctttaccctgtgattattatgcattgcatacctgtatcaaagtatcccataaatatatacacctactatcttacccac

SEQ ID NO: 660726 - DNA, 161 bp, Homo sapiens
cctgtgtacacagaatgtactttactcaaaatggacctctcataccttaaagccaatggtgacttgtcagccacacttacctagaccctactatgcttgtccatttcaatgtaacagaagctagtggctcaccccagagcatagacatattcccatatccc

SEQ ID NO: 660727 - DNA, 869 bp, Homo sapiens
  misc_feature (733)..(733): n is a, c, g, or t
tatcagcgggggtttgctccgggtatacgggggtttttctcacccgccccgtgtgcggtatgcaaggggcccaggtgtctcgttccccctttggcggccaaaaacgataaattaatctcccttcctattgcgaagattttatctttcatgtaatggccacatttctcacccggagacaccctcctttccctgtttggtttccacccccttggggaccccccttttccttggccccaccacaaaggtcctgtgagttaacgccgttgctgggcgaacggccatccctgttagaattcccccgctgtgtcgacagaaaacagcgtgaggttcttttgccctccagaggagacattcctcccacctgggtgacatatatccgcaagcaaatgcttcccccgtgggtataagaaaattgtggggcccccacataatcccgttgcaagatctgaaccattgtccgctctcccacacggagttctccagcagtttgcaagattgttcttgcactagaagcatttgcggtaagtctcttcacgttgtagagaggagacacgtttcatagagatcccaggcgcaaataatgcagcacccccgccaatcgcttccttaacccccctcttaggcgcgcaccccatcgccccatacaggttggtggtacacacaaagatactcttccccgattgttacttcccttgttccaccctagtagccccactacacaacagcacagctnctcacaccgccttaatgaaacactccttcacacaccgcatatgtactgcacacaaaaaacgctgttttctggggttaaccaaaactgagaaaacaaattccaggcaaaaccgtcaaaacaccccgccacatgcaaa

SEQ ID NO: 660728 - DNA, 1470 bp, Homo sapiens
  misc_feature (295)..(295): n is a, c, g, or t
  misc_feature (1469)..(1470): n is a, c, g, or t
ctttactcagtatacacagataaaaccgctggctgtgtgggatagtgaaacaggtgagagggttcataccacggcatacaagggcacatacttcctatgtgaattcctgtaatccagccaggagagggccctcagacttgtgctgcgacttggactagctagtatcggactcggccaacagttctcataagcgttctgaggcacgatcgcgagaagaagagtcagtccattactcatgaccacttttcaagaagcatccgtaccacggctgattatgctgttcgatccattcaantcggaacatcaagctagactcacgaattaatttcatggatgtgcaaatacgtaacagacttgcaataatcaaaggttgcattggagaccacttgcagcacagaacatcacaggcgtaacagcactacctagcactacttgccatgtaagtgacctaatggtccaatgcaactttccaagttcgaatctttgtgtcacttgggacgctatctaaaacgttatacctcgtacacgtgcgtgctcttactaccctatttatggttgccctagagtggactataatcggaagcaaaattgaacgacgctaatcccggtgatcctcgagggaatggtccctgtgcgcattgttaggtgccccgcagataggatgagccatgtagtttcagaggaattatatttccatacgcgcatagattagtagtcaaccaaaccttttgcaaacaggaaccctatcatgaggactgttctttgggtcaacccttgattggaaagccaaaactagcaagcttggcttcagccagacagagtattgtcttcatagtcgtggggaataccacaaagcaaggagacatattggtcacttaacgcttgccctggacaatgcttggcttcccatcacatgacagtggcttttccaacccctgattgaagcccatcattaatcctccagacatccgagtggaccaacgaagacttggtataatgggggaggagacatttcacgtgcacacatactcggccctgggaagaacttccacaggggccgggttgagcatttggagaaaactcccagacaaggggcacaagtgactgccccacatgtttggagctgtttccacaggtagtacaaccatcccattgaaagaacaccatgggtgacaacacacacacgcggcggcgggggaagaatattcaaagaaacaacattggttgaccattaaaaggaggaaataaagaggaacagaggagtttaaaaaaaaggaagatataggaaggaaggggaggaaaaataatatacgatgttagtaaagaccacgcaaaaaaaaagtaggagaagggatcactgcagcgggagtatgataatgtattatgagtagataaatagtgagcaggaactaaaaaaagaagagcgaggagtgtgatgtattattttttgtgatataaataatatgagnn

SEQ ID NO: 660729 - DNA, 80 bp, Homo sapiens
gctatgttgacttcagcttcgtatgcaccttcttgataactgcccccagccccctgccccattaatgacccttgaatcct

SEQ ID NO: 660730 - DNA, 150 bp, Homo sapiens
ttgcacgattctctcttggcagagtcttctgcgggggggagccctctcgtgtctcttgcgcctttcgcccccctgggggttttgcgccttgttctcctgcggctttctgcggccgccttgttggtcttcctgcggtcgcccttggccacc

SEQ ID NO: 660731 - DNA, 324 bp, Homo sapiens
gggtcccccaaaaaggggggaaaaggggcccaatccggcccccgttaacttgggaattaaaaggtagccggaggggggagggtcggctccaaaggccccagtaatttagctggttgcagctgtttatagccttcaggggggggcctgccccggtatgccttcccgtgatgcccccccaagaaaccctttttttttagtttttaaagggtttttgtaaaatgtttttggcccagtaggatttgaattagccgttttccagttttcctttttactaataataaatttgtttttccaatccctctgtggtaaaatgtgaaaaaccca

SEQ ID NO: 660732 - DNA, 291 bp, Homo sapiens
tgtagcttttgacaacttgattatagtttgtttttggatttatcctacttggagtttggtgaacttattggttgtgtagatttatgttttcatcaaatttaagaagttttggactattatttcttcaaatattctttctactcctttctctccaaaccctttgaaattctcaatatgcatatattggtatgcttgatggatccccagaggtctcttaaggtctgctcaaaaaggtcaaacttttatctttcaaaactgaagacagataattataaatgaacccatcttcaa

SEQ ID NO: 660733 - DNA, 502 bp, Homo sapiens
cgtggaactgcaccgaagtagacaatagaccgtgctggtgtgcgcggtggccactgcgctgcggaacatggccttggacgtcagaaataaggagctcatctggcacaatacgcctatgcgacgacctatgtccacagcgcttccagtgagggaacaacgagcaacaacacttgcaagcaacggccatgctcggactgaccacagtgacagcttgtctgcgtgcacactagcacgaatgtgattaccaaggaacatggatgaacgccaagggccttaacgggatgccggaggccatcgacgaagttggtcgcgcatctcccaaaagcaaagggagaataaacactctccaaaaagtgggtccagggctgcatctccaggtcctacaacaagcatgtggcagttaccgaagatctgaaggagtctctaccaaaaagggatggatggtccacaatacccactttgtagccctccgtcttcaaccatcgaggaggggaccggcaaa

SEQ ID NO: 660734 - DNA, 383 bp, Homo sapiens
acctcttttagatcagacttgagtccattgccacattttcagaacacctgtcagcaacttgtgggaataagcgaaggttttcctataagagggaaagaaggcaaaaacgggacaggtatattcaaacacatttgagttcatttcgtgaccaagggaatcttcgcaccattcctacctgaggagtaacagctgcgaacctgtgcaggtctcagtgagagccagctcacttatagctttgctgtttgaacctgttgtggctgcattttctgtgggccagtgacaactgtgtaaccagaatagatgtatggcgctgaccctctgggcggcattggctcttgggttccttcttgtgcacccaccacctctctgcacagccctctgtt

SEQ ID NO: 660735 - DNA, 3592 bp, Homo sapiens
  misc_feature (481)..(481): n is a, c, g, or t
  misc_feature (484)..(484): n is a, c, g, or t
ccagctccagccgccgtcgctgctgcctgtgtagttgcagccgcggccgcctcccgccagctcgcctcggggaacaggacgcgcgtgagctcaggcgtccccgccccagcttttctcggaaccatgaaccccaactgcgcccggtgcggcaagatcgtgtatcccacggagaaggtgaactgtctggataagttctggcataaagcatgcttccattgcgagacctgcaagatgacactgaacatgaagaactacaagggctacgagaagaagccctactgcaacgcacactaccccaagcagtccttcaccatggtggcggacaccccggaaaaccttcgcctcaagcaacagagtgaggctccagagtcaggtgcgctacaaggaggagtttgagaagaacaagggcaaaggtttcagcgtagtggcagacacgcccgagctccagagaatcaagaagacccaggaccagatcagtaanatnaaataccatgaggagtttgagaagagccgcatgggccctagcgggggcgagggcatggagccagagcgtcgggattcgcaggacggcagcagctaccggcggcccctggagcagcagcagcctcaccacatcccgaccagtgccccggtttaccagcagccccagcagcagccggtggcccagtcctatggtggctacaaggagcctgcagccccagtctccatacagcgcagcgccccaggtggtggcgggaagcggtaccgcgcggcgtatgactacagcgccgccgacgaggacgaggtctccttccaggacggggacaccatcgtcaacgtgcagcagatcgacgacggctggatgtacgggacggtggagcgcaccggcgacacggggatgctgccggccaactacgtggaggccatctgaacccgcagcgcccccatctgtcttcagcacattccacggcatcgcatccgtcctgggcgtgacccgtccattcttcagtgtctctgttttttaaaacctgcgacagcttgtgattcctacccctcttccagcttcttttgccaactgaagccttcttctgccacttctgcgggctccctcctctggcaggcttcccccttgatcgacttcttggttttctctctggatggaacgggcatgggcctctctgggggagggcgaggcccgtggggcagggctggaatgggagacctgttggcctgtgggcctcacctgcccctctgttctctcccctcacatcctcctgcccagctcctcacatacccacacattccagggctggggtgagcctgactgccaggaccccaggtcaggggctccctacattccccagagtgggatccacttcttggttcctgggatggcgatggggactctgccgctgtgtagagaccagtgggatgggctctacctctctttctcaaagagggggctctgcccacctggggtctctctccctacctccctcctcaggggcaacaacaggagaatggggttcctgctgtggggcgaattcatcccctccccgcgcgttccttcgcacactgtgattttgccctcctgcccacgcagacctgcagcgggcaaagagctcccgaggaagcacagcttgggtcaggttcttgcctttcttaattttagggacagctaccggaaggaggggaacaaggagttctcttccgcagcccctttccccacgcccacccccagtctccagggacccttgcctgcctcctaggctggaagccatggtcccgaagtgtagggcaagggtgcctcaggaccttttggtcttcagcctccctcagcccccaggatctgggttaggtggccgctcctccctgctcctcatgggaagatgtctcagagccttccatgacctcccctccccagcccaatgccaagtggacttggagctgcacaaagtcagcagggaccactaaatctccaagacctggtgtgcggaggcaggagcatgtatgtctgcaggtgtctgacacgcaagtgtgtgagtgtgagtgtgagagatggggcgggggtgtgtctgtaggtgtctctgggcctgtgtgtgggtggggttatgtgagggtatgaagagctgtcttcccctgagagtttcctcacttacataaagctcccttgaagcaagaaagagggtcccagggctgcaaaactggaagcacagcctcggggatggggagggaaagacggtgctatatccagttcctgctctctgctcatgggtggctgtgacaaccctggcctcacttgattcatctctggttttcttgccaccctctgggagtccccatcccattttcatcctgagcccaaccaggccctgccattggcctcttgtcccttggcacacttgtacccacaggtgaggggcaggacctgaaggtattggcctgttcaacaatcagtcatcatgggtgtttttgtcaactgcttgttaattgatttggggatgtttgccccgaatgagaggttgaggaaaagactgtgggtggggaggccctgcctgacccatcccttttcctttctggccccagcctaggtggaggcaagtggaatatcttatattgggcgatttgggggctcggggaggcagagaatctcttgggagtcttgggtggcgctggtgcattctgtttcctcttgatctcaaagcacaatgtggatttggggaccaaaggtcagggacacatccccttagaggacctgagtttgggagagtggtgagtggaagggaggagcagcaagaagcagcctgttttcactcagcttaattctccttcccagataaggcaagccagtcatggaatcttgctgcaggccctccctctactcttcctgtcctaaaaataggggccgttttcttacacacccccagagagaggagggactgtcacactggtgctgagtgaccgggggctgctgggcgtctgttctttaccaaaaccatccatccctagaagagcacagagccctgaggggctgggctgggctgggctgagcccctggtcttctctacagttcacagaggtctttcagctcatttaatcccaggaaagaggcatcaaagctagaatgtgaatataacttttgtggaccaatactaagaataacaagaagcccagtggtgaggaaagtgcgttctcccagcactgcctcctgttttctccctctcatgtccctccagggaaaatgactttattgcttaatttctgcctttcccccctcacacatgcacttttgggcctttttttatagctggaaaaaacaaaataccaccctacaaacctgtatttaaaaagaaacagaaatgaccacgtgaaatttgcctctgtccaaacatttcatccgtgtgtatgtgtatgtgtgtgagtgtgtgaagccgccagttcatctttttatatggggttgttgtctcattttggtctgttttggtcccctccctcgtgggcttgtgctcgggatcaaacctttctggcctgttatgattctgaacatttgacttgaaccacaagtgaatctttctcctggtgactcaaataaaagtataatttttacctgcgg

SEQ ID NO: 660736 - DNA, 3641 bp, Homo sapiens
  misc_feature (481)..(481): n is a, c, g, or t
  misc_feature (484)..(484): n is a, c, g, or t
ccagctccagccgccgtcgctgctgcctgtgtagttgcagccgcggccgcctcccgccagctcgcctcggggaacaggacgcgcgtgagctcaggcgtccccgccccagcttttctcggaaccatgaaccccaactgcgcccggtgcggcaagatcgtgtatcccacggagaaggtgaactgtctggataagttctggcataaagcatgcttccattgcgagacctgcaagatgacactgaacatgaagaactacaagggctacgagaagaagccctactgcaacgcacactaccccaagcagtccttcaccatggtggcggacaccccggaaaaccttcgcctcaagcaacagagtgaggctccagagtcaggtgcgctacaaggaggagtttgagaagaacaagggcaaaggtttcagcgtagtggcagacacgcccgagctccagagaatcaagaagacccaggaccagatcagtaanatnaaataccatgaggagtttgagaagagccgcatgggccctagcgggggcgagggcatggagccagagcgtcgggattcgcaggacggcagcagctaccggcggcccctggagcagcagcagcctcaccacatcccgaccagtgccccggtttaccagcagccccagcagcagccggtggcccagtcctatggtggctacaaggagcctgcagccccagtctccatacagcgcagcgcccccatctgtcttcagcacattccacggcatcgcatccgtcctgggcgtgacccgtccattcttcagtgtctctgttttttaaaacctgcgacagcttgtgattcctacccctcttccagcttcttttgccaactgaagccttcttctgccacttctgcgggctccctcctctggcaggcttcccccttgatcgacttcttggttttctctctggatggaacgggcatgggcctctctgggggagggcgaggcccgtggggcagggctggaatgggagacctgttggcctgtgggcctcacctgcccctctgttctctcccctcacatcctcctgcccagctcctcacatacccacacattccagggctggggtgagcctgactgccaggaccccaggtcaggggctccctacattccccagagtgggatccacttcttggttcctgggatggcgatggggactctgccgctgtgtagagaccagtgggatgggctctacctctctttctcaaagagggggctctgcccacctggggtctctctccctacctccctcctcaggggcaacaacaggagaatggggttcctgctgtggggcgaattcatcccctccccgcgcgttccttcgcacactgtgattttgccctcctgcccacgcagacctgcagcgggcaaagagctcccgaggaagcacagcttgggtcaggttcttgcctttcttaattttagggacagctaccggaaggaggggaacaaggagttctcttccgcagcccctttccccacgcccacccccagtctccagggacccttgcctgcctcctaggctggaagccatggtcccgaagtgtagggcaagggtgcctcaggaccttttggtcttcagcctccctcagcccccaggatctgggttaggtggccgctcctccctgctcctcatgggaagatgtctcagagccttccatgacctcccctccccagcccaatgccaagtggacttggagctgcacaaagtcagcagggaccactaaatctccaagacctggtgtgcggaggcaggagcatgtatgtctgcaggtgtctgacacgcaagtgtgtgagtgtgagtgtgagagatggggcgggggtgtgtctgtaggtgtctctgggcctgtgtgtgggtggggttatgtgagggtatgaagagctgtcttcccctgagagtttcctcagaacccacagtgagaggggagggctcctggggcagagaagttccttaggttttctttggaatgaaattcctccttccccccatctctgagtagaggaagcccaccaatctgccctttgcagtgtgcagggtggaaggtaagaggttggtgtggagttggggctgccatagggtctgcagcctgctggggctaagcggtggaggaaggctctgtcactccaggcatatgtttccccatctctgtctggggctacagaatagggtggcagaagtgtcaccctgtgggtgtctccctcgggggctcttcccctagacctccccctcacttacaaagagctcccttgaagcaagaaagagctctctgctcatgggtggctgtgacaaccctggcctcacttgattcatctctggttttcttgccaccctctgggagtccccatcccattttcatcctgagcccaaccaggccctgccattggcctcttgtcccttggcacacttgtacccacaggtgaggggcaggacctgaaggtattggcctgttcaacaatcagtcatcatgggtgtttttgtcaactgcttgttaattgatttggggatgtttgccccgaatgagaggttgaggaaaagactgtgggtggggaggccctgcctgacccatcccttttcctttctggccccagcctaggtggaggcaagtggaatatcttatattgggcgatttgggggctcggggaggcagagaatctcttgggagtcttgggtggcgctggtgcattctgtttcctcttgatctcaaagcacaatgtggatttggggaccaaaggtcagggacacatccccttagaggacctgagtttgggagagtggtgagtggaagggaggagcagcaagaagcagcctgttttcactcagcttaattctccttcccagataaggcaagccagtcatggaatcttgctgcaggccctccctctactcttcctgtcctaaaaataggggccgttttcttacacacccccagagagaggagggactgtcacactggtgctgagtgaccgggggctgctgggcgtctgttctttaccaaaaccatccatccctagaagagcacagagccctgaggggctgggctgggctgggctgagcccctggtcttctctacagttcacagaggtctttcagctcatttaatcccaggaaagaggcatcaaagctagaatgtgaatataacttttgtggaccaatactaagaataacaagaagcccagtggtgaggaaagtgcgttctcccagcactgcctcctgttttctccctctcatgtccctccagggaaaatgactttattgcttaatttctgcctttcccccctcacacatgcacttttgggcctttttttatagctggaaaaaacaaaataccaccctacaaacctgtatttaaaaagaaacagaaatgaccacgtgaaatttgcctctgtccaaacatttcatccgtgtgtatgtgtatgtgtgtgagtgtgtgaagccgccagttcatctttttatatggggttgttgtctcattttggtctgttttggtcccctccctcgtgggcttgtgctcgggatcaaacctttctggcctgttatgattctgaacatttgacttgaaccacaagtgaatctttctcctggtgactcaaataaaagtataatttttacctgcgg

SEQ ID NO: 660737 - DNA, 170 bp, Homo sapiens
caagacttggagaatcactacaagaaaaactccttgtggtggaaggttctaaggacgggggatcgtttccagtatgagaattcacaagcgactcatggactggcacagtccttctgagatggttaagcagattacttccatcagtatggagccaggagtggaggtggagg

SEQ ID NO: 660738 - DNA, 467 bp, Homo sapiens
  misc_feature (20)..(20): n is a, c, g, or t
  misc_feature (33)..(33): n is a, c, g, or t
  misc_feature (77)..(77): n is a, c, g, or t
  misc_feature (96)..(96): n is a, c, g, or t
  misc_feature (412)..(412): n is a, c, g, or t
caaacatgggaaaaaatctnactctgtcccccngctaaaatgcaatggccctgtctcggctcactgcaacctcccanatccccggtttcaagcaantctcgtgcccccagcctcccgaatagctgagattaacaggcacatgcccaccatgcccagctaatttttgtattttcagtagagttgggatttcaccatgttgcccagggtggcctcgaactccagacctcaggtgatctgcctgcctcagcctcccaaagtgctggaattacaatcatgagccaccactcttagcctctacaaaaaaaatttttttagttagcaggtgtggtgatgtgcacctttagtcccaggaggctgaggtaggaggattgcttgagcctggagaggtcagggctgcagtgagctatgattngccactgcactccagcctgggtgacagagtgagaccctgtctcaagaaaaaaaaa

SEQ ID NO: 660739 - DNA, 200 bp, Homo sapiens
tacgaatcctatcttgttgttgtactgactctaagaatcgaatacatgtcgggaggccctcactgtctccaagacatggcgtatcactgtggctgcaagtcctacggacccaatgaaatggtgtcatagtgatggatttgggttagtgttgaaagccagcctaattgttctccagatgtactctcactcgtggaataaaa

SEQ ID NO: 660740 - DNA, 180 bp, Homo sapiens
tgggtaatgaaaaaccacctcctgccaccaaatattaaaatagtccattgttatcgtattaggaatcacttctattatatgtcatactctaagatcaaaattttcattatctgctcacctgaagaggatgctctttaagattccgttctagcttaaacaataacagggaaaataaactcg

SEQ ID NO: 660741 - DNA, 127 bp, Homo sapiens
ttcagcggtaccctcattgttagcctcctgctccctattttcctcattagcattcccgttagcagggcgtctcttccattttctgcctcttccacaacttccttcttctcctttaagtctttgctgg

SEQ ID NO: 660742 - DNA, 344 bp, Homo sapiens
tttttttatgtttagccccttccattttcaacccccccctaagattccagggggcctggcccagggcccaaaatggtttagggaagcaggatcccccccctggggtttggtccttgcccctcctgcaggggttggcccccgtttttcaaaaacccccccttagggggggcccaggtttaatggtggtggttttaatgggggacccccgcccttggggggccccccgaaaaacctttttttttttctttgggaggggtgggggacccttcagggaatttcccccctccccccaggtgccaagttgggggtaaaggtccaaaaaaaaaaaaaccttgtttttccga

SEQ ID NO: 660743 - DNA, 234 bp, Homo sapiens
tgtcagtgatggcttcacattttgcatataggaagtagaactgtggactaggaaggtgttacccttcttcctgcagatcacagatgctggggtctccatgcttccagccctccggcccctgggcacctatgtactttgtggaccattattatgtcttttccctgtaccagtttatgatctagttactgaaaggcctgtgctgctaattcctttcatacgtatcatatgtttttt

SEQ ID NO: 660744 - DNA, 229 bp, Homo sapiens
tgatatctagaggatcctttatccgggaggggtatttgtcttccctgacatgagtgggatcccagcgaggcctaggcctcagcagggaagggatcccgggcgggcaggtccaggagcagacctgcctcaggcccacagacacaccccaatctgaaagccatgcgtgtcggtgtatataggaaccatgtacagagcccagagaagccccctacatctccccgggatacag

SEQ ID NO: 660745 - DNA, 772 bp, Homo sapiens
tcagttcctttaatgacccccatctccctgaagggcaggtgcaggcagctaggtgatggcaagagatgttcacttgaagatcttgccctgatggaaggcttggcccacatgctggaaggccccctcccaggaaaagtacttctcgaaccaggcgttcgtgggttcctccttcgcgtgccaggactccagtttctccgccatgtggtgtattgactcgtagtccaccgtgccaatcgtggacctcagcggaagggcaagcctcctgtggcctcggaagacccagactccagaaagtggagctgctatgtgtgggtctccaaaaaggatgacactggcgaaggctattcttcctcagtcttgtccagtcgctggaacattccagtgatgagatggcagctcatgaaggtctgagtgagtacttcagggaagcgatactctgagtaccacagggaccagccgtccttatcaaagtgcctcccagaattttggcagtgccacagagagtgtgtcctcatgggagtactggcgcttaaattcatccaacacaagggtactctggggcaggtgagcgaaggggtcctgtggcctgtgggactaagcagccagcgcctgttcacattcatccaatctcctcctcaggagcgggggaggcgctttttctcctcttccgatcacctggggtactgttctctccgtgaaccttctcttccggggttgtccttaggggtggttcctgaccttttagcttaatgggcttttcccagttctccca

SEQ ID NO: 660746 - DNA, 307 bp, Homo sapiens
aaatgtgcttctctatctgaaactaaagaaataactgtaaattcctcaacttttctgaagagccgatactaacctgacattgtcctttctataaaagatagggaacagaaaaaaacttataaaccaacaaaaacttttaaaacactatcctgggccgggtgcagtggcccatgtctataatcccagcactttgggaggccaaggcaagtggattgcctgagcttaggagtttgcgaccagcctgggcaacatggtcaaacccagtctctactaaaataaaaaaattagccaggcatggtggcatgcg

SEQ ID NO: 660747 - DNA, 337 bp, Homo sapiens
  misc_feature (113)..(113): n is a, c, g, or t
  misc_feature (133)..(135): n is a, c, g, or t
  misc_feature (173)..(174): n is a, c, g, or t
  misc_feature (185)..(185): n is a, c, g, or t
  misc_feature (189)..(189): n is a, c, g, or t
attgccccaccatggaggcccagaccacactgaccacaaatgacattgtcattagcaagctgacccagatcctttcatacctgaggcagggaacccgtaacaagaatcttaanaagaattagaaaggagagcnnnaaaaaaaaaaacccccggatctttacaataatattttnnaaaacaggggntatnagttaccccccacaaccaaaacacctcggacaaaggagcgggagagatatcgggaacgggagcgtgatcgggaaagagacagagaccgtgaccgagagcgagagcgagaacgagatccggaacgagagcgagagcgggaccgagagag

SEQ ID NO: 660748 - DNA, 799 bp, Homo sapiens
tgcttgataacaagttttgtactatgggcgtttgcgcgaggttacttttggaagacttgttgtttttagtcacggaaccatcgatctgcgtggaggtagtcccagtgcaaaatgttcgttcacttcttccctggggtaagagtttatccagtgggttttgttccatattgcgtgtttccgacgatgtttttatgcgagagagatcaattatactgggttatctgctgtatagctcccctatccacagtgacggtggctggcatgtttgttttggcagaaattctatgcaagttcccaaatataggtgttggtatggaagtggtgcttttgtactagaaaaccatgtcttgttttgcctatggtctaatgatccccacaaggccggctcaatagtaccattggccatttagaccactgcgtgcaacagtgtccagaagcccttggaaacagcattcaggttctgactcctgtagtacagaaggtggcagtacatctatgggcttgattccccttgcccatcagtagaggagcatttcaatctgctttccatgccttacatcaaggtggtcaagggatctataatctaatttcagggctcaagaccgacccattttaatgtagacctcacgccagtggggtgaggaattagatgctggatttgaagctacgcactcagcctcaagactccctgggatatccctgagaacatggggtttgacggattgtcacactttttcggttcttggtttgatggttttctgtaagaggaatccaataaagttatagccctttactgcca

SEQ ID NO: 660749 - DNA, 205 bp, Homo sapiens
tagaggatacggacaggagacgtaccctaacaagtcagactgatatattcagtgtagtgacaaccagcactgtctcatgggtcctgggtcccctcgctggccctcctgtgggctccatttgacctgctgtgtagtctttttctttttttctttctttctttttatttttttttagaggaaagggtatgtattaatgggggcctgg

SEQ ID NO: 660750 - DNA, 808 bp, Homo sapiens
  misc_feature (625)..(625): n is a, c, g, or t
gtcttaacaagcacttaaattcattagacgcatagaaaataaccatttattattttattatttttatttttatttgagaggaagtctctgtcacccaggctggagtgcagtggcgcgatctcagttcactgcaacctccccttcccaagttcaagcaattttcatgccgcagcctcctagctgggattacagggtcccactctgttgccgaagctggagtgcagtggcgcgaacatgtctcactgcggcctcaacctcctgggctcaggctttcctcctgcctcagcctcctgtgtagctgggaccacaagcactcgtcaccacacctggataatttttgatgtttgtagagacagtgcttcagtttgttgcctgtgctggtcttgaactcctggcctcaagcaatccttctgctttggctcccagattgctgagattacaggtgtgagtcactgtgcccggctcccttctgcttctttcctggatttgtcagtttgtcttgccttatttgtcatgttttccatgaatctctatattgtagtttgttgtccttctgggaaatattcattaggttttttttcggagcagatttttttttttttttggggggaacccctctcaaaancgaaagagaaaaatttgagccagtgtccttatggtggggggcgcgaattccatggaacgagttgggaatatcccgtgattggggggtccctttcttttgtccaagggttatacttcattgtacctttgggtgaaaaagggtggtggaaggtgggatgaaaggtgcgggaataggggaattaga

SEQ ID NO: 660751 - DNA, 284 bp, Homo sapiens
ggggcagcagagagagatccgtctcagaaccaaacaaaaaaaaagcaaagatttttttttttaggagacagggtctggctcccatcggccgggcggaacgatcgggagatcatagctcaggggaacgtcaaactctggggtccaagtgatcctctcccctagggctcccaaagggcggggataacgggcgtgagccatgtgcacggagccaaagcagaaatttttttcctgggatctcacaggtccttgatattttaatgggaaatttcggaactataaaaaat

SEQ ID NO: 660752 - DNA, 371 bp, Homo sapiens
  misc_feature (32)..(32): n is a, c, g, or t
  misc_feature (72)..(73): n is a, c, g, or t
  misc_feature (76)..(76): n is a, c, g, or t
  misc_feature (80)..(80): n is a, c, g, or t
  misc_feature (101)..(101): n is a, c, g, or t
  misc_feature (107)..(108): n is a, c, g, or t
  misc_feature (114)..(114): n is a, c, g, or t
  misc_feature (118)..(118): n is a, c, g, or t
  misc_feature (122)..(122): n is a, c, g, or t
  misc_feature (130)..(131): n is a, c, g, or t
  misc_feature (135)..(135): n is a, c, g, or t
  misc_feature (148)..(150): n is a, c, g, or t
  misc_feature (155)..(155): n is a, c, g, or t
  misc_feature (161)..(161): n is a, c, g, or t
  misc_feature (165)..(167): n is a, c, g, or t
  misc_feature (169)..(171): n is a, c, g, or t
  misc_feature (195)..(195): n is a, c, g, or t
  misc_feature (207)..(207): n is a, c, g, or t
  misc_feature (225)..(225): n is a, c, g, or t
  misc_feature (227)..(227): n is a, c, g, or t
  misc_feature (290)..(290): n is a, c, g, or t
  misc_feature (368)..(368): n is a, c, g, or t
ggccttttatatttacattccctttattaatnccccctcccacccacccaccctccctctccttccctcccnnagncagncatccactttttttcccttcntttccnncatatnaagnaagngagggctnngcanggagagggaagannnaaganggaagncggnnncnnncatttctttacatttctttttctnttattccttcanctccatttccatttacancntctattattttcttttctcaacactcttctcctaatccccctcttccacccctttctcctccntattcacctcccattataattcctttcttctcttttttctcctacccctattttctcatccctttctcccctttcttntta

SEQ ID NO: 660753 - DNA, 298 bp, Homo sapiens
ggtgccccacacaggctctccatgatgggaaccagtggttagtggcttcaaaggcccagctgacaccctccacagcctaatggggtgtcctaaaagtgcctccccctgtattccccttcccagggcagcccctgcccagcacaaaagcccaggaccctggtctctgtcacgcctggggcagggactttggagtgtctaggactctgtagttttctaaagtcccccagctttctccctggctctcctgttctgaacataaaggattgaaaagcggtaaaaataaaatagaacacagagg

SEQ ID NO: 660754 - DNA, 127 bp, Homo sapiens
atctagaggaggtggacagcacagagaggatcttcaaaacagacaacttgacgagtttcattcgccagctgaacctctatggattctggaatacatccttgcctcctctgtgcctcctctgtgctgt

SEQ ID NO: 660755 - DNA, 228 bp, Homo sapiens
gggtgatccctgctctctgcagcccctttctcacccctggtccccacggcccctggctctctcccctctgctagaatctacgctgagggattggtaggggagggggtggtcacgcactgggtgggagatctaggtgcccccgtgaaggccggacatgaaagggccagggcggacaaggtctttagagacactcggtggcatccctgctccgtgatggccctgggtccc

SEQ ID NO: 660756 - DNA, 338 bp, Homo sapiens
gatcaacacctcataagaataggatctttgaaatgaaccctctttttgcttaccctgacctttattctactctctaacacattgtggacattttcaatgaataggattctcattatctcagggtgttaactgtatttttagaatgaatatcttttcctctttatctaaatgaaaaggattaagacgaagttggaatctccataagatgaaaatatttcaaagcatcttctaagcaggacaaacaacagtaagcatggcaagtgcaataattcagatgagcacacagatgaataagtcaaagcatcgccttaaggaattcatttgtttctctgctgcct

SEQ ID NO: 660757 - DNA, 259 bp, Homo sapiens
gaggatccccattcattaccgggggaggggtgtttaaagtggcgttggctatcggtataattgtctgggtcgcctacgaagtctggtgtacacatagtgttaatgtcattaacgagataactgaatacgaagtacgccgagggcgtctttgattgtgtattaagggtggaacgtgattttatcggaatgggagtgtgattccctaggtgggtagttctgggctaccgagcctcgaatttcgttaatcctggttcattag

SEQ ID NO: 660758 - DNA, 396 bp, Homo sapiens
ctgacttgaggatcccatcgccaacacaggactctcctaacatgtaggaagagtgagagcaaatctgacagcatggactcatcagggtatgaagatggtttgggtgttttgtttgttttgttttgtttttgagataggatctcgctgtgttatccaggctggtctcgaactcctgggctcaagggatcctcccacttcagcctcccgagtagctgggacaacaggcatgagccaccccacctggctggtttggggtttttttgtttggtttggggttttgactacttttttgggggaaatgtttgggcaagaacatgtgaggacagggataaggccgacagggggctatctggcatttagaatgtgttgggcgataacatcacgggtaccgagctc

SEQ ID NO: 660759 - DNA, 445 bp, Homo sapiens
gggatggtaaagtacagtcgtgcttcgctgcgaagtcggatctggtccagttaaagagtgtcgcagacaaagtatctgacagattagagaagaatcccccccaagatgccccaacactgaactacagacaaacactattttatttaaatatcggagacagctttctaaaagtatacattctctaataaaaatagtttattattttgaatgattaacggctttctacacaactttacatcacaacatgtaaccttctcagcacgtaacatctgattctaacagcacatcatgctattccttctcatagagccttcagagattcaatgctaaacaaatttccttagctggcatcaaggcactgatcactctacaggcttcaagcacaatatccaaagactgcacatgcctctgagtgacagtgtctatcccatcactgaagcccacg

SEQ ID NO: 660760 - DNA, 207 bp, Homo sapiens
acgcgttgattacagggttgggaacagctcgtacacttgccattctactagcatatactggttagtgaggtgaacctgtcgctcttctttgcgctgagctaaagcttaatacaatggctttgtagccacaattctacctttcaattctgtaactgctttagtggcttcttctggggaggagaaacatacaaaaccaaaaccatgctg

SEQ ID NO: 660761 - DNA, 415 bp, Homo sapiens
ccaggagagctagaaagaacttaagcaaatttacaatgaagagaagaagcccatcgaaaagagtgggtgaaggatatgaacagatacttctcaaaagaagacatttatgcagtcaagcaaacatatgaaaaaaaagctcatcatcactgggcataagagaaatgcaaataagaaaccacaatgagatgagataccatctaaccccagttagaatgatgatcattaaaaagtcaggataaaacagatgcttgagaggatgtggagaaataagaatgcttttacactgttggtgggagtgtaaattagttcaaccattgtggaagacagtgtggtgattcctcaaggatcgtagaaccagaaataccatttgacccagaaatcccattactgggtatatacccaaaggattattaat

SEQ ID NO: 660762 - DNA, 1255 bp, Homo sapiens
ttgagcggccgccgagcgggtgcgggtgcgggcgcatctggtcatcaccgcgcgggtcgcgcagtgtgacaccgtgcgtaccggtcatgcggctgcccgtgccaccggggcggaccggggtaaacccggaggcctatgtcccattgaaaacgagttaagggtgtctggggacacactttatcctccccctaagcctggattatccggggggggtgcccctgagccactcttatgccccccccttattggttctgccatcacaatgacctcgtggggtcgcccttgtaccgttggtgggcgcctttatgcacgacgcctgtccctgcgccactgacggtgtcagggccttacctgccttgctgtgtcagcacgtgcaggcgctaccgaagggatgcgtcagtgcaaacacagtctacccatttcaaacgggtacacatcgaggttgtcactcctacccagttgtccgtatggttgagagttgcaccgtgatttcgcctcctaacatagtgtgcgctttaccctagttgactatgcgttgtggaacccgcttcttagagtcccccagaaaaaatgcccgggattgagagagtaaccacctttgagtctaacgtttgcagcaaaaattggaatcgtaccgggacggatatttggtaagacgattagcgtaccagcgccaccttaatgtggccaagcaccacgacgtgggtgctcgaattttccccccttccggaggggggaaacaccccctcggaggtccaaatactcaaccgaggaatccctgagaggacagacacgactagtagagcaaccggtgtttggccgcctagtgtacatctactggggtagtgacacatcgcatctgaccagtgatggccaagcgaaaagtccacgagcagtcgaaaaccaacagaaggatcatcttccacgagatcgggcgacgaacaagacaggcacttggccgccaacagcactataagaaagttgagcggcatttgagtatgattggagtactagtggttcaaaagcgttcgccctcaaagaagaccccatctgggcctaggcacaagagtcgtatgcccaacagcgcttttggaaatagagtaatgcatacaaagggaggacgctacacatgtacattcccgcctattacacacatagagaggtgtttccaacgagaatatattcccacctgtttaacacagaagccccattgctaaggtacaataatttcaccctcccccggtcgcttatcacg

SEQ ID NO: 660763 - DNA, 397 bp, Homo sapiens
  misc_feature (35)..(35): n is a, c, g, or t
  misc_feature (64)..(64): n is a, c, g, or t
tgagtaaattccatctcaaaaaaaactactttgcntcatccacagaagcaactcttctagcatntagaatggtgaatgatctccagaagcttttcaatttactttgcccagatccatcagaggaatcagttatctatgacagatgtagcctagcaaaatatatttcttaaataagaagacttgaaaggcaaaattactccttgacctatgggctgcagaacagatgttgtgttagcaggcatgaaaacaacatgaaccttcttgtacatcttcatcagagctgttggatgaccaaatgtattgtcaataagcagtagtattttgaaaggaatctttttgtgaagccagtagctctcaacagtaggcttaaaatatttaataaaatatgctgtaaaca

SEQ ID NO: 660764 - DNA, 416 bp, Homo sapiens
gcctgtgtacaggcttgcagtgtagcaggatgctatctctactcagaatacaaaattagccgacatggatggcgctatgcgactagatcccagctactcgggaggccaaggaaggagactcacttggacccagggttgctgagactagcagtgagctgagatcacaccactgcattccagcctgggtgatagagtaagactccatctcaaaataaaaaaaacaaataatcattattctagtacatatctacctcaacccaaacatccagtgcaaataggtcatcttaaaaagacggattgccatgaaaatcatgtccgatcacaccctgcagcctcggctatggccatgaggcggtcaccctcttctatccctatgagttggttaaactccccgggagagtaggaacctgggcccc

SEQ ID NO: 660765 - DNA, 403 bp, Homo sapiens
ccactaggcgcacttctagattgtgaaaaatagggaaggcaggcttgtctagctgaagagagtggtctatgactactggctagaatagaaggaatgtgtcacatactcgggacgtcctgaactttagcatggcttactttgcttagatgttatttagcaaagcccatgaatataccaggattacgatcgttatcagtgcttaacctggcttatatcagaatgacggagtagggttttttttgttctgttttttctttgtttgttttgagaggagtcttgctctgtccccaggctggagtgtcagtggtgcattctcggctcattgtctcctccacctcccagttcaaatgattcccctgcctcagcctcctgagtagcttggtgcagaagtgcgcctggtgtg

SEQ ID NO: 660766 - DNA, 625 bp, Homo sapiens
  misc_feature (19)..(22): n is a, c, g, or t
  misc_feature (71)..(71): n is a, c, g, or t
  misc_feature (353)..(353): n is a, c, g, or t
  misc_feature (443)..(444): n is a, c, g, or t
  misc_feature (446)..(447): n is a, c, g, or t
  misc_feature (451)..(453): n is a, c, g, or t
  misc_feature (455)..(457): n is a, c, g, or t
  misc_feature (460)..(460): n is a, c, g, or t
  misc_feature (462)..(462): n is a, c, g, or t
cataagcgtgattggcatnnnngggcaagaaaagccgcgatggggatagcgggctgaaaggtattcactangagcttgagtaaccgtacaccgccggctgtgaaaaggttgtgaacggccagacacgagaagcccggcgcatggccgggctctctgaatgaaacttatcaatcaagctgcgcttctgcgcttcattgcgatggcaattgaacgcagaacactttcgtttgcgtttactaggcgcagatgagatgtgacgtagctcactcctttctccaaaaccataacgccaaaaagctcgtcagcgaaggattcagaaatagaatgcacgttgccgagatcgattgtgaatnttgggccgctttctagctggcaaggatcgcccggcgctcttgagctgccaaatttcttgatgcggatccgttctctcaaaggtataggcnncnntgannngnnnccngntggtacataatgtcatctatttcagcagatgtcgggatcgcctatagcttgcgccatcttcgattcctgaagggttagcgagattgcgacccccttccaagcgaattagactcttaaagctcaatttccttttaagctgcaaatggtgtccgatacatgttag

SEQ ID NO: 660767 - DNA, 265 bp, Homo sapiens
gggaatggggggcccgggggggggttttaccaaaaaaaaggccccttcttcaaaggttcctttaaagggggggtttcccccggggggaaaaaccccatatttttcgggggatcctttgttaacccccccgcaaattttttttttttcggccccataaggtccagaagccgggagaaaggttttttcaaagggggggggaaaaaagggacccccttagattttttgggccaaaatggggggcaaaaaaaaaacaggtttggccata

SEQ ID NO: 660768 - DNA, 192 bp, Homo sapiens
cgtagccgcactgttacagtttaccgtgcacactgcgttcacgatatcttctctggcagttcaattcgttgtgacccatacgccaagaagaaacttcaggaatttggtgatgatagtccatatccttatgatcatcgcctttccctaaggactctccgagcgcctctaactcttcaattgtggtgtattcct

SEQ ID NO: 660769 - DNA, 136 bp, Homo sapiens
gaggaagtgtgagagcggagaaaaggtttgttagcagaatctcaacaaacggtgcagatttcgtgcagactgtaaaggagagtggcatggtgtaggccctcgtcatagtaggagagccgtgtcaagaagcatgagc

SEQ ID NO: 660770 - DNA, 373 bp, Homo sapiens
  misc_feature (44)..(44): n is a, c, g, or t
  misc_feature (61)..(61): n is a, c, g, or t
  misc_feature (229)..(229): n is a, c, g, or t
  misc_feature (255)..(255): n is a, c, g, or t
  misc_feature (333)..(333): n is a, c, g, or t
  misc_feature (338)..(338): n is a, c, g, or t
  misc_feature (364)..(364): n is a, c, g, or t
ttctttttttttttcgatatggagtctcgccctgggcaacaagngcaaaactctgtctcanaaaaaaaaaaaacaatctaaaatctttcctggccgggtacgtggctcactcctgtaatcccagcactttgggaggccgaggtgggtacatcacctgaagtcaggagtttgagaccagcctggccaacatggtgaaaccctgttggggttaaaattctaaaaatacaanaatacaaaataaaaatacaaaaattnaaggctgggtgcgttggctcacgcctgtaatcccagcactttgggaggctgaggcggggcagatcatggaggtcaggnagatnggagaccattcctgggcttaacactngtggaaacc

SEQ ID NO: 660771 - DNA, 203 bp, Homo sapiens
gacatctgaggatccccgtccttatcatacctacccctcatttgtacattataactcagaaatgccccacctacaacatcttttcatgttccactgcatggaacaaacttggctagtagtttagttctttctataattctgaatactttttgactgctaattctcttgggaaaagccaggatgaaggtaggtatgatgaagga

SEQ ID NO: 660772 - DNA, 684 bp, Homo sapiens
caagcgtagggaataacggtgacatgtaaactccgttgcgatgacgctccgggttaggggccccctacctccgggtgtatgtatcgggcagcatatatcttgtgcgtttcatggcgcttccgggactggatatgccctccacttcgggatgattgacttactccacgatcgccgcgataactcgtgccctctccgaaccaagtagtactcaaaataaccgctcttctaacaaggggtcttcagaaatcgttagtccgccaaagaagagttttgtaagggaagatttaggaccaagaagatgttagaaatcttttgcggccgtgcctcccccgttcacaccactcactgggggcgaccgctctggcgatgattactcccgggtgttccgagtgcacgaataaatctcacgtctctccggagcgcccgagtgtggttcaccacaagatcaggttgccccccgccttatttctcttgcttaaataatttcccccaccaccctggggtggtcacatacctcacgccgcccactgatgctaacaattacccctcctgtctcccccggtggacccctcttcattgttttacccccttctcctcaactatctcctccctagtccactctccactccccgcgaactatttaccgggtatgttctccccccaatcaaatatcaaacaaaaacc

SEQ ID NO: 660773 - DNA, 759 bp, Homo sapiens
cagagaccatggagggaacatctgatattggaaaaacatgaagcttgtgatacagctcagctggaacaaagctattactatggtgctttaactgcctttataccctttgcagaaatcaagccacccctgtgggctcagggctcacgtggagggttgcgggctttgtggcgcatccagagggaagacaatacatccctgaatcttgtggctaataatatctccccttagagacctctcagtacatgacagacatggaaagacatgatcagtcccagtgtggcacctgatgcatgctgtcccttgaagctggagggcactagcatagtgaggcactagagtccagacccaggggcttgaaatgataagccgaggcacttccccagaggaacaggtaagcacctgccctcagtttccccgtctgctcatggtctacctctgtcctctctcccaggatgattggtttcccttcctctagcaggtaacgggaacagccccgtggtgtgtgggggaggcagagttgtgcctcccattcactgcccctaagtggtgggtgggagctggcggggacggtgagggcagccgagtcgtcgtgggctctcgcagtgatagtggcatgcggggagcagctcgcgggtggacaagtggtcattcgctcactgtatctttgccttttgacctcttgattggctctgcccctggagcagctatttggctgacttggtgaacgagccatcttctggggactatcatagagtctcc

SEQ ID NO: 660774 - DNA, 237 bp, Homo sapiens
attcggcatcgggtgggaggattgctaggaggtcaggaaactagcctgggcaacactcgtgagaccctgtctctatggaaaaaatacaaaaattagccaggcttcgtggtatgcacctgcagtcccagctactccggagctgaggtggaaggactgcttgtagcccgaggggtcgatgctgcagtgagctatgatcacactactgtactccagtctgagtcacaaagtgagactctg

SEQ ID NO: 660775 - DNA, 259 bp, Homo sapiens
tagaggatcccctccataatgtgtgcccaggctggcctgaactcctgggcccaggtgatcctcctgcctcagccttccgagtagccaggaatatgggcatggcggcttcaatctttttgattcaagaggcaattattaagttcaagaagccgcaattattaagttcaagatggggttatctaaatgaccacattacttaaataagaaaatactgcaacaaaagcccatttgataaagcaaatgggcacacattatggag

SEQ ID NO: 660776 - DNA, 845 bp, Homo sapiens
  misc_feature (793)..(793): n is a, c, g, or t
  misc_feature (809)..(809): n is a, c, g, or t
  misc_feature (825)..(825): n is a, c, g, or t
aacaggtacgaaaaaatcaggctactaagcccactgttaatatagacgcagaccaattgttaggaacaggtccaaattggagcaccattaaccaacaatcagtgatgcagaatgaggctattgaacaagtaagggctatttgcctcagggcctggggaaaaattcaggacccaggaacagctttccctattaattcaattagacaaggctctaaagagccatatcctgactttgtggcaagattacaagatgctgctcaaaagtctattacagatgacaatgcccgaaaagttattgtagaattaatggcctatgaaaatgcaaatccagaatgtcagtcggccataaagccattaaaaggaaaagttccagcaggagttgatgtaattacagaatatgtgaaggcttgtgatgggattggaggagctatgcataaggcgatgctaatggctcaagcaatgagggggctcactctaggaggacaagttagaacatttgggaaaaaatgttataattgtggtcaaatcggtcatctgaaaaggagttgcccagtcttaaataaacagaatataataaatcaagctattacagcaaaaaataaaaagccatctggcctgtgtccaaaatgtggaaaaggaaaacattgggccaatcaatgtcattctaaatttgataaagatgggcaaccattgtcgggaaacaggaagaagggccagcctcagccccccaacaaactggggcatttccagttcactggttggtcctcaagggtttcaaggacacaacccctacngaaatacccccacttnagggagtcagccaatnccacaattcaacagttgtcc

SEQ ID NO: 660777 - DNA, 791 bp, Homo sapiens
  misc_feature (141)..(141): n is a, c, g, or t
  misc_feature (163)..(163): n is a, c, g, or t
  misc_feature (165)..(165): n is a, c, g, or t
  misc_feature (171)..(171): n is a, c, g, or t
  misc_feature (234)..(234): n is a, c, g, or t
  misc_feature (303)..(303): n is a, c, g, or t
cggcatttccaacgagctccccgacattggagatgctgcctggctggaggactatctgagaacctcaatgtctagtggaaacttacgtgccctcgattccaaccaggctctaccccatgaacaaattactcttgctgagcnccagtgtgagtagaaagagctncnatatcnaagctgctaggaggattacctaagataacgcagccttgctcaagacaaacgttcaggaaatcnaaatcggtttggagatgaaatgggaaagacaagagcagctccaaggagagaagaacgtccagaaaaccnagaaataggactggtaaagggtgctgaccaggtccctggagctgcaccccgccccgtgcgcctccccagccccccggccgcaccgtgcccaccccgcgctcgtcgtccccctcgcccccagcgccaccctgcactgcggacccgggaccgcctgggaaacgccctggtctgacatggcttggggctctgggcagaagccaggtctgaaaaccaaggttggggcctcatgtgttagtctggaagcaccaagcaccgcataccaaaatacctcgaggcaaccgtatggcttttttttttttaattaagttgttcccgggcggtggctcacgcccgtaatcccagcatgttgggaggctgaggcgggcgcgtcccttgagcacggaagctgaggctgcagaaggctgtggtcgcgccactgcactccggcctgggggacagagtgagcccctgtctcaaaaatataaaacaaaataaaaaattaataatta

SEQ ID NO: 660778 - DNA, 461 bp, Homo sapiens
  misc_feature (12)..(12): n is a, c, g, or t
  misc_feature (416)..(416): n is a, c, g, or t
  misc_feature (458)..(458): n is a, c, g, or t
ctaaaagccccngttaggaaaccccccggagtatgccattgtccatggtgggtaaaaatccgtccagtggccagccatggatgttgccctatggaaagccagaggaaggaatcctcaaataaaggcccaagggtgtccatgggtcacctgacaaattattgccatagactgaggttcaaaccccggtatctgtgctgaacgtggaggctcacatctgtaatcctcaacactttgggaggctgaggtaggagggtcatttgagcataggagttcaagattggcttggacaaaatagcaagacctcatctctaccaaaaaaaaaattagccactcatggtagtgctactcaggaggctgaggtgggaggcttgcttgagccaggagtttgaggctttagtgaaccatgatcacaccanccgccctccagcttgggtaacaaagctagaccctgtctcttnaat

SEQ ID NO: 660779 - DNA, 272 bp, Homo sapiens
  misc_feature (68)..(68): n is a, c, g, or t
tagagcgactccagccgcaggtgttataatttggcatctataattcattcttatttcttgttcctatnttattgtctgtccctccagaagacatctgagcaatatttcagtaggcctcctggcttattcctggccttactggaaaatcatcagtgcttcaccattaactataatgatcactgatagcttttaatgaataattgtcatcaagttacagtttcttttttttttttcgttttgggtttttttttttttttttttttttttttttt

SEQ ID NO: 660780 - DNA, 217 bp, Homo sapiens
cagttgtgacccgcttgatttctcataacgacctaacttatcaagacgttgtctgtttcgcgccggaaacaactcgaattgggtcatttgatagttgtttccacgttgtcgggcatgtgatgcctcctggtttggtcatgtggtggacaggacagagcacgtaaaggactccagccgctcctcagccgaagagcctcagtgtgcctctttctgtggc

SEQ ID NO: 660781 - DNA, 457 bp, Homo sapiens
aattcggcctttatggccggaagggaaaccatttttattacccagttttgggaatggcagaccaagggctggtttgggtggtttttcttttttaggaaaaccttgcctaaaaggttaacctggcaaaaggcttgtattgggaatttcctacgttttagtcgagtattttaaagccaaattttaaatttttttcaaattgggagtttaggatttagctgtaaagggggtttaaattcctttagaggcctcataaaaggagacttttaatatgttaaggtttattaaacctgaaccaggattattttccatttgaaattttggaatagtttaaaagggcttccgaattcttggttggaattgggccattgcaaaactttagggcagagtttatatttagctaacctgtaatgttaattaagaaaggcttaaatcttcaattcttaatattggtaattct

SEQ ID NO: 660782 - DNA, 107 bp, Homo sapiens
caaaggtttttttaaattccgggccagctatccaatggaatcctttccaaaatggagagttccataagataaagcaaatgaataaagccaaatgcttgtgttgccca

SEQ ID NO: 660783 - DNA, 998 bp, Homo sapiens
gagggactgtagttatgtcggtgcctttacctgtaccagtggacaggataccaggtaggttcgcagtggatcctcgaattattacacatcgaggcagcaatggcctataatcatgaacgctattacagacaacatggatcgaggtatctcgctattccttatggcgcttggacatcacccatgctgtcaccataggccagccacaaaatcaggcatcaggcagaaggcatcaaccatgagcaaaatcggaaatggtaaaagtgatacaaataattccggacctgaaattaataggattcgaacactcgagagaaaaagccgaactagaaccaaaacaggtgagttggaatcagatccacgagaaagcagaagtcctgaatcaacgtcctagtgtggtttatcccagtaccaaatttcctcgccaagataatctcaacccagagaacacatagaaggatcttgccccttcctgtctccccagcgcagagtatgcaatccctaatcgccactttcatccccttccccagctaccaagagcaccgcttgccagagttccacagcagcacaccttggtgaaatcagggagcgagaataagttggctgaacaaccagatcgggataccagctcagcgaatgaggtagtccagcagcaaagtcagttgaatcagcagctcagcagccacctcctcagcattgtctcctgctatcaggcggaaccaaccagctttgtaatagtgcactgcccatcggcacagactcctcccggagaagctgattcggagcagagaccctccatgtggagaaaggccagtctctgggagccagacaacggcgcgcactcctgatttcgaaagtctgggagaccccgggtaccaagggggcgcacgctaaggaggggcggcaaaaagagacgggagccacaggggacaccgcacaggggaccaacacacacaaagccgagacaggggacacaaggaaaacagagagcagcaaaacca

SEQ ID NO: 660784 - DNA, 102 bp, Homo sapiens
  misc_feature (4)..(4): n is a, c, g, or t
catngcgaactcgcgaacgatctccagggtctcgctccagcgggcgccgaggccgccgtattgggtggggatgctaagggccagcaagccgctttggcgcag

SEQ ID NO: 660785 - DNA, 198 bp, Homo sapiens
tagtcgagctcggtcgaaacctaatacgtctccagcattattattttatttttaattttgtcttttgtctttttagggctacacccgtggcaagtggaggttcccaggctaggggtctaattggagctgtcgctgccagcctacaccacagtcacagccatgccagatccagaattgcatctgcaacctacactactg

SEQ ID NO: 660786 - DNA, 2089 bp, Homo sapiens
gaactttatagttttttcaaaatggcagatacttgccttatcagagcagaaggttagcttggtgattgtacaagtgttgtcaatttctagtttatacttaatattcctttttctcacctgctacttacatcaccaaacactcacacagtctgattataaaatattgagactgacagtcatatagaaccagtttcataacctcattaccatgtacacccagctcagtacctctccagactgcaaaccctttgagggttccggcctggcttttctttatatttggggaaatgttagagaaaacagcatctaaaactggaaaccttgacttaaattagccatttcttctcatcctaaattgagagacatgagttctaaatggcagagaccatttataggagaatgccaaagagagcagaagagaatgggaagcctttcccacagcagaaactttccacagcagagacaatagactgatccctatcacatcccctaaatatttcttctgacacctggatgggttttgacaatcatagaagcaaactggacagagtgccatttacttctgtgccatttcatactggggctttgcacagaataggaaatgcattgtctaggttcctctagacctctaggttcccttctattctcagaagaaacttaagttatgcttgagtataacttgagtaggggccaggtaggggcagcattgtgggattcagccacaatggtgtgattcaatctgccctctggtctttggttccatttaacgtgcatttattgagcagctaacttgagtcagcactgtactaggtgctatataccagggatgtacaaaacagatttgatgttgctgattaagaaagtatctgtacaagttacaaactcacctcccagagcacttgccctggagccctggagcttgccccagtcttcctcctttctaagatcaccacttacccaactgggaagagatcttggtctgcttgttttccatacctctctggtaggaggcaaagcgatctgcttgaaaatatgtctgaaagataatcagcaaataatttcaaatcttggaactgtcattatgaatttactgccattagattgtattgaggtccctgaagtcatggataaccagaagggggaatttgaagattccatttaataaaaagaagttgatacaaagaagctaagatatataataaaatttcatagttggaagagaacatgatgcttctgtattccaattactgattataccttttgttcatagtcttttaaatctgagctctttggcaatcccatttcagccgctggtctcattaggtaccatcctttctccctcagaattaattttcgcttctggaatcagaatgtcattcttaagggtctcccttattagtacctttaggaccaagttcaaactacctagcaggacataacaggcccttcacaatataactccattctattattttgacctcttctctccaacctcctttatgcactagccacagtaagtgtctgctattcacacttcagcacatatgtctctatgctttcatgcctctgtagaagttgtgccttctgcctgcaacgcctctcacctccacactcaccacaattgcaccctccttcacttcctttccatcctttgaactcttgcctatgatccttttgtagttcataagcatgatgattgagtgttcatacacatgtgtgaggtatgtcgcccccaaaccttttatgacattggcacattacctgtctgacatgaaagaaaaataataataaaaattttaaaaatgggcagccaggcgccatggctcacgcctgtaatcccagcactttgggaggccgaggcgggcggatcacgagatcaggagatcgagaccatcctggctaacacaatgaaacaccgtctctactaaaaatacagaaaattagccaggcgtggtggcgggcacctgtagtcccagctactcgggaggctgaggcaggagaatggcgtgaacctgggaggcagagcttgcagtgatccaagatagcaccactgcactcctgcctgggcaaaagagcaagactccatctc

SEQ ID NO: 660787 - DNA, 378 bp, Homo sapiens
gacgatcccgggtcgaagttgccctcacatgtgagttccagaaacactactgctggggtctgaatgtttgaccctcacattggatgccagaagattcctgcctgtggtctgaaagttttattacatcacatatggactccagaatatctgcttccagggtctgaattttttgtcaccttcacatatgtagttccagaaactatctcctgccttatggtctaatattttttgtatcctcacattggatacgagaattctcctcttgtgctctgaatcttggtccctcacctaggattcgagaatattcacgcggggatgtgaatgcttgcacttaacataggatttaagaacactgctcctggggtctgaatgttggtc

SEQ ID NO: 660788 - DNA, 382 bp, Homo sapiens
gagtcacggcaagataaatatatctcttctgtactctctgtggtagaaattactgtcaggtaatgagatctgataaaggaaattatatcaaaacatagcttctattaactctctctaggcagcataggaagttaagagtcatcagaaagaaggagaatgccaacaaaacaattagaaacaaagtaatactcaggtgagattttaaaattttctacaaagtacacatatatacacacaaacacatgtatacatatgcacaggaaaaggtctgaacagctgtaagccaaagacatttctggaaacttggaagaggagactggaattagaagtggcggccgggtctctaatttttagtattctttatcaggactatttatttatg

SEQ ID NO: 660789 - DNA, 215 bp, Homo sapiens
tattatactatataagatctttctgacttaccaattatgactcagtactgcagttgacgaatcacttacttgtagcttttccttctctctctgaagcatctgataagctgtaacaagctaaaatatagtcatcaacaacattagtcattcctaaataaatgcaattattctaaagtccactaaaaaattctctttatgatgagccgactgagtcc

SEQ ID NO: 660790 - DNA, 166 bp, Homo sapiens
  misc_feature (47)..(47): n is a, c, g, or t
tgagagagagagaccgagacagggtcttgctttgttgcccaggatgntccgaacttctggcttcaagcgatcctctcacctcggactcccaaagtgctggtatcacagatgtgaaccatggcacctggccctgccttttccatcttagcacttctcacatactgtg

SEQ ID NO: 660791 - DNA, 663 bp, Homo sapiens
aaggacacacgtgaaggcccaacagtgataagaagcttggcatcaaaaatcactagaaagtctcatgctttttatcgctatttaatccaagtgactgtcacttaattttaataatgctaaacaaactagtttgagagaaatctcagccaatataatttccttaagggcaaggccaatatttcctgaacattaaaactttgtacccatgtaatagtttttcctcattaccctaaggaaaaaagagttgaaaccaattcaaattactgattgaactgaattaccttggaagtaaataccattgaaatatttttactctttacttttctaaataacaaaataaatactgtactatccctgttcagaacttataagaagtctttcatttttgacgaggaaccttaaagttcttatagctctctaggtcatcagaggtaggcaagaccaatccaattttaaatgtctggtgtgttctatcattttttggagctatctttgcttagaaattttagataaacagagcaaatgataaattgctggtaaggcattggaaacaaaatgactactcatagaaccaaataaaagccttccatttgaaacctaaaaaccccaatggttttaatatcctgggtatttaggaaaaaccctaaaggggaaccaaaatgc

SEQ ID NO: 660792 - DNA, 248 bp, Homo sapiens
ccgcctgctgctgaggatgctggagaagcggatggaccgagcggagcacaagggtcgcttcagtacagacacgatgaaagggcagctgccaaggatgtgcacaggctccaaggccagagctgtaaggaacccccagaagttcagtctttcagggagaagatggcatttttcacccgagcctcggaattaatatcccaggctctctctgcatgcattccacaaccgggtaccgacggctcgaacttcga

SEQ ID NO: 660793 - DNA, 238 bp, Homo sapiens
aagagagagagatttcgctctccaaaaaagaaaaaaaaagtaagtcgcccctcactcacagcggacactaaccacatacctttattagtaacgcacaaaagcctaagcctcttaagctttcggtagtacccagcgccatagcccccccaaccccaatcactcaataggcaagcagcgacactccatggcgaccctaacccgtacccttcgacgctcaacaacgccgatacgcgctata

SEQ ID NO: 660794 - DNA, 952 bp, Homo sapiens
gccaaactttttgtggaagaatttttatgagtcgcccccccaacaattggttaaaggggaggttctcccagacccctatcttgagagctcaccccggagtattttggggagacagcttggtatagagccggcgaaatctcgagagtgtgtgccccctctatagaatgtcgccccgcccacgcgctgtttaagagaagacgtccctcttttcgtggggaagtaaaccaccgcactgtgtttttgtgttctctctttccagagacacccctcgcggttagtgcggagatacacgggcagtagaccgccccccactttttgggggaacccacactttctctctggggtaggctacacgagccgcacttataatttgtgtgtatggacttatgagggttatgggacccctgggggtccccttctaggagcggcgttacacagagtgggagcgtgttgaattttggcttgccccgacgtgaacagatcgttgtgtatgcacagagcggggccgctctgcgttcacatcaccacgattaaaaccccctctgtgttacacacagtatgacacccttccccgcagaacttcttttggtttatgcacaggggcaccaccacctgaagtgcgttagagatgtcttccccgcgtgaattcttatatggcccgccacgctagttcttgactgaccccgagtcctcttttttccgctcctttattgggaaactacaactgggggaccacacaccacgcaatcgagaccagctgtttgcaaactttctggggggggggaaggaccctctcttgtgcgtctattcccggagagcttggacatctattttgggatgtatattgctcgcgttgttgtatttaccccgttgattcatagtcactttttatgggattgattggccttgaaccccccaccgttaattttaaagaaatgggtgtaaaaaaaaa

SEQ ID NO: 660795 - DNA, 1335 bp, Homo sapiens
gtggtcgtcgtcatgtattctggggtgggtgtgcgtgctggcagtcgttgtattcgtgctgcgctcgttctcgtttgtaggcgtgtacgtcgtgtgtgggggccccgcgcgctggttgtgccgcaccgtgtttcccccgtattgtgtgatgtgggggcaaaagcacgggggttgtccggagggtggttgtctagaggcgcccgctgcccctattatagtcgtcggcctctttccccctggcgcaggggtgtccccccccccgtggtagaaccattgcggggccccgcctttttggcgctgttgtgcacgcccacgaggttgtccccacgaccgcccttccttggtccaacgggaaaaaatgtggaatgggagaggggtcctgtgacaaaaccaaaggggttgcaagggaaggtcacaaaggttgaggaaccccacgtgagcgccaggaattaattgttaataccggggcgtatattaagaccccccggatgttcgccccagaggggccccctccccgtcgcgcgaatagtgcatgccctatgtaggagggccgcgccgcaatgagagatagatttatagggagaattccagagggagattgaggacccccaggggtctaaacagccgcacctctatacgtctgggtaccgcccgcgaacgtctccgatgtgaccggaccgccagtactcccccaggtgacacccccttagagcccaccaagagtgcgccaaagaggcacctaaacgccaccccgagtcccgcccgcgtgagaatttctgtcccgctctcccgaaggcttgacgccaggcgccggggcctgaggtaaaatggcccggcgttttaccacatcttcgtgacccatccatacccggtgttttagtcgcatccccccaccgaggagagaatatatatagagaatgtcccgacgcgcacattagaggaaatgtgcacccaagagattgggtgagctcggagagcaccctcaagagtggcgttgcgtttgttgcccccgttgcaccccagatgaaatagacacttatttcgccatttatctatcgccacgcccatggggttttttattgattgtttcaccctagaagacagtcttcttttgttgggtgaatacaccaaaccgtggtgtttttgaaaaaagcctcggttgtttcctccatacgcctcttaaaggtgttttaaattgtgttgcatatgctgggtcccacgttggagatttttaagaacttcacttgtttaatttgtaataaaagtttaccacttgattttttccaaaaagtccaccaactgccagcccctgttaataaaggtttttaataatta

SEQ ID NO: 660796 - DNA, 140 bp, Homo sapiens
ctgttcttcagttttatgaaggctgagagactggttcatgacatttaaagggaaaaaagccatctccataacataaaagtgcaaggtggctctccctctctccctctctccctctctccctctccccttctctctccact

SEQ ID NO: 660797 - DNA, 635 bp, Homo sapiens
  misc_feature (2)..(2): n is a, c, g, or t
  misc_feature (132)..(132): n is a, c, g, or t
  misc_feature (136)..(136): n is a, c, g, or t
  misc_feature (138)..(138): n is a, c, g, or t
  misc_feature (149)..(149): n is a, c, g, or t
  misc_feature (154)..(154): n is a, c, g, or t
  misc_feature (201)..(201): n is a, c, g, or t
  misc_feature (203)..(203): n is a, c, g, or t
  misc_feature (300)..(300): n is a, c, g, or t
  misc_feature (305)..(305): n is a, c, g, or t
  misc_feature (312)..(312): n is a, c, g, or t
  misc_feature (316)..(316): n is a, c, g, or t
  misc_feature (321)..(321): n is a, c, g, or t
  misc_feature (336)..(336): n is a, c, g, or t
  misc_feature (351)..(351): n is a, c, g, or t
  misc_feature (357)..(357): n is a, c, g, or t
  misc_feature (410)..(410): n is a, c, g, or t
  misc_feature (419)..(419): n is a, c, g, or t
  misc_feature (421)..(421): n is a, c, g, or t
  misc_feature (423)..(423): n is a, c, g, or t
  misc_feature (446)..(446): n is a, c, g, or t
  misc_feature (458)..(458): n is a, c, g, or t
  misc_feature (554)..(554): n is a, c, g, or t
  misc_feature (559)..(559): n is a, c, g, or t
  misc_feature (586)..(586): n is a, c, g, or t
  misc_feature (615)..(615): n is a, c, g, or t
tntttcttttttttggtttgtggtggaataacaatagcgggctctgggactcacattgctttgggggaggctcaagcttcccagaatcccttgtccctccccactttgggcacttaggggtggggctggggngtgngngggccaaggcngggcntgattgattaaagctaacgagcagacagaaggcactggtgggtcacntntcgggcctgggagagggagggcgtgggccaggccccatgtgacaccaggggctccttggcatccaggcttggcgtctagtcctttcccttccctttnttggntttggcntttnctttngtctctggcgggctnccgggcttggtgccncggatngtctcctggcactgagcattgtagcgcgccttcttcagggtgccttggcggtntttggtgcntntncccccatcacacgcaccccagtnctcaaacttgtncttgcagtcggctccaaactccttcttccagttgcagggcaccctgcaccggatgcgctgggtctgggccccgcaggtttccctcttcggtaaccngggcnggggtccttgctgctgggggtgggggnccccccccgccccctccccgcccctcgcnccccgggccgcccttctctc

SEQ ID NO: 660798 - DNA, 249 bp, Homo sapiens
ctatatccagcaaatttggttcttccccaatgaaggagaaataaagtatttcccagacaatcaaatgccgagaaaattcattactactaaactcaagggagtcctacaactggtggtgaaatgatgatagttactatcatgaaaacacatgaaactataaaactcacaagtaaagcaaacacacaaaggaggaggagaaaggactcaaatgattctactacagaaaaccaccaaaacatggtgacaaat

SEQ ID NO: 660799 - DNA, 130 bp, Homo sapiens
attactccggaacgtggtgggtactgggctgaggagatccccaggcgatcccgaacctaccgactcaaataccagtaccaccagagtaaccaccctactgccccgatcccagactcgacacctatatgat

SEQ ID NO: 660800 - DNA, 530 bp, Homo sapiens
  misc_feature (60)..(60): n is a, c, g, or t
gagtgaaccggccttttctgggaaagtaattccaggccaagtgagcgccgctcctctggnctctgggagtggagacccaaaacgaatgcctgggagactttgggcttcctgaaccctttcccgatgaaaaaccccaatgggcccaccccctcccctttgaagttgggtttttcccctgccccgcccccctcctaattaggggcctagggaaagtcccctttgggcaggaaaacctttttctttcccttaagcccctttttggttttggtttttgccaaagatcttggattccccttttttttttttttttttttttttaaaagccagggttggagaggctttctttcccctaatggaaaccctggaaatttcccgggggggggagagggggactgttttttccccaaattacccctccctttttaaaaatttttggccctggggtttttttttttcccggtccaccctttgggcggccccgggactcttggcccctttccataaaattgtttgggaaataacccccccca

SEQ ID NO: 660801 - DNA, 539 bp, Homo sapiens
agcggaacttgcaacactccgaggcaggaacgccgccgtctggaacgggcaggtcccagcagctggggttccccgtcagcccgtgagcggcatgtccaaccccagcgccccaccaccatatgaagaccgcaacccctgtacccaggcctccgccctgggggctatgggcagcatctgtctgcaggaggtatctgctactggctacccgcagcctggctacggtcaccctgctggctacccacagccatgctctccgaccacccgatgcccagaacgtacggaccaggcatggactatgacgcgcgacgagagagaggagagtgatagacccgggcctgcacagtggcatgaacaggactgagcgaaacacatcaatacagaaaggaaaccaccactcatcaccctggcccacgccacagtcacctgtcacacaccactggatatcatcaccacagcaggaacatgaacaccgcgtcagtgagagagacaagtgcagacaaaacggagaccaatgatgcctccgacgaaaactaacagac

SEQ ID NO: 660802 - DNA, 291 bp, Homo sapiens
ccctgttttccaaaaccccgcccccgggtagggggggccaaaaagggtccccctttcccccccccccaaaaagggggggggccccggggggggggccccagggagtttttttggcaccccccggggggcccccccccccttcccaaaacaccgggggcccccgggggggggccccccccaaaaggcggggggcattttaccaaacccccaaggttgccttttttcccgggggggggtttttttttacccccccctgggaatttttttttaaaaacgggggttcccttggga

SEQ ID NO: 660803 - DNA, 344 bp, Homo sapiens
aacattcagaggccttcattagcacaactctctgacccccttctgttcattcaacaaacccctccccaatgtgagctccaccaggacaggggccagggctgccttatttgtcactgacagcacccaacacagtgccttggcccctgacacagccacactttatcatcccacaatttggggagcaccatcctctaacccaagaacaagcgatgaacaagacaaagcacagctctcaggaagcttatggtttaggggaggagacaaaaaaacatcaaacagctgaaagagtgacaatgctacaaagaataaaaggtggccaggcgaggtggctcacacctgtggtc

SEQ ID NO: 660804 - DNA, 495 bp, Homo sapiens
  misc_feature (51)..(51): n is a, c, g, or t
  misc_feature (249)..(249): n is a, c, g, or t
  misc_feature (464)..(464): n is a, c, g, or t
aggggtgtgaccctaccatgaagaaggacatgaaaacattttgggattctnccaactccaaaaaggttttaacagactgtgatggttaatattgagtgtcaacttgattggattgaaggatgcaaagtattcttcctgggtgtgtctgtgagggtgttgccaaaggagattaacatttgagtcagtggactgggagaggcagaccaacccttaatcagctgccagcactatctaatcagctgccagggnggctaggataaaagcaggaggaggaaagtggaaggactagactggcttagtcttctggcctccatctttctcctgtactggatgtttcctgcccttgaacatcagattccagggtcttcagcttttggactcttggacttacaccagtggtttgccaggggcttttgggcctttggccacagactgaaggctgcactgtcagcttccctactttngaggttttgggactcggactggcttcctggc

SEQ ID NO: 660805 - DNA, 722 bp, Homo sapiens
  misc_feature (43)..(43): n is a, c, g, or t
  misc_feature (76)..(76): n is a, c, g, or t
  misc_feature (113)..(113): n is a, c, g, or t
  misc_feature (117)..(117): n is a, c, g, or t
  misc_feature (122)..(122): n is a, c, g, or t
  misc_feature (141)..(141): n is a, c, g, or t
  misc_feature (149)..(149): n is a, c, g, or t
  misc_feature (153)..(153): n is a, c, g, or t
  misc_feature (170)..(170): n is a, c, g, or t
  misc_feature (188)..(188): n is a, c, g, or t
  misc_feature (213)..(213): n is a, c, g, or t
  misc_feature (321)..(321): n is a, c, g, or t
  misc_feature (448)..(448): n is a, c, g, or t
  misc_feature (467)..(467): n is a, c, g, or t
  misc_feature (555)..(555): n is a, c, g, or t
  misc_feature (590)..(590): n is a, c, g, or t
  misc_feature (617)..(617): n is a, c, g, or t
  misc_feature (645)..(645): n is a, c, g, or t
  misc_feature (703)..(703): n is a, c, g, or t
attactggcttatgaatggctgaaacactcaacaaactaaaanactcttatgaagagcagctttataaaacctacnagaaacattacggccaagacacaccagaaccaaagcntagncatcnccagggaagacggtaacantgattccnagancatcatcatcatcattntcaagtccttcatcactntctttagtaatacactgggcacgtntctctcctgggtttctttttttcttatgaatatatgaggagttatttttctctttgatctggggatgtaagtgagtgatcgtttccctttccaaagcatgcggtaggnagtggtgaaacctctcaattcttttcttgtgttcctccattttttgatttgccaaatttaacaggaagtgaatatattcctctgtgaccatcagttttcccttatggcttaatggaactcctaagcnatgtgtccgccggacagcnaacagagtttttcctctttttcccaccgttatgccagagttcctgaaaccagaatctattgccatggaatgcagaatctgtgcatccngcaattgtcgacacttcacaagaagaacaaatggnttaaatttcaaagtggcatcaccattngctttcttcagagccacaatcacatcancttttacacaaagtttgtgtgttaacagttgccagccacagttttgtttctgaacctnaaaaccatttataccccgg

SEQ ID NO: 660806 - DNA, 932 bp, Homo sapiens
ggtgatagcggtgcaccgcagtatgcctcaacatctacgctcacctccggacgcagctgatggcgagtacttgtgccatgccgcgttcacctacgcttaccacgacaaagaaactaacagattggcatgcacatatgtgacagtaataagagtccgttgtcgttaatcatagattccctgaatgacagtcgcaccgactgagaagaagtgagtgatggtggtgagtcgaatgcgcgtctctcagggccagagcaattagccacgaacgtgccatgtaccttccatcaatctaatacgctttgcatattccctatacagagggacgatttacctatctgggaggttgatctcctaatgcttgggtgagtgccatgtgcgagcaacgatttcgcatactgagaaagacctgactcagagcacctttcagacacatgtaggaccaaggcgcgattaaagaagactagaaaaggattgaacaatacaatcctcacataccgcatgcaatgggaaagccggtataccccctagtatctattgtgagtttcaggacagcaagtgcaactaagggcgatagggaaaaacagactagtgacttggaattcgtaccactttcgaagcacgttacacatctatgggggaaaaacccaatttggcacacagatactgagttaacttagagagaacaattgttcaattgtgggagcgaacatccctatgccaagagtcttgtgtatgacaaggaaccaaattcgtacccaattggaagtatgggagcaccaagaattgaaggtgagtgaataagtgccattaaagtaagtatgacgttggcaactacaatcataagaagatagtgagaaaggaaaaaaaggagagtgggaggaagggatgaattcaaagaaagaaagaacaagaaaaagaaatgaaatgaaaaa

SEQ ID NO: 660807 - DNA, 227 bp, Homo sapiens
cttaccatttgcatttgactaattagttgcttttcaaggactccctatagattattgagtgctggcttgataagtagggccttcaaggatatgttttaggttctccgcaatgattttaaggacagctcttagcttttgccttcaagaagtttgtataggaacttgttcttttccttatcagttcagcttatgagaggcaaattctgagaggcaaaattcttataatt

SEQ ID NO: 660808 - DNA, 1710 bp, Homo sapiens
gcgcatgcgtcagctgcttccacgatgaagctgaacatctccttcccagccacctgcgctgccagaacactcattgcaagtggactgatgaacgcaaacttcgtactctctatgagaagcgtatggccacagcaagcttgctgctgcacgctctggcgtgcaacgcacatggaaacgggctcactctgctgcgtcctgcacactcacgctggctggcgaagcgcacacacaccacaggcctatcccccactgcaacgaccagggctgctcctctagaccccaatgcgcctgtgctcccgccctgccctaactgacgactacacgcggcgcattacctggccgcccacggcaccgcaaagcgcagcacacatggcaccgaaccgcaacacgacgacacacctcccacgccatcgccgcgcatccgccacctcgcccggcactcgccaacactccctgacgcccgatcccgtcaacaccctccgcccacccactcgccaaccaccccagcggacgaccgacagcgggaaatacttcccacattcgcgacccattggacccattgacataacatcacacaacgctcggcccctccggcccaggccattagggggccccacccaaacacagagacgccttaccgccagcgaacactttccacggcaaaagaacacctcctctaccaacacagtccgctctgtcgtacaacagacgcaaccagcaccatcgacgtggcgtcacccagcaggcaaggacagcttcggccagggataaaaccggaaacacgagccccgcctataaaaaagctaaacacaacgaacacctgcggctcaaggcaaacgatcccaccaagcgaggacgccccaagacatcgcccacccccccagacggaacctttaccacaggcccggagccattccggctgcaacacatcccacagcccggcttagatctcccctcggccagagtcgcgacaactaaaaccccgcgcccggcgccctccaaccatagcgcgcctacctcgcgcgcacgacaacacagcatcgaccgatcaacccccgaagccgcgacacacccaacactcacgccacggcacacgcgacaccgccccttgcaccagcacgacctacctcggcccgaaaaccagcctcacacagcggctcccaacccgcgctccgccacacctggcacacgcggcacgggcaccatcaccgcgcaacgcacacatcgccgcccccaaccgaccaccccaccaactctcgcccgccacaccggcaagccacgcggcacgccaccgaccatcgtccaccacactccctggccggaccgacgctcgcatactacccactcatcacgcggtcatctgaagcgtctagccggcactcagccagaacagacagtagcacacaactaccagaggagagctacgacaacacccagacaacgaccagacacccaaggcacgcgcctgaacaagacagacaccggagcacagacagcaagaacagaacacccacaggcggcaccacaaagcagcgcggggccagcgcaagagcaagaccggacactagaagacgcgcagaagacaaggcaagcaagcaggaagccgccacaccacacgccgcgtcgctagggccaagcgcgaggaaaccggtcagagcgccccccacgcgacggcgcgtacacacaccccacccgaaccgcagcccatcg

SEQ ID NO: 660809 - DNA, 629 bp, Homo sapiens
gttactcagaggaatacacctaccttaaaactcccccgataaaataaggtctctaatagctaattaattttggaagaaaagtgattccccagcaatggctccaggcagtgcaggtggcctgtacctagaggcaacagcagtagctactcctctataggtaattcctaccaggaactcagcagaggccccgaagcaacatttgcaacagcaacagcagcagcagaggctgatgaaatcagaaagcatgcctgtgcaattgaacaaagggctaagttctaaaaacatcagttcatctccaagcgttgagagtttgcctggaggaagaagaattcactggctatccaccttcatctgctaataaaaaagattccttttttagcaacatctcacgtactcgctcacacagcaaaactatgggcagaaaagaatctgaagaagaattagaagcccaaatttccttccttcaagggcagttgaatagacctggatgccatgtgcaaatactgtgcaaaggtgatggacactcatcttgtaaatattcaagatgtgatattacaagaaaatttggaaaacgaagatcaaattctgctttcctaggcgggataaaacagatcaagacttctaaaagg

SEQ ID NO: 660810 - DNA, 298 bp, Homo sapiens
ctaagatcctactaatgcttcagtactctgtcgagcagttttgtacagtgtaaatcatgcacacaacagtcaacacgcagacacacatgacacaatgcaatatctatgctactgccaagacactatcagtatcatcccatcttcccatcacaccagccagccagcagcgttctagaaacagccctttggattgtcgatcagcatctccaaagtaagtggcatcttcctccgaacagggagcaggtagtccaccagtagtagaaacaacaaacactagacctccaaacagccatttggt

SEQ ID NO: 660811 - DNA, 569 bp, Homo sapiens
  misc_feature (107)..(107): n is a, c, g, or t
  misc_feature (165)..(165): n is a, c, g, or t
  misc_feature (233)..(233): n is a, c, g, or t
  misc_feature (238)..(238): n is a, c, g, or t
  misc_feature (404)..(404): n is a, c, g, or t
caagcccccccggggcgcgcaggaaagggccccgggtccccggattataaggggccccattgggggcccaaggaagggtcccctcaaatgatttccccaggagggtntggagaggcccccaccttaaaggggtggggttctgggaccgctcccgcgccctcttcncctcccggggaaaagggggtttctaaaattaaaaattcgtggggttaggtccctggccatgaaaaggnccaanccctgggtttcccgggcaaagaagttctgggttgttgtttcaaaaccccaaagggccttttttttgggccgttgggcaaaaatccgggccctccaaaaattgggcccccccccaaaaaaatagggggccccccccccggggaaggggggttccctaaggaaaattnttcccccccccccttgtgaaaacaacaaaaacgggggggccctcgggccgggccgggttccttaaaaggggcccccggggccccgggcccggggggtttttcccccccccccccggttttcccctttggggtttttttttggtttttaaacggggggggctttta

SEQ ID NO: 660812 - DNA, 569 bp, Homo sapiens
  misc_feature (26)..(26): n is a, c, g, or t
atcatttataaaaggaagaaactatntcatgaactagttccattaatcagacataagcatatgcaacatctggaaatattttcttcttatggggaaagttgaacagatcagcttaacaatatttttttccagcatttttgtaaggcattctaacaccttttaaatgcatctgtttgtttctccctgaaatgaaagattattctcatagacatagctgtaaatatgataaagcagccatgtgaatgactcatgtgtgggctgtttttctgttgtcagtaaagttgtatttcctggtgtttatcttacgaataatttggtgataaatgtgttcacctgaaaagttgtcaagatacaagatttagtcatataggaatgtatttctaaatgaatagattaattatgtttgtatagttttatcaaatagccaaaggtcttgagcttagatatccaaaaataaccttgtgtagtaattatgtctttaaataacaggtgcctattgtaatgccatggagtctgtatttaaatatattgataacatgtaaaatgttgataaagaagtttcactgtta

SEQ ID NO: 660813 - DNA, 1034 bp, Homo sapiens
aatgccggccgcgagaccaagggggaggaggggcagtgctggtgctgggtaaaactactgcacaatgcgaaggaatctgggcccccagacctctcgccgcccagctctccagaggcagactgcaccttgcctccttctgctcgagccccaggccccacagactccgggcaatacccacaaacccacagatggcgcgcaacggcggcacccccgtaactgcgtcacgcaccctcgactcgccactcgcgccagagcccgcgagctcgacgcacgccgcgcgattccgtcacagagcggtgcgagagggtggcgcggtggacgcctgccagcagccctggagcccgcgagctgcggcacacgcccggcccgctgcacacgacaaagccccgcccccgcagcgccatccccgcgagccactcgccagctgcgcgaccaacggacctccgacactggcatccccgggcgcagcgccagaccatcccgcgcacacgccacaaacacacacccctcggcgcccccccactggccatacggacagaaaaactcctagcacaccagccagcagctgcccccaccacgcgcgctcgagccactcgggacggcacgcaccgccgcgacacccgcgccaccgcctgccaacaccgcagcgcatcgctcgcccgacccccgccctcgccctaacagcccgcgtccactgcccacgccaccgcccgcaactccccacgggcaacaccggccaacacacccgcacccacgccccccccacaccccccaacggcaccaacccacggcccatcataacaagacggccaggaccacacccacgccacaccccgctcggccccgcccctcccgcccgcacggcacgggatccacactggcaaccgccgccacgcggcccccaactcaccgagccacccccatggcacacacaccacgccaacccactacacacccccggccactcgcccccaacccagcgcatcgccgaccacccgcactcccacaaccacacacgccaacacaaccgccct

SEQ ID NO: 660814 - DNA, 369 bp, Homo sapiens
  misc_feature (131)..(131): n is a, c, g, or t
  misc_feature (135)..(135): n is a, c, g, or t
  misc_feature (271)..(271): n is a, c, g, or t
  misc_feature (316)..(316): n is a, c, g, or t
  misc_feature (321)..(321): n is a, c, g, or t
  misc_feature (358)..(358): n is a, c, g, or t
ctgtggatttggtcaaggcccttgacagagacacagtcctttgctctggtgaattacccttctttaaaggcaaatccggagagaccctttgaagtccaaggacaccgaggaagaccacttccacgtggacnaggncgaccaccgtgcaaggtgccccatgatgaagcgtttaggcctgtttaacatccagcactgtaagaagctgtccagctgggtgctgctgatgaaatacctgggcaatgccaccgccatcttcttcctgcctgatgangggaaactacagcacctgggaaaatggaactcacccacggatatnatcancaagttcctgggaaaattgaagacagaaggtctggcnagcttacattt

SEQ ID NO: 660815 - DNA, 205 bp, Homo sapiens
gcacgtgtgcatgagtcgcgattgtgccattgtaccagcctgggcgaagagcaaactctgcctcaagaaaaaaaaaaaaaaaaaaggccattgtctgtctctcgggaagaatttctgctttgaattacccctagggtctcccattgccaaacatgcctccgatcttgccccgaaacatcattgcaacacggtcggggatcctcta

SEQ ID NO: 660816 - DNA, 137 bp, Homo sapiens
agaggactccgctctcacccacccaggaacacctctggctctgcttcacttatttcttctatgtgattgatcaaggagagacggatgtctatgttaacaatgaatgggcaaccagtgttggggtgggtggagagcgg

SEQ ID NO: 660817 - DNA, 93 bp, Homo sapiens
ctagaagattcagcaaagtacttttgtgctcttggggaaattcgggctgggcttcctatcgtactgtgccttactttgacagcacaactcttc

SEQ ID NO: 660818 - DNA, 1138 bp, Homo sapiens
tgtcgtgaaaagtacccctatatagccaaaatgggaaaggagaaagactcatatcaacgagtggtcgtcatgggacatgctagattcgggcaagtccaccactacgtggccagtctgatctataaatgcggatggcttcgacgaagagagaccattgaaaaatttgagaaggaggctgctgagatgggaaatgggctccttcaaggtattgcctgggatcttggtataacatctggataggctgaggcggtgaaccgatggtattcaccatgttgatattctcgctgtgtggaacaatttgatgaaccagacaagtgactagtggtgacgtatacatctgcagtgccccagggatcactaggagtactttgatcgaaaatagcatgtattacagggtaccatctgcagtggcctgactgctgcctgtcctgaatggatatgctcgctctggtgtcagcgtgcaattctgcatagcgtgggtcatgctcccacagcaactggcgacagtaccccgagtagcaatgccacttgctggcgtctacactacctagggatggtgtagagagcagctacacttgatccggtgcttgacacacatactgcgattccagctggagccgacccatagagcccagacagagcatcatgcacggcacacatcgtccaagggaagtcagctactgaccattaacgaccacatgggccttaactaatctcacgacaccagcgagcatccggtgccaagtcgccggcgcctggaaaggtgacaaccatgcctggaagccccaagtgctagccatgccttggcttcaacgggactggccacacgccaccccgacacggatgcgcagtgcgcagttgggtacccaagctggccacgagggcctcgggcaccaggtaacctaaacagccaattcggcgcccaacttggaagaaacctctgggagaccgggactcttcccaacgaactactccccaccatctggggggggcataggcgccactggcatgttggcacccatgggcaatccggcgtgtaccacagaaccacggcatagaggatgaacaaatacgaacacacaggaacaacgtgaaacaacaaagagaaactctgccgaaagaccgccagcaacatcag

SEQ ID NO: 660819 - DNA, 188 bp, Homo sapiens
ctacggcttatgtgggtcttgctgcttctttgtagccttcatcagtgtttgctgaagatggctggtatatatggctgagcaagatggtggtgacggttgatcggggtttatcgattacagaacagtgctcctctatgcgggatatgacagcaccgccagtgtcctattgagttttaatgcttgtggct

SEQ ID NO: 660820 - DNA, 482 bp, Homo sapiens
cacgagggctaccagtacctcgccgagtcgatccgcaagcacccgccgcaggacgagctcaagggcatgatggaaacggccggcttcgcgcgctgccgctaccgcaacctcagcggcggcatcgtcgccatccacgacggcttcaaggcctgagtgcaggtggcgcggctgtcgaaccgccgcggcacttccatcctctgcgtgccgccgcacccgttgtaggcgcgcctgcgcgcggtcctgcagggcgcgatgccgatgcgacgagaggatctctgcgtttcctggggcgttgcggcgcaatgtcccctgccacagcgtcgtgatgcagtgcctcgctcggcacggcgcatcgtgtaggagcgcgctggcgcgcgatgaggcgcttccgggaatgcccgtcgcgcgcgagcgcgctcctgcagaggcggacgtgcgcgcgggttggcgcagcgaaggacgatcgtgcgatccgcgccgat

SEQ ID NO: 660821 - DNA, 820 bp, Homo sapiens
tagtcccaaaataaaataactggttgtttaacaaggagggatgttcaggacaaaccagaaagtccaagcatgtcatgaacattggtgtaagtcatgataagattttatatatatatatacacacacacacaccccaaaagcttttatataatcaagttgtcatattattattaagttgtggtttgcttagggaagaaagagctaatttttaaaaaatcaaggttattacatccatgtatcttcctgtgtatgcttttaaagtccttgtaacattgagttacagggctttaactcctgtgtctgaaaaatcacaaacactgatgacaatcaaagcctcatcttaaggccccgtagaagatgccaatcaaaataaactgcattcctgaggcactaggcaagaaattaaagctattcaactcctcaaggcccagggactattgcggaagaggtgggcgcgtaagattgtaagggccgattttgaaagatccagtaagttcagtttctctatgaactaatcattcaagtcaaaggcacactgatgcaaaatcagtatatggacccctgtgtctgattagcaaggttttcttgaaagcattaaccaactccttcataaaggttataaaaggcttatggaagttatattttaataatcaagattaaatcttatagtttgtttacaaaattttgaaaaccaaatgtgattggtttcaggctgttatattaggggcttcttagtaaaaaaaggttaagtcaagctctctcaaagaatgaaggtattaggctttgtttgaaatctttgaattatcacgtgggattactg

SEQ ID NO: 660822 - DNA, 113 bp, Homo sapiens
agaccatttagtattctgtagttgtttaacacacacttaaatggtcttatgggggaagggaaaggggaggttaaacaactacagaatactaaataaaaagtttggccaaaacc

SEQ ID NO: 660823 - DNA, 146 bp, Homo sapiens
cttctcgtctgtctgtgtatgcccgcctcttcacgggcaggctcaatttcactggttaatagtagagactgcaagactagaagaccctatggagctttactttattaatgcaacctgtacctaacaaacccaatggtccaggtatg

SEQ ID NO: 660824 - DNA, 352 bp, Homo sapiens
tactctgtgcaaataaagaagtggcttgttgtttgagaagtttaacccggttgcttgtgctgcagccctgtctacttgggcacccccaccacctgttagctggggttgtggagtgtcttttgtagctctggactggaggggtagatggggagtcaattacccatcacatgaatatgaaacatttatcaggaagggtgccattttaatgggatgattttcttcgatctcataattaaaatgacctgggtttggggagagtagaatgtgccgggagccataggaatgtctgtatgttggatgacttgaatgcgacagttttaaaaaaggaaataaggttataatataactcaga

SEQ ID NO: 660825 - DNA, 239 bp, Homo sapiens
attcgcgaatcacctatgtgttctcttaattttgtgctagactcagggaactggtgcatcaccctaccaccagaagttaccaacaggtttctaagagcatttttcatgcagagttcctcccaagaattatagctaatttgagggcctttttggataccacctttttgcacaggaggttaaatggcctttaggcgtgaatgttaaatgtataatgccagacttggaagcacactggcaca

SEQ ID NO: 660826 - DNA, 873 bp, Homo sapiens
ttggtggggttacacgcgggttcaagatgcgtatcgaaaagtgtaattatctgttcgcgcgggcccatctatcctggcacacaggatgatgttcgtccgtcaacgattgcttagggtgttcagattttgcaaaatcgtaaatgtcataaaaaatttaaaaagaagcgcagtcctcgcaaatgttatggtggaccaaagcattcctggaaaggagctggtagaagagcgttacagtggagtaattcatttgagatttggataggacgtagaaatgaacctatcaaataccagtgagagctatggaatagaaattagtgatgcgatgaagagagttgaagaaatcgaacagaagcgccaagctagatttataatgaacagatcgacgaacaaatacatagagctacagacaaatggtcaggacttctcacagagacgtcaggcaaaacagtccaatcttatgcgagcccctcttgcgggcgaagggaacacagttggagagagacagatggttgcagcagttacacgaggatgtggacgtggaagatgctccttagagatctgtgtagccatatctttgcatgtacatgtgaaaatgccgttggatactgtggtaactgctaagttatgtatgttttacgtgaggtcactttgagtgaaaagggatttaaaagagatctttctggcttggcatctacataatgtctgattttagggggaaaatggattcaggttaatctttccggagacgtctggtaatgtgggaactttcatgtgcttttaaagaaagggcggaaaggggggattggaaaggggggcgtggttgctctgggagatgggggggaaaaaatttgggaaaccgtgtaggggggagaa

SEQ ID NO: 660827 - DNA, 171 bp, Homo sapiens
  misc_feature (28)..(28): n is a, c, g, or t
  misc_feature (59)..(59): n is a, c, g, or t
ttcacagcctcctgatttcataaccagnccggaccaccgtgcatagggtggaaaccaanactgctccagccgggttatttaaaagaaaggcagagtttgtggtggctttttttttttttttttttttggattgtttgtaatttttttaaataaaagtattttggaaggaga

SEQ ID NO: 660828 - DNA, 285 bp, Homo sapiens
cggttttctgattatggtgtacactcctccccactgggtgtctgttcttgaggccagggtgagaggtggaggaggatggttcacgcagatcagtactcgggggaggcagtgtaccattgggaaggaggagtacaggctgttcagaagtctgagcgaagatgaactggcgcagattgccatcgagcagagtctcagaggacaagaaaaagggtccaaccactactgatgccaacccgtcttttattttccaacccgacaaccctcccaattcttaccctcgttcca

SEQ ID NO: 660829 - DNA, 102 bp, Homo sapiens
  misc_feature (72)..(72): n is a, c, g, or t
  misc_feature (102)..(102): n is a, c, g, or t
gcgggtgaaaaagttgagaagccagatacttaaggagaagagaccgaagccaagagggttgatgcctgggtnggcaaggttgaaaaagggttaacctcaaan

SEQ ID NO: 660830 - DNA, 113 bp, Homo sapiens
tatagcagggtacattctcctatgccagagatggtgagtacagtgatgattccttgggactaggaatcaccgggagaggcaggtcactgtgaatggtcatgcagcatgcacac

SEQ ID NO: 660831 - DNA, 249 bp, Homo sapiens
ggtagagcgtctgcttggatccagttgctgtggctctggcataggctggcgttacagctctgattagacccctagcttgggaactccatatgctgtgggaagagcctagaaaaggcaaaaagaccaaaaaaaaaaaaaggagagaaaacgaaattttgtttggggggaaagatgctttggggcccgaatatagttgaattatttttgaaggggctttttggtttcccaggaaattaagggtttccaatt

SEQ ID NO: 660832 - DNA, 664 bp, Homo sapiens
tgtatttcatccacggaccggggctttcagtgataagattagctggtccgctgggtcgacaattaacatgagctcatgacccagctgtaagtcgctccttctggccatatccttctgtatatggctgcgcccaaatacaggataaatactgtacagtgaggtgtgtacatcaactgttcagcttcctgggaaagtagtatcgcggtcacaggagctactacaggtatcgggaaggagacagccaaagagctggctcagagaggagctcgcagtatattatagcttgccgggatagtggacaaagggcggaatatggtaggccaaagagatccagaccacgacagggaaccagcaggtgtctggtcgcggaaactggacctgtctgatactaagtctaattcgagctattcgctaagggctatactctcagctagaggcaacaagcacctccaacgtcttctgatcaacaatagcaaggcagtagattgatcgtcgtccgtactcgaaagacagcacgatcggcttcagacgatagcacatcaggagtcaaccactatgggtcacttcctcctaacccatctagctgctagagaaactacacggaatcagccccatcaaggatagtaaatgtgtcttccctcgcacatcacctgggaaggatcca

SEQ ID NO: 660833 - DNA, 126 bp, Homo sapiens
aactggaaaactggtcgtcctggtgagcgtgggcctcctgggcctcaggatgctcgaggattgcccggatacagctggcctccctggaatgaagggacacagaggtttcagtggtttggatagttg

SEQ ID NO: 660834 - DNA, 376 bp, Homo sapiens
acgaacgaaaagaaaaaggaaaaaagtatctatatagttagactataggtcaaagatataccttcataaaagaaaaaaaaatcaataaaatttattcacatggccatgcaccatggctcacgcctgtaatctcagcacgtcaggaggccgaggtgggtggatcacttgaagtcaggagttcgagaccaccctggccaccatgatgaactcccatctctactaaaatacagacattagctgggcgtggtgataggcacctgtaatcccagctactcaggaggctcaggcgggagaatcacttgaaacctgggcggcagaggctccagtgagccgagatcgcgccactgcactccagcctgggcaatcaagcttgggt

SEQ ID NO: 660835 - DNA, 1663 bp, Homo sapiens
  misc_feature (985)..(985): n is a, c, g, or t
cctcctttgttgtggtggttcgtctcttctctctattcctactagtctattgtgttggtgcgatgtaccactaattatccagtatgagttgtggtgcgtctgtttagcactatgttgtgcgtggtgggttggcttcgttctcgtgctgcgaggccgcggcttctgtctagttcatatatctggttgtggctgctctcctgcgtctctctgttgtgttgagtggctctccggcggttccaacccacttgtttgatgtgtacccccgtgccccgccccctttgttgggggggtgtttcagtatggaccgacgccactgttccccagatattttttatgtcgtggcacaccccgcttctatgttggggacccgtctccggaataaaggggggatgccgccgccccgacagaggttgtttgggtcgcccccagactctcagtagacctccaaagggcctttgttggttacaaaaaatcctgctccccgccgccctctcacgttttatccgtatatattcacccacggggtccgccatcaaaaaagggtattttcccggaagaggcgcccccattgtggccgtttgtgcccgcgacaaatttttcctcgcgcccaccccctagggggatttccccccctttttgcggcagaacagaaacacaagcgtggatatttaccgctttgagtttgggccctttctctggacaaagaaatatttcctctgctgggtgggacaccttcttggggggcccaccctctcgttgagaggagattcccccaccttattgtcccccaccgccccacctgctaaggatgggggaacaacacctcctatataaggcgcatttcccaacttatgttatctcaccggcgccccccaccacttcttctcgacaacaccatctgtgtccgcaccgtcccccctgttgtggctcgcgtccccacacccacatggtgatgattacagagacagtttttgttgttcacagncacgcacagcgagagagagtgaccccctactgtgtgtgacacccttttgtgttccccgcagagaggcccacaccctgtctcacccacccccgctttttcttcgtgtttctgtgaggccctctttgtttttgtgcgagaaacccacatgagttattcccacgagactctttaattgttgcgccacacactcgctttgtgttcctggtgtgttatacacacgcgtgtgaggcgcccacacgcgtataataactctctctatatcccacatgggtcttaccacacaacgcacacggagaatttggagcccacacgcggcaccacccgcgttctataatgtatacttacaccctctccgcgcctaacgcctctttccgcgagacgttttgtacaacatggcgtgaacttcgttctcttttcccctcgtcccgctttataggaaaatggcttattaacgctccccatttagttcacggaatagactttataccggtttgttccttggagataacctcaaagaggataactctctcttcggataatctctcattattcgccctaatttcttactttcatagctttgaatagactacatcccgttctgcaccatataccctctggctcttccttttttaccttcctggcatccctttttttacaaattacagaccttttcagatc

SEQ ID NO: 660836 - DNA, 161 bp, Homo sapiens
  misc_feature (140)..(140): n is a, c, g, or t
cgctactattaccgggtgtaattttttacctctctctacaacggttttttcctagttgtccaaacgacgcggttcctcttgggacctacccacgttaacactttaccacacggggacttttacgacgggtttctgggtgnggcaacactttacacacgtgg

SEQ ID NO: 660837 - DNA, 924 bp, Homo sapiens
  misc_feature (13)..(13): n is a, c, g, or t
  misc_feature (73)..(73): n is a, c, g, or t
  misc_feature (99)..(99): n is a, c, g, or t
  misc_feature (126)..(126): n is a, c, g, or t
  misc_feature (138)..(138): n is a, c, g, or t
  misc_feature (161)..(161): n is a, c, g, or t
  misc_feature (180)..(181): n is a, c, g, or t
  misc_feature (227)..(227): n is a, c, g, or t
  misc_feature (252)..(252): n is a, c, g, or t
  misc_feature (263)..(266): n is a, c, g, or t
  misc_feature (271)..(271): n is a, c, g, or t
  misc_feature (274)..(274): n is a, c, g, or t
  misc_feature (277)..(278): n is a, c, g, or t
  misc_feature (282)..(283): n is a, c, g, or t
  misc_feature (286)..(286): n is a, c, g, or t
  misc_feature (289)..(290): n is a, c, g, or t
  misc_feature (292)..(292): n is a, c, g, or t
  misc_feature (294)..(296): n is a, c, g, or t
  misc_feature (317)..(318): n is a, c, g, or t
  misc_feature (321)..(321): n is a, c, g, or t
  misc_feature (331)..(331): n is a, c, g, or t
  misc_feature (334)..(334): n is a, c, g, or t
  misc_feature (338)..(338): n is a, c, g, or t
  misc_feature (340)..(341): n is a, c, g, or t
  misc_feature (347)..(347): n is a, c, g, or t
  misc_feature (369)..(369): n is a, c, g, or t
  misc_feature (385)..(385): n is a, c, g, or t
  misc_feature (423)..(423): n is a, c, g, or t
  misc_feature (471)..(471): n is a, c, g, or t
  misc_feature (484)..(484): n is a, c, g, or t
  misc_feature (622)..(622): n is a, c, g, or t
  misc_feature (635)..(635): n is a, c, g, or t
  misc_feature (851)..(851): n is a, c, g, or t
  misc_feature (924)..(924): n is a, c, g, or t
cttcttacctgcntaggctctcgggggtcaagggctctaaaaccatagcaagaatatgctttaaatttctttnttttaattctgttaagatgtccagtntttctatacccattttcttgccaatcngtcctgcaagtntacactgcagtacagctattttntccccatccccttgctctnngaattcatgtccactattttcctgtaatcttttcctcttgcttttnatgaacagctcatgtaccaattgcnagggggggggnnnnggganggnggnngggnnagnggnngnannnccactctcatcactactcagnngancctctgaganggnaggngnngctgcngctcttttttcagagtcagggngggcaatctgcttttnctcttctgtctctgactgcgagctttgttcccgaaggnggacagtcttctcgaccttccaagatgtcttgtctttcttatggtgtncccaactttgggngtccccttatgtttctgcagtagttcttgaaaagaaccctcctggtcagacagggaatcttctgatttctccaagctaagtgagttaaaaccactgtcttcaggcgttgaaatactgcctctcacttcaggtggaggngaaagtatttganttgcgttaaatctaatgtttgccacaagattacttatcggagtcacaaatatgtcctcatctgttccacaagttgttccactaacagaggagcccaggagctctggacatgcattctcatcattaatgcataaactgctatcactaaagtcatgtgtgatagagtctttaaaattattgccctggattggagatatacattcaacttcaaataggntacaatcatctttggaatcatcaattgttggaagtcttttgctgagaaaaattaagcctcaatttttgactgn

SEQ ID NO: 660838 - DNA, 134 bp, Homo sapiens
atcccctctctgctcccagattcaacgcaattctcgtgcctcagccttctgattagctgggattacaagcgcccatcaccatgtcccagctaaatatagagatggggtctcactatgttggacgggactggttt

SEQ ID NO: 660839 - DNA, 86 bp, Homo sapiens
caaaaaattattaaaaagctttttttccccaggattttctgtattattttaatgtttatggcaaataaaatgtaaagggacatgca

SEQ ID NO: 660840 - DNA, 494 bp, Homo sapiens
tagaggatcccgttggtcgatcactgtactatatgcctgtttttcatctacctgagcaattgtggtatttttttaatctactttttttttaagaggtgagggtcttgctatattgctcaggctgacatcaaactcctggactcaagcactctttctgcctcagcctcctcagtagctgggtattatggtatgtgtacatatatacttttagagacagggtcccgttctgttgtccaggctgaactacagtggtataatcatggctcactgcagcctccaacacctgggctcaagcaatcctcccacctcagcctcctgagtagctagggactacaggcgtgtgccaccatgcctaatctttttttttttttttggagagggagtctcgcctcttcccccgggcgtggagttccggggactcgaccaaggttggtcgatcacggtccttttgattagggacaaggcccttttttggtttccacttaaggactagc

SEQ ID NO: 660841 - DNA, 108 bp, Homo sapiens
ctccttgcaaaagcgtgtatatgtccaatagcagaatgtctcggacaccttgtggtcaaattgttccactctggtctgaagcccccagacctcaaacctcacagtgct

SEQ ID NO: 660842 - DNA, 599 bp, Homo sapiens
ggggcaacggagtcatgcaaaggatcccacttcactagaagaagagatcaaagagattcgtcgaagctggtagtagtaaggctctggacaacactccagagttcgagctctctgacattttctacttttgcgcggcaagaggaatggagaccagttatggactgatgaggtgcacaagagagatatctcagcgagaacgaactggaggtcctggagatctgctgagcagaaccgaattatagacttccagtacgatcagccattcggctcacggatcctgtgtggggtgaggactgctgattcgggtactggcttgcctcgtctgtgcgacgtcagggatacgtcagctggactttcatcaccggtattagcccttctgcatggctgctggcaacctaactggtctgtgtcggaggatattacttgttccaaagatggagaacgtgtcctagaggggaggtcgctgtcgactatagacacctaggtcacgctcttgaaggtggtaacatcccgggccagtcgtcgacactcgtgtgacctgccctgacgggtcgcaggccccggagccgaaccattgcctcttggcttacgtagtaacc

SEQ ID NO: 660843 - DNA, 260 bp, Homo sapiens
ggcgtccacgtacgtcgcgcatccagcgttcagccacgacgcttcgagcgatccctatcgggactagatgccgggatcggaccatgaagcgccggtcctcggtggcgattacggccttggcgaaatatcgctggaattttcgtcatagctcattgcctttctcgtgacttctcgcgcatgcgcagggccgccgcctgcctcacgcgcgcggcgacgggattcaacgtgtggaagtacacgtcctgccccacccacaaggc

SEQ ID NO: 660844 - DNA, 229 bp, Homo sapiens
ccaaaaaaaaacaggttttggaaaagacaggaattagctcctgtagctagttcccaagcatttttgtacataatcaccaggttcatctcaactttttttgaggcatgattcacattcaatgaagtgcaggggtaatcacccaatgggttcttcttgctcgctgcctagactgagccaatttatcaaggcaggggaattgcaatagagaaagagtttcattcacacagcg

SEQ ID NO: 660845 - DNA, 784 bp, Homo sapiens
gggtccgctgccttgctgctgcggtggcggtgggccatggtggtttggatatgagcctgggcccggcctggggctgccgagtcggagggggtggcagtgagctggggagaggctacggggctcggtttggctgactggggagtcggcagtgcgtgcatggaaccatgctgatggccatgcggagcctgctgctgggccctggccctgcctctgcctcctgcctccttctgctgctagggttacagtgctgccgctgtccacctctactccggggtctagtacatgtgctgtgctgctactgtgcaatggtcttgcctgcgctccctgctctagcaactcctttgggggcagttgacacctgcttgttgattgctgcctttgatgcctgtctacttgtgctggtagacaagtgtgatcctgctggtttggagttggttgttcgtggtcctggtgatctgtgcttgacatggctccatttgtagctatcgcctaccttgtgttgtcctgcctctcatcctccgaaacctactcaggtgccacgatcttgctgacatttcttctatagaccactgaatctagatcctgatttgtcttccactaactaccaatgccatcaccaactccggctgggtacccatcccagggcatgaattatatcagcagcgctccatctagtaaagtgctttacccaggacaccgaaaaacattgagatctgacggttgctgagatgacacgatccctggtaaaattgtggcatatacatggaaaccaaggaaaagcagg

SEQ ID NO: 660846 - DNA, 487 bp, Homo sapiens
gttaagctatgaccgtgagttaggcttcacggtacgacgtaaacatccggaaacacgtctttaccatagaaaagagtttaaaaggcattctatgtgacctggaggacaaaggtaatatacagaaccatccacaagacaactacagaacgtatctcatatgaatatagatgcaaaaatcctccacaaaatactagcaaacctaacccagcaacaatataacagaacaatacaccatgaccaagtcggaattattccagaaatgcaagatagtataaacaatacaaaaatcaatcagagtggccgggcacgatggcatcaaccctgtaaatcccagcactttgaggaaggctgaagccaggtggatcacttgaggtcaggagtatgagaccagcctagacaacacggtgaaatccatctctactaaaaatacaaaaaatattagctggctgtggtggtgcacacctgtaatcccagctagtcaggaagc

SEQ ID NO: 660847 - DNA, 505 bp, Homo sapiens
atccgggtgctatctctctttgatgtactcgctacaggcctcctggttggtgaaggacttgggcattcaggtggaccgctacattggcctcggaggtgtgtgaggactccatcacggtggtcatggtgcggcaccaggagaagatcatgtacgtcgggaacatccgcagcgtgacacagaagcatatccaggagtgggcccattcgatcaggttgattgggggcaagtccctgcaatgaactctacatcgtaaaccctgctcgcaagggcctctacgagggcactggccggctcttctaagagttctaccgcctcctgcatgatgcgcggcccaaggagggaaatgatcgccccttcttctggctcttagagaatgtggtggccatgggcgtaagtgacaagagggacatctcgcgatttctcgagtccaaccctgtgatgattgatgccaaagaagtgtcagctgcacaacagggcccgatacttctgaggtaaccttcccggt

SEQ ID NO: 660848 - DNA, 870 bp, Homo sapiens
ctgccggcacccgtgttttggaactgaggggtgcgcttttgctccgggcggcccatctgtcttggatatttgaaggaagcgccttctgcccggctggcccccgtttcgggaaggtttcaggaggcgcctttttgccccggccggccccatcgtctggggagcgtgtaggggcgcctctgctccatgccgcgcactcctatctagggacgttgatggagcgcctctgcccaggcatgccccgttctgggaagtgaggagcgtctcttgcctggccaccgcccatctgggaagctgaggattgtcctctgcctggccgctgtgcaatcttccaagtggtgaagggacaacgccttttctgcaggtgtatcctacagctgtgaagagacagcgatccatccgagaaccgggccatgatggcgactggcggttgttgtcgataaggaaaggggggaatgtgggggaaagataagagagatcagatgtgtatactgtagtctgtgtgagaaagaagtagacattaggaagactccatatcttctgtacattcagaaaattcttctcgccttgggatgctgttgacatctgatgaacgcttgacccccaaccccgtgctctctgaaacacgggttgggtccactcagggttaaatggattaagggcggtgcaagatgtgctcttggtaaacagatgctcgaaggccgcatgcttgttaagagtcatcaccactccctaatttcaagtacccagggacacaaacactgcggaggccgcagggtcctctgcctagggaaaccagagacctttgttcacatggtctatctgctgaccttctgaccactagtgtcctagtaattccgagtgtcccccttt

SEQ ID NO: 660849 - DNA, 847 bp, Homo sapiens
  misc_feature (15)..(15): n is a, c, g, or t
  misc_feature (20)..(20): n is a, c, g, or t
  misc_feature (53)..(54): n is a, c, g, or t
  misc_feature (60)..(60): n is a, c, g, or t
  misc_feature (72)..(72): n is a, c, g, or t
aaaaaaaaaaaaaanaaaanaaaaaaaaaaaaaaaaaaaaaaaaaataaaaannaaaaanattctttatttnttacatgaacaggaactccacaatcatccgctctacagcagccacctacttcaaacccagcaccgtagattgtgcaggctgtgtcttcagcaccagcacttgaaactgactcttcccctccaccatatagtagtattactgtggaagtacctacaacttcagatacggaagtttacggtgagttctatcccgtgccacctccctatagcgctgctacctctcttcctacatacgatgaagctgataaggctaaagctgctgcaatggcagctgcagcaacataaacatcttaaagaattaaggaggaagagtgtccaccaacagatgacttcagcgatgcagaccagctcacagtcgggaatgatggcatcttcatgctcccctctccccatggtcctcattttcaactggctcggattttgttcatccttctgcaccaccaattccataccttggaaggtacggctatatctccggatttcgcgcttccttgatcaactggatccttagtgacacgggcttctaactctttcctctggactttccatcagacaaacacttcgcccccctggtcacttctcgtctttcaccttgcctcccacacggacataacttgcttattaatcttacattcctcatctatcacctgccagtgtcgccaccttaaccacataccactttttctctttcttaacacaccaactccgtctccccaacacatcacttttcacacccaggaacagttcttgacattcctcgtaaccacctccctccg

SEQ ID NO: 660850 - DNA, 435 bp, Homo sapiens
cgagagagagatgagatagtagtaaaggaaaaaacagtgtaccctattcctttaaaagccaggtaaatttaaaacctataattgataattgaaggtcttctccgtgacactgtaacactccaataccaccttgtccagtgtaaacaagggcatagcccaaaagcactgaggccactgacaactcgtagccttcctatcaaaaatccttaacccagtaacccgcagatggccctaatacattcaatctgtagcgacaactgttttgctaacacaagaaagtatgaggctattctgttaaaaaaaaaaaaaaaaaaaaaaaagagggttatttcccttttacccattaaaattccctttaccccaggggtttcccaaaggggtccaaatttttaatacttgtacaaggtctccgacaagcccttgggagacccccct

SEQ ID NO: 660851 - DNA, 547 bp, Homo sapiens
  misc_feature (28)..(28): n is a, c, g, or t
  misc_feature (84)..(84): n is a, c, g, or t
  misc_feature (90)..(90): n is a, c, g, or t
  misc_feature (94)..(94): n is a, c, g, or t
  misc_feature (96)..(96): n is a, c, g, or t
  misc_feature (302)..(302): n is a, c, g, or t
  misc_feature (354)..(354): n is a, c, g, or t
  misc_feature (382)..(382): n is a, c, g, or t
  misc_feature (385)..(385): n is a, c, g, or t
  misc_feature (398)..(398): n is a, c, g, or t
  misc_feature (434)..(434): n is a, c, g, or t
  misc_feature (437)..(437): n is a, c, g, or t
  misc_feature (454)..(454): n is a, c, g, or t
  misc_feature (507)..(507): n is a, c, g, or t
  misc_feature (511)..(511): n is a, c, g, or t
cagctccaggctatctggcaataacaangaaagtggcagttccttacaccctgctgctggggttgattttgaactggagtcatnttctgnaagnanagaagaggagaaggaagaattgatggaatggtggaaaatgatgtcagaaactttaaatttttaaaaaggcttctagttagctgctttaaatctatctatataatgtagtatgatgtaatgtggtcttttttttagattttgtgcagttaatacttaacattgatttattttttaatcatttaaatattaaatccaactttcccttnaaaataaaatagcctcttagggtaaaaaatataaggaccttggatatatttncattccccttatatagtattccattttnccntaccccattattnacacaaaaaaagttttaggaaaaggttttaagtaanttngcccatcctagggcttnaaatgccatattcccgggtattatttacaatgcaggattttttgagtaattcnaggnttccaaaattaggtggaggtcctttaccgtaatggg

SEQ ID NO: 660852 - DNA, 343 bp, Homo sapiens
gaatactcccatataatctctgtcttcataaataatcttttgtaacgcttatacactgctggtgggaatgtaaattagttcagccattgtgaaaagtagcgtagcaattccttgaaaaacttaaaatagaattaccgttcaacccagcaatcccattattgggcatatacccagtggaatgtaaatcatcctgccataaaaacacatgcacatgtatgttcattgcagcactattcacaatagcaaagacatggaatcaacctatatgcccatcaatagtagactgaataaagaaaatatggtacatattcaccacagaatactaagcagccataaaaaaaaa

SEQ ID NO: 660853 - DNA, 237 bp, Homo sapiens
tgtggtgctctagaggatcctctctggatgcaagtgtcggcaagaattcgaccaagggatttggaagagtttttctctagcagtaggaagaggttcgagatgtgaggatgatttctgacagaagttcaaggacgttccaagcggaatggctatatgtgagagttcgtcgtactgttagctcagctgcctcgtagcaatacggattaactgtgccaatcgagttaaaaggctgtgcca

SEQ ID NO: 660854 - DNA, 1026 bp, Homo sapiens
  misc_feature (3)..(3): n is a, c, g, or t
  misc_feature (6)..(6): n is a, c, g, or t
  misc_feature (15)..(15): n is a, c, g, or t
  misc_feature (23)..(23): n is a, c, g, or t
  misc_feature (30)..(30): n is a, c, g, or t
  misc_feature (42)..(42): n is a, c, g, or t
  misc_feature (47)..(47): n is a, c, g, or t
  misc_feature (65)..(65): n is a, c, g, or t
  misc_feature (70)..(70): n is a, c, g, or t
  misc_feature (108)..(108): n is a, c, g, or t
  misc_feature (120)..(120): n is a, c, g, or t
  misc_feature (129)..(129): n is a, c, g, or t
  misc_feature (132)..(132): n is a, c, g, or t
  misc_feature (140)..(140): n is a, c, g, or t
  misc_feature (151)..(151): n is a, c, g, or t
  misc_feature (171)..(171): n is a, c, g, or t
  misc_feature (184)..(184): n is a, c, g, or t
  misc_feature (222)..(222): n is a, c, g, or t
  misc_feature (235)..(235): n is a, c, g, or t
  misc_feature (239)..(239): n is a, c, g, or t
  misc_feature (259)..(259): n is a, c, g, or t
  misc_feature (264)..(264): n is a, c, g, or t
  misc_feature (280)..(280): n is a, c, g, or t
  misc_feature (283)..(283): n is a, c, g, or t
  misc_feature (295)..(295): n is a, c, g, or t
  misc_feature (301)..(301): n is a, c, g, or t
  misc_feature (315)..(315): n is a, c, g, or t
  misc_feature (322)..(322): n is a, c, g, or t
  misc_feature (337)..(337): n is a, c, g, or t
  misc_feature (339)..(339): n is a, c, g, or t
  misc_feature (361)..(361): n is a, c, g, or t
  misc_feature (416)..(416): n is a, c, g, or t
  misc_feature (428)..(428): n is a, c, g, or t
  misc_feature (450)..(450): n is a, c, g, or t
  misc_feature (512)..(512): n is a, c, g, or t
  misc_feature (518)..(518): n is a, c, g, or t
  misc_feature (521)..(521): n is a, c, g, or t
  misc_feature (537)..(537): n is a, c, g, or t
  misc_feature (567)..(567): n is a, c, g, or t
  misc_feature (602)..(602): n is a, c, g, or t
  misc_feature (605)..(605): n is a, c, g, or t
  misc_feature (623)..(623): n is a, c, g, or t
  misc_feature (659)..(659): n is a, c, g, or t
  misc_feature (664)..(664): n is a, c, g, or t
  misc_feature (674)..(674): n is a, c, g, or t
  misc_feature (679)..(679): n is a, c, g, or t
  misc_feature (719)..(719): n is a, c, g, or t
  misc_feature (729)..(729): n is a, c, g, or t
  misc_feature (738)..(738): n is a, c, g, or t
  misc_feature (752)..(753): n is a, c, g, or t
  misc_feature (770)..(770): n is a, c, g, or t
  misc_feature (790)..(790): n is a, c, g, or t
  misc_feature (805)..(805): n is a, c, g, or t
  misc_feature (816)..(816): n is a, c, g, or t
  misc_feature (819)..(819): n is a, c, g, or t
  misc_feature (836)..(836): n is a, c, g, or t
  misc_feature (838)..(838): n is a, c, g, or t
  misc_feature (848)..(848): n is a, c, g, or t
  misc_feature (852)..(852): n is a, c, g, or t
  misc_feature (884)..(884): n is a, c, g, or t
  misc_feature (905)..(905): n is a, c, g, or t
  misc_feature (917)..(917): n is a, c, g, or t
  misc_feature (931)..(931): n is a, c, g, or t
  misc_feature (936)..(936): n is a, c, g, or t
  misc_feature (940)..(940): n is a, c, g, or t
  misc_feature (951)..(951): n is a, c, g, or t
  misc_feature (1014)..(1014): n is a, c, g, or t
tgncanaaaaaaaantaaaaaangaaagtnagtaaagaaaanaagtnagtatccacaaaagaggnttaancagccaagggtgcccccaaaaagaaaaaaaaacccaancccacttgaaancaaaaacanaancccagtanaaaaggaacanttccacccccttttgacaanatgcccgtaaaancaccaaaaaaagtaaaaaagaaaaagccccaacaaaancaaaggagaaaanaaanacaaaaccaacaagccacancccanacaatcccacccagcnccnccgcccccaganccgtcncccggccccccccncccagcncccccgcccccggancnatgtctcccggccccccccccnccccaccccaaaaaaataagcccccaaccccaccccaccttgtaaggggggaggnccaccaaaaganggggcctgtccagaagaaaaanaattaaagggcagtgcaagtggaaaagaaagtaccaaaagggggagagggccgccccccccnttaaancancaaaagagggtaaacnaaaacccaagagtgtccctaaaagactganccccgaacaaggctttggccccacaaactgctgcngtncaaaacgtgaaaagattntgctgaatccatttgatgtctctctttagtggtctnctcantagtggtctnctctncaaatgggttgttttctcactaggaaaaaaaatgtcccanctctggaatnaacgttganggtgttttgctcannctgaaagtttttatccncccttctcaagcatgccctntttggcatgatttanaaagttcatanacngggtggccagagcgganantttgagggtntggngggtgttctcacggtaacacttaagaattttnggcctgcagaacagcacaaantggatgagactnaaatcgcttgaacnttgcntccncctcttcagcngctttctgaaattgttcagtggtgactctgtagaactctgagcccctctcccccagtatagcnagcggtccttgg

SEQ ID NO: 660855 - DNA, 1508 bp, Homo sapiens
  misc_feature (292)..(292): n is a, c, g, or t
  misc_feature (318)..(318): n is a, c, g, or t
caaagtgcacatatgcgtgaaactgagcactggatatgtgactacacgtgactcatgatacatagtaggatacttagtgccaactgatgtgggacaacacttcatatagtgattgagccacattgaccacaggaaggatacaggaatgcactacccacatctacgtgatgcgacataccggaggctagtagacgatctaggtatcgagtgttagaccgatatccacactcaaggcacgatagaaagtagctcgtgcagatcgtagatggatatgagaggaggacccatgttntgtactggtccaaggacgacatacancatgtttcaaccgttacatgagcttggtgcaccacttggtcactaatgacacagcaccacctagagcatgtattttcatgttctcctacaccaagtgccatgacagtgctatgtaacaacataagcagttcgtaatttggtagagcctgtcagagctcgttcctctataaacgatacttgagggactaaaaggtttccccgtgcttactccagaatgcgtgggccaagggtttccacacaccgattgacgtcccgcgaacgcaattctatagagaacactgcgttggggcgcggacacaattgcacgcactatgcaagagaaggtctcgacttacccatagcaatctctatatttaccatacgccggtatgtgacaccatggggtcaacattgaaaatagcatacatcagctcccttgttggccaactcctataaataatttcgactaaacctaaaggcattcaagacaaattgttgtgccaagcgtacaaatctctaaggcgcgaatacaaggagacatcgacgcgactagttagggaacaacgggttatacacactcttattgaaggatacgtttgcgccaacacgaactaggcgcaaagttgcaagagcgaagatgaacaaagaggaacgctgcccattctttgcacacagtacccgagaggatcctccagttgatttgagacacgaataaggcggccttgaaacaagaatggaggggtaataggcctagatgcagagcatcttggtttccaaggaccactacacactttccgagtgacagcatatgtggagagagataagaaggagagaagaccacaagacaaaaagtgccgagaatcagcctaacaggaaagtacagcaacacacacagcagtagagaaaaaaagacgtcaatcgacagaggaccaaaaacgtgtaaacgcaacaatgaggaacgaaacggtataggaaacagcgggaacaaacaataggaaaccacacaagtgaattaaccgactaacccgacaaatgaaaacattagaaaaagaaagaacgagaacagaacacagtaaaagaaaacaggaagcaagagacccatagagcaaaggaaacataaaccacgagaaacaaaagacaaaaagccaacgataagaagacagcacaacagagagccactgaacaacacaagaacaacccagaaaaacaca

SEQ ID NO: 660856 - DNA, 122 bp, Homo sapiens
gaggatcccccgcccggtttgcgctccaggctcccggacgtcctgctcctgggctcaagtgctctgcccgcttaggcttcccaaagggtggggattacaggtttgagcgcgacaccgggcgg

SEQ ID NO: 660857 - DNA, 113 bp, Homo sapiens
ctcaggatcttcactttacgcaggcttacacaactattataacagaagaggggcacgcaaaaaaggtgggcaaaagtggtccattcggcgggggaatgctttgaatactggat

SEQ ID NO: 660858 - DNA, 447 bp, Homo sapiens
gaaacaacatctggaacttcaagtaactcctcccacagtactttcaactctggggtggccccaaatccaactaatgccaccaccaacgcggctggtggcgccctgcaaccaacagccaatctcttcgcggtctcactctctcttctgcatctctactcttaagagactcacgccacgaaacgtcttctaaatttccccatcttctaaacccaatccaaacggcagttggaagtccaatgtggcaaagaaaaacaggtcttcatcgaatctactaatcacacaccttgtattgacacacaaaatgttgcaaatcccaaatttgattgatttgaagaacatgtgaaaggtttgactagatgatggatgccaatattaaatctgctggagtttcatgtacaatatgaaggagaggcaacatccaaaatagttaagacatgatttccttga

SEQ ID NO: 660859 - DNA, 901 bp, Homo sapiens
ggggtgggataaagcaatgaactgtagtataaacaaatcccaggctatatctagcaaattatattacggtgaaatacagtatatttgccttactggagtgagtcatagaagctgtcaatatgtatctactgtacaggtactaaatagtatgcattgatgagatgagtagtgtatgggtggctaggggttaggggaaaatgagacttggaaatcgtagcttctatccgaagtttctgagtatgaacatgagggtattgtatttgtatttttgtaacctaaaagactgaaatgccatatagatagaaacagcattgtttttacagttggtatgtaagtaactttttaaagattttatcacataaaagaatcttgtctatagtgagtccaaagcaatgttctaataatggtccgtaagttcactgtcatgttttaatagaaacaaagttcgagagaaatgacattggttaaaacttagtagataaggaggtgaaccatgtgacattgggcgttctgtaagtcaacaaagaggttcagatatggtaagactaatattcacagtgtgtccgtcatttgtaatctcttgaaatacaaatatactaaggtttctaaagggactcactctggaaaaacgtgagtgcactggccagatgctacgtggacagttatccattcttgaggaattatcttgaggcgacgtttctggccaaggtttgtttcgctgggccaggctttaccgttacccgtggaaccaacctggcccaccgttctcgtgtgtggggacaccgctcaaaacacgggttgtggcaccagcacaaaaaaacattggggcgcgccgcaaaaaatatggcggcgacaaaggagctcacatcattgtaaaacacgacacgaattttgttcaaaa

SEQ ID NO: 660860 - DNA, 445 bp, Homo sapiens
  misc_feature (416)..(416): n is a, c, g, or t
tgtgtgaaaacgcgacggggttttcccgatcacgacagcagtgatatctctttcctctgttataataagcgcgatggtgattttgcacttcccctaattaggggaattccctttataacaacaaccgagatagcatttcacaccagtcagaacggctattattcaaaaagtcaaaaactaactgatgctgatgaggttgcagaaaaaagagaatgcttatacactgcaaatgggaatgtacattagttcagccattgtggaaagcagtctggaaatttctcagagaatttaaaagtaccgtttaacccagcaatccctttactgggtatatccccaaaggaatataaatagttctacctaaagacacacgcacatgtatgttcactgcgggactattcgcaatgagtacagattanatctgtactcattgcggaacttctttaca

SEQ ID NO: 660861 - DNA, 971 bp, Homo sapiens
  misc_feature (958)..(958): n is a, c, g, or t
tgcgggggtggttttttcttctctttcttctgttttctttattttgtttttttttggcttctcttttctgttgttttttttttctgtttcctcttttgttttttgactcttggtcttgtttctctttttattcctcgtgctccttacttgttactgttgcgtatcgttatgatctctgtcttgtctgtgttttcgcgtttctgtctattttagggttgttacgctgtccgtgttttgtcgttctacgtctctggttgatttccgttcctctccacccttcctttctttcttgcggtttgtgccgtgtgtttagtactcgctcttcttttggagtgtactggtctacaagggcctgagtaggtggccctagccagggttggagctgtgagggtgatggtagccccaccctgaggtgccgtgtcactcggggttagagggtcactgcggttacaccggtgcggtggcttctgtgatttattttcttgatggtaacttctcagatcatgggcctgattgggacatctagtcagccagatgcacatggaagccaccctgcctgctggggaggagggacctcacacaagccccctcggcagtttgtccccccagcttctggtatgccttcagggaaaggtcatcaatctggggaggaaagcgggggggacgcctgtcacccctggcagtgtggtgaggttcaggtgggggctccctgctgcccccaggccatgggagcttgaagccctcccggcatcatggcatccgagcctcccgcccatccagggtgcgcttccctctcttgcccgcagcatacacgagggcaggcagtggccattgtcacatgtatcattgcatcagagacaaaggaggacccgcaattattagccctgatgcgggaaaatgggggaggggcccagggccagcgcaattgtgcaactggtttacatttaaatacgtacangggtgattcatcg

SEQ ID NO: 660862 - DNA, 119 bp, Homo sapiens
tcttgagtgctatcatgggcgtgagatgaccatgtagggcttcagcagggtgccttccaggtagatagtggtgctcactcagagccttgtcgagcgcagcgctgtcgggctagtcgcgg

SEQ ID NO: 660863 - DNA, 123 bp, Homo sapiens
aggatccgagagggtgggacactgggctggcctcgatcagaaggacttgggcccccacgagcggcgagtgaacagtggaagagcccagcgccgaatcccgcccgctgggggggcccggacatg

SEQ ID NO: 660864 - DNA, 408 bp, Homo sapiens
gtcactgcatgtgtgagaactttgttgctttttaggagtgaaaaatattccatcctgtgttgtattagtcaggtttcgctagagggacagaattaataggatggatgtatatatatggggagtttattaaggagtattgactcacatggtcacaaggtgaagtcccacaataggccatctgcaagctgaggagcaaggaagccagtccgattcctaaaacctcaaaagtagggaagccaacagtgcagccttcagtctgtggctgaaggcctgagagcccctagcaagtcactggtgtaagaccaaaagtccaaaagctgaagaacttggggtctgatgttcgagggcaggaagcatccagctcaggagaaagatgaaggccggaagactcagcaagtcaagtccttc

SEQ ID NO: 660865 - DNA, 1089 bp, Homo sapiens
ccgaagtgaagaaaagaggcgagggcaagggagggccagaaccagggagagagaaaggaggggcagcccaccagcccgctgtctcgccacagaaccggctcagctccaagctccaggagtcactcagctgcagaggcagtggcagccctactcctcaggcaaagggcagcagacagacagacagaggtcctaggactggaggtcctcagtcattgaccactgcagcctggcccagccccatggccttcaatgacctcctgaaacaggtggggggtgtcggacgcttccagctgatccaggtcaccatggtggttgctcccctactgctgatggcttcccacaacaccctgcagaacttcactgctgctatccccgctcaccactgccgcccacctgctaatgccaacctcagcaaagatggaggtctggaggcctggctgcccctggacaagcaaggacgacccgaatcttgcctccgctttcctttcccgcacaatggcacagaggccaatggcaccggagtcacagagccctgccttgatggctgggtctatgacaacatgcaccttcccttcaaccatcgtgactgagtggaaccttgtgtgctctcatcgggccttccgccagctggcccagtccctgttcatggtgggagtgttactggagccatgatggttggctacctggcggacaggctgggccgtcggaagggtggtgatcctgaactacctggcaacagctgtgccgggaacctgtgcagcttatgacccaactatatggttatggattccgggctactcgggcatgtatttgggtacattgcatcactgtgttgacataaaacgggagtgatggccattcaacaccgggcctattgggaccatggtagggaatcgaaagcgtgagggcacacccggggcggaggatcacgcaaagtgacccagggtcacccgcgaaggggacagacgcatagtaagcacacaactgggagcataaagatcagacgaaaccacggagggacaacccagcctgcataggcgcaacaaaagactaatatcacaccgaagacagatgacgcgcacagtggga

SEQ ID NO: 660866 - DNA, 621 bp, Homo sapiens
  misc_feature (621)..(621): n is a, c, g, or t
aaaaaaaaaggaaaaaagccccccccgccccccgagaaaaaaaggcggggagcggtttttttgtttcgtgtggggagaaaaccctttgggggtttttcacctctcgttaattagtgagaaacttggggttggtcaaaaagtccgttggagaaaaaagagaatgctcagggaacaaagcgcgggacacagcagaacgggaaagcagacgcgtggcaacaacggcagattggcccctttgcgcacaaaggagctctatgatgagagggaaaacatttgggtacagccgaaaaagaagcccctgaaaagatccccgccaccggctgttttgcttctgttccgcccccagttttttgtggggggggcgctttaaaggtttagcaaaacacttggggaacaaaaacgggggaaacccaaagggggcaactttatgaagccgaagccaaatggggaaacacaggggttttacacattttgagcctttgtcgattgcccctttggggagcttcgtggtggagaacccctttttaccccaaagcaccttctggtgggtgacgaggcgctcaaaaaaccgttacccgcaagaaacaaaaggggagtcagcgggccctcccacaggcgggn

SEQ ID NO: 660867 - DNA, 257 bp, Homo sapiens
gtagtttatgtcatcaggctgcgaccatatgaaagcttgcacatacttcacattctgtagggtttctcgcccagatatgaattttcttatgtacgttcagtgttgtggaccgtgtaaaggcttagccacattcttcacatatgtaaggtttatgcccacgacatggcttctcttgtgtacatataacgagttgacggatcggttaaaacgctttgccaacacttcttcgcacgctgtacgggtttctcttccagtac

SEQ ID NO: 660868 - DNA, 168 bp, Homo sapiens
ccggtatcgcatgtacttcattcctctctcgctctcatcagccgccttctcggcctcctcccagcttctgcagggctgtagccaggcgctcctgggcccggtcccagctcctcctccaaccagctgaatgcggcggttcagggaggccacatctgcctccgcatccgt

SEQ ID NO: 660869 - DNA, 160 bp, Homo sapiens
catggattcggtgagttattagattgggaggcgagagtgaaagaagacaaggataaattctggatttcaccaagtacaatatttcggaaagagtgctggggatacatctggaacagagctaaccactacaatgtgtatgagttactgacgggggcggatc

SEQ ID NO: 660870 - DNA, 305 bp, Homo sapiens
acagcccgagaatacaacacagaagattattttcccccacagaatttcgtccgctggaaattacacgcgagaacacgtaattcacacacaccgcatggtgaggggttgtgatgcagattctagagcatggtgtgagcctagaggagggcaactagcctagcctaagagtttaaagaagtcatgtggtgacagactagactgagcaactgcaggcattcaggcaagcagttccttcaacatcacaacagcggggcacagtgtctgggcacagcacagtcactaggcatcaccagtcagggcagcag

SEQ ID NO: 660871 - DNA, 279 bp, Homo sapiens
cacgcaggagcagccgacacaggccagtctgcggaaggagcagatgcgagtggacgcccatggcacaggacgctggagcagacgaatcaagaaatagaagaactcaccaagattatgtgacgaacctgattgccagaaatggggaacaagctaactctgacaccgaatgtattggacttaacctgttgagtgcaatatgaccgtcgtgcacactgcatgttcctcccagttccatggcacaggttctagttttcactttatacgtatgcgactcactgt

SEQ ID NO: 660872 - DNA, 254 bp, Homo sapiens
acaggcacccaggcgcagctccaggtgcatgcctggcccacccagcccatgccgtggccgtggtcagctccggcttctggctttccacccacagcagcagtgtttcttccactccacactccaggtggccattgtggggtgcacctctccacaggcccaggccttccggttgcacttgttgggctggtctgggctcagatcggggcaggctcatgtcggggaggggcatcctctcgacgtcgacccgtgcacgg

SEQ ID NO: 660873 - DNA, 1368 bp, Homo sapiens
ggccggtgcggcccaggcccgtctcaaccgtgggagactctgaggctgaccgtcggtcgtgaatactcaactgcggtcgtcgtccggctccaagctcggtgtcgagcccgtgagcggatgctgcgagaagcccggggccggctgaaggcgccgtggtacaattgggatgccgtcgcgttcttgacctctagacaaacctggcacattccgtgccaggccgccaaaaaggctctgtcatggatccctgctacatcagcagcggacgctggggttcaatcagagcagagagctagttggctggctgcgtgctgtagccttcttcatgacactacgcgttgctcccacgtcgtggtgccgtgggcgcgctcggaaaccggcacggcttgtggggtcactcggtcttggtaggcgtgctgtgtgttaccctgtatctgggacggcatcggggtgccgtccgggacccaccaacctgtgtctttctgggctagttgtgtgagccgtccttgagagcctggagggcatgccgatcgcacagtttgggagcacctcttgtcaactctgagccggctgttgtccgaaacgctgtctggagacaagacactgtgcgacagaacttttagatctggaggtttctttccgtggtggcctagatcgacacaggacttagcttgccgaaggggctggcacggacgctttgtgccaccgctttttagaccttggggccgacgctacttagtctctttgtgtgcttcgctggccttgctcacatatcttatgtcatccttttgcggggcctctggtgccccccttaggggacgtttccattccaggggcgggatgaaagctctcgagccactcccctggtggcctgcttacacttggcccacctgggtacgggcttttttggtggtgtttgcttgctttgtcccgctgcagttgctttgcctttgcgaacgtgggctttgtcggcgcctcgcaacccattgtgattagggctttgctctgtcgaaacggacgagtcggtccagtggctgcctgccccttgaattgggagggtttgggccctagtggggttccgagcttatctaattaccttccggaaattggctcccatcccggaggagggttggggtgcccttggcaccttggagttggtaacccaagcggaagcgcgggggtgttggccaagccttaattttaggcccacacttcctttgagagcatgtcagttggaaggcacccctctggttgtgaggaataagcccaatgagttagcacaggtatgagagtggtgagagcactattcatatttttatctcgatacatctggtcagccccccctttgagaccagggacccaaaccacttg

SEQ ID NO: 660874 - DNA, 401 bp, Homo sapiens
  misc_feature (31)..(31): n is a, c, g, or t
  misc_feature (72)..(73): n is a, c, g, or t
  misc_feature (79)..(79): n is a, c, g, or t
  misc_feature (109)..(109): n is a, c, g, or t
  misc_feature (132)..(132): n is a, c, g, or t
  misc_feature (136)..(136): n is a, c, g, or t
  misc_feature (138)..(139): n is a, c, g, or t
  misc_feature (148)..(149): n is a, c, g, or t
  misc_feature (213)..(213): n is a, c, g, or t
  misc_feature (347)..(347): n is a, c, g, or t
aggccctctcccttcccagaaggggcgtggngtggaggaaatctaccacccagcacatggctagaccttggnnttggcnaggcagcgcacacaataagctgggcctttnctaggaggcaggcggggttttgngggngnnaggctgaanngctaggccactgcaacagtgagagacccggggagcccctctgctatctcagccaggaggaaggngagaccaaggcacagagccttaaaaaagacatcctctcccggcctcccatcccaaagccctggcccctaggccagtctagacagaaccaggaaagccaaaaacaaaaggcacctagtatgttagttcatggggngatcgcaggcaggtgtgggaagctcccacctccaaccccgggccttggatactg

SEQ ID NO: 660875 - DNA, 932 bp, Homo sapiens
gtcaggagttcgagaccagcctggccaacatggtgaaaccccgtctctactaaaaatacaaaaattagtcaggtgtggtggacgcctgtgatctcaatctcagctactcgggaggctgaggcaggagaatcacttgaacccaggaggtgttgcagtgaaccaagatcacaccactgcactccagcctaggcaacagaatcacttgaacccaggaggtgttgcagtgaaccaagatcacaccactgcactccagcctaggcaacagagactctgtctcaaaaaaaaaaaaaaaaaaaagaaactcccaggaaacaggcagcctagtttccggaggtggtagaagcttgtgcttgtagaaagctaaccatgttaaccaccaagggcaaagcagcccaggtggtgattaggaacagagcggggatcaaaattttcacagaagacgggtcacgctgaggggcctgcacacacggggttgttgaggacccacagattgggcgccgagaggcctgcctttggccgggcccaggctcacccccaccttggggcctcaccttcctccaggaagcctttcccagttacccgaagctcaggtggccttcttgcaggtccccgtagcacctgagcctgtacctggggtggcccttgttatgctatcctgtgctagccgttgtgtgcctcgtctcggctgttagatggtgagtctcccatggcgcagagcaccactgttcgtctccccggtgtgtccccagcccggtcctgtcacttttgttaccttgaaggaacatggaggccagtggtaaggtcggccaaggaaatagcacagctccagtgggggcgaaactggggccggacttgtggcgccgagttactctgtttcgtacggtcaacatcccgtgtgtggcgcgcgcaaccaccggtgtctcccgcttttg

SEQ ID NO: 660876 - DNA, 139 bp, Homo sapiens
catggaggtatgagtcaccacgctgacaggccacataccaggccgtgtatagtagcagaacgtggtcaagctctacgccctccatcctgcagcagaaggagcaggccggggtaagcagcatggaggaattcctgcgggg

SEQ ID NO: 660877 - DNA, 572 bp, Homo sapiens
ccatgtgggccaggcctgtctcaaactgctgacttcaggtgatcctctcgcctcaacctcccaaagggctggggattacaggcgtgagccaacgcgcccggcatggattccagttcttagggggtgtgtgataaccgaaaagatgtttaaggaacacctttttttttgggtagctccagttaaagggaacactatgctggggggaaaaaaattagcaaatatgcgtagataaacatttaagagagtgtccaatctgtaaaaagctaagggatcaaatccagttttcttacatagaatacattgggcttttaatatgggaatatttccttaaatcatttcggagaatcagaagtttcccagtatttcagcattttaagttaattgggcggagtgacgggattaagtgaatctatacagttaatttctaaaacagtggtatctcataaccagtcatgaggtcaatagctattggtatcgggcagaagggtttcaaaagcacttggacccttgtgaatagttgcgggtggaattcagtcctcggtgcagcatttcgaggcatgtggagtcatctc

SEQ ID NO: 660878 - DNA, 459 bp, Homo sapiens
atcttgcacctgccattctacggggacctagtctgcctggaatggaccactctgcccacaggaagctccatcaaactttcaccccaaacaacagccatcggtaacctcagacctggaggtgaacataatggctgcatgtttggcttttgggggatagacccaagaaggaagcccatgtatgccccagaaggggacttcttactgttgaacagggaatcccaatttctgagcagctggaccatgagcacaaagatggaggggctagggcagcatgtccccttgggtgctggattccttgcctttggagagaggtgtaagcctaggaagattcagggcagaaaccctggtgcttagtcctgacgagcagtactgggattacaggtgtgagccaccacacttggccaaaaagccaactcttacagatgtgcatcagaatggacatggtggcttgttatggct

SEQ ID NO: 660879 - DNA, 1048 bp, Homo sapiens
ctctacaacaaaatgactttaaactatctgggtatggtggtgtgcctatggtgtccggctgaagtgggaggattgcttgagcccaggagtttgaggttgcagtgagctatgattgcaccactgcactccagcctgggtgacagaatgagagcatgtactgaaaaaaacaaaacaagctgggcacagtggctcacgcctgtaatgctagcacttagggaggctgaggccaggaagatcccttgaggccaggagttccaagaacaccctggacaacacggcaagccccatctctacaaaaacttagccatgtgtgctgcagcatgcctgtacatcccagctacttgggaggctgacgtgggagaatcatctcagactgggcaggtcacaggctgccgtgaaccatgattacaccactgactccagctgggtgacagagaccctgtctccaaaaacaaaactgtgaacacacaaactggcctaggcaccagtgggctcaccacctattaccccctcaggcacattttgctcagcgcccacaggtggcacgggattcacttgaaagaccacggaggtatcaaagaacaagcacttgagctcggcatcctagagcccccatttgctatctaatttaacctatctctactactttaattattcaggggtactgactcacatatctattcacaaattaaacaatcgtccactttccggctggacgtggtcgtacccaccgtatatgcacaacagtttgtgtcggccaaggcggcagaatacaacgtacggacaatagcaacctccctggccaagtcggtggaaccccggaccacactcgtgtcacccacttgtgggcgcaatgtggccacgtcactcacacccgagcagcgcaacagagtaaccgaagtcacttaacgacaacctacactgcctcgcgtgaacgacagtttcaaaaacagtcgggaacatacaggaatcacccgtaagcgcacgacaaaacgacgtcatagataaaacacacctcgctcccacataactccagcactaccagcct

SEQ ID NO: 660880 - DNA, 367 bp, Homo sapiens
acttaattttgtgaggataccacataacctcgattcatatagccagtgctgaccactatacacttgtgctaaggaatgagtattgggtatagcacttgggagagcgcaagctaataccgatgaatccagacgagctagctaagaacagctttgagtgcacacccagctatggagcacctgagtgataagagtgataggttgaggcgataaaccgagcgcgtctggagagagctgcatgtgcaatgtactaacttacattaacaccaacagtgtacacagaatcttttcaaatcctttgcagaatgtgtcaggccaatgaggtacaagtctttgtacactaggaggtcaccaattaagatgcgctcgg

SEQ ID NO: 660881 - DNA, 401 bp, Homo sapiens
aggagccgacaggtctgatcccagctcactacaacctccgactcctgggttcaagcgattctcctgcctagcctcccgagtagctgggattacaggtgcccaccagaacgcccagctcatttttgtgcttctagaggagacagggtttcaccatgttggccaggctggtctccaactcctggcctcaagtgatctgcctgcctggcctcccaaagtgctgggattacaggtgtaagccactgcaccctgcctcagtacctccattcttcccacacaccctcctcacgtgctccttcctgacttctgggcccttccttccttcttttttttttttttttttttggggaaaagggtacacacccaacacccaaaagggaaaaaggggggggcacacagagaca

SEQ ID NO: 660882 - DNA, 196 bp, Homo sapiens
tgtagccgctgcaccagcctgggcaatggagcaagactcagtttcaaaaaaaaaaaaaaggccccagttgggttgttaaatttttcccactataatataccccaagctgtaaaaaattggattttaaaattatatttaaggggcacccagaaaaccagccagggttattttttttcattctattaactcctttata

SEQ ID NO: 660883 - DNA, 626 bp, Homo sapiens
  misc_feature (539)..(539): n is a, c, g, or t
gcattttacagatactgttctttttacaaattgaaggtttgtggcaaccctgcattaaacaagtctattggttccattttttctaacagtatgtactcactttgtttcacattttgggaattcttgtaatatttcacaatttgtcattattattaattacatctgttatggcgatctctcatcagcgacctattatgttactattgcaatttctttcgggcaccacaaattacacccatataggatggtgaaataatcgacaaacattgtgtgtgttctgactgctccaccaaccagccatttccttggctctatccctctccttgggcctatttcaagacacaaccatatggaaattaggccagttaataaccctgcaatggcctctaactgttcaagtaaaagagtcccctttctcacttaaatcaaaagctagaaatgattaagcttagttaagaaagcatgccaaaagctgagacaggtcaaaagctaggccttcttgtccagttagctgagttgcgaatgcaaagaaaaagatnaagttcttgaaggatattaaaagtgcccctcccgtgaacacaaacacccaaatgattgataagaaagccaaaccgttcttatttgtt

SEQ ID NO: 660884 - DNA, 460 bp, Homo sapiens
  misc_feature (11)..(11): n is a, c, g, or t
  misc_feature (71)..(71): n is a, c, g, or t
  misc_feature (103)..(104): n is a, c, g, or t
  misc_feature (129)..(129): n is a, c, g, or t
  misc_feature (170)..(172): n is a, c, g, or t
  misc_feature (199)..(199): n is a, c, g, or t
  misc_feature (267)..(267): n is a, c, g, or t
  misc_feature (408)..(408): n is a, c, g, or t
  misc_feature (414)..(414): n is a, c, g, or t
gctttggcatnaggacactcccagaacttgcattacaacaaagaaatgaggtgtctttgttattcataatnagccaataattgccaagatggctgccgtcagnncaaaagggccagtggacggtttggnggcttctccaaggaacctcagctgaaacctctgggggattnnntgattgtctgccaagagaacaggcggnctcgcttttgttctgaaatcaaatcctccaagtacggagagggtcaccaagcgtgggatcgttggcanttgtggaaaagggaaaccgaacggcccggatccattgacaagccgcgagttattgaagtcctgcctcgtggggccacagctgctgttcttgctcctgacagttcaaatgcctcctctgagcctagctcgtgagatgcaaangaaccngaacgttgtttgggaccctctaagagccattgtcccacaattcaac

SEQ ID NO: 660885 - DNA, 395 bp, Homo sapiens
  misc_feature (324)..(324): n is a, c, g, or t
tggcctctccagctacatgggggaatttcttatagataatattttgaagtatgtttttcaggttgtttccattcttctcatttctttcaagaatgctagtgagtcatagatttggtctctttacataagcacatattttacagagattttgttcattctttttattctttattgttgtcttattttggaaagccggtatttgacctcttaagtctttttttatcagcttaagtctgttctgctttgatatttgcaagtgcattaatgaaatttttatagtgtgtcattcagctctatcaggttgattatgtccatttttttttntttttagagtctaactgttacccagagtggagtgcagtggcacgaatctcggctcactgcaacctcagcct

SEQ ID NO: 660886 - DNA, 105 bp, Homo sapiens
gcgcgaagaggctggactctggattctgttgcctgagcaatggctgccatcctggaagaaactggtgatctgttggttgatggagcctgtggaactgacatgctt

SEQ ID NO: 660887 - DNA, 220 bp, Homo sapiens
  misc_feature (10)..(10): n is a, c, g, or t
  misc_feature (102)..(102): n is a, c, g, or t
  misc_feature (139)..(139): n is a, c, g, or t
  misc_feature (149)..(150): n is a, c, g, or t
  misc_feature (199)..(199): n is a, c, g, or t
acgttgctangcaccgctgtgctatcctatacgcctctggcgtacattggcatcgtgatggagtccgctgacggggtcacccacaatgtgcccatctacgangggtatgccctcccccatgccatcctgcgtctggacntggctggccnnggacctgactgactacctcatgaagatcctcaccgagctgcggctacangcttctacctaccactggctc

SEQ ID NO: 660888 - DNA, 588 bp, Homo sapiens
tcagctcggtacccttacaggcttggagccctgtagtactgagtctcatgtcctcatctgtgtggatctttaccagtactaatcctgagcacaaggctggctgcgaggatgaatgtgctcgggaagcacggtgtttgggaaactggcacacgctcgcattcagtggagggtatcgcctacaacagagctgcacaacaggagggtatcgcctacaacagagctgaccacacgggggtatcgtctacaacagagctgaccaacaggagggtatcgcctacaacagagctgaccaacagggcggcgcctggccacatctggctctttacagtcaacattcaaccaaaattcaacaaaatgtgtcactttggttcctccaccacactggccatatttcaggtgctcagatggaccacaggtggctaccgcattggccagtgcagatacggagcgttagcatcatcacagacgatcctgtcgggcagtgccagtctcaactcatttaggctacaaagaacttaaaagctatcaccaagaaagtaagatcaaataaaacacaagagggatgtatacttctcccatgagatatct

SEQ ID NO: 660889 - DNA, 425 bp, Homo sapiens
actttttttatctagccacttcatggggacactacgggtttcatgatctgtgatgggatgacctgatcgatcctcagttggtaacacccctttttttcccttggtaggggtttaaacaattctaaaagagatgctttttttctggttttacactgacaatttcatcccgaacgttcctcctgtgggaggcattagaccatgtgtacaggatctcatcttcattcttttctcactctcatacaccttctgaaattggtgtggagacgctgaccatgctgtgtccgtccaccaacaggaagaaggcctgattagcattgagctgtaagcgccttctatttatcttgatgagctcactctatgttgactatggtcaggtacaaggaatcttggtttttatcccagaaacaggaagctgttcccacccg

SEQ ID NO: 660890 - DNA, 1335 bp, Homo sapiens
atgattgaagacaataaggagaacaaagaccattctttggagagaggaagagcgactctcattttttccttaaagaatgaagttggaggacttataaaagcactgaaaatcttccaggagaaacatgtgaacctgttacatattgagtcccgaaaatctaagagaagaaactcagaatttgagatttttgttgactgtgataccaacagagaacaattgaatgatatttttcatcttctgaagtctcataccaatgttctttctgtgactccaccagataattttactatgaaggaagaaggcatggagagtgttccttggtttccaaagaaaatttcagacctggaccattgtgctaaccgagttctgatgtatggatctgagctagatgcagaccaccctggcttcaaagacaatgtctaccgtaaaagacgaaagtactttgcagactcggctatgagctataaatatggagaccccattcctaaggttgaattcacggaagaggagattaagacctggggaaccgtattccgggagctcaacaaactctatccgacccatgcttgcagagagtatctcaaaaatttacctctgctttccaagtattgtggatatcaggaagacaatatcccacagctggaagatatttcaaactttttaaaagagcgcacaggtttttccattcgtcctgtggctggttacttatcaccaagagatttcttatcaggtttagcctttcgagtttttcactgcactcaatatgtgagacacagttcagaccccttctataccccagagccggatacctgccatgaactcttaggtcacgttccccttttggctgagccaagttttgctcagttctcccaagaaattggcctggcttcccttggagcttcagaggaggctgttcaaaaactggcaacgtgctactttttcactgtggagtttggtctatgtaaacaagacggacagttacgagtcttcggcgctggcttactttcttctatcagtgaactcaaacatgtgctttctggacatgccaaagtaaagccttttgatcccaagattacctgcaaacaagaatgcctcatcacaacttttcaggatgtctactttgtatctgaaagttttgaagatgcaaaggagaagatgagagaatttaccaaaacaattaagcgtccctttggagtgaaatataatccctacacacgaagcattcagatcctgaaagacgccaaaagcataacgaatgccatgaacgagctgcggcatgatcttgacgttgtcagcgacgcccttgggaaggtcagcaggaagccgagtatctaa

SEQ ID NO: 660891 - DNA, 509 bp, Homo sapiens
ccacgcgtccgatcacttgaggtcaggagttagagaccagcctgaccaacatggtgaaacactgtctctactgaaaatacaaaattagctgggtttggtggcgcacgcctgtgatcccagctacctgggaggttgaggcgggagaatcgcttggacctggggggcggaggttgcagtgagccgagatggtgccattgcactccgacctgggcaacagagcgaaacactgtctcaaaaaaaaaaaaaaaaggtaacaggaaaaaagagtgaaatatattacgctatcttttattctggagccaaaacttggacagatgtggggaaatctccatatacgtggtatgaaaattccattggtacaggggaaattatttccctcggtggtcttttcttttactataaagtgatctcagaattttacgtggttcctataaaattatgcaaagtatggtgacaaaactggcatcaattggtgggactattaaaggtgctccttgtgaacatttaag

SEQ ID NO: 660892 - DNA, 170 bp, Homo sapiens
agatagacactgagatagtgtcactgtactccagacctggagggacagcgatgagacctcgtctccgaaaagaaaagcaaaaagctaactggaagacaaaaagtagttgcaagctgttacagagctggaacagaaaatgcatttagcataaaagtgtagtgtagaaattg

SEQ ID NO: 660893 - DNA, 180 bp, Homo sapiens
ctgagcagtattgtgccattttattaccctttgtggatgtgcctgcatgacgaagtctggggcatgtgtggaaaagatacttcacagctgaagggggctgggagggtctctttggagacattaagtaaactgtgtgttgtgtatctagcattttgactggtgatccatcatactgaggtc

SEQ ID NO: 660894 - DNA, 691 bp, Homo sapiens
cccctggtgccctggacagtcgcccctacagccctttccccgggcagagcaacggaatttcctgagatcctctggcacctcccagccccaccctggccatgggtacctcggggaacatagctccgtcttccacgcagcccctggacatttgccactccttcacatctcagggagggggccgggaacccctcccagccccctaccaacaccagctgtcggagccctgcccacgcctatcacccagcagagctttaagcaaagaataaccatgggattccctggatttgagaaaagcgggggcacagcacgagcgcgtggcaacaggggtggtcgtctggaggagcagagagtacccaggggacggggtggtgataccaaagaggaacagacggacgttcgcctacgactcagatgtcaccgggtgcgcatcaatagtacctccacacagagggcttctctgggccctctccaggtgacggggcatgggctatggctatgagaaaactctggaaacattaccagatgatgtctggtagtccgtgagaaatttgaaggagacatcaagcaggaaggggtacgggcattcgagagggggctgcctaacaaggccggagtgacctgcagctgtggaaattatggtggctggtggatgaacaaaaactgccattcattgctggaaggggcgggaatg

SEQ ID NO: 660895 - DNA, 323 bp, Homo sapiens
agctgacagatagccgcgtaggctcgccattagttccactctctagccttgcttgcttgtcttcagctcggtggctgctattaggtatcgcaatacttacaagctatccaaggggtctacgcgactcatgatgaaatcttctcctggtgagcctctgaggtgattctggctatgagttcccgtgcgactgcttcggcgtactctatggcctttccaacattagaaacttcgtcagttggcagcatttcaagcggcaatcggtatgaacacatcgccttgaccgctgctcgtccgttcaattcagtctcaaagaacggtctacg

SEQ ID NO: 660896 - DNA, 214 bp, Homo sapiens
acgtgtacaaggatcccactgcgagtacagtggtacgtaggccgtgatttgtacccagggtgtaagggtctacattccatgctcttcccacataactgctttgtccgagatttgctgcaccaggtatttgggggccatgcagggggaatgggagaatggtaagatgacacctaaaaatgtcttttgaaggaaaatgctggaggccacggaggct

SEQ ID NO: 660897 - DNA, 164 bp, Homo sapiens
cctgtgtgacttttttgtcccacaatgggcttcagcgagagggagggcagcatatacctcaatgacttcgcgcgcgtggtgagcagagaccatgaggccgtgaacggcatcctgcacttcattgaccgtgtcctgctgccccccgaggcgctgcactgggagcg

SEQ ID NO: 660898 - DNA, 186 bp, Homo sapiens
aaccaaattaatgagcaatcaggattttgtggaccataagacaggtgagacttaaaccccaaggactgtcagatcctgatactcgtagttatcccctgttgtttctgggccataggtctatccccatccaggtcgtgactcatggcagctgtttctcatgaagctaataaaattcgctttctaaag

SEQ ID NO: 660899 - DNA, 240 bp, Homo sapiens
cgttcagaagcatctgagttgaggcagagaggtgggtggtgtagaaaggcgctccgcattatggaatcaaccatggaatcaacctaggtgccagtggtagactagataaagaaaatgtggtacatatacaccatgtcatatcacgcacccatgaaaaagaatgagatcatgtcctttgcatcaatgtgcatggagctggaggtcattatcctaagcaaactaactcaggatgcttcttga

SEQ ID NO: 660900 - DNA, 685 bp, Homo sapiens
gctgcaggaattcggcactagctggtatgtactaaaccgggaccctgaagcaggttgtttacggatggattatcgccaatgtaccgacgaacgctcagtgcgtgacagctgatggggcctctgaacgcgggcacggtgccggccgacaccgacgtaggttgttctgcacctactgcctatatcgactctgcccggcatacgctcgatcccaagattgctgtggctgcgcagaactgctacaaagtgactaatggggcttttactgtggagatcagccctggcatgatcaaagactgcggagccacgtggatggtcctggggcactcagagagaaggcatgtctttgtggagtcagatgagctgattgggcagaaagtggcccatgctatgacagagggactcggagtaatcgtctgcattgaagagaagctagatgaatggcaagctggcatcactgagaaggttgatctcgagctgactgtcatcgtagataacgtgaacgactgcagcaaggtcgtctggcctatgagcctgtgtgggccattggttctggcaagactgcaacacccgcaacaggcccaagaagtacacgagaagctccgacgatggctgaagtccatcgtcatttatgcggcggcttatagcacccgattatttattggagtttgttactgggggacctggg

SEQ ID NO: 660901 - DNA, 202 bp, Homo sapiens
caggagggaggcggtggtgaacagccacctttcggggtcggcccagctctgcacggagcctgttccccatctcgatgagctgctcttctccaggcggaggctgatgattttctggctgcctccttcagctttctctggagtcggtgcatagataaggtctggggggcacgtgccactgaccggaggtgcaggaaaagctccc

SEQ ID NO: 660902 - DNA, 297 bp, Homo sapiens
agatatgccaagacagacggatgacctggaatgtcccaagccacaggacatctatgttccggggaggatgaatgaatcaaatcgcacctattttgaggcaagcaaggactctgtgacttcaggagccctggtgggtggacagaagctccctgctcccccagcctgtctacccagcagcgctttggccagtcccattcctgtacttctgagcctgcctgtcagtccctcctcacacgcacaccgtggctttgtgcctggtactgagtgtcccggagcccccggggagtgatgctttga

SEQ ID NO: 660903 - DNA, 455 bp, Homo sapiens
  misc_feature (7)..(7): n is a, c, g, or t
  misc_feature (141)..(141): n is a, c, g, or t
  misc_feature (235)..(235): n is a, c, g, or t
  misc_feature (360)..(360): n is a, c, g, or t
attttantggcccccactggaacaggggaggaagcagaggaagaaggcggcatttttctaaagtgcagagtgcagcagcctctgcatcaccccactgcagggagagagccacgccctttgcagttgtgaaaccagacccgntggacagttcgcctccaagcacacagtgcatattggatactgacaggccagggtggcagtggggctcctgggacccacgtgacaggacaagagntgaggctcagccagtcgcccccacaaggccagccgaagaatgccagggaccgagagctgaggctcagtgagccatcccacccatgccagcgggagaatgccaggtacatcgctctccatgctgtngtcctcaaaccccagcacaatgcctcacccttggtaacattcagccttcagctcatttgtcttgcaaataaaaaggttgaacttggaagaaaaaa

SEQ ID NO: 660904 - DNA, 731 bp, Homo sapiens
aagtgtcttgctccagactacaaagtgcatatcatctcctttaatagatccctaagtcccatgcatattgacgcataccttcaacatcattggaacctgcgtatagttgctttcctaacacctgtactcgacgcatgtcatccgagtatcgatctatttcaagtaaagctagtgatggtactatcattcactcctccaacgaccaatctatcccgaggacgatcgatccattctgggatgtcatccaaatggctttccatgaatgtcttaatgctagatgaaaaacgtgttatggtggatgccaatgaagttccaatatcatcagatgtcttgaaaagctgggtatcactaccatttaaagtctgacattcgtaataccaattaccctgggtaggaggcttccattgctggatcctgcgatgtcctggcgccgaggcaccttactagtcctacttggactgaacaggcctgatggagcttgtagctgggctcagatactactaagaagcttaggggcaaggtgtcattctcctgctttaagagaagtgcatgaactgatagtgcttgtcaacaatccatctccttaacagcggtcgaaagcctggtttgctgctattacttgtctttgacatacagaaaataacttcatgctagagtattactctctactcctaaagtcattcactatttcggctactagtatcacaattgggtgactgtgtccccagaaa

SEQ ID NO: 660905 - DNA, 149 bp, Homo sapiens
  misc_feature (7)..(7): n is a, c, g, or t
  misc_feature (12)..(12): n is a, c, g, or t
  misc_feature (16)..(16): n is a, c, g, or t
  misc_feature (68)..(68): n is a, c, g, or t
  misc_feature (106)..(106): n is a, c, g, or t
aacccgngaccncctntggcttttatggcttgagcatatttcctttcaaacaattcttcaacttgttnacgtagatcagtgatgcgagcattccatttctcgaagntgaactccctcactttccgcttcccagcaaaggggtcgattga

SEQ ID NO: 660906 - DNA, 790 bp, Homo sapiens
tctccggggtccaccattgggcctctacccgccgggtggggttacacaaagccaagggaaacagaaggagaaaaaaaaagaaaaacaaaaccacgccgcctctcagcccgggtgagtggtccacacagttcagaagtactcagcagacggggtgaaagagactcttcggcgtgacccctttattccatcttctgtggagtgagagacagagtgccttcgcgtgaactcgcgtggcaccaagcacacagcacttcttcgctgtgggtgatcacacgcgggtgtgacaaaagtatctcttatacagcgtgagacgcgccacagcgtggtctcctctcgaggcgtctcacaagatacacctcgcgtggagcagcgagcccacacgaaggaatcgcgtggacaaacaacatatagagcacacagacagaaagtgaacatagtgcgcagagtgcatcgggtgtgggggagaacacggcaggagccccacagaaagacctccgtgtcatcaggcgagacacagtgaaatgtgagcgtagagcagtgacacacaaggaaaagcacctctcaacgaggaatgaggggcacttgggccccccagctaccgctccagcgcaaactccacgcaacgggaaaaccagcctaacagtgcgccccatcggaaacaacatatcacccaggagtgatgaaagtggggattcgagagggaacaacacagcatcgacgagcaaacgtcacccctaaacaaggggagcgacaacaaacgaaacaggacataactccccaaggagacaag

SEQ ID NO: 660907 - DNA, 227 bp, Homo sapiens
gggagctcaggtctggcttatagacattctacagcacaaggtttgtgggtgcaggacacctcagccacctctcactcataacctgaaaagacacgtgtgggtgctcctaagaacagagccatggaacaccgagagaacacagacgagcaggccctgtggccattcaaggacacacactgctgtctgcagctccaacagggtaagtggtcagacatgaagtttccaag

SEQ ID NO: 660908 - DNA, 151 bp, Homo sapiens
  misc_feature (38)..(38): n is a, c, g, or t
  misc_feature (84)..(84): n is a, c, g, or t
  misc_feature (112)..(112): n is a, c, g, or t
  misc_feature (119)..(119): n is a, c, g, or t
  misc_feature (140)..(140): n is a, c, g, or t
ttaattttcaggaaaaaagggaaattgcagctcctcancccccaggattgacctttggggagtgatggtagcgttggtgccagnccgtgggttcaggtgtggcaaaagcttncaaatgngtcccaagggaaataaagtgngttggggttta

SEQ ID NO: 660909 - DNA, 183 bp, Homo sapiens
gtacataagcacagtaccccatttaagcactggcctaagacgggcttggcaaccaattttcaaatttgtttgcccaccattaaacccattgatttggttaccttttattcttgtttagccccaattgttttgttaattgttgttgcaagccttaaaattgtattcaagaattgccgtgccctt

SEQ ID NO: 660910 - DNA, 475 bp, Homo sapiens
caagtctagacagccgtctgtgacatcccacctcgtggcctcaagatggcagtcaccttcattggcaatagcacagccattcaggagcttttcaagcgcattttggagcagttcactgccatgttccgccggaaggccttcctccactggtacacaggcgagggcatggaccagatggagttccccgaggcttagagcaacatgaacgaccttgtctttgagtatcagcagtaccaggatgcccccgcaaaaaaggaggaggatttcggttaggaggccgaaaaggaggcctaaggcagagcccccatcacctcagggttttcagttcccttaaccgttttaatcaactgcccctttcctttccctcaaaatttgtgtttgctgcctctatcttgttttttgttttttcttctgggggggggtttaaaacagtgcctggcacatagtaggcgctccataaatacttgtttgttta

SEQ ID NO: 660911 - DNA, 346 bp, Homo sapiens
ggagctcgccctgttgaatgaatccacaaataatttattactaaacattaatttcaaacggctaaaaaaaaaaaaaaaaaaaagcgcattttcctctgcattcccggtcacggccccaggttttctaacaagaagggaggtaagggttgggttaaaagggggccaaagatggaaccggaggagcaggtgtaaaatgcaaaaaaccgggaaaacaaggggttgtgtgtctcaacgagtgagctctgggagtttaaaagtttcacagacaggtacttacgggtacctttaaaatttccaggacacagcacttacgggataatttctcttggtctctaaacgcgggttt

SEQ ID NO: 660912 - DNA, 2922 bp, Homo sapiens
  misc_feature (2315)..(2315): n is a, c, g, or t
  misc_feature (2319)..(2320): n is a, c, g, or t
  misc_feature (2327)..(2327): n is a, c, g, or t
  misc_feature (2329)..(2329): n is a, c, g, or t
  misc_feature (2335)..(2335): n is a, c, g, or t
  misc_feature (2339)..(2339): n is a, c, g, or t
  misc_feature (2348)..(2348): n is a, c, g, or t
  misc_feature (2365)..(2365): n is a, c, g, or t
  misc_feature (2371)..(2371): n is a, c, g, or t
  misc_feature (2376)..(2376): n is a, c, g, or t
  misc_feature (2386)..(2386): n is a, c, g, or t
gcacgtgctcattatacatgaaagaattcatacaggagagaaaccatatgaatgcaatgaatgtcagaaagcctttaatacaaagtcaaaccttatggtacatcagagaacccatacaggggagaaaccttatgtttgtagtgattgtggaaaagcctttacattcaagtcacagctcattgtacatcaggggattcacacaggagtaaagccctatgggtgtattcagtgtggtaaaggattcagtttgaaatcacagctcattgtacatcagagaagtcacacaggaatgaaaccttatgtatgcaatgaatgtggcaaagccttcaggagcaagtcataccttattatacatacaaggactcatacaggagaaaaactccatgaatgcaacaattgtgggaaagccttcagttttaaatcacagctcattatacatcagaggattcatacaggagagaacccctatgaatgccatgaatgtgggaaagccttcagtcggaaataccagcttatttcacaccagagaactcatgcaggagagaagccttatgaatgcaccgactgtggaaaggcttttggtttaaagtcacagcttattatacaccagagaactcatacaggggagaaaccatttgaatgtagtgagtgtcagaaagcctttaatacaaagtcaaacctgattgtacatcagagaactcatacaggagagaaaccctatagttgtaatgaatgtggaaaagcctttacgttcaaatcacagctcattgtacataaaggagtgcacactggagtaaaaccctatggatgcagtcaatgtgcaaaaacctttagtttgaagtcccagctcattgtacatcagagaagtcacacaggagtaaaaccatatggatgcagtgagtgtgggaaagccttcaggagcaagtcataccttattatacatatgagaactcatacaggagagaaaccacatgagtgcagggaatgcgggaaatcctttagtttcaattcacaactcattgtgcatcagagaattcacacaggagaaaatccctatgaatgcagtgaatgtgggaaagcctttaataggaaagaccagctcatttcacatcagcgaactcatgcaggggaaaagccttatgggtgcagtgaatgtgggaaagcttttagcagcaagtcatacctaattatacacatgagaactcattcaggtgaaaaaccatatgaatgtaatgaatgtgggaaagccttcatttggaaatcactactcattgtacatgagcgaactcatgcaggggtcaacccttataaatgcagtcaatgtgagaaatccttcagtgggaaattacgccttcttgtacaccagagaatgcacacaagagaggaaaccatatgaatgcagtgagtgtggaaaagccttcattaggaattctcaactcattgtacatcaaagaactcattcaggagagaaaccctatgggtgcaatgaatgtgggaaaaccttctctcaaaaatcaattctcagtgcacatcagagaacacatacaggagagaagccttgtaagtgcactgaatgtgggaaagccttttgtggaagtcacagctcattatgcatcagagaactcatgtagatgacaaacattgataattttacgaaactctgaaaagtggattcacaagagatagaaacaatcatatataaagagaaactctgtaagtggaatcatcttgtcatcttccagaaaactcatactgaatagaactttatgaatgcacagcatatggaaaggcatccacagaaagctgttctttacatgcaaaaagatagtagacaatacacaggaaaactgaatttagtaaccactctgaaaatttttagcagcaagtcatacctttttttaaaaagttcatacaggtgaggaaccatgttaaacgttgtaaagtcattttactaacataagattcacaaagaggaaacttcatgaaccagatgaatatagaatagacttctttgaaattcatagtttacagaattttaatgagagaaattattgagctaatgaatggcagaattaacaaaattacaaacattttatgtatcggaagcatataccttggagggaccatgctatgagggaaagtgtaaatctagaaatgagaaacccctagggaaaaaatatatataggagtgaacatcttatgaatgtaccaaataaaccacagctggactgttaacctcaccttagaagcttcattctaaaaaaaaaaaaaaaaaaaaaaaaaaaaaacctgttaatttttctttaatatttaantttnnaaaaatntnttcccnttangaacctctnttaaaaaaatttaattnccaggntgtcnccaaaatttncaggcgaacacggcgttcggacagaacaattctcctcaagttattaacattaaattaaggattccaggatatacttccactcggtccacaggtcgcacttcctacgatcaaggggagggtaaacggaattacacgacaattaacattcccaagagccatacagggggaactactctaaggaataactctcgctcatatgtgggtgtaccagaccacataattacggtgaactcttggccagatcggggcaatttttaaaccctgtgggtgaactgtgcccatctatgtgctgcaacggaaccaaaacaagatctccaatctcgttctccaaagaaagaattttccccagagaaaatttcctctgggcacaatacggaggacaaaataactcccccggtgaattatctggaccgcagaattactcactgtcctgccccagaaagaaatttccaacacctccgggccaattacccaaaccattctgggtctcccttgggaggctcttacacccaagggtgcccccctggctaaccctc

SEQ ID NO: 660913 - DNA, 3303 bp, Homo sapiens
  misc_feature (3156)..(3156): n is a, c, g, or t
gcacgtgctcattatacatgaaagaattcatacaggagagaaaccatatgaatgcaatgaatgtcagaaagcctttaatacaaagtcaaaccttatggtacatcagagaacccatacaggggagaaaccttatgtttgtagtgattgtggaaaagcctttacattcaagtcacagctcattgtacatcaggggattcacacaggagtaaagccctatgggtgtattcagtgtggtaaaggattcagtttgaaatcacagctcattgtacatcagagaagtcacacaggaatgaaaccttatgtatgcaatgaatgtggcaaagccttcaggagcaagtcataccttattatacatacaaggactcatacaggagaaaaactccatgaatgcaacaattgtgggaaagccttcagttttaaatcacagctcattatacatcagaggattcatacaggagagaacccctatgaatgccatgaatgtgggaaagccttcagtcggaaataccagcttatttcacaccagagaactcatgcaggagagaagccttatgaatgcaccgactgtggaaaggcttttggtttaaagtcacagcttattatacaccagagaactcatacaggggagaaaccatttgaatgtagtgagtgtcagaaagcctttaatacaaagtcaaacctgattgtacatcagagaactcatacaggagagaaaccctatagttgtaatgaatgtggaaaagcctttacgttcaaatcacagctcattgtacataaaggagtgcacactggagtaaaaccctatggatgcagtcaatgtgcaaaaacctttagtttgaagtcccagctcattgtacatcagagaagtcacacaggagtaaaaccatatggatgcagtgagtgtgggaaagccttcaggagcaagtcataccttattatacatatgagaactcatacaggagagaaaccacatgagtgcagggaatgcgggaaatcctttagtttcaattcacaactcattgtgcatcagagaattcacacaggagaaaatccctatgaatgcagtgaatgtgggaaagcctttaataggaaagaccagctcatttcacatcagcgaactcatgcaggggaaaagccttatgggtgcagtgaatgtgggaaagcttttagcagcaagtcatacctaattatacacatgagaactcattcaggtgaaaaaccatatgaatgtaatgaatgtgggaaagccttcatttggaaatcactactcattgtacatgagcgaactcatgcaggggtcaacccttataaatgcagtcaatgtgagaaatccttcagtgggaaattacgccttcttgtacaccagagaatgcacacaagagaggaaaccatatgaatgcagtgagtgtggaaaagccttcattaggaattctcaactcattgtacatcaaagaactcattcaggagagaaaccctatgggtgcaatgaatgtgggaaaaccttctctcaaaaatcaattctcagtgcacatcagagaacacatacaggagagaagccttgtaagtgcactgaatgtgggaaagccttttgtggaagtcacagctcattatgcatcagagaactcatgtagatgacaaacattgataattttacgaaactctgaaaagtggattcacaagagatagaaacaatcatatataaagagaaactctgtaagtggaatcatcttgtcatcttccagaaaactcatactgaatagaactttatgaatgcacagcatatggaaaggcatccacagaaagctgttctttacatgcaaaaagatagtagacaatacacaggaaaactgaatttagtaaccactctgaaaatttttagcagcaagtcatacctttttttaaaaagttcatacaggtgaggaaccatgttaaacgttgtaaagtcattttactaacataagattcacaaagaggaaacttcatgaaccagatgaatatagaatagacttctttgaaattcatagtttacagaattttaatgagagaaattattgagctaatgaatggcagaattaacaaaattacaaacattttatgtatcggaagcatataccttggagggaccatgctatgagggaaagtgtaaatctagaaatgagaaacccctagggaaaaaatatatataggagtgaacatcttatgaatgtaccaaataaaccacagctggactgttaacctcaccttagaagcttcattctaaaaaaaaaaaaaaaaaaaaaaaaaaaaaaaaaaaaaaaaaaaaaaaaaaaaaaaaaccggtttttttttttttttttttttttggggaaaattttttttttggaagaagatcgttttatgacaaaaaaagtttttttccccgaggggggccaccacaagattttgagagaaaaggggcggtgggacaaaaattcttctcatgatgtagtatatagtatataataggaaacaaaagtatatatttcttcatggttgaaacaagggagagtcatcttctcatataataggggggggtgtaacaagaattagagagaaaacatagacatctcgctcgacaagaagcacatacagcggaggatattaatggaaaatatcttcccatcatgggtgtcgtcatcaaccaaaaaaagtaaatcatcttggcaggaggtggaggaagtcattactgggtgtggaagaagagccatcttggttggagaaaaaaacaatctcttctttcagcagaaagatattatgaggatattctcgtgggagagtcgggagcaaatgatatctggtggatggataaaacaaatattcttcgtccgcagaaagatttattatctgcggagtgcaaacacaacaaaattggttctgtgtggggtggtatacaccaccaaagtgagcaggctggttgacccaagaagaataaggtacgtgattttaaaaacagggcgttcgttatccccccacagcggaagcacatactattcttatgcgaggagcacataattacgcacgccgctattggaggagaaacgctctctcggaggagcacaccacactcttgatgatacatactacacatatgatggaggagcgccaaccaccatttcggtttagtgagtgagagtcgcncgacagagaaccaatatatgccacccacaacacggagggtagacagacacatagtgatcaccccactcattaagaagaaacacatccaccacaacagcgagcggaatgtgatacgtcactaggaaggaacccccaccaatgtagagg

SEQ ID NO: 660914 - DNA, 2868 bp, Homo sapiens
  misc_feature (2261)..(2261): n is a, c, g, or t
  misc_feature (2265)..(2266): n is a, c, g, or t
  misc_feature (2273)..(2273): n is a, c, g, or t
  misc_feature (2275)..(2275): n is a, c, g, or t
  misc_feature (2281)..(2281): n is a, c, g, or t
  misc_feature (2285)..(2285): n is a, c, g, or t
  misc_feature (2294)..(2294): n is a, c, g, or t
  misc_feature (2311)..(2311): n is a, c, g, or t
  misc_feature (2317)..(2317): n is a, c, g, or t
  misc_feature (2322)..(2322): n is a, c, g, or t
  misc_feature (2332)..(2332): n is a, c, g, or t
gcacgtgctcattatacatgaaagaattcatacaggagagaaaccatatgaatgcaatgaatgtcagaaagcctttaatacaaagtcaaaccttatggtacatcagagaacccatacaggggagaaaccttatgtttgtagtgattgtggaaaagcctttacattcaagtcacagctcattgtacatcaggggattcacacaggagtaaagccctatgggtgtattcagtgtggtaaaggattcagtttgaaatcacagctcattgtacatcagagaagtcacacaggaatgaaaccttatgtatgcaatgaatgtggcaaagccttcaggagcaagtcataccttattatacatacaaggactcatacaggagacattatacatcagaggattcatacaggagagaacccctatgaatgccatgaatgtgggaaagccttcagtcggaaataccagcttatttcacaccagagaactcatgcaggagagaagccttatgaatgcaccgactgtggaaaggcttttggtttaaagtcacagcttattatacaccagagaactcatacaggggagaaaccatttgaatgtagtgagtgtcagaaagcctttaatacaaagtcaaacctgattgtacatcagagaactcatacaggagagaaaccctatagttgtaatgaatgtggaaaagcctttacgttcaaatcacagctcattgtacataaaggagtgcacactggagtaaaaccctatggatgcagtcaatgtgcaaaaacctttagtttgaagtcccagctcattgtacatcagagaagtcacacaggagtaaaaccatatggatgcagtgagtgtgggaaagccttcaggagcaagtcataccttattatacatatgagaactcatacaggagagaaaccacatgagtgcagggaatgcgggaaatcctttagtttcaattcacaactcattgtgcatcagagaattcacacaggagaaaatccctatgaatgcagtgaatgtgggaaagcctttaataggaaagaccagctcatttcacatcagcgaactcatgcaggggaaaagccttatgggtgcagtgaatgtgggaaagcttttagcagcaagtcatacctaattatacacatgagaactcattcaggtgaaaaaccatatgaatgtaatgaatgtgggaaagccttcatttggaaatcactactcattgtacatgagcgaactcatgcaggggtcaacccttataaatgcagtcaatgtgagaaatccttcagtgggaaattacgccttcttgtacaccagagaatgcacacaagagaggaaaccatatgaatgcagtgagtgtggaaaagccttcattaggaattctcaactcattgtacatcaaagaactcattcaggagagaaaccctatgggtgcaatgaatgtgggaaaaccttctctcaaaaatcaattctcagtgcacatcagagaacacatacaggagagaagccttgtaagtgcactgaatgtgggaaagccttttgtggaagtcacagctcattatgcatcagagaactcatgtagatgacaaacattgataattttacgaaactctgaaaagtggattcacaagagatagaaacaatcatatataaagagaaactctgtaagtggaatcatcttgtcatcttccagaaaactcatactgaatagaactttatgaatgcacagcatatggaaaggcatccacagaaagctgttctttacatgcaaaaagatagtagacaatacacaggaaaactgaatttagtaaccactctgaaaatttttagcagcaagtcatacctttttttaaaaagttcatacaggtgaggaaccatgttaaacgttgtaaagtcattttactaacataagattcacaaagaggaaacttcatgaaccagatgaatatagaatagacttctttgaaattcatagtttacagaattttaatgagagaaattattgagctaatgaatggcagaattaacaaaattacaaacattttatgtatcggaagcatataccttggagggaccatgctatgagggaaagtgtaaatctagaaatgagaaacccctagggaaaaaatatatataggagtgaacatcttatgaatgtaccaaataaaccacagctggactgttaacctcaccttagaagcttcattctaaaaaaaaaaaaaaaaaaaaaaaaaaaaaacctgttaatttttctttaatatttaantttnnaaaaatntnttcccnttangaacctctnttaaaaaaatttaattnccaggntgtcnccaaaatttncaggcgaacacggcgttcggacagaacaattctcctcaagttattaacattaaattaaggattccaggatatacttccactcggtccacaggtcgcacttcctacgatcaaggggagggtaaacggaattacacgacaattaacattcccaagagccatacagggggaactactctaaggaataactctcgctcatatgtgggtgtaccagaccacataattacggtgaactcttggccagatcggggcaatttttaaaccctgtgggtgaactgtgcccatctatgtgctgcaacggaaccaaaacaagatctccaatctcgttctccaaagaaagaattttccccagagaaaatttcctctgggcacaatacggaggacaaaataactcccccggtgaattatctggaccgcagaattactcactgtcctgccccagaaagaaatttccaacacctccgggccaattacccaaaccattctgggtctcccttgggaggctcttacacccaagggtgcccccctggctaaccctc

SEQ ID NO: 660915 - DNA, 138 bp, Homo sapiens
tgagctacctttgggagggcaggaccatttcagcacctgtgtcctctttgcactatgggatttggtaaaagatggtgtttacttactaacccaaaagcagtgattgaatttggaggatggatggagctgctgtagttg

SEQ ID NO: 660916 - DNA, 221 bp, Homo sapiens
gggggggggctttttttttttggggggtttttgggggaagggtccaattcttataaggaaattgggaaatttttatagggttttggggaaaggccattttggggctgaaaaaaaattgcccattcccttttttgggggtttttttcccccttttttggggtttttttttttttggggggttttaaggggtaaccctttcccttaaaggttttttttcccca

SEQ ID NO: 660917 - DNA, 350 bp, Homo sapiens
ttccgggattgcttctgcttctctctatgcctaatgtgcgtgtacacgctcactagtgcatacgtcttgctgatgttattatcatactcaattggggcttcaatcgggagtactactcaattgtcaacgtccaggagtcgcatgtcgcctggttctatgcattcactgggggatgctatgtagcgcggttgaacgcattagtcccgccgtactctgtgtacccattggttctctcacctttggtgcgcccattgatttgatggtcaggtagggatcgtttacctcgtcttgttctgtcccggatgtcgtgcggatgggcgggcgctgtggcctaggatgatggccggccg

SEQ ID NO: 660918 - DNA, 539 bp, Homo sapiens
aacgatggtcctcgagcttggatagagaaactgaagccaaataacatcaatttcaaaatgaagccaggtttccatcttggggcacttgttcaggacacttactaaaaagcagcagcatggccgggcacagtggctcatgcccagacctttgggaaggcgaggtgggcggatcacttgaggtcaagagttcgagaccagcctggccaacatggtgaaaccccatctctactaaaaatacaaaaattagctgggtgtggcagtgcacacctgtaatcctagctactcaggaggttaaggcagagaatcgcttgaacctgagaggcaaaggctgcagtgagccgagatggtaccactgcactccagcttgggtgacagagcgagactccatttcaaaaaaaaaaaaaggggtccaggtgcaggggctcacgccggtaatcccagcactggggaggccgaggggggcagatcactagaggtcaggagtgggagaccagcctagcaaacagggaaaaaccccgtctctactaaaaatacaaaaa

SEQ ID NO: 660919 - DNA, 115 bp, Homo sapiens
gtaaaacccagccccatgtcccttacagggccctactgagccctcctaatgaacctccagacctagccatgtggatttcactgcactccataacggtctgatactagggctacta

SEQ ID NO: 660920 - DNA, 355 bp, Homo sapiens
ccattctcacgacctgcatggcttgcacctcatgtctcttaggtctctactcaaatgttatctctctgagcagactccctgactaactctaatctaaaacacttgtgcagttgccctatattccaccttatcctgccatcattatattcctccatgctgctttaggtttttcctcctggcatttattcctcactgacattcatgttacctatttacttgtgaatttcttacctcccctgactagaacataaacttcatgataacatcagtatatcccagcacttcgtatatgctgtctgaaagaagctacttaccgttgtcaaaacacgcataattgtgtctatatgccatcgta

SEQ ID NO: 660921 - DNA, 546 bp, Homo sapiens
gtgtttgtatccataataaaagaaaaatttgtcagaactgctgcttcaatctaatcccatttgagagaattgtctttactgtcttaataactggatgaattatcactctgaaaatgtatttattgaactaaagttagtttaggcttgataaaacactccagacatttttactacagactgtttctataaaactgccattgcttctaatggagaattttattttaaaagaaataaaattgctgagtttatctgcaaaacctttctctaagtcttatgggacgtaaggagacacctccataattataagagccgttgtgctcagagtctccatgctggcttgaatgtatgatccacactgttaaaacataggcagcagctcagggccctggacagcctgagtcaacctagagtagctggaaccattttgacatgtaatggataagaaaattatccattgagaagctgaacaataaaccaaagaacgggtgtattttatccttaacctctgtaaaccacgttacactgagaacacttcagttcttccta

SEQ ID NO: 660922 - DNA, 480 bp, Homo sapiens
  misc_feature (41)..(41): n is a, c, g, or t
  misc_feature (457)..(457): n is a, c, g, or t
atggtttactctgtggcccaggctggagtgcagggagtgcnatcaacaaagtaattcgtttttaagaaagctctgatctacaagccttagggacttgtctacttaccaaagtgaagcatacccatataatgacaactacctctgctgatctgcaagattttataataggaaatcttctttacaacaagaagtatgtggcttataaataatatataataaaacatttatgctatgatgacaaaattagtcttattcttgccatcaaatatgtatttgacaatgaaactgctatctgtattgaatgactatataatttgtttgccatatggcaagtacatcagcactgcatactttgtggaacagtatatttccacagaacagcagtgtattaaaacattctaaatattaagaaaaagaatatcaattttgtaaattacccattgtaaagcacagaaanaaaaactgttttcagaatgccgg

SEQ ID NO: 660923 - DNA, 134 bp, Homo sapiens
ttggggctccatcagggagggacttggtacaggaagaaatccggtgtctccaaccacactatctacccatcatagacccctttcctatcactcacgggccccagccggagcacaaaggagatgcatacagttct

SEQ ID NO: 660924 - DNA, 325 bp, Homo sapiens
tggcgctgtctactctggatgcgcacggtccacagcggttagtgagctgctgcacggtaccagctcgtcgtcgaagcacagttctttcttttcagcattggagacggatgcagcggactatagaagggctccggcttccccagtgcctccaagagcttgttaagggatgtctgggaactgggtcgctgatgcttggtggcttttgcgggttgtgcaggtgcagtaaggacttggtggtgcggtcgtgcagagtcatgctgatgatgagtttcagggacttggagtctagtaggttcgccggaatgatctggttaagtctgatacc

SEQ ID NO: 660925 - DNA, 341 bp, Homo sapiens
cacggtagattgcactaattagttctcgtcggagtctcagaggagtcgagtgtgtgtgtgtagtagtgtgtgtagtgtgtgtgtataatcacaaacacacaggaagccaaacggatgctagtctttctatccctccccaatactctgtgtgtataaaagccccaaaaacaggagagagagggcagcgcaggagagcccatctgagaaaattctaaaataccagtgtctatatgacactgggcttagaaatagaaagtcacaattcagtctataccgctttacaacggatggcccaaattcgacccacgctaagactggcgctgccccagtgagcgtagggg

SEQ ID NO: 660926 - DNA, 246 bp, Homo sapiens
atgtgatttacctaaatagctgttaccttaattgctgtaatagctctgaatagctttcagtttatgtcttacatttcactaggataatgcgtgctaataacagttaatatatgcttcgaggtcaggctgtacattgattcaccatctagagtgacctggcccagaacaaattgcatccagttcctttgacctcactgaattgctgtaacaacactgtatgactaaaagtcctgacagtcatttagg

SEQ ID NO: 660927 - DNA, 1220 bp, Homo sapiens
tagtgttgttgttgtgggattacggcttggtagatgggtttatgcagagtggaagttgagtttaatgctatggggacagagagatagaatgtgtgataacagtgggggaatgttgtgataagaggtgcaatgatgtctagggagggaaatctcggtagataggtatatggagtggtgtaaaggcagttgggtgggtaggtatttacttatatgatagtatgtggtgtaatggggttctgtcgtccatcctagctggtaggtttattgttatttttagatgaaagggtaggtgtgatataattatgttgagcgtttgatagtgatggttttatacgtaatgttcttagggtattcttatggggtaaagtgagagttgatagggggaatggaattatagagttggagagatgccgaaaagttagtgggtgccataggggtgcattcggagatgtttgtgtggagtgttttataggttggtctcgcgaataattattccttggattcgaagagttgagtttagtttatgagtgaaggtttgcttactatataggtgtccttaggaagggttgtttttactctaaactgaggggtgcgctgagcaaagtaccctgcgtagaggtgcaagagatggtgagtctgaggctgcagaggacggcaggttagtctgctaggagactaccggtttgcgcggaatgacacttagacgacgtatagtggcttttcgtgagcacgccttggcgtgtgatgattcagtcgttgcagctgtgtctgaatgtcacggctcagtgggtcattacagttacgacgttcatttatagcgaatcttgagacaaccaggacgtgacaccttacaggtcataccagagtcaatctcagatatgactagatgtattatagcaaaatttctggtataaaaggataaataatctgttactatgagtatttaatgccaatattcgttctaaacttcagtatattgtagcttatataatactttttgtcaattgaaaattatagtcaataggtagtatgcacttgctttaatatatctctcaactgattctctttcgcagggtgttcatttagaagaaagcaacagctaatgattcatacagcttcctgaattttgtgttgtctcacagaaagccttatcataaattccataattctaatttatttaccaagattatgtaattacatataacttcgtgggtatacag

SEQ ID NO: 660928 - DNA, 961 bp, Homo sapiens
ctataacggggtcatcagatgctccttccaaacttgtggccggagtggtttaagactgcctatatgtctccatcaacgcactgtgccaggcacccctttgggcgcagtgactccttactcaccggcctcaaacagtccaactgcagcaacactgttgcccgacaccgggtccctgttccttctccgcgggtaaagtaagcccgccttgccgccctccctacgccctctcttgtcgtgcttccggagaccccccttggagtcccccgctgtcgtgccaaagcttccggccccggtgtttcaaaccgtccggcttcggctctccgtccggttcacgggcgccgtgactccactagaaaattatatatgggccgcgattcagcaaagcgtgaattcagtgtgttgaatcgaagctgttcatacccggcggcagtttcctactgacattttcttccaacgtgcgaagtttgtcggccgtacgaggcataaatcgcctatggtgattacatcaggcctcaatttttgggcccccttggcaaccccccgcggctggtttccccgtcggatcaccccccctgtgcagacgttgaccctcctgtacgccgcgtcccacccctggggagaatccgcccctctacacccaccctctgggggggtaccacacgcgcgattggagcagatgtctcacagtacacctttcacaaaaagcgatctcgattcttttcaataagaacactaatttgctcgcaggacacgagagatgagtagatagcaatcatttccctacagcatcacttggaaacgaatgcgaaagatctgcaccgatgcattcatgtagtagacgacaaagagcacccccctgtggtgtaaacaagcactcacaccacctttatttcctggagaaaaacttagtttccgaagccctttccaatacaaccactttttctgcccgatcattagacaa

SEQ ID NO: 660929 - DNA, 158 bp, Homo sapiens
ccgcgtgcatgtgctaggatatcgctagctacttctttcaatcatcataatacctgtaaattacatgctcttatctcggaatataccagaactggggttggaaaaatatgtctaacttcaaaactggaaaatttttttactacaataattcggccatt

SEQ ID NO: 660930 - DNA, 729 bp, Homo sapiens
atttgagttgaaatttctgatgtttaaaatctcacatcctcttcacagtggggacagtaactttctgcatctttctgcttttccctcagagatttttctctttctgccaggagggaatcccttgcctgttgctgtgaacaacacttctcactaatttccctctttcagttcctccgatccaaactgaaacttcctttttctttctcttatctttcttttcttttcttttttcttaagacagggtctccctctgtcacccaggctggagtgcaatgacacgaacacagctcactgcagcctcgacttcctgggctcaggtgattttcccacctcagcttcctgagtagctggaaccacaggcatgcaccaccatgcccggcttatttttgtagtttttttggagagacagggtttcaccatgttgccgaggctggtctcaaactactgggctcaagggatcctcctgcttcagcctcccaaagtgctgggattacaggcgtgactcactgcgcccggcccaaactgaaactttctaaaaggaagtgttactctatgactcccctgcttgaagtcctgggactctccagggtttatttaaatgcaaatttagtttacggaatttgtcactacttccaatccccaagcctgcttacagcacacagacacacgcgcgcacgcacacacaacacacgcacaacacagttctccagccatagtacattatcccta

SEQ ID NO: 660931 - DNA, 92 bp, Homo sapiens
gcggccgcctactactactactactgctcgaattcaagcttctaacgatgtacggggacatgtaataaaggtgtttattgttttgttcccac

SEQ ID NO: 660932 - DNA, 458 bp, Homo sapiens
  misc_feature (83)..(83): n is a, c, g, or t
  misc_feature (126)..(126): n is a, c, g, or t
  misc_feature (128)..(128): n is a, c, g, or t
  misc_feature (156)..(156): n is a, c, g, or t
  misc_feature (162)..(162): n is a, c, g, or t
  misc_feature (176)..(176): n is a, c, g, or t
  misc_feature (195)..(195): n is a, c, g, or t
  misc_feature (202)..(202): n is a, c, g, or t
  misc_feature (249)..(249): n is a, c, g, or t
  misc_feature (259)..(259): n is a, c, g, or t
  misc_feature (261)..(261): n is a, c, g, or t
  misc_feature (266)..(266): n is a, c, g, or t
  misc_feature (273)..(273): n is a, c, g, or t
  misc_feature (285)..(285): n is a, c, g, or t
  misc_feature (310)..(310): n is a, c, g, or t
  misc_feature (359)..(359): n is a, c, g, or t
  misc_feature (366)..(366): n is a, c, g, or t
  misc_feature (368)..(368): n is a, c, g, or t
  misc_feature (370)..(370): n is a, c, g, or t
  misc_feature (390)..(390): n is a, c, g, or t
  misc_feature (434)..(434): n is a, c, g, or t
agccatggcaggaatgcacaggactgtggcatttgcagcatcaaatcaccctagtgccatgtttggttatgagattgtaaatnattcgctcccccgtcctcccctcccctcattttcagtggcaananaggacccttgttgtacttcttgtttaanttgcanataatgtgtaaaangctttcgttgaaagaaaantgaaganactgaatgtgtatgtctgtgtgggtgctctgtccctgtggttgtcanagccagtaananttgancactganaccccgtacaanaaattgcataggtaagaacctcganctggtgttctctgcgtggctgtaagggactgtatatcttgtaaaaaaanacttgtnanangcttgaacagttacagcaanagctgaagaaacatttcctcaaatgtattattttaacaggaatnatgttctaatttcccatcctttaa

SEQ ID NO: 660933 - DNA, 82 bp, Homo sapiens
tcctgccttaggtttttttgtacaaatagcacaggaggaccccagccccatgcaaatgggaccccaggggcgggggtggggg

SEQ ID NO: 660934 - DNA, 705 bp, Homo sapiens
agaaaaaagctaggtagagaggctgagatggcgctgtcttccgaactggaaccaagttatccacagcaaaccatgctggcatccaacaggctctggcccagcttagtagccgtcaatgggagtgtaacttgcaccagtgagagtcatccaaggacacaaagcctgggcttccccaagaccccatcagggaccccatcatccataagacccacacaacaccgaatacgagaccccaaaagggatcaacagacgagaccatcagaaatcatgaccacccacaactattgaagagaggccaggtggaccaaatggatgagaagtgaggatagaggttgagagacatcactcagaggaacatcattgctcagtgtggattaagatcaccatatataccacccatacaacagtcatggtgagacatggccatccccaagaacaaaccaaaacgacattgcatacaaaggacgggaactcattatgcacaacacatcacatccatagacatcatgagcaattacattgtgagacatactaaaaagacccttagcaggtgggcaccccaagatgcacccataccaaggtggacaacgacagtacccaataacacgcaataaccatgaggcaaacaaagaaaggtggcaccccattgaaaaccacccatacaaacaataccttaggagaaaacccaagatataaaaattaaca

SEQ ID NO: 660935 - DNA, 743 bp, Homo sapiens
gggaaatttgtaaaatgcaaaactgaatgaaactgttactaccataaatcaggatatgtttcatgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattttcccccccttttgcccaagcaactttaaaactaaacaattttaaaaatcgcccccaaatttggacccaattgccaaattgccccaaaagggaggcctttaaaaataaaagggcccggttttaaaaacccttaaactggaaaaaccctggggtaacccaattaaaagcctttggaaaaaaacccctttttccaaattggggtaaaacgaaaaaggccccaaccaataccctttaaaaaaattgccaacccttaatggaaaagggaaatttaaaacctaaaaatttggtaaaaatccggccaaaatttttggaaaaaaccctaattttttaaacaaaaggcccaaaccggaaaaacccttaaaaaccaaaaaaatcccccaaaaaggtttaaatgtgttcccaatttggaaaaaagaccccttttaaaaaacgggccctcaacctaaaaggccaaaaaacctttattagggcagagccccattggaaaccttcccccaaacaaattttttgggccaagagcccaaaacgctaaaattgccctggcccccctttt

SEQ ID NO: 660936 - DNA, 166 bp, Homo sapiens
catgctgctgctgctttagcgcgccgccgcccaggctgactgccttgacaatgatggcgcagtacccttggaggccctgaatccagcagctctgcactgctctgagtccagccctgaaccttgcctcccagtgtttccagctctccagcctctttaccccccagca

SEQ ID NO: 660937 - DNA, 946 bp, Homo sapiens
tgccctttctgtgccccccaggttctatctccccgtacacacccgacggcctggcttcagtgatgtgtgatgctggagcatgccacttctccatgtgcccctgtgtgttgcccctgtgactgtgttgcagtctgcttgctcctgtgtggtgtgaggctggtggtgtgggatgcacgtgcctcgatgtgtgtgtgcctggtgccgtcctccagccccgcatgctccctggccagcccccttgtcgctgtcggtccctgtctaaccatgatgccttaacatgtgtgagtgtacctgtgggtgcctcactagcctctaactccctgtgtctgcatgagcatgtggcctacccctgtcccttccccggtggcgaacccagtgacccagtggacactgtggggtgtgcttgctgctgctaccccagcccacacagtgcctggccagcctgcccaccattccctggacagggctgtggagattggctccggcggcttggggaaagccaaattgccaaaactcaagtacacctcagtaccataccagtgaggcttgggtatagtcccttgcctcatgccattttctgatctcaagcggagcaagtgcccaagagacacacaaacacagaccaaaagagcacctcaagagaaaaagacatacaacacaaaaaaacatgagaacaaaacaaagacacagaaatagacaatcaaaaacaaaaaggacaaccagaacagaagcacgaaaacaaggaacaacataacatgacgacatgaacccacaagaaacacaaaaaccacaaaccaggaaagcataaccaaacagaccagaaaaaaaaagagaacagaacacaaaagaagagccgccagaacaacaccaaaacacaacacagagagaaacaaaaagaaaacaaaaacaaaaaagacgagaaaaaacaccagaaaaagcaacaaag

SEQ ID NO: 660938 - DNA, 1515 bp, Homo sapiens
  misc_feature (375)..(375): n is a, c, g, or t
  misc_feature (1479)..(1479): n is a, c, g, or t
ggtggtggccatttgcaacgccaggttgtgcatgctcagggctatgcgggtgcgtgggcgagggctcgcacgcgactgcccctagctaattgtcatctcatcggagcgctgcagcttgcccgggggcgtagtaggcgctagcagaggctgccggcgtcacgcttcgtggggcgtcaacggctgccttagctctccatcgtatcatattctcgagcctgcgccttcatagtacccgatactgactggagcgccgtggacatattactgccaaaatgcaccggacacgtgacaagtggttgtgcatacgagacgctgggcgacacatggctggggtacgttgcgcgggtatcccccgctcggaacagccaacgggcncaagtgttctaccttcgaggcaaaaagaccggttgcgacacgtagaacgggccataggcattgacttttcctgggaaactcttccacctcccattcgggtcaccccgttcccaggggcacgtcgaggtagtattggcgaggtgtcagcacgcaacccataccgtggtgcaacttggctttccggggaacaggaaatagagggtagcaacacagcgttagacagccgagttagcgggggcgtggggcaagcgaccaacctactccatgtacggacacatgtacccatcgaccgttgggtagccgcgcttggcttagcgtgcaccgaggggaaccggaaagggattcggcaccggaggcgaatgagtttggatcccgggaacctcccaaaaagcttctgatggaagccttggctgttctcatgccctgcggggtagtcctcccaacgggactcgtacttgttcggttcggtcacaaatctcttgcaagtacattggctcccatgcgcgcttcgttcgccaccaagcaagtttgtggcctaggaacgctctaacaagccggaagggcacccaaggacaggccttgggtttaccgcaaagaagccagtttggccacgattcgggaggccccttgtttagcggattgcccacaataacggcggtttgttttggaccctctagacaaggcgtacctaggggttgccctaaagccggaagacgttgccgcgcccacccaaattcccgtaggccacacggagtttgggtccatatatgggtccttggaattgtccaccatgggccaatgccggttgtctctctgggaagaaaggccccgcattagccgaagtcgttagtagaaggagggggagacattttgggccttcccaaatagaacccttaacaagtaacttgccgcaaagggaaattgactcctcggaaaaagcgttctggcgcggaaaaaatttcttactctctaccgggtccggagggaaaatgcgtttttggaactaggcgcgttgccttgtgccgatgaaatacgcgcatggttccgtgtgttgccccccagaaagtccaccacggggaaccacagggtttctggcgcctcatngctttgaaattcagacaccttagggcaaggcgtgtg

SEQ ID NO: 660939 - DNA, 266 bp, Homo sapiens
tgtgaacctgaggattcggctgtgcatgcttacaactcgccagtattgactgttgtttgccaggtctctggcagggtctggggtgacgaacgcaggactgacccgtcagtgcaactatcctgtgtcgtactggctggggctgctcacgtcctggaaagtgagagaaaggggccgtggccagtgatgccctggtgtggcacatccagaacgcctgggtcaccacggagcagcaggagcgataattctcccaggatgggccgggactt

SEQ ID NO: 660940 - DNA, 1842 bp, Homo sapiens
ccaagataactaaagcagggaagtgatcaggtttagtgtcttagaaaagtgttgccagtgttgcatgctaaatgtgcactcagcacagggtgcacttggcaaccatggcattgacaggggtgggcagcatgggcagcacacaggcacatgccagtactggccagccagcttaccagccagtcccaggtgggcaaacacccagcagccttgcaactcacaggttgtaacacactcagcaggggccatcagggctgcgcacagcagcatgcgcatctccagcagcatagtctgcacccacagcatcaacagctccacgtcagagcacttctcacacagcacctgcaccaagttacacggcattttctcacccaaccacagtgtgcagacagacataggtggagcacatgcacactatggtcctctcagagacatagcgtatagccacgactgacagagattcgcatcgcatcttaatcgagaatcacacacaggtagcatcagcagtcccaagcagagcgtcagcacacatatatcaggcgttcagaccagatcgaccgagagcacacaacatttcccccccacatttccgtccacaggcgggcaatatctcaacgcaccttccagcgtccctctaacaaccgataactttgttcaagcaaaaggaatatccaccaaggtacaagcatacaacaagcatacctctcaaaagagataaaattcggaccacattcaaacaatatccccgaaaatttcagcgtagctataagcggccgcggcgggcccacctaaccgatgggcccatccaacccaccacgatgggacacacatgcccgcaaagaccaaccactacatgaggcgaaaggcggacccacgacacgggaccacaggtgccgaggcaacacccaaacgggaacgcacgttccacaacggcaccgacttcaccaaagacacagggcaacgcacacagttggggacagccccacgcacccactctggaggtagcaaaaaacagcacccaaccaggctcccagtcccataacccattcacacccgcaaacgtaacccaacacaaccaacacaacttctaaggccgcatagggcgcgccaacttggctgctaggcggcgccgccacatgggccacgatcaataagacaagcccgcactcaggaccctagacgcgtcaagcggggccaagggcacgctgaacacgccacccgcggacggcacaaccctacggccagtacggcaacccacccgcggtggcagcggcacagcgccacgagacatggacacaacgagaacgcgccacacgcgacaccacacgccgcaagccatcacccgaccactccaccaagaccactgataggacgtaaacacgagacagcgggaacaccgactcccctggaccagccacagcaacagcacaaagagcaacgacaagcccacgaaaagcacgacaccacagcagccagcgagaccaacgaccagagcatcgcacacacaaagacaggacagcagacaccagaacaagaccacaaccactcgaccgccacctcaacacgcgaacagacaaacaacacgcgcagacccccacagccgccacccccgcgccccgcacgccgccccacaagcggggcgccacaaccaggacccgcacacacacagacaccagcacgatcacaacgacgccaccagccggcaggccacaaacgacaacaggaacagaagtgagcgacagacagaaaccaacacgaacaccgctcagcacgacacatcagacccagaagaacaaagcagacacagagcaaacagcagcacgagcagccacgacgccgcaccag

SEQ ID NO: 660941 - DNA, 422 bp, Homo sapiens
tcccctcttgtgctcagtcgccctgtgttttgaggtctcttttctctactccatggttctcaatttattgggggggaaataccttgaagcaaaatacaatggaaaaaaagtttttacccttttctgtcaaatgttcatttttatcccttcctggtctgaacaaaaactggttatgggaatcaacaccaccgagctctggtgggagaaaaaaagaaaaaccgtgttcccttcgctctgctggagaacgctggagagggtggctaggcccctgtgtagtagtgcatagaatcctagctttttccctccttttctctggtatatggggccttcagagagtacactggtgtctcctagttgtgaaattatgagcacagtttagcttttaccaacattgttatcgttgctctactttctcctggttt

SEQ ID NO: 660942 - DNA, 209 bp, Homo sapiens
ctaatggttaagggactacttcctgagaaacgttataatttatgtagggtattgagcttgaattttttttaatcataaaatcttaggctgggcgtggtggctcaagcctgtaatcccagcactttgggaggccgaggcaggcagatcacatggttagaagttcaagaccagtgtggtcaccatggtgaaaacctgtctctactaaaaaa

SEQ ID NO: 660943 - DNA, 395 bp, Homo sapiens
ctgtggccttcaaagtagcagcgtctgtcatatttggttttgatgatccctcaggattataagtcagttgaatggcttttaccaggtgtttgacttctgatgttgtgttttcaccttaatgtaagatgtcttccaaagactgtagtcccttgtccacttgggtgtgataagtagacagggaatatgcaatgccacagggagttgcgcaatagcgaccgagtctttcatctaagatgcagcagtggtctctggtagcaacatatgcgacacatgttgaagagagcaataagagagcatagaagtagagagttacattccgggggcgcgaggtgccactcatcatgtgtgagtgcccggagctgcgagccgtgctcgtgcagaattcgcgcagcccg

SEQ ID NO: 660944 - DNA, 422 bp, Homo sapiens
gcgacactcttgagtggaaggtacttaaaaaacaggaaaagcgtgtggaaaatgccttgtcttagcgactctcaaatgcaatgtaataaatgctggctctgaggacaacgtacaaatcaggcaatctcaggtgtgatgccaagagggaaaatgaggtattcattcaataatagttcattggctgggcgcggtggctcacgtctgtaatcccagcactttgggaggccaaggtgggcggatcacgaggtcaggagatcgaaacaatcctggccaacatggtgaaaccgcgtctctactaaaaaaagaaaaaaaacaaaaaaggaaacattttatccagataacgtggtagattccattgtgtggttcgaaagaaattaattacgcggagaactgtgcatataaccggttaaccccagaatcca

SEQ ID NO: 660945 - DNA, 904 bp, Homo sapiens
tacaatccactccggaatgagtctctgtccatcagctggaggaaggggcttctgggtccaccccacacggagagagctgcacttccccatcagcttcatccctggggcccatcctgactcctctgacctggggacgatagtcccactaccctgtgctccttcttcccccggatgagcaacctgagtgctggccaaacccgtggcatggagtggtgcgcccagtggtctacgtggtggagccagagaatgggcagatgatgatgggagaggggatcgtaggggcaggccatgccagactcaggccccctacccctccctccaggacatgaacaaagctgagtggaggacggacggtgcagcagtgacttcgagagtgtgaaaggtgggcacacgcatatgagtgagagacgaaggaagatggacccagaccacagagagagcatatgtcaataaagcccacgctgggggcaaggcatagcaatccacaacggaccaaaagatcataggggaacccggtagatattacctaccttgagttccgagaaacaatgggtttgtagtggaaggatccaacaaagtacaaaatagccgtagccccttgagaacattcaacaaacccatgaacatccaggagttcaaccaaaaggcatgagaccaatcaagaatcatgagtagtagttgaagtagattgaagaccgaggattgctcaatggataccaaacaacgtgcacgatgtaaccaagacacctgataaaccaggacaacatacacgctactatcccatgcggagaggaacgtaaaccctgaaaatatagattggaatttgcaacacacatacaaacagtatcaaaaaaaatacaacccattagacaaaaactgaaacagaactagtaacaacaatgga

SEQ ID NO: 660946 - DNA, 179 bp, Homo sapiens
cacctcacctagctcacttctcgatgtcgaacagtgccctggtggcgtgggtagcattggaggagggcaggtccccgcgcgcgcctcacggacagaggtgaccttaatgaaacgcttggtcccggcgcggttgtctcggggatcatgcagcggaatccatctttggtagaactggccat

SEQ ID NO: 660947 - DNA, 313 bp, Homo sapiens
ctgagtgcagtggcgcaaccatcagctacactgtcaacccccacctcccgcactcaggtcatcctcccgcctcagcctccagagtagctataaccacaggcatcaccacacatccagttaacttttgtatctattgtagtgatgggtcacgccatgttgcccaggctcacaaattaactatagctagtggtccccttaataagcagtagagtcaggattcagcgcccggtatcaaggctggactctcagattcacgctgtcaaatcacactgccttaactgtaaaaccagcagatacaattctggataagtga

SEQ ID NO: 660948 - DNA, 236 bp, Homo sapiens
ttcacagacccagatggccgggttggacccgaattaggccaagtaagacaagtttctatgctaggtggtggcctgcggacaggatatgtgaagaaacttcagagaagggacaagacgttctattactacaacaaacggagggaatgtgatgacaaggaagtccacaaagtgaaaatgttagtgcttacgagcgtgtcttcgttgtattacttgtcaattatatgttaagtattcgt

SEQ ID NO: 660949 - DNA, 148 bp, Homo sapiens
cctatttgtttccggggaacaatgacggggtgggaaaggggaaaggaaaaagtttgggaaagggagatggaaaagaactcaaggccattgcaaccctgcccggggcagatttgattttcacatttttacctggacattgagcctccag

SEQ ID NO: 660950 - DNA, 551 bp, Homo sapiens
ggatccccgattgtgaataggtaggtaggataagagaatcacgatgcaccaaaatggtaagaaaggcagctatgaacatggggaagacaagtgtgaacatgaggaagacagagatgaaggtgtgaaaacagatgtgaggataagaagacaggtgtaaaggtgagaaagaggccgggcatggtggctcacgcctgtaatcccagcactgtgggaggccaaggcagatggatcatctgaaatcaagagttcgagaccagcctggccaacatggcaaaaccccgtctctactaaaaatacaaaattagccgggcgtggtggcacatgcctgtaatcccaggtactcgggaggctgatgcagcagaattgcttgaacccaagaggcggaggttgcagtgagctgagaacgtgccattgcactccagcccgggcaagagagcgagactccatctcaaaaaaaaggtgagaaagataggtgtgaacatgaggtggcaggtgtgaagataggaaaggcaggctcatgttcacacctacctatttcacgatcggggtac

SEQ ID NO: 660951 - DNA, 351 bp, Homo sapiens
  misc_feature (255)..(255): n is a, c, g, or t
tgtgttcactgtataatgtgttgtctaaactgggacacgtttggaaataagagggatcatgtgttaatatatatagaaggacagcagacttaagccaggcctgtcctggaaaaccagaatgtatgtgtcacctcagagagacatgtggtaaaccctttaaagatactgtctcttggtatctcctattcccttagacaaagtatcatgtgtggaaagagcacaagctgtattcttcttcttgtatctctctctcanaataggagaagagtctgtaagggggaggtaggtacagaagtactccatattatactacaggcatcctcagatgaatgaggtattgtgctcgtgccg

SEQ ID NO: 660952 - DNA, 115 bp, Homo sapiens
actctagcagagatgcctgatgggtgctcatcccccgccgcggaacgactcttcaggccccacattcactgggagcttcctgtcaccctgtgcaccagcggtcacttgatgccct

SEQ ID NO: 660953 - DNA, 211 bp, Homo sapiens
gcgctgggggtttgggacctttaaagcctgccctggttgtgtggactccttaaagccaatcattttttcacttttttgggacacccagggggcctgtttacaagtgtggaaaaactcctaattttaatgtcccagacaatgtcctagtgttggctactacaatgttgatgctaccctgttggaattattaaactgattattttttttatta

SEQ ID NO: 660954 - DNA, 164 bp, Homo sapiens
tcgtgctaagattaaaaatgccctaacgcagttcttaccacaaggcacacctacacccctgtatccccatactagattattatcgaaaacatcagccatactcattcaaccaaatagccctggacagtacggcggggataccgacgctcgacattcgatcaatc

SEQ ID NO: 660955 - DNA, 298 bp, Homo sapiens
tgttgggctctctttctgcagctctttcaggctgtctttctcaaagcgtctgcagcaccacgcggccacggccctgaccgacgccggtgttgctcttgcccagcttggagccggcggagctcagccagcctttgtccagcagcttgttcttcaggtcggcttcgatgcccgggaattgcttgggctctttggtctcgatgtacaggccgggtttgtgctgcgggttgccttcggcgatcttgatgatgtcgtccaggctctggatcttcaggcccacgaagcctgggcgcgcgcggtc

SEQ ID NO: 660956 - DNA, 169 bp, Homo sapiens
tttaccacggggttaggctggtctcgaactcccgactcgagatctgcccgctttggcctcccaaagtgctgggattacaggcatgcatcatgcatcaccatgcccagctaatttttttaagaagttttttctgagccactgcgtctggccttctaacaatgctccgtca

SEQ ID NO: 660957 - DNA, 221 bp, Homo sapiens
  misc_feature (53)..(53): n is a, c, g, or t
  misc_feature (55)..(55): n is a, c, g, or t
  misc_feature (59)..(61): n is a, c, g, or t
  misc_feature (67)..(72): n is a, c, g, or t
  misc_feature (75)..(75): n is a, c, g, or t
gctgggccgtcgggcatgttcccatcatcacggacgggcactgggtagttgtntncgtnnnctgttnnnnnnganggagtacttgaagtaggggctcaatgggggcagaattacagcgaggcccccgacgacgaaggacacgaccagcactggctccttgtcccaggcattcttggggaaggcgccgactctcgcagccatctttgtctccccgggataca

SEQ ID NO: 660958 - DNA, 434 bp, Homo sapiens
  misc_feature (31)..(31): n is a, c, g, or t
  misc_feature (136)..(136): n is a, c, g, or t
tggtcctcaaacctccctggaccctccatgnatcccgcccggcctcggccctcccccaaagtgctggggattaacaggtgtgagcccactgtgccccagccccccacttttttgtaaattgccacctgatcccagnaaaatcctaaatgccctgagaagctctcttcccctggaattatgagagtagcctattcgtgtataaaaattcatccctaatttacccaaaaattacacagtcccacagagttaggctactttgaagcagcaaagatggcagtgtccacaaatgacacacatagaatatacagcctgaatgcagaatgtgaacctgtgagcctaaatacccaagagccttaaatctgaagttaatgtgaagggaataaacagttccagtggaatggtgaatgcatagagtgtactagtgtgttagcaaa

SEQ ID NO: 660959 - DNA, 154 bp, Homo sapiens
aaccacattttagttatgtcttttattggccatgatcaaggttccagcccctaaattaaaagaagtaaagctcaataggtaaggaagaccacagccaggattggaaaattttgcaacctagtttcaggtaggggatggatttggaatggattaa

SEQ ID NO: 660960 - DNA, 122 bp, Homo sapiens
cgcaacaggtcagaaaaaacctttaataccttttaagggtggccacttatgctttcttgccagatgcctttgaagcaggtgctatctgggctggagctatttgacccatctgtcgtcttctc

SEQ ID NO: 660961 - DNA, 611 bp, Homo sapiens
gggtgcagtggctcacacctgtaatcccagcactttgggaggctgcggagggaggattgcttgagcccaggagtttgaaaccagcctgggcaacataggcctccttgtctctatgaaaaaaaattagccaggcatagtggcatcttcctgtagtcccagctactccagaggctgaggtgagaggatcccttgagcctggaaggttgaggatgcagtgaaccgtgatggcaccactgtagtctatctagcctggtgacagagcaagaccctgtctcaaaaaaaaaaaaaaagtagaatgaaggacttttcataaatttttgtaaatggatgatgatgggtatgaaattgctgcggcttttagccttcttctgatgcatttacaagagatgcaattattttaacctatcagctttaccgctgccgcgccagacttgccaaatgcgtctaattacacctaatccattctcacacgccaagcaaccatcaatcgagtaaccacacaacctaccgactacgaccccatctttacccattacgcacccactcagccctaatcccgaacgtctccggcacctcaaccacctccaggcacctatctcccatcgccggcc

SEQ ID NO: 660962 - DNA, 140 bp, Homo sapiens
atccagaactcacggtacggtcagaaaggtagcagcttctccaggtcagcacgcaggtgtgaaatcactcaggagggtgacgtcccggatggccatgccagacagccccaccttgccgttccgctagatgcacacggtgt

SEQ ID NO: 660963 - DNA, 332 bp, Homo sapiens
tcaatgtgacctcgcgcatgatcgccaactagctggagccagacaaagagatcgtgcatgacggcgaccatatgatcatccgcacgctgagcacttttaggaactacatcatggacttgcaggttgggaaggagtttgaggaggatctgacccgcatagacgaccgcacgtgcatgacaaccgtgagctggcacggagacaagctccagtgtgtgcagaagggtcataaggaggcccatggcttcacccagtgtatcctggacgatgagctgcacctggagattatagtgcaaggtgaagctcgcatggaagccctcaagggtcaacgcagc

SEQ ID NO: 660964 - DNA, 311 bp, Homo sapiens
gggaactgcattccccaggctggatgcggtggctcacacctgtaatcccggcactttcggaggccaaggtgggtggatcaccggaggtccagggagttccacaccagcctgggcccatctcttactaaggatacaaaaatttagccaggcgtgtttggtgcgctactcttggtgcccggctactctgggaggcttgagcaagcaaatctgctttaacccctgaggcgggaagtgccggatggacaaagattgtccctttgcaatcccaccttggggacgaggagactatccctctcgagcacacaaaagag

SEQ ID NO: 660965 - DNA, 1009 bp, Homo sapiens
cattggttccccttgtacgtggtgaagttttcttccctgtcgctgactaggcttctctcttgtgctatgggccccatcgaatcttcggcgtttatgaaaggatatctttaggtctcacaatatgatagttaattagttcttccaaaggggaacctttttgaggcaagcaagtgtagtagcattcctaactgtgcaaccgtcgcatagccagagcccatgtaggcgtctgtctgtctaatgcagcgtactgacgtatgtccggaatcttcacagacgtgtcaaatcacaggcagtattctccaactagcacggcacagggactcacgagactattgtctccttaacccaggactagagttccctcgttactgtcacttcctttggtcagtacatgccctgggcttgctcgcactttggccggtcctagacgctgcttcatgacctcctctgtcctgacatgtctgcatctccttgccaggtcagctcattcacaagagtgtgctcccaagcctggatgaggttgcaccttgcatcttgagcatgcatttctcacaataattatctaagctgctgtgataatgttctgcatttcaggacactcatccattatcttggtctgtgagctcctagggttacgggtaccttgtatgtctaatcttatatccctagcacaaagcaagtgcctggcacatagtcagtgccctaagtattcgtagacgtgaagaatgaccagccatctcttgtgcctggtttccttatgtgttgaatgtggtagaggttatgtccattgctagggagagacatccagtaatgaaatttactattctagatgcttctacggtaatgtctgatctgcccacatcatctttcttagtaacacaggagaaatgtgtgacacctatattatacatgaaaacaatctgattaccactagttgatctataatacacaaatttaacttgcattttaaagcattcttgatatgtgctttgctacacagggtatctgg

SEQ ID NO: 660966 - DNA, 458 bp, Homo sapiens
ccctaccccggggtttgcctcacagggggggggggccccttttttttgaaaacaaaaagggggtattcagttgggccctgttttttccaaaaaatccccggggggcccgggggccccaccggaagggctaaacccggtgggcccttggccaggggcattaaagtttccccccccccccctgggcccccagggggcccggggggggttgggggtcccttgcccaaaaacctttttggggggcccattaaaaagttggggcccaaaaaaaaaccggccaaaaagggggccctccgccgccttaggggggtttttttcccccttccccgggggcccccccttttctttgtccccccccccccactttgtttttaagttttttaaatttggggggggggggggggggggccgggggccccggggcccgggttttttttttttaaaaaaagttggaaaaccca

SEQ ID NO: 660967 - DNA, 324 bp, Homo sapiens
cccagggaaaacagcctgtttattccagcgtctagaggtggggatgcaaaatgcaggggtgcccaaaggagggggcgcctgcaccccaggggcggaccgggacaatgcccccaatccaaatacagttcacccggaagacacggcagagcctcccacgttccaaaggctgacacaaaccagcagcgtgttgtgttggggggggggttcgaccaccatggctcgccccgacggtggggggggagtggccggtttctcatgtatcagctttcggccctcggggggcacatattttaagggggaccgatgttattaatacacaggttg

SEQ ID NO: 660968 - DNA, 138 bp, Homo sapiens
gagagtagaatcgagtggaccgaatctcgaaagtgtgcacagtttgttatttaagctcagggtcaagttctgtttcatttagtcgttccaaagtacaaaaagaaaaaagaaaatcaggggtgggagggtggggggggg

SEQ ID NO: 660969 - DNA, 302 bp, Homo sapiens
  misc_feature (280)..(280): n is a, c, g, or t
gggggggtgtgtgaactcgtgagtttgtgtaaatgtgtttgtgtgagtttgtgtttgagtctgagtctgtgtatatgtgtgtcagtgtgagttagtgtgtgtgaatctgtgtgtctgtgtgtgtgtcagtctgtgtgtgagtcagcgtgtcagtgtgagtctgtgtatgtgtagggtgttagtccgtgtgtgtgtgagtccgtgtacaaacgtgtgtgacaatgtgtgtgctcactgacaatacactggactagtagtactaatcgacccgggaattccngaacggtacctgcagcgtacca

SEQ ID NO: 660970 - DNA, 967 bp, Homo sapiens
  misc_feature (23)..(23): n is a, c, g, or t
  misc_feature (158)..(158): n is a, c, g, or t
  misc_feature (161)..(161): n is a, c, g, or t
  misc_feature (190)..(190): n is a, c, g, or t
  misc_feature (201)..(201): n is a, c, g, or t
  misc_feature (207)..(207): n is a, c, g, or t
  misc_feature (209)..(209): n is a, c, g, or t
  misc_feature (213)..(213): n is a, c, g, or t
  misc_feature (220)..(220): n is a, c, g, or t
  misc_feature (223)..(223): n is a, c, g, or t
  misc_feature (233)..(233): n is a, c, g, or t
  misc_feature (235)..(235): n is a, c, g, or t
  misc_feature (238)..(239): n is a, c, g, or t
  misc_feature (241)..(242): n is a, c, g, or t
  misc_feature (245)..(245): n is a, c, g, or t
  misc_feature (269)..(269): n is a, c, g, or t
  misc_feature (278)..(278): n is a, c, g, or t
  misc_feature (307)..(307): n is a, c, g, or t
  misc_feature (314)..(314): n is a, c, g, or t
  misc_feature (319)..(319): n is a, c, g, or t
  misc_feature (326)..(326): n is a, c, g, or t
  misc_feature (360)..(360): n is a, c, g, or t
  misc_feature (391)..(391): n is a, c, g, or t
  misc_feature (427)..(427): n is a, c, g, or t
  misc_feature (466)..(466): n is a, c, g, or t
  misc_feature (469)..(469): n is a, c, g, or t
  misc_feature (535)..(535): n is a, c, g, or t
  misc_feature (560)..(560): n is a, c, g, or t
  misc_feature (728)..(728): n is a, c, g, or t
  misc_feature (765)..(765): n is a, c, g, or t
  misc_feature (807)..(807): n is a, c, g, or t
  misc_feature (810)..(810): n is a, c, g, or t
  misc_feature (850)..(850): n is a, c, g, or t
  misc_feature (896)..(896): n is a, c, g, or t
  misc_feature (903)..(903): n is a, c, g, or t
  misc_feature (906)..(906): n is a, c, g, or t
  misc_feature (939)..(939): n is a, c, g, or t
ctaaatgtttatttgcaaatganctacagacacactccttgagtgtccactttcaggataaggaactcataaaggcaacaccatatttacaactttgcatcagatctctctcctggtgtgacttttctgaagcactgcacatgaattcatttgcaggnggntgtcctacattacacttatactgtttttntgtagtgtgtnttctcncntgtngccttanggntgggggggantnggnngnnttngcacaatgcttacattgatagggnttctctccngtgtgcggtctcatatgtattggtaaagntgatggncattngggggcnttcccacattccttacattcatagggcttctctncagtgtgcgttctcacatgttgttgcgaaanttcaggccaactgagagctttcccacactgcttgcntttatagagtttctctgcgcgtatgccttctcatatgtnttngtgagggtatgtggcaatagaaagctttcccacatagcttgcattcataggatttgtcttcagggngcattctcacatgttctcgaaagcnagcagacaagctgaaggctttcccacactgcttacattcatagggtttctctctagtatgtgttctcatatgttttcgtaaagatatgggccaattgaaagttttcccacattgcttgcactcatagggtttctctccagtgtgcaccctcatgtgtcctcgaaaggnggaggggtgactgaatgctttcccgcactggttgccntcatagggtttctctccaccatgagtcctttcatgtcttcgnaangaatgggggataaatgaaggtcttcccacactgtttgcantcgtagggtttctctccagtgtgaatcctttcagtcttcgaaaggntggaganaangaaggtttcccacatgtttgcatcgtagggttntctcagtgtgtgtatcagtgtctcgaaa

SEQ ID NO: 660971 - DNA, 287 bp, Homo sapiens
  misc_feature (8)..(8): n is a, c, g, or t
  misc_feature (142)..(142): n is a, c, g, or t
  misc_feature (155)..(155): n is a, c, g, or t
  misc_feature (196)..(196): n is a, c, g, or t
  misc_feature (220)..(220): n is a, c, g, or t
cgaggtantggaaggtggagtaagtggaatacaggtcaagggcagagctcctggcctctggtgggcagggcgaggaatggaagatagagtacgtgggatacaggtcacgtggcagagctccttgtgcctcaatgatgcctcnctgatctatcgcntgggcctgtgacgaccaaacactgtggatgactgatgagcnagaatggtcatgaatgatgcccanaaatcagggcccatgatgttcagtgcacttggctggtgtttggcataggccttgggcccctggtcac

SEQ ID NO: 660972 - DNA, 209 bp, Homo sapiens
tttctttattggtcattaccttcttatattgttcaattatttgtaaaatgttgacttttttctttattttttctggtattcttttttctctttttggggtatttttcccttccgttttgtttatccctttcctttgttatatattgattctttatatatattggttccccattggtttctctttacctcgtctttatctttctatacct

SEQ ID NO: 660973 - DNA, 357 bp, Homo sapiens
  misc_feature (110)..(110): n is a, c, g, or t
ctgcatgttgactcttcatgatccccctgttgctatgcaagctgagtgatacaggcttagtgttgagtgaaatttctgcagttttacagtcagtcgtgactgtgataacnccttgcgatatcatttttgctaggtgtattatcttgtcaaatgcttgtttgttcatatcttctcgtctgtgagaaccctctcgcgtagtcttttccagatgcaaccttaaaatcagtgacaagaaacattccaaacaagcaacagtcttcaagaaattaaactggcaagtggaaatgtttaaacagttcagtgatctttagtgcattgtttatgtgtgggtttctctctcccctcccttggtcttaa

SEQ ID NO: 660974 - DNA, 156 bp, Homo sapiens
cgccttcgagcaccagagagtcctcgcaatcctcaaagagacccactaaaacttgagatcatgttgaagctaaacccatatcaaagaccatgcgccggacaccattcttcgccaggccagggattaaaagctccgggtggataaggcaacttctga

SEQ ID NO: 660975 - DNA, 605 bp, Homo sapiens
  misc_feature (60)..(60): n is a, c, g, or t
ccattacacaatggaaaaacagggccggcagggcgagcagcccccccagttacggtggtngaggcttcgctttgtcggggtcaatgccgacaagtggacgaggtgatcaattttgtgggggaagtggtcatcgccagcgccggggccaacctgttggcgcgcggcagttcgaacgggccgttgcaggaatccacttcggtggtgtcgggactgatggaggaaatcctcgacggcgcgttgcacctgcggatgatccccatcggagacaccttcaaccgtttccgtcgtgtggtccgggatgtcagccaggaactgggcaaggacatcgaaccgttgatcagcggtgccgataccgagctggacaagaccgaggtggaaaaaatcggtgatccgctgatgcacctgttgacgtcatgcgatggatcacggcatcgaatccccgtcgctgcgcgaggccgccggaaagcccgccaagggccggttgcagctcaacgcatttcaagattcgggcagcattgtcctggaaatcgcagacgacggcgccgggctgaaccgcgaccggattttgcaaaaagccgtcgagcgcggcctggtccctgtcgggg

SEQ ID NO: 660976 - DNA, 987 bp, Homo sapiens
ttaaaatatctcttcagatgaaactgtccagattaattaggaaaaggcatatattaacataaaaattgcaaaagaaatgtcgctgtaaataagatttacaactgatgtttctagaaaatttccacttctatatctaggctttgtcagtaatttccacaccttaattatcattcaacttgcaaaagagacaactgataagaagaaaattgaaatgagaatccgtggataagtgtttgtgttcagaagatgttgttttgccagtattagaaaatactgtgagccgggcatggtggcttacatctgtaatcccagcactttgggaggctgagggggtggatcacctgaggtcgggagttctagaccagctgacaacatggaaaacccatctctactaaaaatacaaattagctgggcatggtggcacatgctggtaatctcctgcctcagccacctgagtagctgggagtacaggcatgtggcaccatgcctggctaatttagtatttctaatagagttgagatttcaccatgatggtcaggatggtctcgaactcctgactcgtgatccgaccgctcggcccccaaagtgctgggaattaacgagtgtgagccacggcggcacagccaggaaagcgtcattaacataagacgctctgtgtaaattataccactggggaaaacactcggctacgctcagggaataatccttaccaaaagacatacttacagtctacataccaactcgtcggaaacgccaaatggcacgattccattacaagatgtcaaaggccttcgaaagacacgtacagcagacctacacacagctagaacacaaggacacacgggcacaggaacacaagaagacacacacaaccgaatagaaaagaacaggcaaggaagcacgacaacagccaagacgacgcaggaatgacaacaagacacgacacagatcacaacaacagcaacaacacacactgagaaaaaacac

SEQ ID NO: 660977 - DNA, 263 bp, Homo sapiens
gctcgaccaaagcgctccaaatctccacttgcacattccacaacaagagtgtttccaaactgctctatcaataggaatgttcaactctgtgaggtgaatgcaatcatcacaaagcagtttctgagaatgcttctatctagtatttaggtgaagatatttccttttccaccacaaaccacaaagccctccaaacgtccacttgtagacactacgaaaagcatgtttcagaactactctatgaaaagcaatgtgaaacgtcgacg

SEQ ID NO: 660978 - DNA, 641 bp, Homo sapiens
  misc_feature (629)..(629): n is a, c, g, or t
tctcaccacccactcctgcatggcgcacaaagtgagaccccgtttcatcaaccaatcaatcaatcaaacataagactttgaaaggtggagagaaggcagaacaactacggacattgggacccaaaacaacacattggtgagttctttggttttctttttgtctcatacatactagactggatactggagaagcctgcaacccacaaacaccaacagatgcagaccaaaaaaatagcctttctccagataaaggaccaagaaaggggcagcctggcaacgcagaaaacttagataatgaccattgtactccagccacacacagtggaaaaactctggctccacccccaccctcactgagagaagagcctagagtctccaggctgtgttgaggtgctcaaatgtccctccactcactgaggtggtgtcagagaaagccaagtggagaacatgaacttctacctccatctggcattaatgaggtagcaccacaccttttcctgccagactctgctcaaaggagttcaactcacgaagattttactgaattccagagtcttataacataataacccaaatatccaggtttcaataaaaagttgctcatcatacccaggatcagggaagatctnaaattgatgggg

SEQ ID NO: 660979 - DNA, 108 bp, Homo sapiens
agaggatcccattcgtgatcccgatgtgccagacatctgatttcagaagcccactattgcccttgtagtgctttcggcccagttctggcctcagcctcaaagtgcacc

SEQ ID NO: 660980 - DNA, 1291 bp, Homo sapiens
gatgaggatgagaacagtacggggaacaagggagagcagaccaagaatccagacctgcattaatgaatcggcagtgaacagaccaccacgatcatcattcccagctacgctggctgagttttgactgacaatgagtgttcatgccattgaagcggagtggctctccccgaggtactcccgaacggcaagaacaatgtccaagaagtccagagatgctaccgtggactatcgaaacatataactgatatgagcaccgttgaccgagctgaagccccacaaggagctatctatgacctcgtaccggccgtgaccgagcgagaactcgtagacggggtggatgatactgtggccatcagtggagggatccaatggccgttaccttagaatgagatgtgcgggtctatcaattgaacgtacgcgagcgtaggaatcgcgtgcagaaggtcggaacgcaaagacgccgaagtggggggccctcgcgccactaacgcttcatcgacttcacgatggtccatatgggcattgaacaccacgcgatctaggggactccggtagccatccatgctacaggctgccaaagggaacaaacgcagtactagagcaggtaacctcatcagttgggctttataccgcccaatagctacacgagtggcggtccagagccatttggtcgcacgtgggaatccaataggggggctcagacaggcatggcacaaagcacgagaacggaagagacgaagtggctgagaacgcacacgttatatgggaggacgtatgacagcccaacacggaacacaggtttgcgtataccgacgtagagatagaaggatgaacgaaaagttgggtttacccacacgcataaccacagagagggaaacgcccaaaatggggacttacgatcatgcgtgccaacggttgggcgctacacattacccggaatgcgaaaagatgggggtgagcaagcgaaaaacaagagggggataaagcacccccctttggcgtttagccgtaccccttggggtaaagagacgatacatgcggagaaccatgtgttaaccaaaggaaggaagtaggaaccttcgggacaaccaaaaaacggatgggtccccgacaaggcgagtgctggggcggaatcgacgcacgacaggagaacaacgggcaccaggaaggctaagacactcacttgtggcagagttacggagctatcagaggcgatacaccgcaaattggcggaaatgaaagccccaaccaaccattgggaggggacacttccggcaagggggccttcccc

SEQ ID NO: 660981 - DNA, 154 bp, Homo sapiens
ccttacaacatctcatggcgcgcatatgataattttctggaacatcaaattcaggtttctacagccagttagtctacaaaccatgcagcagcaccatcaaaccagagtctgccaccttggcccagcaatcatccagcgatgagatgttggaagg

SEQ ID NO: 660982 - DNA, 323 bp, Homo sapiens
  misc_feature (83)..(83): n is a, c, g, or t
  misc_feature (130)..(130): n is a, c, g, or t
  misc_feature (197)..(197): n is a, c, g, or t
  misc_feature (261)..(261): n is a, c, g, or t
  misc_feature (322)..(322): n is a, c, g, or t
gccttccttcctgcttcgcctccgcgcctcgcgctatgggacagagcccccgatccgccagcaccactgagggatccagaaancgccccagcgatggaagaagatcaggaactggagagtatctggaatngaagacctcaatggctgaaggcgagaggaagacagccctggaaatggtccaggcagctggaaacagntagacactgtgtgaacatttgttattgcacgagggaagacccataccctagggaaattcttctnacgttaacatgattcatgaagcccggaatggtttgtggttacactacgacccatccttcgng

SEQ ID NO: 660983 - DNA, 126 bp, Homo sapiens
aactcctgacctcatttgatcgcccgcctcagcccccaaatgtgctgggattacgggcgtgagccgccacgcccggctcttggcatgaatttctttgagtttatcctgtgttgggcgataacatca

SEQ ID NO: 660984 - DNA, 1172 bp, Homo sapiens
ggacaaaactggttcaagctgtagcgaaaaccctttctaaaaacgagtaaccgccatgaccattaaaactaactatacattgatcaacccaaaatgtccagtggtgttgggctatagtggtctgtcaattccaggcacttgcgcgtaggctgagaccaggagaatcatctatatatgtcacaaggccctgggttcatcctagtgtcccaacgggacaaagtagtaatgattaacggggctagacgagctcacgtcacgtgggataagcagctgcttgcaggtccagggtgttagcttgcctaaggcattgttgggcagctcacaaccacttgtaactccagctccggggcatgctctcttctggcctctgcaagtcgattcataagcatgcacataaacacacatacatatacactacacataagtaatctaacataagtctctaacaaataatctaaactagggctgaagcagatggctcagacacttaagagcactgattgctcttctagagttacaattgcccagaaaccacatggctcacgaaccatcttcaccctcttctctggtttatctgaggagaacaacagtcgtatacagcattacctacacacacgtacctggaaccaaacacattacgcgtacagcacaacacctatcgaacctacctaatctacactgcattttaactcatggacacatctgcgcgcctgtatgccacaaacgactagaacgggaaacgttgaactcaactgcaacaagcctagctcctcaattccctcgggggcccaacgtgactatgcctttcataggcggtcccctaacagcaacagcacgtgcctgggaccaacttcctcaataactggcctatgccctgtaccatggagaagctaatggtacaattacacactccggcacacccacagcaccaaacacggctccccaaacacacaccaccgcaaacgactattaacaggcgatccacgacagaaagctcaccagacaactagaagacaacaacaacaatcactccctataaaacatacactcagcgaacgccccaactaacaacacacaaaccaggtacacaaaacatacacagctagatagccacccaaagtagcactcacctaacacatacgcaccgacgactgaatctactacacaccgac

SEQ ID NO: 660985 - DNA, 1016 bp, Homo sapiens
gtcagatcagaagtctcactgtttgttaatggctcctgtgggtacatctcacagtaggaaagccaaagttatgcagccacggaaaagaaatgaagcatgaattcacactgcaacgtggatcaactgaaaacatgatgctgatagaggccagacatgaaatgacccatactgtatgattccacatatatgaaatgtacactaagaagattggggactgccagggctgtgggagggaggttcttggaagatgacagtctcatgttgatgcaggatgttttttcctgggggtgatgggaattagtgtagttgggtgatggctgcataatatccgtgaatcaatctaatagataccgaactgaaatatgtgcactttaaaaaatgaatttagggccggttgtggtggctcatgcctgtaatctcagcactttgggaggtcaaggcggacagatcagttgtagggcatggagtggcaatatcactctaagctcttgcactaagaacagtgaatagcctgtctctactaaattgatacacaaattagccaggcacggtgatgggcgtctgtaatccgcagttctggtggagactgagtgcgggagaatttattgaagccggggggaggtggaggttgcgtgagctgagatcatggcattgcatgccagctggggatggaggagtcttgcgctcgaaataaatgctaatagatggtacagtttggcctgagagccaggggttcacacctggtaatcccagcactttggaacgacaatggccgggggtgcactgaggtaggagttcagacaaggcgagccaatggcaaaacccggtctattaaaatacaacatagccggctgggtggcgctttaaccgaccgagggcgaacagaacccgacacaggggggggctgccacaaccgtccccgcggaagaacctcacacaaccgaacggtcaaaagcggccaacaggacgagcttagcaccacacgacacgcgcaggaggccagggatacccagggg

SEQ ID NO: 660986 - DNA, 1175 bp, Homo sapiens
  misc_feature (473)..(473): n is a, c, g, or t
tttgtgtcgtcgtgttcagccaaagaaatggtctacacacgacttgttgatcggccgggtcgcccagtcgctgtgctctctgctgctcgtcgctcctcgtcgcgctcttcccagatgctgactagatgaacacgagcgttgttgaccccgcgccttgtgcaccaatgttcacagtcataaagtgttgtaatactatattagtagcatttaactagtatcacccaccaactactatagcttagcaacgaagggagactacgatctatcattgactcatactatgctgtgaggagtactcaaccgtctgccgtgatgtgtggtcactagtgtgcgtactgactgcgtgacgtactagaacgaagcagggtaactgtcttgcaactcatccaaatcaccccttgctgagctgattacaacaactccttgaatcagatcaacccaggtatttatcctaacggtcagcgcggcaactngactcatgtactccatcacaacaatcccactataagtcggaccaacgtaggcgcgatgccttacttcagtaaggtggatcgagcctgttacacattccttcagttacttacttgtcaccacctaactatgtatgtcacgccctagatatattacacgcactcgcccacctatttactaaccatgattagcaacgaccgacactgtaccacgttaccctacaacaggacagttagctcttaagcgttcggtgcaagcaatggtcgaacctcctttcgaagagatagttagtgggcagaaccctcctaccttaaatcacgtggagaggaccttcaaggcgaagtggatcgactcagggacagctcactcacatccctccgttgcgtacagagtatggttccttcctcccagggaactctacatttatatagttgtccaccccacctatctaattcaagtctccgccccacagtaccttgcgcatggaaagacgggatcgaacataacttatcgccgccaaagcggggcagtagagttgaccgcaacttaccagacggatcctccacatacattctatataggaacaatacaccaccgcatggaggagcaggaaaggatggcgagagtttagtgtaacatcactgacggacagtcttcagacaaatcgctgacacgacaaggagaggatatatcattaacaaagg

SEQ ID NO: 660987 - DNA, 681 bp, Homo sapiens
  misc_feature (72)..(72): n is a, c, g, or t
  misc_feature (88)..(88): n is a, c, g, or t
  misc_feature (200)..(200): n is a, c, g, or t
ttatcagcaattacattgttcggattcacaaatgtagacgggctacaaggatatgaagcagctctatcaatnatagatgatgatcaanattagtcacattcgagcacatactaattaccagggccctttaactaaggcaaatgaacaagctgatttgctagtatcatctgccttcatggaagcacaagaacttcatatcntgactcatgtaaatgtaacaggattaaaaaccaaatttgatatcacatggaaccaagcaaaaaatattgtacaacattgtgctcagtgtcaagtcttacacctgcccactcaagaggcaggagttaatcccagaggtttatgtcctgatgcactatggcaaatggatgttacacatgtaccttcatttggaaaattgtcatttgtccatgtaacattgatacttattcacatttcatatgggcaacctgtcagacaggagaaagtacttcccatgttaaaagacatttattatcttgttttgcagtcatgggagttccaaaaaaattaaaacagataatgggccaggatattgtagtaaagcatttcaaaaatttttaaatccatggaaaattgcacatacaacaggaatcccttataattcccaaggacaggccatagttgaaagaactaatagaacactcaaagctcaattggttaaac

SEQ ID NO: 660988 - DNA, 912 bp, Homo sapiens
  misc_feature (241)..(241): n is a, c, g, or t
  misc_feature (246)..(246): n is a, c, g, or t
  misc_feature (251)..(251): n is a, c, g, or t
  misc_feature (253)..(253): n is a, c, g, or t
  misc_feature (269)..(269): n is a, c, g, or t
  misc_feature (319)..(319): n is a, c, g, or t
  misc_feature (828)..(828): n is a, c, g, or t
  misc_feature (893)..(893): n is a, c, g, or t
ggacgagtggagcaccagtaactgttatacctcgcccagaagcacctcggtgtgccatcccactggcaatcatatgcagatggtacgctgatgcccactctatatctccactgaccgcttcacctggccagttgatgactccgccacacggtgtattgtatgctcgtactcattatgtcccacggtggtccacattgcatgttagtatgggtcctggctgggtcagcccggacaatgtggncttgnaagtngncaatgccatcatcggncactatgactgcacttatggtggtggcgtgacctgtccagcccactggcnttcaggtgctgtggccaacaagctatgccagagtttccagaccttcagcatctgctatgcagagacgggcttgctgggtgcacactttgtctgtgaccgaatgaaaatcgatgacatgatgttcgtcctgcaagggcagtggatgcgcctgtgtaccagtgccacggagagtgaggtggcccggggcaaaaacatcctcagaaatgccctggtatctcatctagatggcactactcctgtgtgtgaggacatcggacgcagcctcctgacctatggccgccgcatccccctggctgaatgggaaagccggattgcggaggtggatgccagtgtggtacgtgagatctgctccaagtacatctatgaccagtgcccagcagtggctggatatggccccattgagcagctcccagactacaaccggatccgtagcggcatgttctggctgcgcttctaggcgggaagcctatgtaagcaagagggcagggccggggtttgtggtccccccnccaccacaaacacagcacttcggctcctctaacctgtgccacaggtgaccaccaatatatatatnactttaagaaaaaaaaaaa

SEQ ID NO: 660989 - DNA, 262 bp, Homo sapiens
ggcttttgaaacttagggattttaaatttttcccccccagaacctttttttaaaagacagaattgccatcctccttaatttgcagggctgccttgggggctttgtttgttgggacaaggcccccaacctgggcctctcctattgacccctactttgaattcaaaaaatctatttaaaagtttaaaaaaagaggccttttttgattcccccccagttttacccagtttcccaaaggaaaaaaaaactctttgaataaagtgga

SEQ ID NO: 660990 - DNA, 950 bp, Homo sapiens
gttcagaggtgcagacaagaggtggcgagaggcccccatcatgcccctcaagctatcccgtagccttctgcctacaatataaaaacgtgcatgctggaatgatctcagtcacatttggatcttgttaaacactgtatagacggaagagtctgcattgctctgaccgaaccttcaagttggtctgcgagtatgtcgtttttctacttgtctgtctcctccccccatcatcctgtagactgatgtttctgattggcccccttgttagttcgtgttggtcggctgtaacggctgcctgcctggcacaggggtgagggtgctctgcctgtgggaaaacagagctgatggaatgatgctgctcctcccagacagagctcacacagatcttcgtggatcaacttgtctattcgcgtgtaccgcacgattcacgctcatgcctggctcttgtagtaaacaagcagacttggtgcattgtggctgaacgcatcaccccttggtactctgctagtagtcattcgtagagagacactgcatgacactagattaatgatacagacctttgcaggacctgatgagtgacccgttcgtggaggctggccaggtaccatctgctaggcaggcgagaccaatcaatcactgaaccatgcctcatgggcacccacaagtgaaatcagggacagagcaggtagtaagcccaggctgggggaaaatggggcgacttcctggtaccgcctacaaatattcctacatgcagcatgtggcgaacagattgcttgcgtattgaatatcagggtcttgtcgtggacagcagagggaccctggtgtggataggttaggtcaggtgcctggaaataggctgtcccagattgatcacggacgcaggcctgtgaagcccacattgggggggaaagggcagattcatgttgacctggggatgctgtgaatttcatcgc

SEQ ID NO: 660991 - DNA, 873 bp, Homo sapiens
  misc_feature (112)..(112): n is a, c, g, or t
  misc_feature (117)..(117): n is a, c, g, or t
  misc_feature (122)..(122): n is a, c, g, or t
  misc_feature (124)..(124): n is a, c, g, or t
  misc_feature (140)..(140): n is a, c, g, or t
  misc_feature (190)..(190): n is a, c, g, or t
  misc_feature (789)..(789): n is a, c, g, or t
  misc_feature (854)..(854): n is a, c, g, or t
tccatgcgcttactggcagtgagatcgcaacgtgatgagttgatctaccatatattgcccacgtgcgcattgcagtagagggtcctggctgggtcagcccggacaatgtggncttgnaagtngncaatgccatcatcggncactatgactgcacttatggtggtggcgtgacctgtccagcccactggcnttcaggtgctgtggccaacaagctatgccagagtttccagaccttcagcatctgctatgcagagacgggcttgctgggtgcacactttgtctgtgaccgaatgaaaatcgatgacatgatgttcgtcctgcaagggcagtggatgcgcctgtgtaccagtgccacggagagtgaggtggcccggggcaaaaacatcctcagaaatgccctggtatctcatctagatggcactactcctgtgtgtgaggacatcggacgcagcctcctgacctatggccgccgcatccccctggctgaatgggaaagccggattgcggaggtggatgccagtgtggtacgtgagatctgctccaagtacatctatgaccagtgcccagcagtggctggatgggaaagccggattgcggaggtggatgccagtgtggtacgtgagatctgctccaagtacatctatgaccagtgcacagcagtggctggatatggccccattgagcagctcccagactacaaccggatccgtagcggcatgttctggctgcgcttctaggcgggaagcctatgtaagcaagagggcagggccggggtttgtggtccccccnccaccacaaacacagcacttcggctcctctaacctgtgccacaggtgaccaccaatatatatatnactttaagaaaaaaaaaaa

SEQ ID NO: 660992 - DNA, 223 bp, Homo sapiens
accagatatctacaaatggactacttacttccctggtttggtggaaactcctgtggcatctgacgcttggaagagtgaggacagtgggaagtagttggggacattgatagtgttggaccatctatgtgaaacaactgacccagtcagtgtcttaatacagtcgtgtgtcataacctgacctggaaaagatcagtcgatgatctagtaggcggtgttgaggaga

SEQ ID NO: 660993 - DNA, 258 bp, Homo sapiens
gaaatttgggcccctttttttaatccggggggcctttaaatggggaaaaaaaaggtttttggaaaaaagccgggaaaataagccccccttttaaaggttttttttatggaagcctcttttaagattttggaaactattttgccctccccagaggttatggtttttgggttttatatggtccccccccaaaaaaaatgggggtttttctttggggggcccccttacccaaaaagggtttttattaaaaattggaatgga

SEQ ID NO: 660994 - DNA, 230 bp, Homo sapiens
cccatctctatagaatttatttaaaaaattaccgatcatggtggtgtgtatgcacctatagtcctagctacttgggaggctgactcaggaagaccatttgagccccaggaatttgaggctgcagtgagctatgatgacaccactgcactccagcctgggcaacagagaaagactctgtatttaaaaaaaaaatggaaaaagaaaaaaagttccgttgaagccgtcgggta

SEQ ID NO: 660995 - DNA, 168 bp, Homo sapiens
gatcatgaaagttctgcctcaatttcctgtgtaccagtcataattcagactgaagattacacacattgattttgcctgatttttcagcctgtctgacctgccctacaatgtttgaagtttctaaattccacaatcatgtaagctaactcccttctccgtgtggcgtgg

SEQ ID NO: 660996 - DNA, 127 bp, Homo sapiens
aaaagttggctttaaaatgtttgcaaatgtctttttttttttaaaactggaaaaaaaaatattttgttgtgtttcatacagggcttaggatgtttttcccaaagcttattaaaaagatgaaacctga

SEQ ID NO: 660997 - DNA, 834 bp, Homo sapiens
  misc_feature (57)..(57): n is a, c, g, or t
  misc_feature (78)..(78): n is a, c, g, or t
  misc_feature (148)..(148): n is a, c, g, or t
  misc_feature (155)..(155): n is a, c, g, or t
  misc_feature (159)..(159): n is a, c, g, or t
  misc_feature (169)..(170): n is a, c, g, or t
  misc_feature (173)..(173): n is a, c, g, or t
cgcttcctccgggcgcgagaagaggggagccaggccgagccccggccctaccgcgcngcgcgccatgtggccccagancccgacccgacgcggaacccgagcctgccggaggcgtcccgtccacggccccgcggtccccgggctccgngccctgnatgncggcgcgggnnttnccatctgctctctcaaaggcctgcgctcctgcctgagacccgagatcgggacacatcagtacatcacttatactctgctattgtggcgtcctcagcaatctgccatttcactcacagaagcctcatgcatggaggtatccatggcatgacccttgatactaccatccatttgcgtgactacgccatgacaaccattgaaatgacacagatgcgcaagcggacatatgatgcctgaggcccaacttgacttggtacgtttcacattgcaggcactggtgtaccaacccgtcgagagacgcgcacttccgaatcccaacacgtatgtggcgataagtcctcacgaattcaaacagggacgcccaagcacagaccgccaaaacgaggtacacacactgaagcacattggcggggcatacacccaccaaaacgccccgggcgatgcgaccacgactaggataaagaccggaggcctacccactctacagacacgtcacccacacgtcgcccgaggcaacaggacgcaaagcagctcgaccctagaccgagcacaccagtagacacgtcctaatacaagcgcgaaacgagaagcggcgccaaaccaactcaccaatcagcaagacaccacaccggacgggaacccacaccatagcacaacgagaaa

SEQ ID NO: 660998 - DNA, 1002 bp, Homo sapiens
  misc_feature (780)..(780): n is a, c, g, or t
gcatatatctgagcagctgatcattaaggcagcagacggtgtgctaactatcgtccacgtggaacttcggtccataagcatgattggcctcaggatgatttctcgagtctactcgtacctcatgtgcagtaggagttttcgaaccatagtcatagaatgggcccaggtcgatcaaaccaagtagcgtacttggaagcggctttcccgagtgtgcgcatgtatgctcgacgtgctctactcaagctcgtgtaactctttactctagaggacgagtgggtacctacacgtcggtaggcctactgcactattgcaaaaattaaccgtctccacagcttcccttgtcaatgcacacggtgttgcaccggtgggaacaattcccggcaaaagccacccttgtaacctgctctaaccaaccagttgcttggtcttggacgcgacagcacaaacccaagttgtttatcactcgtgggaccattttgaccctggcatcacggggacttgccagcgcacacaggggacggcagttcaaccttgtcgctcctggggtcgaagcacctatgcgcaacatactcggaatgaagttctaaagggaattcaactatgacgttccctttctcattgaagatcaggcaaagggttagctgttcgcggtatggtttggacacattcagggtcgtgggtctttcccaagtacacgtggggccccctactgacagttagtttcgcagaacactatattcaccaaggctacggcacttggcttggcggacattccaatgngcatacacggccaacggtgcacggcttacgttcgaactcagtacaagggtcctcctgaggatttctccagctttcccacagagttactcggtgtcctcatagtccctggtccacaagcagttagtctcttgtcactataagtcgcggcacgagacaccctaaatatggtacctcatcatcaagggcttctggcgcggatgctaatcacagaggccccgtttg

SEQ ID NO: 660999 - DNA, 627 bp, Homo sapiens
tctcgggaatatttagaaattgtggatattgagatgtatgcgcattttggaaattaattggacaacacgtaatggctctcagatattatatattagtaagtgtgcctttaaaatgtatgatatatttcaaaagtctgagtagccatatttaagagtatatttttagaatctaatatgtgttctaaatggagctgatattcaggagaatgtgcacagtcactggtgtctttaatgtcctgctccaccacagcccagcagagtcactgctaatactgggcacacagaggaggtcaaggcgtggctctcagccttaaaccgatgtggaaagtttccttttatgcacaagacgtaattaccaaaagagcatgtgtttgtatttcccaagcagaatgtgctcaactcccttctcacctctcccatatctgactcctaattatttctcctgaatgggtgccctcccacctccctaaccattaccccacagggatgctgctcccttaggttgctgaagctcccattcttggaatgctgaagggaggccattaattgttggtcatcctgtcaatatggctcacgttcaggttctgtgccgtgtgttttcctctttctggaagagctaaagacaga

SEQ ID NO: 661000 - DNA, 203 bp, Homo sapiens
tgaatcagtaccagagctgaagaacagtgattccacccatggcaacacacaacaagcccagctggtggagaatgtgaaatcgatgaagaaccagtcagtaaagcaaaacagagtcggagtgaaaagaaggcacggaaggctatgtccaaacgtgtgtcttcggcaggttacaggagttactagagtcactatcagatccggca

SEQ ID NO: 661001 - DNA, 250 bp, Homo sapiens
agaaaaaacaagaaagaaaaaagaaaaaaaaaacaaaaaaaaaaaataaaaaaaagaagaaaaacaaaaaacaaacataaaaaagcgaagagaacaaaagcagaaaagagaagagaaaagacaacagaacctaggagaaagaaagaagagaagcaaagagacgaaaaatacagaagcgcgaacgcagcaaaaaggaaaaaaagaaaaacagcgaaacgaaggatgcagagaaaaaaaaagaggaaccaaa

SEQ ID NO: 661002 - DNA, 1132 bp, Homo sapiens
  misc_feature (520)..(520): n is a, c, g, or t
  misc_feature (568)..(568): n is a, c, g, or t
  misc_feature (585)..(585): n is a, c, g, or t
aagtaaagcacttattctaattcatatagaggtatctaattaacacagtcacattgtactaattgactagcgagtagacagacttctactaactctccctctatgaattcttataatgtcccttttctctgtaacttcatgagacgagcaactctgcgcaatccagggatggcagccatggtctgattacgagtccaaatcctctgacatgtctcagttcgttcgcacgtctacttagactcgatctatttgcgtgcaatgctccttgatcattatgctatggcggctacataagatgatgttgtcgcagactctgcttcacttgtgtgatataagttgtagtactcagcgaaacacatcatcatcaagcgtagtcacttggaccatggcatcatggccttgaccaacaagtagtagcaatcgtacatgctggactaagcacaaaccgagaaggtcttaactttagttagcccattgacatccggctacaccctttgtggtagatcgacacctaagaacntaagcaagcgcaagattgattgcgtgtgtcactctgagcccttctgtnccctctagtatcctccnctaacaataactactcttgcgctattaaccaatcttacactgcagctgtaggcgttttctatagtgcggtgtctatggtccagtgtccatcgggcattgcaatgtgatcatctattgagtgatattatatataaaccacccaagtcccactccaaaatacatactacattggcctccagtgtatcaaagattctcattacttaaggaattttcatgttccttaaaatttttagaagcaaatatcgtggaacaactgtgtaaagccatattttagatttttaattatactaagtcttgaagattgtgattcgttaaagatttcgtaagactttgggccttctttagaatacatcttcgaacttgcagaatcttaacccgaatgtcaccttgttcgatgaaagtattatgttcagcagatataatcctttgggagaccgtttcacaattgaggaaaaagctaggtaaggcatgttcccacctgtgggggtacattttgcgatacccttcaatgtttggccaggtatcagaattggttgaacagcccaca

SEQ ID NO: 661003 - DNA, 207 bp, Homo sapiens
tcaaaactacaaaaaaagcaaataactaaatcattcaaaattggctttttttgttgttttaaaaataaagtttaaggctaggagcggtggctcatgcctgtaatcccagcactttgggaggccgaggcgggcggatcatgaggtcaggagctcgagaccatcctggctaacacggtgaaaccccgtctctgctaaaaatacaaaaaa

SEQ ID NO: 661004 - DNA, 367 bp, Homo sapiens
cctaagtgcgttctgggagacatctagtagccacaaatcgagagatgcccagagcccaccttctgataccagaatcagatgtttacttacaagacagagagaatctgaaacaacgggctacaagaaatttgggaaatgacatttgatctcatttgcctctcaaatggaagtcatagatatccatgaatatcaaatggaaaaataagctcagaagtaggtgagaataatgatctctaaaacgccggtccagatttctaatccttctcacaaaataccggatcacaaattgagggctgatgagaagatcttacaccggaggcactaactgggcctaatgtgagtcagcaacatgtgacaggctaatcca

SEQ ID NO: 661005 - DNA, 425 bp, Homo sapiens
aggtcttgctcgtccttgatatgcaagtcgcagagatagggtccttcaagtaatttgtgccaaaccaacgtgttcgcagctctatgccgtcccagggccaagcagggggcctatcgtctgctggtgtctcaggagtccctcgtggaccttcatccgcagtatgcgcgtattcttcaccatcttacggtacttgcggtggttcttctcacgctggcgaatcttcagcccgttcacgcggtgatctgaggcgcatccgagacgccttcagccaggtgctcggcaccttcccctatctggctgggcgcacattggtaggattgcgggatagccacagtccctacggtcccggtatgcagtctggacagcacacatcggtacgtaaatcagctctacaggggacttacgcacatctttctggggcacag

SEQ ID NO: 661006 - DNA, 308 bp, Homo sapiens
ttgagacccccctatacaaccagacctttctcatacatacagctacgacatgtatcaatcttcaatgccataatttcaggttcaactggctttgtcatacaactcacaagtctaagaatgtagataaagctacaaatctaagtatcacagatgtgtctaaggcttggtaggtaacaatctagaagcaatctgtatacataaagtgccaccaaaagcattttaaacgaaaccaatttaagggccaccaaatcataagcctgctataccatgggaaactatgaaatctcacaccgtaaattctagacaga

SEQ ID NO: 661007 - DNA, 322 bp, Homo sapiens
tcaggcattctttcttcagtcagagcattcattcctcaagccattcacacatttaggcctcatgcttttttctgtctttcatcacatccatttccaccatcattgagaggtaatctagcagtgtgggtttaaagggggtatgtgggtggttaatcaagtctggcttagaatcccagctcgagatgaaaatgtcttgactcggatagcaaagagacatggtgtgagaattgaatgaattcaaataggcaaagcgcttagaatagttcctggcccagagtaagtgcgcttttaagtgtttaatagaaccctagatttgttttta

SEQ ID NO: 661008 - DNA, 1685 bp, Homo sapiens
  misc_feature (1337)..(1337): n is a, c, g, or t
ggaagcaaggaggcggcggcggacgcacgcgagtggcgagatagtggatcacgttgcttctgagtgggagacccaaggatgacctgtgttctagacgacgttcaatgctgaacccagcgcacccagaggagtgagcatcatctctccagtgaatgattcacagtgctcgataaaccatcaccgaagatagacttggcttgtcatccatcctggagaccctcgtcgcaataacgatcgacaatacaactgcctggccccgagaccagacaatcaagaatgtcctgcgacactccgacacgatagcgccacaacaacacgaagccgagtcatacgcagaagccacatgcgacaccttgaacagacccgtattcataaccgcaaagtccatacaacagcacaaatggcacataggaaacgatcgaaacagagacccatcaaacaactcatgtcaaactatcgaacacgagctgcccactgaacacacattctcacaacaccaacaacctagagactccaacaccaacacaatacaactccaatatcagtacaacagccacaccacacaccacacaaccactccacatctgcacaccctccgtaataccataccacattgaatgactacatccacagacataccccattgccattccacacaagatacaacgagtcgaccacaccgcatcacaacataacccaaaacaaccactagccacaaacaaacataatcacccacaacatcactaaaccacactatacagattaaacaattacacctagaccacaaacgcgaccacttgcccacaccatataaacacacacaaccctatcaccactcacacgacctacaccaccaccagaacaccaccgcacacaaacacaacaacaaatataaccacacaccacatcacaacaaaacacaacaagacttagaccccaacacaaaacgatacacccatacacacataacaccacaacgataccaacgtcacaaaacacaaaagcaaatctacccactaccaaaacaatactacaaacctcacacaccacaacatcgacacatcataaaacactaaagaacctacaacacacatcattacactatccgtaactcaatcagcaactcaaattcacacacagacttcaatagcagcaaaacacacctaacaacgataacaaacaacacatccacacacacagaacctcatcaaacaacaatattcgcgtactaacacaacacacacacacacatccatagtcacataacaatcacacaatcacacagacaaaactcacacacacacgcaacacaccacgaacacaactactcctagctncacgacactcacacactatatagcacacagatcgagacctatccactacgcaacataaacagacaacaatcactcaagcatcacaaacctaactcgaacatctacaccacgatctacaacaatggcgcaacatagtacaccacacacagcacaggcacaacaagaaacgacacacacactaagagataaaacatacaaaatctgatatacataaacctcaaccacagcaaacaccacaccaatcaaacatcacataaaccagaccacacaaccgacaccacaaccttcctatctactacactacatccaaaacaacataccacttacatcaagcacagactaccacac

SEQ ID NO: 661009 - DNA, 104 bp, Homo sapiens
ttgtatgatgagaggtgtgctgtgtgcaatgtttcgtttgcctcagacaggtatctcttcgttatcagaagagttgcttcatttcatcttgcagcatgacaaca

SEQ ID NO: 661010 - DNA, 781 bp, Homo sapiens
gaaccagggcatatctgaagaatagcattgcaggcagtcagaatagcaggtgcaaagtcctgaggtaggatcttgtgtctttcctgcaaggctgactgcctacacttggacagccaaaagtttgaagaattgctcactgtagagggtctagggatgcattttatgaatttgtccatgtgtttactcaagaagtacttactaggtactgatgaggactgcagagacaggcttcctgtccacaaacatcttttttttttggggcaacagagcaagactcttgctaaaaaaaaaaatttaccttcataagggaactggtggcccgaatttgggattgggtgaggtggagattggcgaagaagggattatgggaaattgggacgcagagggagacagggaaggacgcttagaagggaagaggccaagtttcccagctgtggcatgcacttgggaggcaagttggccacctttgtgatttcaacaatagatcatacaagtgagggaggagaagcattagggtgacttgatgaagctcagagtttgcactttgctgagttggagggtgtctcaagcattctcaggcggcagttgaagaggttccagcaattcaattagcgtcgagtggacccgtgaagttccaccgggcagtaggcgaaagcggggggaatacgggattcgagaacttcaccagcctggagactggtcttgtgaaacccatggagactaactttgattaccttcccagggaaaacgttctatgacgttggaactggacaacattcgg

SEQ ID NO: 661011 - DNA, 872 bp, Homo sapiens
gctctgggatacggttgctgctgctggagggcatttgttcccgcctgcccggctactacctgcgctccctggaggaggagcggacgccctactcccgtgctctataggcctcatggggtgcccagttcactgcatcaacgcctcaagtaatcggtgcagcgtggcatgcgtgtggcggacgtgcccattcccatctactttccccccgaatcccagcgggtggttgtggggcggcgagggctggatcctgggacacttattgccaacaacgacaagctctccaagaggctgaagaacgtgtggaagccacagcgtgtttgagcagagtagattcatacagtgaagatctatggacaaagcaagttcactagtgactgtgaccatgtcaggaccctgtgaatctcatcgatgaggctaacgggctcgacttatacatcctcaagaccccgaaggaggaccgtgtgctccaagttagggaatggacctgaagcgagggaatgctgactgtcgggattgcccggttaggaaccccagagtgcaccccgagtaccccgtagcggcgggcatccattctacgtacaaggtacaaggaatttgccatcccagtaggaggaggcagactgggtggtgcctcacgctggagcgaggcgcattgagaaggcagagacttttgagagagacaaggacgcctgtatcccgtgtgcaagatctatgtggcggagctgatccagacaggttgcaggcagcagtgcagctgtccaggagccggttggtcggtgcaaaaacagagcaagtggccagatgaccacatcagggtcttccatgctggagcaaccagggccagttttccctgtcgggcccctttgcggtga

SEQ ID NO: 661012 - DNA, 245 bp, Homo sapiens
gacatgcatcctacgcgcacggaagggtggtgagaaggcgagcagtacatcccggtctcggcgaagcttccttcgggcgatctgtggataccaggagcttgggatgggcaggcattatggtccggaaatgaaatgggtagatggaggcaggccactgctgaaaatgtcgcactcatctggtttctacagtgtatactcaggatcaggatttacgataatatggtccatgtactgtcagaaaaccg

SEQ ID NO: 661013 - DNA, 279 bp, Homo sapiens
ctcttctatgttgtgccatactgcccaaagcaatttatatattcaatgctattcccattatactaccaatgacattgctcacagaattagaaataactatttataataaattcatgtggaaccgtataagagcttgtatcgccaggacaattctaagcaaagagaacaaagctggaggcatcacactacccgacttcaaactattctacaaggctacagtaaccaaaacagcacggtactgtctccctaaactggcacatcgagaccattggaacagaa

SEQ ID NO: 661014 - DNA, 426 bp, Homo sapiens
gagagagagagagagagagagagagagagagagagagagagagagagagagagagagagagagagagagagagagagagagagagagagagagagagagagagagagagagagagagagaggaaatgtgcccatatcacatgctcttctgactcttcttcactcgtattttagtgcgacgcgctccataaagagtctcactgttctgattaacactttagatatatctaagatgtgacacttatatatcgcgacaagtcactaggctctcgtacacatttatattagtgagcgctatacacacgcactttctctatagcgcattgaccatactgcgctcttgctattaagtgcgcacacacctatatagagaactgagtatatgcgctattctgcgcatgtgtgtgtaacactggtactcagttct

SEQ ID NO: 661015 - DNA, 170 bp, Homo sapiens
cactctatggaaagtagctgacactttggatcccatgaatatagttaatagaacttatggacaggaccatgtcaaaattaactaaatgtgaacagacaaagctttggatgtcacagcaacaattaaacttaggaaaagtgagcacgtacttaatcagaaacaaaaaaaaa

SEQ ID NO: 661016 - DNA, 223 bp, Homo sapiens
gcgaaatttcttcaaggtcctgttttgaattcttttagatatatacccagaaataggtatgtatttatgtatcagaaataggatcccatgataattctatttttaatattttgaggcccctccatgttgttttccatagggggtgcatcattttacatttcccccaacagtgcccaaaaagattaaaacagtgtctccaattttaataaatttttgcaatcca

SEQ ID NO: 661017 - DNA, 172 bp, Homo sapiens
gtgatctgcccgcctcggcctcccaaagtgctgggattacaggtgtgggccaccatgcctggcctgaacatccttttttgatcgtaggcagaaataagtgctgctgtgggtgcagctcacatccttgggctaacccctagcagcagctatccatatccactcaaccccacca

SEQ ID NO: 661018 - DNA, 152 bp, Homo sapiens
aggatttaagatggggacagactggtgaaaatgcggctgactggaaggaaatggggcatacgagtaatatgtacatatcaaacaatcaattgcctcctgaaatcaaaaaatcaaatggtgaaatggagcctccttgatagtttaggccaaca

SEQ ID NO: 661019 - DNA, 2845 bp, Homo sapiens
  misc_feature (56)..(56): n is a, c, g, or t
  misc_feature (97)..(97): n is a, c, g, or t
tgtgggctgattcctggactgtactggaaacatttcagtgattgctctttatgatnaaataggccctgtattttctgtgacatttagccatgctgtnggtctggattccttttggcttacacttgtctatctggttcccaccaaaatgaatgagagtatctgattagcctacattgtttgcattgtatgatagggagttgttctttttaacccctctaatctttgtttctacaggcctgtcatctttacttcagagtgttactgggaacccagttccagccagtgaagctgcctcacagagcacttcagcctcccctgccaacaccacagtctctaccataaagggaagaaatctgccctccagtgcccaaccttttattcccaaaagcttcaactattctcctaactcatcaacttctgaagtctcttcaacttcagccagcaaggcctcaattgggcaaagccagggctcccaagcactacttttaaactaccttccaactctttggggtttacagctacccacaatactagccctgctgccccacctactgaagttaccatctgccaatcttcagaggtctccaagccaaagctggagtcagagtccacctccccaagcctggaaatgaagattcacaacttcttaaaaggtaatcctggtttcagtggcttaaacttaaacatcccaatcctgagcagtttggggtccagcgccccatcagagagccatccctcagacttccagcgtggccctactagcacctcaatcgacaacattgatggaacccctgtacgggatgaacggagtgggacacccacccaggatgagatgatggacaagcccacatccagcagtgtagatactatgtccctgctttctaagatcattagccctggttcctcaacacccagcagtacaagatcaccaccccctgggagagatgaaagctacccccgagagctctccaattctgtatctacatatcgaccctttggtctgggcagtgaatctccctataagcagccttctgatggaatggagagaccatcttccctgatggactcttcacaggaaaagttctacccagatacttctttccaagaagatgaggattaccgagattttgagtattcagggcctccaccctctgccatgatgaacctagagaagaaaccagccaaatctatcctgaaatcaagcaagctgtctgataccaccgagtaccagccaattctgtccagttatagccacagagcccaagaatttggggtaaagtctgccttccctccatctgtaagggccctcctggactctagtgagaactgtgaccgtctctcatcttcccctgggctatttggtgccttcagcgtaagagggaatgaacctgggtctgaccggtcaccatcaccgagtaagaatgattcatttttcacccctgactccaaccacaatagcttgtctcaatctaccactgggcatctcagtttgccacagaagcagtacccagactctcctcacccagtcccacatcgttcccttttctctccgcagaacacccttgccgctcccacgggtcacccacccacgtcaggcgtggagaaagtcctggcctccaccatttccaccacgtcgacgattgaatttaagaatatgcttaaaaacgcctcacgtaagccctcagatgataagcattttggccaggctcccagcaagggcactccaagtgatggtgtcagtctctcaaacctcacccaacccagcttgaccgccactgatcagcagcaacaagaagagcactaccgcatagaaacccgcgtctcctcctcctgcttagacttgcctgatagcacagaagaaaagggggcccctatagaaaccttgggttatcacagtgcatccaataggaggatgtcaggggagccgatccagaccgtagagtccatccgagttcctgggaagggaaatagaggacatgggcgtgaggcttcaagggtgggttggtttgatctgagcacatcaggtagctcttttgacaatggcccttcaagtgcctctgagttggcatcccttgggggtgggggcagcggaggcctcactggctttaaaacagcaccatacaaggaacgggcacctcaatttcaggagagtgtcggcagctttcgttccaacagtttcaactcaacatttgagcatcatcttcccccatcccccttggaacatgggacacccttccagagagagccagtggggccatcatctgccccacctgtccctcctaaggatcatggtggtatcttctctcgagatgcacccactcatctaccctctgtggatctttcgaaccccttcacaaaggaggcagccctggcccatgctgccccacccgctcctcctggagagcacagtggaattcctttccctaccccactcctcctaactgcttcatggggaacataagccagcagatggtcggtgacgatggagacaccataagaagtactacaagcaaagttatatcaagaagaatgattgcgaatactaagaggtagaagaccgttaaagagcaaacattggagagatagggagaggggaaggagagagcaaggggaggatagatccccaagagagcagtagtagccgacctaggattgaagaagggaagacatgggggagagaagattatgggaaggagcgcgcgcaaggaacgacacgggaaaatcaaggggaggaagagagcgaaggggaacacgctaccaagacccagagagaataagggaaggatatgaaaaagaggcgtggaagcaatacagcacaagaacaggaggcgacactgacgcaaca

SEQ ID NO: 661020 - DNA, 271 bp, Homo sapiens
  misc_feature (23)..(23): n is a, c, g, or t
  misc_feature (33)..(33): n is a, c, g, or t
  misc_feature (62)..(62): n is a, c, g, or t
  misc_feature (111)..(111): n is a, c, g, or t
cccggccgaaatttgtaattttntaactaagantttttagttaagaacattatcagtaaagncaacgtaatcccaccctggagagtttattgggagcccaggaatattcanttttaatacacacacacacacacacacacacacacacacacacacacacacactgatcagagtaacgggagtttctctcaggagtcatactccatgagcctggacccagtggttctttatgtggaaacaaatttcacctataggtaacctggtaactgct

SEQ ID NO: 661021 - DNA, 509 bp, Homo sapiens
gcccagttctacctgtttgagaatgtggacaatgcccagcagttcaagcagctctacggccaagatgacgcctggacctgaacatgaagagccaaagagaggatcgtggaggaggccaacaaggcttttgagtataacatgcagatattcaatgaactggaccaggccggctccacactggccagagagacctttgaggatggggttccctgtacacgatgggaaaagagacatgcgtaaattccctttctacgctgctgaacaagaaaaaaggtaggtgtgtgtgtcctccagctcccctcctcgggcaggtatagcaggagactcccctcatgccatttctcctatttgtgctgccacacaagggccctcgagggagcagctgtcccttccgacagatattgctgttctggggaggccagcctccatttaatcctcgccgctggtgtggccccgctgctggactcttggctcgtactacatttgaggggccccaatgcaaacaggtc

SEQ ID NO: 661022 - DNA, 2705 bp, Homo sapiens
  misc_feature (56)..(56): n is a, c, g, or t
  misc_feature (97)..(97): n is a, c, g, or t
tgtgggctgattcctggactgtactggaaacatttcagtgattgctctttatgatnaaataggccctgtattttctgtgacatttagccatgctgtnggtctggattccttttggcttacacttgtctatctggttcccaccaaaatgaatgagagtatctgattagcctacattgtttgcattgtatgatagggagttgttctttttaacccctctaatctttgtttctacaggcctgtcatctttacttcagagtgttactgggaacccagttccagccagtgaagctgcctcacagagcacttcagcctcccctgccaacaccacagtctctaccataaagggaagaaatctgccctccagtgcccaaccttttattcccaaaagcttcaactattctcctaactcatcaacttctgaagtctcttcaacttcagccagcaaggcctcaattgggcaaagccagggctcccaagcactacttttaaactaccttccaactctttggggtttacagctacccacaatactagccctgctgccccacctactgaagttaccatctgccaatcttcagaggtctccaagccaaagctggagtcagagtccacctccccaagcctggaaatgaagattcacaacttcttaaaaggtaatcctggtttcagtggcttaaacttaaacatcccaatcctgagcagtttggggtccagcgccccatcagagagccatccctcagacttccagcgtggccctactagcacctcaatcgacaacattgatggaacccctgtacgggatgaacggagtgggacacccacccaggatgagatgatggacaagcccacatccagcagtgtagatactatgtccctgctttctaagatcattagccctggttcctcaacacccagcagtacaagatcaccaccccctgggagagatgaaagctacccccgagagctctccaattctgtatctacatatcgaccctttggtctgggcagtgaatctccctataagcagccttctgatggaatggagagaccatcttccctgatggactcttcacaggaaaagttctacccagatacttctttccaagaagatgaggattaccgagattttgagtattcagggcctccaccctctgccatgatgaacctagagaagaaaccagccaaatctatcctgaaatcaagcaagctgtctgataccaccgagtaccagccaattctgtccagttatagccacagagcccaagaatttggggtaaagtctgccttccctccatctgtaagggccctcctggactctagtgagaactgtgaccgtctctcatcttcccctgggctatttggtgccttcagcgtaagagggaatgaacctgggtctgaccggtcaccatcaccgaaacacccttgccgctcccacgggtcacccacccacgtcaggcgtggagaaagtcctggcctccaccatttccaccacgtcgacgattgaatttaagaatatgcttaaaaacgcctcacgtaagccctcagatgataagcattttggccaggctcccagcaagggcactccaagtgatggtgtcagtctctcaaacctcacccaacccagcttgaccgccactgatcagcagcaacaagaagagcactaccgcatagaaacccgcgtctcctcctcctgcttagacttgcctgatagcacagaagaaaagggggcccctatagaaaccttgggttatcacagtgcatccaataggaggatgtcaggggagccgatccagaccgtagagtccatccgagttcctgggaagggaaatagaggacatgggcgtgaggcttcaagggtgggttggtttgatctgagcacatcaggtagctcttttgacaatggcccttcaagtgcctctgagttggcatcccttgggggtgggggcagcggaggcctcactggctttaaaacagcaccatacaaggaacgggcacctcaatttcaggagagtgtcggcagctttcgttccaacagtttcaactcaacatttgagcatcatcttcccccatcccccttggaacatgggacacccttccagagagagccagtggggccatcatctgccccacctgtccctcctaaggatcatggtggtatcttctctcgagatgcacccactcatctaccctctgtggatctttcgaaccccttcacaaaggaggcagccctggcccatgctgccccacccgctcctcctggagagcacagtggaattcctttccctaccccactcctcctaactgcttcatggggaacataagccagcagatggtcggtgacgatggagacaccataagaagtactacaagcaaagttatatcaagaagaatgattgcgaatactaagaggtagaagaccgttaaagagcaaacattggagagatagggagaggggaaggagagagcaaggggaggatagatccccaagagagcagtagtagccgacctaggattgaagaagggaagacatgggggagagaagattatgggaaggagcgcgcgcaaggaacgacacgggaaaatcaaggggaggaagagagcgaaggggaacacgctaccaagacccagagagaataagggaaggatatgaaaaagaggcgtggaagcaatacagcacaagaacaggaggcgacactgacgcaaca

SEQ ID NO: 661023 - DNA, 1605 bp, Homo sapiens
  misc_feature (56)..(56): n is a, c, g, or t
  misc_feature (97)..(97): n is a, c, g, or t
tgtgggctgattcctggactgtactggaaacatttcagtgattgctctttatgatnaaataggccctgtattttctgtgacatttagccatgctgtnggtctggattccttttggcttacacttgtctatctggttcccaccaaaatgaatgagagtatctgattagcctacattgtttgcattgtatgatagggagttgttctttttaacccctctaatctttgtttctacaggcctgtcatctttacttcagagtgttactgggaacccagttccagccagtgaagctgcctcacagagcacttcagcctcccctgccaacaccacagtctctaccataaagggaagaaatctgccctccagtgcccaaccttttattcccaaaagcttcaactattctcctaactcatcaacttctgaagtctcttcaacttcagccagcaaggcctcaattgggcaaagccagggctcccaagcactacttttaaactaccttccaactctttggggtttacagctacccacaatactagccctgctgccccacctactgaagttaccatctgccaatcttcagaggtctccaagccaaagctggagtcagagtccacctccccaagcctggaaatgaagattcacaacttcttaaaaggtaatcctggtttcagtggcttaaacttaaacatcccaatcctgagcagtttggggtccagcgccccatcagagagccatccctcagacttccagcgtggccctactagcacctcaatcgacaacattgatggaacccctgtacgggatgaacggagtgggacacccacccaggatgagatgatggacaagcccacatccagcagtgtagatactatgtccctgctttctaagatcattagccctggttcctcaacacccagcagtacaagatcaccaccccctgggagagatgaaagctacccccgagagctctccaattctgtatctacatatcgaccctttggtctgggcagtgaatctccctataagcagccttctgatggaatggagagaccatcttccctgatggactcttcacaggaaaagttctacccagatacttctttccaagaagatgaggattaccgagattttgagtattcagggcctccaccctctgccatgatgaacctagagaagaaaccagccaaatctatcctgaaatcaagcaagctgtctgataccaccgagtaccagccaattctgtccagttatagccacagagcccaagaatttggggtaaagtctgccttccctccatctgtaagggccctcctggactctagtgagaactgtgaccgtctctcatcttcccctgggctatttggtgccttcagcgtaagagggaatgaacctgggtctgaccggtcaccatcaccgagtaagaatgattcatttttcacccctgactccaaccacaatagcttgtctcaatctaccactgggcaataaactatccatttccattctcctcccttggatggggcatggtcaaacttagccatcccctcctcagcaaggcattacggccccccacagagagagctcgggatcctctagatctagttcag

SEQ ID NO: 661024 - DNA, 110 bp, Homo sapiens
acggcgacagaatctaagctaagattgtgtgtgaggaaggtaggtttccccaaggccacattgctacttttcaccagtatgcctgacatgcagcgttaggatctatctga

SEQ ID NO: 661025 - DNA, 308 bp, Homo sapiens
aagctggggtatgggtcgaggatctgatgagacggtcactactactctttctggcttcattagggtggttggtgacacccagaagagctgaagggggcatcttggtggggaaggagtagaagggtagccctcagaaagggggttccgggagatagtcagaatgtgtttaccagtgcagagaggcagaattaaggggctggcaacatagctgggaagtggacggcatgggtggtcatatctaaaagagatttcaaagatggaaacaggagcatgggcgaagttgagatctcagccccctcattttacgg

SEQ ID NO: 661026 - DNA, 510 bp, Homo sapiens
  misc_feature (270)..(270): n is a, c, g, or t
ccccccctgttcatggatttaccttcttgtttgagcgcagagaaggaaggaagggtccattaacctcaatcccattataaagtgccccctgctgaagccttgggccttactcttttcttagagcaagaccctgcaggccttttcccttaaggcttggggggggaaaaaagaaaaccttaaggttgcgcaggaggagtatttcaaacaagccctggccaacacccttccctgtcaaggaaagtacactccgaacggtcagggtgggggtgntgccaaggagtccctttttgtttttaaccacccccatataaagggaggttgttcccagggtggcccccaaaatttaaggccctgccccctcccattttttaaaaggaggccccctccttgggggtccagggtgggttgcccgggtttttttttcccttgtgacagtggtgtgtgggtttgtttgtaaaagctaagtccatcccccttttcggccccctgccaaaaaaacagttttttaag

SEQ ID NO: 661027 - DNA, 489 bp, Homo sapiens
  misc_feature (303)..(303): n is a, c, g, or t
  misc_feature (360)..(360): n is a, c, g, or t
tctgatgttaccataggggtaatgaagttcatcgcagattgttttctaaccttcggtgcatgtattgaaatagatttttgttttaaaaatatgagattacatttttctggatctggtgtgcattggggtagagaggatgactgtcttaaaaatagatcgtgtattctgcctagagcaaagactcttaagtcttttggctgaaaatgaactgagtatggacaaaaatattgaagtattctacttgtaaacttaccgtataatcagtgtcttgataaaatagtagtttttgttggttgaatctangaatgtgttggacttgggtaaatttcagacatgaccaacaacaaaaaacaaaagccnaattccttaacctttcctgactgaaacttctcaggaagaaaccagttttgaattgtatgacataaataagattgtcttttattataagtttttaaactatgtaataaaacatttggggataacatcaaa

SEQ ID NO: 661028 - DNA, 352 bp, Homo sapiens
acacgccgagtggccacacacacgttggtctgcatgttctgcaaatgtatccagtttgttttgtctggtttttagaataaagaaaaaaaaatttataaagggcaatgtatcaggttgggtgtgatagcacatgcccgtaatcctgacactggggaggccaagacgggaggatcgcttgaggtgaggagttcaagaccagcctggtcaacatagcaagactccgtctcataatgtacaatcagtgggagccctgagcttgttttccagtaaggaaatctggaggtccatccccgacattgtgtgaccttgaattaagcacttcatctttatgtctgggtattcggcgtgtgca

SEQ ID NO: 661029 - DNA, 172 bp, Homo sapiens
cctgacctttttccggggagccggggggttgtatgctctctcctcacaccaactgatgtcactatcccaggtagtccccacttaggatcatggaaagagaaggagagtccctcagtcctgctaacatggaccttactgagaatggtgccctgtgaacaggttgccattgctg

SEQ ID NO: 661030 - DNA, 122 bp, Homo sapiens
taaagaaatccccccttacttcccttttttgcaaaaaaaagcggataaggttgcttctttttggtgattcatccaaaagaaaaaataccaaatcctccgacggctccgccgcatcctccgtg

SEQ ID NO: 661031 - DNA, 308 bp, Homo sapiens
cgaggtgttgctggggtgactctccaggattaatgttatcgcccaacactttcggaggctatgcaggcggatcacaaggtcaggagatggagaccatcctggctaacacagtaaaactccatctcttactgaaaataccaaaaaaatagcagtggcatgtgtggttgggctgcccgtagccccagctattcgggaggctgaggcaggagaatggcgtgaacccgggaggcggagcgtgcagtgagccaaagatcgtgccacgtgcactcccagccttgggttgcatgagcaagactcctattccaaaa

SEQ ID NO: 661032 - DNA, 315 bp, Homo sapiens
atgagtggaccttgatgggcatgccgatcgtggcagcgccttcgagttctcgttcacccccggggccatgggcgccatcgtcggcgaacgtttcgtgcgcgcggccaactacgccctggagcatcgctgcccgatggtctgcttctccgcttcgggcggtgcgcgcatgcaggaggcgttgatctcgctgatgcagatggccaagacctcggccgtgctggcacgcctgcgcgaagaaggcatcccgtacatctcggggctgaccgacccggtgttcggcggtgtctctgccagccttgcaatgctcggcgattt

SEQ ID NO: 661033 - DNA, 146 bp, Homo sapiens
tgttgtactttcaactctgcctccttgcatagtattgagcccatgatgaaaaattagtatttcttgaatggaatgatgaatgtggcagaccctgacttgctccctcacattgtgatcaaccttccaaacaacaatccccctctacc

SEQ ID NO: 661034 - DNA, 906 bp, Homo sapiens
tcaattgtccagtttccttaaatgaccccaatctccctgaaagggcaggtgcggccgctaggtaatggcaaaaaatgtccatttgaaaatttggccctgattgaaggtttggcccaattgctgaaaggccccctcccaaggaaaagttacttctcgataaccaggcgtccggggttcctccctcgcgttgccaggactccagtttcccgccaatgtgtgtgttattgacctcgttagttccacccgtgccaactcgtggacatcaggcggaagggcaagcctcctgtggccctccggaaaaaacccagatctccagaaagtggcgcgtgcttattgggtggtgtcccaaaaggggtgtgtaccttgtggggcgaagaggccatattcttctccctcaagtgtgtgtccccgagttggtcgtgggaaaactattcccgagcgtgatatgaagatattggccgagtctctattgaaagaggggttcttgaaggtgacagttcccttacgagggggcaaagcccgatacatcttccttgagagtttcaccccaccggggggcccccaggcccgcccctataattccaaagagtttggcttccccaagaagaattttatggggcagtggttcgccccccagaatcaattgttgtgtgtccgctcctactcgggggcacgtacatctatggcgcgcttaaatatttctatcgcccaaacccaccaaactgcgttctctcctggggcgccagtgtcagaagccagcaagggggtcccccttggagctctggggggtctacaaggaaggccaagcccgccctggtctcactatttgccatcaccgattcttcgctcctctcagggaagcaccgggtgcaagccccgccttttttcacctccctacccggcaca

SEQ ID NO: 661035 - DNA, 305 bp, Homo sapiens
gtggaaatggagaagaagttggagaaaggccagtccattgacgacatgatccccgcccagaagtaggcgctgcccacctgccaccgactgttggacccagccagtgggagggcctggccaccagagtcctgtccttcactctcgcccgcccctgtccagagtccacctggggcttttcacctatcagagtccagttcaccagagtccaccaatggctccatctctgatttggccataaatatctccatggcaggtccttttttttccagactcacccaaccaggagtttagttaatggagactcc

SEQ ID NO: 661036 - DNA, 864 bp, Homo sapiens
  misc_feature (157)..(157): n is a, c, g, or t
gcattgtcgcaaggggttgtgccgccaagaacacgaggtgtctgtgaaagatacgccctaaaagccaaaatggcgaaaggcaaaagactcattatcaacattgtcgtcatgtggacacgttagattcgggcaagtccacacactagtggccatctgnatctatcaaatgcggtggcatcgacaaaagaaccacttgaaaacatttgagaacggaggctgctgagagtgggaaagggctcccttcacagtatgcctgtggtctgtggataaaactgaaaagcttgagccgtgacacgttggtactcaccattgatactctccttggtgaaattttgagacccagcaagtctatgttgactatcatgtgagtgccccagggacaccagagactttatcaaaacacatgattcacagggacatctcaggctgactgtgctgtcctgatggtggctgctggggtgggtgaattggaagctggtatctccaagaatgggcagacccgagagcatgccctttctgctttacacactgggtgtgaaccaataattgtcggtgtacaaaaatggatcccattgaggccaaccttacaggccgaacgacgatattgaggacaatgtttcaaggaacgccagcctttacttaagcaaatggttaacaacccgacacaagagcctttgtcgcattctggttgacttggtgcaacatgttggagcagtgctactgcttgtcaagggtggaatcgccgttagggtgaaggcagtggaccacctgtgagttggtgtccacacatgtcattgaacctgcgtggttcggtgtcacatgggtgatgctggcggaatgtgcaccgggcatttcactcacgga

SEQ ID NO: 661037 - DNA, 619 bp, Homo sapiens
tctattttatttatttttcccagtgaaaagtgtattttgatagagaacttttcattctataaatacactatgagttactaaaatatcatggattttgtttattcctgaaacatagttacatagttaaactgtacatatgacatggcttatgttaaaaatacccagtgctcagttttgaaagataggcaaccaaaaaagttaggagaaactgaagaatgtacacttttttagagggcacattttgctgtaaatctggaaatttgatagacttgactgtgtttgtgaaaactgagcattaaaggttttgattgatccttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatttttggcccccttggcccaattaatttttaaatttaaaaaattttttttttggggccaaatttggggtcattttggcaaattcccctttatgggggggttttaaaaataaatgggccggtttttaaaaacgtgatatcgggaaaaacctggggtttcccattagcctttggtc

SEQ ID NO: 661038 - DNA, 831 bp, Homo sapiens
  misc_feature (831)..(831): n is a, c, g, or t
gacagagtccagcgcacttgtggctgacgaagggattcccagcgcgagggaagtgctggatctcgtggtgttttggctgcgcgtgacccctgcgtggtcgggaggtgttctgtgaaaagcctaaagattatactgttacaaatcgcaatagaatacaggccactgtttcgaagagctgtattacaggtacttcgtcagtttgtaagacatgagtccgaaaaaactaccagatttggttcttgaaaagatccctgaatcgtgtgcacttactttgggcggagtggctcaggaccctgtcttgactacacgtctgcgtcatggaacatactatccagtcacgatatgttctctagcagctaatgagatgtggcgatcagcgggatagtgaagtttaccaactgggtgatgtcagtcagaaagacaacatgggccagaatatcagtattccggccaggcctcagagacgttcgcatatcactattttgacaacacggggtctccgaattccatttgcggcaagggaaaatagactatgcgtcgcaatacagttggattgcaccactacttgtgacgcgctgaccaaagcatcaacaactcgtagctgagtcctattaatatccctgagttgaacagatcgaacagagaacggacttccacactggattgatgccattctttgcgccatcattaggtaacaagtctcaatttcccaagtctgtactaactctttatgggtccaagggacaggaattacacatacatctcttaccaaaacacacacgaacaaacaccacaaaaaaacatctttgcgccccccgcctccggagggtn

SEQ ID NO: 661039 - DNA, 226 bp, Homo sapiens
cacacacgcgaacacaggcatacacgaacacggagcactacacagctacaatacaaaaacacagcacatacatgcacacagcacatgcacactcagcactacacattaacacagcacacagcacacacatgcacacagaacacacgcatgcaaagcaaacatgaacacagcaacacacaaacacacagaacacacatgcacacacagaacacgcaacattaatgcg

SEQ ID NO: 661040 - DNA, 827 bp, Homo sapiens
gggtcaccgtggtgattgtccgtgatgacctgctggggttatgccctccgagagtgcccctcggtcctggaatacaaggtgcaggctggaaacagctccttgtacacacacgcctccatgatttcagcatctacgtagggctggtctggagggataaaacaaggaggtgccgggcaggagaagctagctccatcaatctcaacaatatgagatatgataatctcaaggatctacgttgtccagggagccccaaatagaagcaagatgaatatccattccgcatggcaatgccaaaggagatgatgctttagaaaaaagatttcttgataaagctctgaactcaatatgtgtccttgaaagggcataggtctgtgggaggcatccgggctctctgtataatgctgtcacaattgaagacgctcagaagctggccgcttcatgaaaaaattttggagatgcatcagctatgaacacatcctaaccaggatatactctgttcttgaacaacatacaaagtttaaagtaacttggggatggctacaaaaagttaacacagtatgtttctcaaatgaacatgttctatgtgcagattcttctttttgtgaacagaacaacagcaaaacatccacaactctggtaaaggctggtgggacccttatgtcaccttaattctgacttgaactggagcctttaacgaaatcttgtggctttctaacacatccgcggtatttgcttgctgcactgttctagttgattcaacttggctgggaatcacaatgcccgtggcatactttccgggcctgggacacacgcacgaggtggggggc

SEQ ID NO: 661041 - DNA, 162 bp, Homo sapiens
ccctagatcctgcaaaatgtttaaagatggccctggctgtgggggtcccagaagggtggtatccctcatagggaaagagtcccaaaagattcccaaagaaggtaaaactagacttgaatgttgggtaccaaacaagcatggtgacatgacacacatatcaca

SEQ ID NO: 661042 - DNA, 490 bp, Homo sapiens
gcacatgctatagtctaactacttggaggctgagtgggaggattcccttcagcccaggagtttgaggctgcagtgagccactgtgattgtgccactgcactctaacctgggcaaaagccgagaccccaggctagagtgcatgattttgggtcactgcaacctccacctcccaggttcaagtgattctcctgcctcagcctcttgagtagctgggactacaggcatgtgccaccacgtctgggtaatttttgtatttttagtagagacagggtttagtagagaccatggtgaaaccccatctctattaaacaaatctctactaaccccatctctacaaaaaacagctgggcgtggtagtgcacacctgtaattccagctacttgggaggccgaggcatgagaatcatttgcatcttggaggcagtttgcagtgagctgagatcgcaccactgcactccagccgggatgacagagcaagaccctgtctcaaa

SEQ ID NO: 661043 - DNA, 1196 bp, Homo sapiens
gggaaggaaggagggagccggggagtgggccaggggcagtagccgggctgaagtcggcttggggagccagagggatgcggagcggaaccttgcggggcagaggcggcggcacgcaagcgggcgcagtctgatagcaggaacaggattctaagtcttccagtaccaggggaccatggccaaaatccatgatctgccacgtgcccctacgttgggccccactgtccccagaagagcagactgctgtgatcatgggcaatatctttggaatagccttctcaagagtcctgattgggaagaaggagatgcgcatcctgatggtgggcctggatgccgtcggaaagatcagcatcctatacaagctgaaactgggggcagatcgtcaccaccatccctaccattgggttcaatgtggagacagtggagtataagtagcatcagtctttacagtgtgggatgttgtgtggccaggacaagattcgaaccctctggagacactatttccagaacagccaagggttgactagttgtggtcgactagctatgatcgggagcgagttcctgaggcccgggcaagagctgatgagaatgctggcggcaggacgatgctccgggcatgctgtagctccttgtctttgcagagccatgcaggatctgccgtatgctctgaacgctgcttgatgatcccaggactacggtggggcgtgtattgccttgcgtcatcgtaactgggtacgcattccagggccaacctggtgtcaccagcgtaggacgggggctgtacggaaggctggaattggtggccgaacaggtccagaatcgcatggaagcctgaagcctaaaaaatgaccccgcgctaaacccggtgagttcccactgttgtcctggacaccagactataaccttattctttaaccacgagtatttgccaaggggccgagggcgttagaagtttaccattcgctcagggaaagactttgcaccccagccgagactcaattattatggcagcgagttaacagaccaaatctgtggctggtgagtaaactcactctgtgtatagatgaaagaagaaagaagaaaggaacagaaaataagatcacaaagaagccaccaaactcttcagagaggtgagcacactatgccgtacaatgcatgaatacggagtactgtgaggcgatggttcttatctattctga

SEQ ID NO: 661044 - DNA, 460 bp, Homo sapiens
ccccccccccccccccccccccccgacaggaagaagaagaaaaaaagaaaaaaagggaagaaggaacaaaagaacaagaagaaaggaaagaaaggaaagaaaaagaaagaaaaaaagaaggagagagggaacagaactgaacatggggcaagaaatggagagtaaagaatacaactgtaaagaaagctcatactgaaagtgaacaagagctaactgtgcatgctatgctaaagatgttttgttttgaagtgtaaataggtagactcagaaaaccctgcttctaatggtccatctgcgccccctgagggagggatgctccagctggacaagagcttagacactgccttgagggcagcagtagtcagaatgcagctcccagaccgcacccctcatctcccaccagcggacccttgaacaagtcacttaactttctaaatgctgtttcctcattggtgaaaaa

SEQ ID NO: 661045 - DNA, 124 bp, Homo sapiens
  misc_feature (21)..(21): n is a, c, g, or t
  misc_feature (42)..(42): n is a, c, g, or t
  misc_feature (112)..(112): n is a, c, g, or t
atagtagcactgatgaggacnttccacacatacctgtgtatnccaggcagacagaatagcgtatacctgggtttagagctgtaatgttcaatatagtagcaactttgtgaantatgtagctatt

SEQ ID NO: 661046 - DNA, 177 bp, Homo sapiens
atgctcagatgagaattgttgatagtgttcagaagaatcatagttgctcaatccgtggagcatttctcatccttgggtatcccataggatgtaggaactgaagtgagcatgatatagagaaaagagtctgggttttgatgtgttgcatgtgttcagtatctatcttgggagcaagta

SEQ ID NO: 661047 - DNA, 140 bp, Homo sapiens
gaggggggtggaacaccacgatgatccgcaggcccagctccggaagccaaggagctccatgcagtccaccagctgaggccacgccgcagaggccagtgtcttgtggacaaagatgggctcatggcctactcggcctgcaa

SEQ ID NO: 661048 - DNA, 157 bp, Homo sapiens
tctgccaaggtggagggaaggataaaaccccttttgggttcagccccccccaggggaaggaaggagggccccttaactccctcccccagcctggtggcagaccctaactttgtatccgttcaataagcctttcataaataaaggggtagaaaaggga

SEQ ID NO: 661049 - DNA, 163 bp, Homo sapiens
tttccctgggggggcccccttttgccccctaacctttttcccccttttttgcccccgtgggggggagccccttgttcctgttccgtgccccacccatgccctttttggctcttttttgttaatttttaaaaataaaggaagtgggccccaagtttttcggcca

SEQ ID NO: 661050 - DNA, 130 bp, Homo sapiens
tacatactgacagacccctcgaagcggtgtccctgaagagcttgcaaaagtgtgagatcgccctggagaaactcaagaatgagatgggggtgccactcccccatcggccgcggtgccaccgaccaaagag

SEQ ID NO: 661051 - DNA, 373 bp, Homo sapiens
cctacctatatgtgcctttcccctcctttatattcccttgaggaaagctagttttgtcaccagaaagtaagctatataaaatagtatggctcccaatagtaagtcatatttatatggaattcttgtgttgaataggctactatatatgagaaaatggaaaaagaatccaattttttcttgatctttcctttagaggactacttccaaatggtcataagaataagctctggtatctgttaaggccccaaaggcacaaaccactggacacaaggcaaagcccatttacacctctcgtgtgcataaagatatgtacctcaaaaggtcgctatctgactctgccttccacaagtggcctcgtgccgtattcgtacag

SEQ ID NO: 661052 - DNA, 819 bp, Homo sapiens
gaggccgcacgccccccacggggccgccagccccaacacacggggcggtcccaccccccccgctcgtgagatgtatagacggacaacagccgcgggggtaaacatccacccacaacgcacgccgggcgccgcccttttgggggggagaccacacaggtctttaagtgtgggagcacccccaaggttgtggggaaaaaataaatggagggcccgcctacgctgttaaatacgccccgcgcggaagcactatataggtgcgctcttatatgtgggggaccacccacatgcaagagagttggagaataaatatggtgtataaagacacgcggcgccccccccccgataaattgttctgcgggagaaaaactattggagctgcacataaataccccacagtaaagtgacggacagacatgtttgtggaactcccctggttcccaacgagggtagactccgctcgcgacgttaccacagcgctcccacgggtggagaggtataaagggggaccacacggggtgatctcgccactgttgtctgtggtctctttgttgttgtatagcccctcctccccccgagcacctttcacacgtgggtgaaaatcttgggatgacggaggcaccccctacagatctgctccacgaacaagatgaggccaccagggcgcgaggctcgacccccgggacagcggccacccaacccttcgttggggaggcaccagagcgcgagggcgtgcgagatcccacgcaggcccaacgcaagtcgacgagccacccccggccgacaacaatacgggcgagccccccgcttccccacaaaaca

SEQ ID NO: 661053 - DNA, 412 bp, Homo sapiens
  misc_feature (23)..(23): n is a, c, g, or t
  misc_feature (34)..(34): n is a, c, g, or t
  misc_feature (192)..(192): n is a, c, g, or t
  misc_feature (318)..(318): n is a, c, g, or t
  misc_feature (374)..(374): n is a, c, g, or t
  misc_feature (407)..(407): n is a, c, g, or t
  misc_feature (412)..(412): n is a, c, g, or t
caatcaccggaaaactgttcctnacccccctgtnaagcgcgcttcaacgtgcacgcaatatcaccgtgaacacgcggtttcgcagcaaaatcaaaaccgaacgctgtactgaggtcctcactgtatgccgaaagccgtgctcccaccgggcggcagagaggtgcgtcccgcctcactgtcgtggcatcggcnccgaagcgaatgcaacgacgccgagggtcacgtcaagccattttcccgacgaaccgaagcttcgtcgagggcagcggaccacttcgcacgtttgaggccaattacctcgtgtcgcccgagggggancgctgcggggttcgatttcgtgaaggacccggagaggaaccgttgcgcaatgatanggcgagaacgagtatgaggaccccgtattcganttggn

SEQ ID NO: 661054 - DNA, 211 bp, Homo sapiens
tgggacatggtgtacgtcggtcttaatgatacgagcatcagtgactcgtgtcgtgcagagagtgccaggagcagcatggttgacagaaagaagagcttggagcttcgaacagtgaagaataatcctcgagtgttacagtattaccctgcgactctcttgttgcaacaaattgggtggctaatggaaagcgaagatataaaatagtggccgt

SEQ ID NO: 661055 - DNA, 208 bp, Homo sapiens
agtaggagctgagtttgcatcagtaggaggcttcattacacgtgaatttgcccttatgctcaggctacgccctaggagcgaacctaggccaaaatccatttcacgtatcatattcatcggagtaagtctaactttcttcccacagcactttctcggtcgtatccggagtgccccgacgttgctcgggctaccccgatgttgagtgagg

SEQ ID NO: 661056 - DNA, 364 bp, Homo sapiens
tggatacagagtcttgggagtcttgctctgtcacccaggatggagtgcagtggccgatcttggctcactgcaacctccgcttcccaggttcaagcaattctcctgcctcagcctccccagtagctgggattacaggcgcacgcagccatgcctggctaatttttgcatttttagtagagatggggtttcaccatgttggccaggctggtctggaactcctgaccacaatgatccacctaccttggcctcccaaagtactgggattacaggcgtgacgaccgcactcagctggttttctaaacttttagatttctcttcttcttcaaatgccacaggtgtttgagttttttttggtcgacgcggc

SEQ ID NO: 661057 - DNA, 279 bp, Homo sapiens
gtgcagtgactcacacactttgggaggcctaggcgggtggattgcttgagcccaggagttcaagaccagcctcagcaacatggctaaatcccatctctataaaaaatataaaaaattatccgggtgtgttgatgtgcacctgtagtcccaggtgcttgggaggctgagatgggaggatcacttgagcccaccatgagagatcgaggctgcagttagccatgattgtgccattgcaattcaggcttgaccaacacattgaggccctgtctcaaaaaaaaa

SEQ ID NO: 661058 - DNA, 645 bp, Homo sapiens
ccagtgtggtgggattttttggtccagctatagagggttcctagtatacaggtccctcgagtcagcacatttcgcggtagtctcaatcgctcagtagctgttttatcatggtatgctttctgtcttttaaaggctccagcttctgtgcatcatacttgctgtggttctcttccaggtatactatcaaaggtgcctcatctctatctcagctttgcagtaatgctatccagaggcagtcttattgatccgctttccatatggcatagtgtcctcgcgtcctacctggccagtcatttagccattagcatctgtcattggttattgagcttcatctttagaataaggttttggtaacacgaatgtactttcctgctaagacagtttatgcatgtctcttcaatgtaagcttattttcaaatacatgtagacggagtattcagcggtcagtttctgttacggatgatgaccttctctggttcgctgacgcttcctcttcttcctgtagctctctgtactttgctgcctgcgcccatggttccttctttgactatggtcgttgcattcttcttcctcatcgcagtctagtccctgatgggcgatctcagtagtgctgttctccccatgctgtttgatatcccgatccat

SEQ ID NO: 661059 - DNA, 331 bp, Homo sapiens
gatggcttaaatgttgcactgtctgctttaacaaattccctataagagttctaatgaatgtactgccttgagatgtgataaattaggaatgtcgttggtttgtgcatgatttgctacaatctcctttggtgtaatgcctggactgtccgtgctttggtttgctgctctgccacaatttatactagtgctagtgagaaaatttcttgctcacgtagcccaaacgtgtgggggggggaggtggttcccccatattgtgcatgaaaccctggatgaacggctgtataattccataaaaaaggacataaacgcgcaatatttcccttatgtctta

SEQ ID NO: 661060 - DNA, 128 bp, Homo sapiens
cgagtgtctgggtactctaaggatccccattggatatgcggtgaggggctctacactgttagctatctttgaagactgagattctgctgcaacattcttggcatgagaataagggtgctacgtctgat

SEQ ID NO: 661061 - DNA, 772 bp, Homo sapiens
gtcttgctctcgacctccaaaagtgctgggattacaggcatgagccactgtgcccggctggaaggggttttaaaaaaaccaatctttacctcccatccacacatcctttagggaaaatgcgccccctcttttcatggcctgtcctggtggtatgaggagacctgcctggcagctgtgtctgttgccggatcatcattttgctggccacagctgattaggaagggggagtaactggactatgctgggccagtggggccctgcctccctcctgggaatttgaattacgtgacactgaatgcccctcaggtagctgtcgggtacccaaatgcaaggagtcagagagtatcatggaaacccatgggcaacttgaagtaacgacagagcagaaactaagagacagacagggaactatgcagttcctacgactgagaaggatggagggtagctgcctggccattgccccgtttccctaaggcctggctgtattgcctgcattgtaatgatgtgagattgtctgacagcctcataataaaaattattttaaccatatactccccacccaagacctgggtgacaagtgatctaaaattgtcacacagattgggcacactgacagcatgtggcatctgaatcaggggagtaaatatttctactgtactctgtggtattcagatcgggaatatggttttgcatctgggaaagtgtcatattttaagaacattatcaaaatatgggatttaaaaatcagcttgtgtgagagcatagaggtagc

SEQ ID NO: 661062 - DNA, 409 bp, Homo sapiens
aagttcctgggggcgattacagctcccagcagggaggcaagtcttccccctggctttgcctggtgttcgcagcaggcagagttggctccctctgggaatttcacaatctgttaagctgtttgtgccagacgaggaatctagactcttcttcatccaaatgcgcgtgatgccccgcgaattcatccggatgtgcatggtaccccgtcttgaattagaagccacccaggagggtctagagatgttgacaggaggccggccaggcctgagtgtggctccccctcgggggtgaggtgacctctgtagcagtcggtgccgtggcagcagccctggctcccggtccaggctcctcaccacagagtcagcagagcgtttagtggcaggctcaacagtggccattctcctacttggg

SEQ ID NO: 661063 - DNA, 116 bp, Homo sapiens
tgtatctgaagatcctgagctgccgtacatgcgacctcctctttcaaaagaactgtgggtttcagatgacccaaatgtcacaaaggcaatgcggttcaaacagttggatgggaaag

SEQ ID NO: 661064 - DNA, 714 bp, Homo sapiens
  misc_feature (93)..(93): n is a, c, g, or t
  misc_feature (96)..(96): n is a, c, g, or t
  misc_feature (132)..(132): n is a, c, g, or t
  misc_feature (134)..(138): n is a, c, g, or t
  misc_feature (140)..(141): n is a, c, g, or t
  misc_feature (147)..(147): n is a, c, g, or t
  misc_feature (149)..(149): n is a, c, g, or t
  misc_feature (152)..(155): n is a, c, g, or t
  misc_feature (159)..(161): n is a, c, g, or t
  misc_feature (166)..(167): n is a, c, g, or t
  misc_feature (169)..(170): n is a, c, g, or t
  misc_feature (173)..(173): n is a, c, g, or t
  misc_feature (175)..(175): n is a, c, g, or t
  misc_feature (179)..(180): n is a, c, g, or t
  misc_feature (182)..(182): n is a, c, g, or t
  misc_feature (185)..(186): n is a, c, g, or t
  misc_feature (188)..(192): n is a, c, g, or t
  misc_feature (215)..(215): n is a, c, g, or t
  misc_feature (220)..(220): n is a, c, g, or t
  misc_feature (222)..(222): n is a, c, g, or t
  misc_feature (230)..(230): n is a, c, g, or t
  misc_feature (234)..(234): n is a, c, g, or t
  misc_feature (243)..(243): n is a, c, g, or t
  misc_feature (245)..(245): n is a, c, g, or t
  misc_feature (249)..(249): n is a, c, g, or t
  misc_feature (251)..(251): n is a, c, g, or t
  misc_feature (253)..(253): n is a, c, g, or t
  misc_feature (255)..(255): n is a, c, g, or t
  misc_feature (259)..(259): n is a, c, g, or t
  misc_feature (271)..(271): n is a, c, g, or t
  misc_feature (285)..(285): n is a, c, g, or t
  misc_feature (288)..(288): n is a, c, g, or t
  misc_feature (297)..(297): n is a, c, g, or t
  misc_feature (307)..(307): n is a, c, g, or t
  misc_feature (310)..(310): n is a, c, g, or t
  misc_feature (312)..(313): n is a, c, g, or t
  misc_feature (317)..(318): n is a, c, g, or t
  misc_feature (323)..(323): n is a, c, g, or t
  misc_feature (341)..(341): n is a, c, g, or t
  misc_feature (344)..(344): n is a, c, g, or t
  misc_feature (347)..(347): n is a, c, g, or t
  misc_feature (361)..(361): n is a, c, g, or t
  misc_feature (374)..(374): n is a, c, g, or t
  misc_feature (377)..(377): n is a, c, g, or t
  misc_feature (386)..(386): n is a, c, g, or t
  misc_feature (408)..(409): n is a, c, g, or t
  misc_feature (417)..(417): n is a, c, g, or t
  misc_feature (435)..(435): n is a, c, g, or t
  misc_feature (439)..(439): n is a, c, g, or t
  misc_feature (450)..(450): n is a, c, g, or t
  misc_feature (456)..(456): n is a, c, g, or t
  misc_feature (476)..(476): n is a, c, g, or t
  misc_feature (481)..(481): n is a, c, g, or t
  misc_feature (484)..(484): n is a, c, g, or t
  misc_feature (496)..(496): n is a, c, g, or t
  misc_feature (505)..(505): n is a, c, g, or t
  misc_feature (515)..(515): n is a, c, g, or t
  misc_feature (523)..(523): n is a, c, g, or t
  misc_feature (534)..(534): n is a, c, g, or t
  misc_feature (539)..(539): n is a, c, g, or t
  misc_feature (541)..(541): n is a, c, g, or t
  misc_feature (543)..(543): n is a, c, g, or t
  misc_feature (551)..(551): n is a, c, g, or t
  misc_feature (559)..(559): n is a, c, g, or t
  misc_feature (563)..(563): n is a, c, g, or t
  misc_feature (576)..(576): n is a, c, g, or t
  misc_feature (580)..(580): n is a, c, g, or t
  misc_feature (586)..(586): n is a, c, g, or t
  misc_feature (588)..(588): n is a, c, g, or t
  misc_feature (592)..(592): n is a, c, g, or t
  misc_feature (621)..(621): n is a, c, g, or t
  misc_feature (633)..(633): n is a, c, g, or t
  misc_feature (637)..(637): n is a, c, g, or t
  misc_feature (658)..(658): n is a, c, g, or t
tggaggccggtggttggggcttctccgcgtcggggatggggccagagtaacctagacccgtttaccagcgcctcagtcggttccccatgcccncanaggtggcccggggcaagcgcgccgccatcttcttcncnnnnntnnccatcntnctnnnnctannnctctnntnnaanancacnnanaannannnnncctcttttccttaatcccatatnatttncnttaattcncttnatctcctcntnattntncntnttantgttgtgtttangcgggagggagggnacngggaagagnaggagaagcngcncnnaganngttgngcagggaaaagaaaaagngcncgngaaaagaaaaaaangaaaaagcaaaangcncggggccanaaaggcctatgcggaagggctnngggaccanggagggagggagggcccngggnagcggggcagngggcanagaaggcagaaagccatgcngaaangangccgcaaggaanaaagcggangggctgcccngaactggnggaccgggganaagcngnancaactccngcaactgnctgnccccaaggacaangaangaagcnanaatngggggcccaaagaaggacaagcagtgggnggcgggggggangaanggcacccggggaaggcctggngaaacatgcatgtggggcgcgcccgcatgaatgccaaggtggggcccaaggccatg

SEQ ID NO: 661065 - DNA, 92 bp, Homo sapiens
aggggttcaggcctggagtcagggaagaaggggaaaggggcagatagctgggggacaaggaaaacctggcgccccccaccgcgaaaaacaca

SEQ ID NO: 661066 - DNA, 712 bp, Homo sapiens
gcagaagtggagaggtgggtattgggacacacaggaagctgctctcttctgttgtctgtggcttctgttggaggatgtgcggtggttgaatgcaaaggaggagatggaaggaaggtgtcaatatagctttagcaaaggaaaccaataatgactaacatcgaaatcagccttgcaataattgtcacagttgagaaaagttatgacattgaacgatatccaatctaacccaatccttcttgccttaacctccaaattgctcttagtcatgcctgagcaaaggccaagctaccttggggagaaattccgttctacagtttaaatgataatagcccttcccaaaactaacctgtctttgtcaaaaacatgatgaaaggccaccaggtctagggaggatgagacggggcctgaatgcgaggctctagcataaacaattacccgccatgtatcagaggtcacaagatttgtaacttccccaattagtcctgtaaaatgatatcacgtgcggccttttgagatgtcttgcacgctataatcgtgcgtggctttgagacaaggtcttgctctgtcaccaaagctggagtgcagtgatcatagctcactgcagtctctatctcctgggctcaagtgaaccttccacctcagccttccaagtagctggaactgcaggtgcaatgccaccatgcctggcagttagtgatttaggtactggggt

SEQ ID NO: 661067 - DNA, 285 bp, Homo sapiens
  misc_feature (27)..(27): n is a, c, g, or t
cctggaggcaactcacacctggggtgngatgatgcaaccgaggagctcatggaacagagtgaggagctgcttacgctgtgatggaaagcactggcagcccctggacacagtggcttcagagatccctgccatgatgtacccaggccaaaggacaagccaggctgcatgatgtgagggagatgagagactcctttttaaaaattgtgaaacctttgttggaaatatgacctcgtaagatctgaataatgactgaatttggagatcatgaatgtttctacaacaaaa

SEQ ID NO: 661068 - DNA, 927 bp, Homo sapiens
ctccctgagttgatcaggccagcatcttttaagaagggcaaccaatgatctgggaggaaagtctgtacaaaaacccctggggcttttccgaagaccccggggtggcccctccttgagcgagcctctcatccgagactgcccagggtgttccttcccaccattacatggacgtcagtttgcccgcgctaatgtcttcctcgctgtatatagtcgggagcgattgacccccgccaagtaaggacgttgtatttttatgacctcgcccctccaccataagtagcgagaccttgtgatgtatagtaagtgtcttagtagcagctcgtgaggtggggccgcaagacaggagatgaactcaagggagataaggggatcgcgctttggtgagttaacgcaaaacacacggcgttagtaatctccaacggaccgtttctggaagaaaaggttttggtcgacacatgtcttgcgtgaggtgtcttgggaacaacccaccgcctagttgagtccggctcatggtagagagtgccccatggccaaagtctccactcccactgccggctggtgagcatgaagcccctggggcgagatggacacgggaataatgtacccttgtgtgtggtgcataatgcgggtgcaacaaacagcctttcccatgaaggtgtcattccttgaacacttacttctgctgggtccccctaatgaaatcctcagacctcctaatatctctgtcgttgtatggatgcaaacaagagtggatgtattggcgacaatctgcttgcctaccccgacatgtgtttttttaggaacccaccaactcacgaggcatcgttggtagggaagaaagtcccccaacacacatcgaggtgaaggaaacagcgttacagacttcgaagggaatcccaaggaccaaccaaaagggcggacaaaaca

SEQ ID NO: 661069 - DNA, 1773 bp, Homo sapiens
cgctggtgaaccagtcgtaccagtacggcccctgcagcgctggtgcaatggtgcttgctgtgtggggtgcagcatgggctgactacatggcccagtgaggacgactgtgtgacctggtggatcctgctgctgtgaccctggcctggtgagaatgcagcatgctgcaagaccttcactggcatgtgtgcaattcccacctgctggaaggtgcatggcaacacatgatctgatgaacatttgattgagtgacttcctgagaacgtgggctcaatgctcattgcattgctaccatgtgatagggtcattagtcatgtggagatgcgtgtttacctaatgctctgggagctggtggtgaatagagatgacggagtgttgcaagcagagacatcgaagaggaattgttgaagcacaaatgctggcattgtgagcgttttactttgcccatgcaaaatgtggcgttccaggccttggatcgtccactctgtgcgtggccaagaaatgacggactttgttgggcactgagccaatctgcaagaacggattgagccacttgtggtgcacttttggattccttgtgacccaagtcagtccccttagggctttctggccgagtcccatgtggaacacttcggtcctggtcggacacattgatgaacccttctgacgccagatggcgacacggggcgcttccctgttcctactgtggttggcccgaggacagagacaacggaacgactgccccctggtgaattaaacggaagctggtacaaactttggttggcaagcacacctttcccgagcaatcaaggcctggcaacgtgggaattggtcgttccttttggccctttccaaacttggcccactgtggacttcccaaatcgtggacagagcaagggaacccacagaatgcctggacgtttttgcagcggttatttgcacccacaattgcctttttgaatggcgcacacgggggaagtctgcacaccacctttggttgcgagcctcagcacgctttgggagatcgacattggcgctattccggaaaacaggttgcgcttgcaggcacatcacgtttaaccctttccgagccgatatgcccccccaaagagtcatctgccttgtgtcgtttgccacggcgtagggcaatacactttgtcctgtcggtccacgtatcatggagagagacccagtgattgtaatgaaagggggcgccaatccatggagctgttaacggttggttcctgttgcgtacgtaccgaaccggactgttcctatcgcggggggcacaagagagacagggctggaagaatgtcgtgagcaaaccggggcattcttgtaagaagagtgcgtgcgatttgcagaaaccacgaaagaaaaggagacacccgagactagtgaggccaaacaaggaaagagcgttgccacgcggcacctccctcgaaggaatggagtcacgagcgccgagcaagccacatgaagtaggaggcacgagtgtgccccaagaaagcacctatcggagcatagacacaacagacgagaggagagcctgcagcacataggagggtgcacgacacgcgcacgcagagaagcagaacaggaagcgtagagcataagcagaacgccacagccgacccagcgcaagacgagacgcgacgcgagaggcggcgccagaccacgcgttgaaacacgagcacgaaggtacacgaagcacgaagacacagagaccaagctagaacagagacagcagagcagaggagcgaccagcacgacagc

SEQ ID NO: 661070 - DNA, 1006 bp, Homo sapiens
gattgtaactgtgcactgtgcccggactgctgaaagccagaccaccatgcaaccaacggggtggtgcaccatcatcgataaggtcatctccaccatcaccaacaacatccagacagatcattgagatcgaggacaccatatgagacccttcggagctgctgtggctgcatcagggatcaacacgatgacttgaaggataacaggcacagtacacgacttatatggcacaccgaccaactgaggccatatcgcagaagatccctattgagacattatgaaccgttatcctgggacgacccaagaagaccctgaaggagaacatgatgaaccaagccacatcattgaagatcaacctactgctgctgcatgaaagaccacaatcgatctgcagcagcggacatgatcatgctgagacgaaccccctgggaagcgcgcaacggcccacctcgcgacaaggctgagggacatgcaacagacggagcgacacaataactacaacatactacacaacgcgcgaaaagagccgacaaccactcctaccacaataaacaagaaccattcacataacacacaaccgaaacgaggggtgctgaattcgcaacataacccacttgcatagaacgccatcacctacaaattcacccaagcaacatccacaacaccaaagaacaccataactctatagaaactatagggacctcagaccaacaaggatgaccaatgaaactcaggtgcaatacccaaagcacaggacccaaacagtcccgatccagccatcaacaaacgaaggcaaacgcacaggtacccaagacgagaactacgagagcgacaaaagtcccaagatactaacgtcaattaggcacaacccggacacaacagagggaatacggcaaccgccacgtcaaccatgagaaacatcacaacgcacgtgacaaaatagtaactcgatactatcgcaaacaagaagatattgagaaaaaagaaccgacaacacaacaagacaaga

SEQ ID NO: 661071 - DNA, 310 bp, Homo sapiens
gccccggaagggagagaagacaaggggaggaaggggggaaggaaaaggaaggaggagaaaggaaaggaaggaagagagaggaaggaaggaagggggggggaagggggagggaaggaggagagagaaggagaggaggggggagaaaagagggggaaagagggaaggagggaggaagggaaaaagaggaaagaggaaagagagggggagaggaggaaggaaaagggagggaaagaggaaaggggaggaggagaggaagaggagggaagagatagggggaagggaggtagggagaagagaggaaggggagagg

SEQ ID NO: 661072 - DNA, 887 bp, Homo sapiens
agaagcattctgagtttcattgcggaagaaacaagctatctctctggttcttgagcacgaagcatttgtataagaagtcgttggtacactgggaccatttcgaaacaatatagagtgaacgaattcggggttgtatcgactcagtgcattctgtaagggattcagcttttcccttatttatcttgcagtatgctagtgactatcttgcagagtcgtgttccagctgtttcctgtgttctcgatcacacgaagactgtatcgctccttatccttgggttcatttgcttcaggaaaaccattccatctagatttcctaggtgtgaaacctcactgattacataatagtgtatatttatagtatctaggacacctttcttcaggcatcctgttacatttctacattataagattcttaaatatgcattgaattacaaataggtccccagggaaaaggcaaagaacgaactggcttgtttctgcgagaaactaggactaatatagatatcttgggagcactgaacatggaggatagagttaaacttgaaaagacatacagagatagaaaagcaggaaactgcccttatcatttgtatgcaagcacacgatatcatgtatgggtttttaatttttggcttgatgtattcatttccaaatcaaactataatgtgctctaattgggtctcttagtgcagcacgtggtacgtggattagaagtactttctccagttgaataatgacatgataattgaggaatgcaatgtgtgatagatttcactaaaaaagccaggatgagtatgtagatttcctttaaagataattatatataatactatatcaaataagaaagttcaagatgattaggtatatggtaattaacaataaggaaa

SEQ ID NO: 661073 - DNA, 452 bp, Homo sapiens
gatcgaggcggaccgactgcagctgtgctctcccctgtgattgtgtcactacgtaggcaggtgtacccttctttctcctctcataggtgtgtatgtcctagagcagtgttgtttgaaaactattcacttgtgctagaactgttcacttgtctgtgtccccacttgacgtatgaggtatgtgatgttaatttctacatcctttgttcaatgagtaaattaatcagaactagaaactatgtagctagatatgttgtttgtacaagtttatatttttatacagttaagcaatggattccagaggagactttatgtcaccagtatgagaacagaaaacataccagttaagccagccatgtcacttactgggctgtttgacctgaggaagatgactgcatctctctgaacctcagtttcctcatttatcagatagatataatgatacagtttgcagt

SEQ ID NO: 661074 - DNA, 375 bp, Homo sapiens
tagaggctgaagtgggagggggggtggacaggccgccttagacgccccctcctgttggcgtcaggcccagctgaccagcgttaacatcaaaacagcgatctcacgactgataaaacagacacagcagtaagattcccggttccaccctgactctgggatagcagcaggcgacagagagcaggccctgcaggaaataaaagtattttaccccagaatatattccttccacctattttgagtggctatagaaaactgcctcttgggggggaaatttgcattctggagagaatcccatgccctttccaggtctctttttcctgatccaggagagatttaactacaagtcaccttttaaagtcccataggagacattta

SEQ ID NO: 661075 - DNA, 372 bp, Homo sapiens
ccatgaggctcttcctgtcgctcccggtcctggtggtggttctgtcgatcgtcttggaagcccagccccagcccagggaccccagacgtctccagtgccttggataagctgaaggagtttggaaacacactggaggacaaggctcgggaactcatcagccgcatcaaacagagtgaactttctgccaagatgcgggagtggttttcagagacatttcagaaagtgaaggagaaactcaagattgactcatgaggacctgaagggtgacatcccaggaggggcctctgaaatttcccacaccccagcgcctgtgctgaggactccctcctattgccccaggtgccaccaataaaaatcctacagaaaacttca

SEQ ID NO: 661076 - DNA, 180 bp, Homo sapiens
tagtaggggctgccattccaatattgatacgccaccccgagttcctgccagtcagcctggcacacataaccatagggatcccctctggtcactgggtcaccatgccttttcttaaactgcgcttctagtgacatggacttaaacgatggggtccccagaatgtacagtgctcctcgatgg

SEQ ID NO: 661077 - DNA, 173 bp, Homo sapiens
tttgttcatggtgacttgtaagctaaggggaaggggtgctaagatgcctttgaatctttccatgtcacgcgatcttgggccagccggcctcccttcctctccttgtatgtaaaacctttttttcccctttcaagcaagaactttcaaaagaactatgcacattttaacataaa

SEQ ID NO: 661078 - DNA, 1320 bp, Homo sapiens
agaattggccaggcatgatggtgcatggcctgtggtcccggctagtcgggaggctgaggcaggggagtcacttgtggcccaggatgcggaggttgcggtgagtcgagatcgtgccatcgtcactccagcttgggcaaggaagagctgaagctccatgctcaaaagaaaagaacaagcagaggaaggtaatgggatttattgccatgggttctatgcagaataccaagtattttgaagaggggaacttctaatgaaggtcggagagctggtaagcacgtgcagttttagagcccatttgcttggcgcatgagcttgtggcgcgtacggttaatttaacctggaggcttcttaaaatcgctcaggaaaaggcgatggcttaggaaagggctgagtctacaggctggcagtcgaactatggttcgtcggaagaaatgggctgtatggagagaagcgaccagatataattgtatagaggtaaacataatcagttgaaggtcgggtggttctcagagagaagaactaaagtgggagaaaagtaaagttaagaggcaagatcctaaaagtgcacattagcatcgggaggggcatcgagagacagggggaactctgcgttggtgcttggggggtttaccagggtatattgattgaacattggagggttcatatgtgctgatagcgttaacttcactggtttccacggagattttttggtcggaaggcgtaaacacaggggttagactagaattgatagttgccattgtttacttcaatgaaaggcggagagtgaatggtaacggtgtgggttaaaggttatcacaagggtcttgggtgggtaaagagaacgggaagatcatttctgtgccgttaataggtattacacctttcgatataaggagtaaacagaacgaaggaaggccttatgggtttattaagaggttggacggaatgaattctgtgaagagcgtcttcggagttgaactcacgttagtaagtttgataatgcacggtgtagcgtgacatgtagtggaacaatccaggggcaacagacatgggggacacaacaaagaaggaaagcacagattacctcatccacccggagtattgggcactggctacccctatgggggacctcaacacaatggggccgaacgcaggccaaggggaacagaattcccaagtgtgccgggagagcagtgaatcgtggcagaagggtaacagggtagaaagccacaaagacaagcgaacaagggtacaaccagacggagcggaaaaaagagcgagtaaactagatgcaaaacgaaaaataggagaacaggaggg

SEQ ID NO: 661079 - DNA, 104 bp, Homo sapiens
gtgacaaatgacatgtacggatacatagggcgaaattagttttgtacttgtatgatacagacacgagtcaagaattccgtcgttttaatcagagttgttgtagt

SEQ ID NO: 661080 - DNA, 966 bp, Homo sapiens
cgatgctggtggatcacgaggtcaggagtttaagaccagcctggccaagatggtgaaaccccgtctctactaaaaatacaaaaattagccaggcctggtggtaggcgcctgtaatcccagctatttgggaggctgaggcagaagattgggtttggaaacccggggaggggaccaggttgcagtagaggccagaagatgtgcaccaccgtgcaactccagctcgtgggcaacagactgaaactatgtcttaaaaaaaaacaaaaaaacgggaaaagaaagaaaagaaaaaaaaaattttaaactggaaaatccaaaaaggctctttttaagaagtggccttccaacacgaacagagtgggggttccccgggggcaacaactcgaacgtgggtccccgtataattgtgcccaggaacgggggcactgtgccaaacacaaaactccaagagtagcggcacctagggccagaggaaaaaccccatgaggcgagaaaacaactaatctatattctcccgctgtgaataggcaggacaactaacaatattgctggcggggtcccattgagacattcccgtctttcaaccattttcttcgcactttctcaccaggtgtctttgtgagggcgacaacaggctcaccattacccagtggtgggcccacactctaagtttgtgaaagaaaaggggggagcataacctggcttatacattttcaaacaccaggagagaatactttcgtgaagcgagagaaaaaatttatccgggggattaagaggggcacgtcgattttagtgactataggggaccccaatatcgtgtcgtgaaagaaccatgcgaaatttttaagtggattgtttgtctggcagaggtggtataacacagtaagagtaaaactacggggtgatcggtaagttagaagaacaatattacgtggggagaattgaatacgtctacagaagtgtcaattt

SEQ ID NO: 661081 - DNA, 178 bp, Homo sapiens
tagcggatctgaatctgcaccacagcctgtctctggtcactttgaatgtgtctctccgttgtactctcctcccaactcccttcatgctgagccatgtacctggagcatgagagaacctcaggccttctctaccacacatacagaatctgactcctaccccacagtcttgtcaggagca

SEQ ID NO: 661082 - DNA, 101 bp, Homo sapiens
ggtcccgttctgcctctgccgttctgcttctgcctgcttctgctgcttctgcttctgctgcttcctgcttctgcccaacgtcctgcaggttcttggtgagg

SEQ ID NO: 661083 - DNA, 122 bp, Homo sapiens
gatcgcttgatttcagagggttgaggctgtagtgaactgtgattgtaccactgcactgcagcctgagtgacagagcaagactccgtttcatatttttaaaaataaataaaaatcatgagttt

SEQ ID NO: 661084 - DNA, 201 bp, Homo sapiens
  misc_feature (9)..(9): n is a, c, g, or t
  misc_feature (80)..(80): n is a, c, g, or t
  misc_feature (85)..(86): n is a, c, g, or t
  misc_feature (110)..(110): n is a, c, g, or t
  misc_feature (114)..(114): n is a, c, g, or t
  misc_feature (123)..(123): n is a, c, g, or t
  misc_feature (147)..(147): n is a, c, g, or t
  misc_feature (152)..(152): n is a, c, g, or t
  misc_feature (182)..(182): n is a, c, g, or t
gagatagtnatgcctttgctttctgatggttcagtgcacacatactttatttaatgcaagacacttattttagaaattgnctagnnatttccttccagccaatatatatnaggngtgcatganccataaatgaagttcatgtttagncttgnagtctcaaccctgagtcctctcaaatatgnaatatgctaatatgctgta

SEQ ID NO: 661085 - DNA, 153 bp, Homo sapiens
gccacttttaaagattccccaattcccgctttttgggaatttaaattatttgctggaagtggaaagaattattccattccttaagaaggcagtggccaattcttaagggccgggatcaccaaccaagctgggcaggaacccaaggcacccaag

SEQ ID NO: 661086 - DNA, 311 bp, Homo sapiens
cgctacgtgaggccaaatatcattcgtagaggggccacagtaataacaaactgtactgatcacgccagtccgcatacattgggacacgacctagttcaatgaatctgaggaggctactcagtatacaggcgccagcctcgacgacgatgcttgacctagcacttcatcttgcccttcattattgcagcgcctagcagcactcacaaccgtgcctattctagcacgacagacgggaatcaaaccaagcccccataggaagtcaccgtcccgattccgactagaaaatcgagacttcccacccattagctaca

SEQ ID NO: 661087 - DNA, 156 bp, Homo sapiens
ggggaatgagtagcaaagatggattaagtgagaagagtataggaggcagcagggccagaggtgtgaatagcccagaaccttctgagaagattcctttgtggacggaagaaaggggaggtttgtggaaatggtggaagataaggtcctacaggtatg

SEQ ID NO: 661088 - DNA, 258 bp, Homo sapiens
tcggcctcccggttcaagtgattctcccacttcagccgactgagtagctgggattacaggcatgctctaccacgcctggctaattttgcgtttttagtagagatgaggtttctccatgttggtcaggctggtctggaattcctgacctcaggtgatccacctgcctcaacctcccaaagtgctgggattacaggcctgagccactgcgcccggcctctcttctttcttattacctaggagtaggatacagtagggaga

SEQ ID NO: 661089 - DNA, 429 bp, Homo sapiens
cgagaatcataatagctatgtaaggacacttaaataactcaagctaacacagagaaggaatacagaattctatcagcataaatttaacaaagagattgaaataataaaaaagaacctagcagaaattctggagttgaaaatgcagttgaaagactgaagaatgtgtgttttttaatagctgaattgatcaagaagaagaaagaattggtgagcttcaagacaagctatttataagagacaaaataataaagaatgaaacatgcctaaaagactctggaaaaatgcctcaaaagggcaaatctaaaagttattgaccataaagaagtggtagagagaagtagaggtagaaagtatattcaaaaggaaagtaacagagaacttctgagacctagagagagatctcaatatctataactttctaagacagtt

SEQ ID NO: 661090 - DNA, 303 bp, Homo sapiens
agctgtctgcctctaggcctactatgggtgttatcttttatactctctctactccgtattccccttttgtcccaagagctgttcctctttggcctaactgctttaatttcgacgtgattatagtgttctgtgtgcgttttcatcatagaataagattctatcttggacaaccagctatcaccaggctcggtaggtgtgtcgcctctacctataaatcttcccactattttgctacatagacgggtgtgctcttttagctgttcttaggtagctcgtctggtttcggggggacacgaatgttca

SEQ ID NO: 661091 - DNA, 109 bp, Homo sapiens
gatcctgtgcgagcgttacattgcctgcatttgtagccttgcttgttgaggccccagacaaagtctttgcacacagaacagaaggtgggttgcccaaatgaaggtggcg

SEQ ID NO: 661092 - DNA, 276 bp, Homo sapiens
aaaccccttccagatttgatatggggctattaatttttatgctgttaattggtattcattcccaaagcagttgaagggggaaggctcccctgcattttttgggtaaggcctgaaagcttggtcatctgtaaaatctaaacccgagggtttgttttccctttaaaattttttaaggaaaaaaggatgggtttttaggggttttgaaagtattattcaatgtgcaacaaacaggtaggttttcagcataagctgaaatatatgcatgtaaaaacttta

SEQ ID NO: 661093 - DNA, 406 bp, Homo sapiens
agctttgtgcaaggcatccccttgcacagagccggtaccaccttgtccaaggccccagtgcccttaagatgtaaggcctacacccagggaatagtccttcgcagaccaggtatccaattacacagcggaaaccagacccggaaccaaaccactgccacctctctcgcatagtccagtgaagagatacacccttgaagccagaatgtgtggctcggtcacaagtgtatgtggtgcactccacaccattctggaatagctcgtgtcttgaagaaattctgagatatgaccaggtctgacctctgaagttcaacgccacagagcggcgccttatagggccgcgcacgcggcactcagcctacagagacgcgacatcgcgctcctgagggctcgaggtcatcccgcgtgc

SEQ ID NO: 661094 - DNA, 574 bp, Homo sapiens
gaacgacccgctgttctgctcgagttgaacccgtcccacaagtctaaagatcgtaggaatgtcttcagtctttcgatgagattacggcgtatgacgtggcgatggcgtgaagcgatgctcctgctcgtgaagaagagccgagacttggctattgctatgtggctctggctacatgcggtggctaaaaccgcctctgagatggtcctggcggcatgacaacttctccaccattgtggctgccgttgaggaggggcgggcaatctacaacaatcctgaaacagttcatccgctacctcatctcgtccgaacgtcggggaacgttgtctgtattttcctgacagcagcccttggatttcccggaggcttcgattcctgttgcagctgcatctgggtcaatctgggtgacgagatggcctagctgccaactgcactggggttcaaccctccgtgatctggactatctatgaataaaccgtccccggaagcccaaaggaacgatggatcatgcgggtggcgtctttatccgttagttggctatgtggctgttacgtcggggctgctaccgtgggtgctg

SEQ ID NO: 661095 - DNA, 577 bp, Homo sapiens
  misc_feature (71)..(71): n is a, c, g, or t
  misc_feature (73)..(73): n is a, c, g, or t
  misc_feature (117)..(117): n is a, c, g, or t
  misc_feature (119)..(119): n is a, c, g, or t
tgcgcggtcctttcctgcggcgccttccgtccgtcggcttctcgtcttgctctctctggtccctccggagncncagccgcgcgtctcccggggaagcatggcgatgaaagcggcaangntgaaccagttgtgttgtcaggacaaattacaggattaactgaaggccagcatgggttccacgtccatcagtatggggacaatacacaaggctgtaccagtgcaggacctcattttaatcctcactctaagaaacatggtggcccggcggatgaagagaggcatgttggagacctgggcaatgtgactgctggaaaggacggtgtggccaatgtgtccattgaagatcgtgtgatctcactctcaggagagcattccatcattggccgtacaatggtggtccatgagaaacaagatgacttgggcaaaggtggaaatgaagaaagtacaaagactggaaatgctgggagccgcttggcctgtggagtgattgggattgcgcagtaaacattccctgtgtggtctgagtctcagactcatctgctaccctcaaaccattaaactgtaatctgaagagtta

SEQ ID NO: 661096 - DNA, 2364 bp, Homo sapiens
ggcacgaggagtaatcgttctggtcactgggacacagctgcgctcgcccattctaaaaagtcagcgccctcaggcccgcgggtaaccacctcctcctgagcgcggtgaccagagcttagaagcaaagttaagagactcatcagattctgagctgctgcgggatattttgcagaagactgtgaagcatcctgtgtgtgtgaagcacccgccgtcagtcaagtatgcccggtgctttctctcagaactcatcaaaaagccctcgggaggctcggtcacactctccaagagcacagccatcatctcccacggtaccacaggcctggtcacatgggacgccgccctctaccttgcagaatgggccatcgagaacccggcagccttcactaacaggactgtcctagagcttggcagtggtgccggcctcacaggcctggccatctgcaagatgtgccgcccccgggcatacatcttcagcgactgtcacagccgggtcctcgagcagctccgagggaatgtccttctcaatggcctctcattagaggcagacatcactgccaacttagacagccccagggtgacagtggcccagctggactgggacgtcgcgacggtccatcagctctctgccttccagccagatgttgtcattgcagcagacgtgctgtattgcccagaagccatcgtgtcgctggtcggggtcctgcggaggctggctgcctgccgggagcaccagcgggctcctgaggtctacgtggcctttaccgtccgcaacccagagacgtgccagctgttcaccaccgagctaggccgggctgggatcagatgggaagtggaagctcgtcatgaccagaaactgtttccctacgaagagcacttggagatggcaatgctgaacctcacactgtaggactcacacacgactccaacgggattgtgagaatcaagtcactctcatgggaagaatttttatatgggaaagcggataaaactttcattggactggaatgtttggagaatgttaatttccaaatcaggaaccacaaactgccctctaataagacatcggctatctaagcgtgtgggtgccccctttctgccagcagttctggttcttaagaaaatcaccataaatcagacatgaaaattctggctccaaaaatagcattttctttgtgcaaataaaaacgtgtgtatcaagtatgatgttcccccaacgtggacacactcggttcctcagaaagccaagcccgctgcagctgccacatccctggacacactcggttcctcacaaagccaagcccgctgcagctgccacatccctggacacactcggttcctcacaaagccaagcccgctgcagctgccacatccctgggcttatggtgcagcaggtgcttttttcaagacaggaatcaaagtgttaggaacacggcagaaaggtgacacctggagaccaaatgcaggatgaggagtactgcagaggtcacagggaagtcacagaacagtaatacgctagcaggggcatggggcatgaagaacagaagacaggaagcgtttcagagactccaaagaagaaatcagggccaaccacagcttcccgggtcacagaacaattcattcaccaggtggcaccactgccgtcatttcagcttctggccactgggaggcgctgctcgaaagggtttgccctgagactccaagaagaagctgcgggaaggacagcaggggccctggggttttagcctctggcccaggagttatgtgtccataaccaaagggagcacagtctgcacccagctctcatcccatcagagctgctgcgactcccgcaggttcttccggaactggtttagcttgcctgcaggatcaggaaagtttgagaaaagcatctgcaaaatactaaagagcagagcttacctcattgcctgtccccaccccatcccaggtcaccacctggctgaccccaggtccccgacccaacaacaacccctcccaagtccctaactccctcacttggactcgagacccttcacaacccccctcacttggacttgagacccttcacaacccagcagcgctccgcctccaacttgacatcatgctttctggaaacttccccgcatgtcccactttcccacacttggtgccctggagcaccttccggcctctacatgctgtacgttcccctgtgagcaccctcctctcggcctctggccaacacagtcccacccatctgtgggtaacaagggggtgtcggtgttcttttcagccttgctaaactgtctgaatcaaggatcacaaactacagcctgcaggccaaatccagcccacagcctgtgtttgtaaataaagctttattggaac

SEQ ID NO: 661097 - DNA, 482 bp, Homo sapiens
  misc_feature (257)..(257): n is a, c, g, or t
  misc_feature (357)..(357): n is a, c, g, or t
  misc_feature (407)..(407): n is a, c, g, or t
  misc_feature (425)..(425): n is a, c, g, or t
  misc_feature (430)..(430): n is a, c, g, or t
  misc_feature (437)..(437): n is a, c, g, or t
ccaatgaagtgaatattttatatggcagctggccggtattacaccattccatcccaaatctcccctccaaacctggcgaaaatcatctggccattgaaaaagattagaacgaaagcaaacaagctctcactcagcctgcccccagcacgaggctgtccacacagagcctttggacgagctgtacgaggtgctggcggagactttgatggccaaggagtccacccagggccactggagctatttgctggtatgagaanggcaccctcctccccctcacagcccagatacccttcctgcacaaagtgaaaacgtgggtgtgggttcaaatcctgactcacccattctgcagtcttaganatgaggtccattaaccttctttagcctcagtttccctgtctgtaaatcangcacttcaacaacaacancatgnctcgtgnggttgttgggcatttgtccaataggtgacacacactacctgcttc

SEQ ID NO: 661098 - DNA, 733 bp, Homo sapiens
  misc_feature (8)..(8): n is a, c, g, or t
  misc_feature (16)..(16): n is a, c, g, or t
  misc_feature (720)..(720): n is a, c, g, or t
tttttttnccccccgngtgttttaacaccaaaaatttttttttgtttttataaaaaaaaaaaaaaaaaaaatttttttttttccctcaaaaaaaaagaaaaaagaaagaaaaaaaaaaaccctttttttttggggggggggggggtttttttccccccccccccccccccaccatttttttttattttttcgggggtggggggggggggggaaagtttctccccccccccccggggggggggcgcccccccccctaaaaagaagagagaaaagaaacacacttcttgtgttttttttaaaaaaagaggaggggggtttttaaattatgaccccccccccccccccccccccggaaaaaaaataatctctcttcttcttttaaaaaaaggaagaagaaaaaagggggggggggggtttttaatatctccaaaaaaaaaaacaccccccttccccacaaaaaaaaaaaaaaagagggggggcgccccccccccccggaggggggaggggggttttttttcccctcctttaaaaggcgcccccccccccccaaaaggccccttcaccctttggagaaaaaccccccccccctttttttcccccagggggtaaagaaaaaaacgcccaaaaatttcccctttaaaaaaattggaaaccctttaaaaagtgccaaaagcccttccaaaatttcctcccaaggccatatgtttgatcccagcaggntaggggtccccca

SEQ ID NO: 661099 - DNA, 440 bp, Homo sapiens
gcggccgactactactgctcgaattcaagcttctaacgatgtacggggacatgctgtacgttcccctgtgagcaccctcctctcggcctctggccaacacagtcccacccatctgtgggtaacaagggggtgtcggtgttcttttcagccttgctaaactgtctgaatcaaggatcacaaactacagcctgcaggccaaatccagcccacagcctgtgtttgtaaataaagctttattggaacaaagccacaccccttaatctacagatgatctgtggctactttcacaccacaacagagtaccatggttctgacagagactgggggaccctgtctaaatgacttctgacctggacctttactgaaaatcctcccaatcattctgttgacaagaatgatgtattactttttgcaataagaaacaagtaacctttgcaaaa

SEQ ID NO: 661100 - DNA, 358 bp, Homo sapiens
ctttgggccccccgggttttccctttttgtttccgggtcggtttttgtgggggattgggggggggaaaccattttcccccgggaacaagttttacctttttttgaattttattcgccccccctttggggatttggccccccgggcccaaaatttgggcccggggtgccctattttagctgggggggggttttttttcccaaaaacagggggggctttcgtttttccccccattgcttgggttcgttttttttcgccctttttgggcccggtttttttttaataacccgggtttttttttgggggccattttttttttcttttggggacccccccccataaaaccgttttttcccttta

SEQ ID NO: 661101 - DNA, 372 bp, Homo sapiens
actctcaatcaccttgactgaccttgatgtcctcataatttcctcaggtatacatttgcaaatgatctcatccatgacattctttatgaatagtattgataattgtttctgattataaaataacacactgtcaaagatggctgaataggatcagctacagtctacagctcccagcgtgagcaatgcagaagatgggtgatttgtgcatttccaactgaggttcatctcactgggacttgttgcacagtgggtgcagcccatgcgagcatgagctacagcagggcagggtatcgcctcactcaggaagctcaaggggtcgggaaactccctgtcctagacaaggtaagccccaacagtcttagcaagcggcac

SEQ ID NO: 661102 - DNA, 2456 bp, Homo sapiens
gccgggcttccgcccggtctgccggcaacgctgcggccccgcccacgtcatggcgcccgaggagaacgcggggaccgaactcttgctgcagagtttcgagcgccgcttcctggcggccgctcactgcgctccttcccctggcagagcttagaagcaaagttaagagactcatcagattctgagctgctgcgggatattttgcagaagactgtgaagcatcctgtgtgtgtgaagcacccgccgtcagtcaagtatgcccggtgctttctctcagaactcatcaaaaagccctcgggaggctcggtcacactctccaagagcacagccatcatctcccacggtaccacaggcctggtcacatgggacgccgccctctaccttgcagaatgggccatcgagaacccggcagccttcactaacaggactgtcctagagcttggcagtggtgccggcctcacaggcctggccatctgcaagatgtgccgcccccgggcatacatcttcagcgactgtcacagccgggtcctcgagcagctccgagggaatgtccttctcaatggcctctcattagaggcagacatcactgccaacttagacagccccagggtgacagtggcccagctggactgggacgtcgcgacggtccatcagctctctgccttccagccagatgttgtcattgcagcagacgtgctgtattgcccagaagccatcgtgtcgctggtcggggtcctgcggaggctggctgcctgccgggagcaccagcgggctcctgaggtctacgtggcctttaccgtccgcaacccagagacgtgccagctgttcaccaccgagctaggccgggctgggatcagatgggaagtggaagctcgtcatgaccagaaactgtttccctacgaagagcacttggagatggcaatgctgaacctcacactgtaggactcacacacgactccaacgggattgtgagaatcaagtcactctcatgggaagaatttttatatgggaaagcggataaaactttcattggactggaatgtttggagaatgttaatttccaaatcaggaaccacaaactgccctctaataagacatcggctatctaagcgtgtgggtgccccctttctgccagcagttctggttcttaagaaaatcaccataaatcagacatgaaaattctggctccaaaaatagcattttctttgtgcaaataaaaacgtgtgtatcaagtatgatgttcccccaacgtggacacactcgttcctcacaaagccaagcccgctgcagctgccacatccctgggcttatggtgcagcaggtgcttttttcaagacaggaatcaaagtgttaggaacacggcagaaaggtgacacctggagaccaaatgcaggatgaggagtactgcagaggtcacagggaagtcacagaacagtaatacgctagcaggggcatggggcatgaagaacagaagacaggaagcgtttcagagactccaaagaagaaatcagggccaaccacagcttcccgggtcacagaacaattcattcaccaggtggcaccactgccgtcatttcagcttctggccactgggaggcgctgctcgaaagggtttgccctgagactccaagaagaagctgcgggaaggacagcaggggccctggggttttagcctctggcccaggagttatgtgtccataaccaaagggagcacagtctgcacccagctctcatcccatcagagctgctgcgactcccgcaggttcttccggaactggtttagcttgcctgcaggatcaggaaagtttgagaaaagcatctgcaaaatactaaagagcagagcttacctcattgcctgtccccaccccatcccaggtcaccacctggctgaccccaggtccccgacccaacaacaacccctcccaagtccctaactccctcacttggactcgagacccttcacaccccagcagcactccgcctccaacttgacatcacagtttctggaaacttccccgcatgtcccactttcccacacttggtgccctggagcacctcccggcctctacgtgctgcccattcccctgtgagcaccctcctctcggcctctggccaacacagtcccacccatctgtgggtaacaagggggtgtcggtgttcttttcagccttgctaaactgtctgaatcaaggatcacaaactacagcctgcaggccaaatccagcccacagcctgtgtttgtaaataaagctttattggaacaaagccacaccccttaatctacagatgatctgtggctactttcacaccacaacagagtaccatggttctgacagagactgggggaccctgtctaaatgacttctgacctggacctttactgaaaatcctcccaatcattctgttgacaagaatgatgtattactttttgcaataagaaacaagtaacctttgcaaaa

SEQ ID NO: 661103 - DNA, 155 bp, Homo sapiens
gaaaatagaaaaaggaaaatattaaagtcctttcttacttcctacctgttaataaggagtggtcttggaaattgtttatgcaaggaggcagtgatgaaaatctctcttgctataagttttaaagagatgaaacgttcttgtttaagaattgatac

SEQ ID NO: 661104 - DNA, 2259 bp, Homo sapiens
gccgggcttccgcccggtctgccggcaacgctgcggccccgcccacgtcatggcgcccgaggagaacgcggggaccgaactcttgctgcagagtttcgagcgccgcttcctggcggccgctcactgcgctccttcccctggcagagcttagaagcaaagttaagagactcatcagattctgagctgctgcgggatattttgcagaagactgtgaagcatcctgtgtgtgtgaagcacccgccgtcagtcaagtatgcccggtgctttctctcagaactcatcaaaaagccctcgggaggctcggtcacactctccaagagcacagccatcatctcccacggtaccacaggcctggtcacatgggacgccgccctctaccttgcagaatgggccatcgagaacccggcagccttcactaacaggactgtcctagagcttggcagtggtgccggcctcacaggcctggccatctgcaagatgtgccgcccccgggcatacatcttcagcgactgtcacagccgggtcctcgagcagctccgagggaatgtccttctcaatggcctctcattagaggcagacatcactgccaacttagacagccccagggtgacagtggcccagctggactgggacgtcgcgacggtccatcagctctctgccttccagccagatgttgtcattgcagcagacgtgctgtattgcccagaagccatcgtgtcgctggtcggggtcctgcggaggctggctgcctgccgggagcaccagcgggctcctgaggtctacgtggcctttaccgtccgcaacccagagacgtgccagctgttcaccaccgagctaggccgggctgggatcagatgggaagtggaagctcgtcatgaccagaaactgtttccctacgaagagcacttggagatggcaatgctgaacctcacactgtaggactcacacacgactccaacgggattgtgagaatcaagtcactctcatgggaagaatttttatatgggaaagcggataaaactttcattggactggaatgtttggagaatgttaatttccaaatcaggaaccacaaactgccctctaataagacatcggctatctaagcgtgtgggtgccccctttctgccagcagttctggttcttaagaaaatcaccataaatcagacatgaaaattctggctccaaaaatagcattttctttgtgcaaataaaaacgtgtgtatcaagtatgatgttcccccaacgtggacacactcgttcctcacaaagccaagcccgctgcagctgccacatccctgggcttatggtgcagcaggtgcttttttcaagacaggaatcaaagtgttaggaacacggcagaaaggtgacacctggagaccaaatgcaggatgaggagtactgcagaggtcacagggaagtcacagaacagtaatacgctagcaggggcatggggcatgaagaacagaagacaggaagcgtttcagagactccaaagaagaaatcagggccaaccacagcttcccgggtcacagaacaattcattcaccaggtggcaccactgccgtcatttcagcttctggccactgggaggcgctgctcgaaagggtttgccctgagactccaagaagaagctgcgggaaggacagcaggggccctggggttttagcctctggcccaggagttatgtgtccataaccaaagggagcacagtctgcacccagctctcatcccatcagagctgctgcgactcccgcaggttcttccggaactggtttagcttgcctgcaggatcaggaaagtttgagaaaagcatctgcaaaatactaaagagcagagcttacctcattgcctgtccccaccccatcccaggtcaccacctggctgaccccaggtccccgacccaacaacaacccctcccaagtccctaactccctcacttggactcgagacccttcacaccccagcagcactccgcctccaacttgacatcacagtttctggaaacttccccgcatgtcccactttcccacacttggtgccctggagcacctcccggcctctacgtgctgcccattcccctgtgagcaccctcctctcggcctctggccaacacagtcccacccatctgtgggtaacaagggggtgtcggtgttcttttcagccttgctaaactgtctgaatcaaggatcacaaactacagcctgcaggccaaatccagcccacagcctgtgtttgtaaataaagctttattggaac

SEQ ID NO: 661105 - DNA, 131 bp, Homo sapiens
atagatctagaggatcccatccccggttctgggtagaagggaagggctgacttggttcagcaaggtcaagagccttgccaaaaagtcacacagctagcggaaactgctctttcgttcagttcactgacata

SEQ ID NO: 661106 - DNA, 275 bp, Homo sapiens
cggcacgaggtggagaacctttgtgtggatactctgtatctaatctgatggggacgtggagaacctttgtatccagctcagggattgtaaacgcaccaatcagcgccctgtcaaaacagaccactgggctgtaccaatcagccggacgtgggtggggccagataagagaatgaaaccaggctgccccagccagcagtggcaacccgcttgggtccccttccacactgtggaagctttgttcttttgctctttgcaataaatcttgctactgctca

SEQ ID NO: 661107 - DNA, 2488 bp, Homo sapiens
gccgggcttccgcccggtctgccggcaacgctgcggccccgcccacgtcatggcgcccgaggagaacgcggggaccgaactcttgctgcagagtttcgagcgccgcttcctggcggccgctcactgcgctccttcccctggcagagcttagaagcaaagttaagagactcatcagattctgagctgctgcgggatattttgcagaagactgtgaagcatcctgtgtgtgtgaagcacccgccgtcagtcaagtatgcccggtgctttctctcagaactcatcaaaaagccctcgggaggctcggtcacactctccaagagcacagccatcatctcccacggtaccacaggcctggtcacatgggacgccgccctctaccttgcagaatgggccatcgagaacccggcagccttcactaacaggactgtcctagagcttggcagtggtgccggcctcacaggcctggccatctgcaagatgtgccgcccccgggcatacatcttcagcgactgtcacagccgggtcctcgagcagctccgagggaatgtccttctcaatggcctctcattagaggcagacatcactgccaacttagacagccccagggtgacagtggcccagctggactgggacgtcgcgacggtccatcagctctctgccttccagccagatgttgtcattgcagcagacgtgctgtattgcccagaagccatcgtgtcgctggtcggggtcctgcggaggctggctgcctgccgggagcaccagcgggctcctgaggtctacgtggcctttaccgtccgcaacccagagacgtgccagctgttcaccaccgagctaggccgggctgggatcagatgggaagtggaagctcgtcatgaccagaaactgtttccctacgaagagcacttggagatggcaatgctgaacctcacactgtaggactcacacacgactccaacgggattgtgagaatcaagtcactctcatgggaagaatttttatatgggaaagcggataaaactttcattggactggaatgtttggagaatgttaatttccaaatcaggaaccacaaactgccctctaataagacatcggctatctaagcgtgtgggtgccccctttctgccagcagttctggttcttaagaaaatcaccataaatcagacatgaaaattctggctccaaaaatagcattttctttgtgcaaataaaaacgtgtgtatcaagtatgatgttcccccaacgtggacacactcgttcctcacaaagccaagcccgctgcagctgccacatccctgggcttatggtgcagcaggtgcttttttcaagacaggaatcaaagtgttaggaacacggcagaaaggtgacacctggagaccaaatgcaggatgaggagtactgcagaggtcacagggaagtcacagaacagtaatacgctagcaggggcatggggcatgaagaacagaagacaggaagcgtttcagagactccaaagaagaaatcagggccaaccacagcttcccgggtcacagaacaattcattcaccaggtggcaccactgccgtcatttcagcttctggccactgggaggcgctgctcgaaagggtttgccctgagactccaagaagaagctgcgggaaggacagcaggggccctggggttttagcctctggcccaggagttatgtgtccataaccaaagggagcacagtctgcacccagctctcatcccatcagagctgctgcgactcccgcaggttcttccggaactggtttagcttgcctgcaggatcaggaaagtttgagaaaagcatctgcaaaatactaaagagcagagcttacctcattgcctgtccccaccccatcccaggtcaccacctggctgaccccaggtccccgacccaacaacaacccctcccaagtccctaactccctcacttggactcgagacccttcacaacccccctcacttggacttgagacccttcacaacccagcagcgctccgcctccaacttgacatcatgctttctggaaacttccccgcatgtcccactttcccacacttggtgccctggagcaccttccggcctctacatgctgtacgttcccctgtgagcaccctcctctcggcctctggccaacacagtcccacccatctgtgggtaacaagggggtgtcggtgttcttttcagccttgctaaactgtctgaatcaaggatcacaaactacagcctgcaggccaaatccagcccacagcctgtgtttgtaaataaagctttattggaacaaagccacaccccttaatctacagatgatctgtggctactttcacaccacaacagagtaccatggttctgacagagactgggggaccctgtctaaatgacttctgacctggacctttactgaaaatcctcccaatcattctgttgacaagaatgatgtattactttttgcaataagaaacaagtaacctttgcaaaa

SEQ ID NO: 661108 - DNA, 2608 bp, Homo sapiens
gccgggcttccgcccggtctgccggcaacgctgcggccccgcccacgtcatggcgcccgaggagaacgcggggaccgaactcttgctgcagagtttcgagcgccgcttcctggcggccgctcactgcgctccttcccctggcagagcttagaagcaaagttaagagactcatcagattctgagctgctgcgggatattttgcagaagactgtgaagcatcctgtgtgtgtgaagcacccgccgtcagtcaagtatgcccggtgctttctctcagaactcatcaaaaaggaaaaagattagaacgaaagcaaacaagctctcactcagcctgcccccagcacgaggctgtccacacagagcctttggacgagctgtacgaggtgctggcggagactttgatggccaaggagtccacccagggccactggagctatttgctgccctcgggaggctcggtcacactctccaagagcacagccatcatctcccacggtaccacaggcctggtcacatgggacgccgccctctaccttgcagaatgggccatcgagaacccggcagccttcactaacaggactgtcctagagcttggcagtggtgccggcctcacaggcctggccatctgcaagatgtgccgcccccgggcatacatcttcagcgactgtcacagccgggtcctcgagcagctccgagggaatgtccttctcaatggcctctcattagaggcagacatcactgccaacttagacagccccagggtgacagtggcccagctggactgggacgtcgcgacggtccatcagctctctgccttccagccagatgttgtcattgcagcagacgtgctgtattgcccagaagccatcgtgtcgctggtcggggtcctgcggaggctggctgcctgccgggagcaccagcgggctcctgaggtctacgtggcctttaccgtccgcaacccagagacgtgccagctgttcaccaccgagctaggccgggctgggatcagatgggaagtggaagctcgtcatgaccagaaactgtttccctacgaagagcacttggagatggcaatgctgaacctcacactgtaggactcacacacgactccaacgggattgtgagaatcaagtcactctcatgggaagaatttttatatgggaaagcggataaaactttcattggactggaatgtttggagaatgttaatttccaaatcaggaaccacaaactgccctctaataagacatcggctatctaagcgtgtgggtgccccctttctgccagcagttctggttcttaagaaaatcaccataaatcagacatgaaaattctggctccaaaaatagcattttctttgtgcaaataaaaacgtgtgtatcaagtatgatgttcccccaacgtggacacactcgttcctcacaaagccaagcccgctgcagctgccacatccctgggcttatggtgcagcaggtgcttttttcaagacaggaatcaaagtgttaggaacacggcagaaaggtgacacctggagaccaaatgcaggatgaggagtactgcagaggtcacagggaagtcacagaacagtaatacgctagcaggggcatggggcatgaagaacagaagacaggaagcgtttcagagactccaaagaagaaatcagggccaaccacagcttcccgggtcacagaacaattcattcaccaggtggcaccactgccgtcatttcagcttctggccactgggaggcgctgctcgaaagggtttgccctgagactccaagaagaagctgcgggaaggacagcaggggccctggggttttagcctctggcccaggagttatgtgtccataaccaaagggagcacagtctgcacccagctctcatcccatcagagctgctgcgactcccgcaggttcttccggaactggtttagcttgcctgcaggatcaggaaagtttgagaaaagcatctgcaaaatactaaagagcagagcttacctcattgcctgtccccaccccatcccaggtcaccacctggctgaccccaggtccccgacccaacaacaacccctcccaagtccctaactccctcacttggactcgagacccttcacaccccagcagcactccgcctccaacttgacatcacagtttctggaaacttccccgcatgtcccactttcccacacttggtgccctggagcacctcccggcctctacgtgctgcccattcccctgtgagcaccctcctctcggcctctggccaacacagtcccacccatctgtgggtaacaagggggtgtcggtgttcttttcagccttgctaaactgtctgaatcaaggatcacaaactacagcctgcaggccaaatccagcccacagcctgtgtttgtaaataaagctttattggaacaaagccacaccccttaatctacagatgatctgtggctactttcacaccacaacagagtaccatggttctgacagagactgggggaccctgtctaaatgacttctgacctggacctttactgaaaatcctcccaatcattctgttgacaagaatgatgtattactttttgcaataagaaacaagtaacctttgcaaaa

SEQ ID NO: 661109 - DNA, 150 bp, Homo sapiens
  misc_feature (2)..(2): n is a, c, g, or t
gntcccggatccccgcaccatcatgtctttgcgtctgagggccctgacccggcgcttgaccagcgctgccaaaggagcccacggaggagcagtagctcgtactgcgtctgctgaccttcgtgctggcgctgcccagcggggccctctgca

SEQ ID NO: 661110 - DNA, 3022 bp, Homo sapiens
  misc_feature (695)..(695): n is a, c, g, or t
  misc_feature (707)..(708): n is a, c, g, or t
  misc_feature (710)..(710): n is a, c, g, or t
  misc_feature (712)..(712): n is a, c, g, or t
  misc_feature (750)..(750): n is a, c, g, or t
  misc_feature (831)..(831): n is a, c, g, or t
  misc_feature (871)..(871): n is a, c, g, or t
  misc_feature (888)..(888): n is a, c, g, or t
  misc_feature (908)..(908): n is a, c, g, or t
  misc_feature (911)..(911): n is a, c, g, or t
  misc_feature (916)..(917): n is a, c, g, or t
  misc_feature (969)..(969): n is a, c, g, or t
  misc_feature (1006)..(1006): n is a, c, g, or t
  misc_feature (1011)..(1011): n is a, c, g, or t
  misc_feature (1108)..(1108): n is a, c, g, or t
  misc_feature (1124)..(1124): n is a, c, g, or t
  misc_feature (1133)..(1133): n is a, c, g, or t
  misc_feature (1143)..(1143): n is a, c, g, or t
  misc_feature (1147)..(1147): n is a, c, g, or t
  misc_feature (1152)..(1152): n is a, c, g, or t
  misc_feature (1178)..(1178): n is a, c, g, or t
  misc_feature (1183)..(1183): n is a, c, g, or t
  misc_feature (1186)..(1186): n is a, c, g, or t
  misc_feature (1189)..(1189): n is a, c, g, or t
  misc_feature (1209)..(1209): n is a, c, g, or t
  misc_feature (1212)..(1212): n is a, c, g, or t
  misc_feature (1215)..(1216): n is a, c, g, or t
  misc_feature (1226)..(1226): n is a, c, g, or t
  misc_feature (1229)..(1229): n is a, c, g, or t
  misc_feature (1234)..(1234): n is a, c, g, or t
  misc_feature (1254)..(1254): n is a, c, g, or t
gccgggcttccgcccggtctgccggcaacgctgcggccccgcccacgtcatggcgcccgaggagaacgcggggaccgaactcttgctgcagagtttcgagcgccgcttcctggcggccgctcactgcgctccttcccctggcagagcttagaagcaaagttaagagactcatcagattctgagctgctgcgggatattttgcagaagccctcgggaggctcggtcacactctccaagagcacagccatcatctcccacggtaccacaggcctggtcacatgggacgccgccctctaccttgcagaatgggccatcgagaacccggcagccttcactcacaggtgacctcggggcgcagggcagggcaccgaggcaggcttaccctggtgcagtcacagacacggtcccctttcctcccacctaacaggactgtcctagagcttggcagtggtgccggcctcacaggcctggccatctgcaagatgtgccgcccccgggcatacatcttcagcgactgtcacagccgggtcctcgagcagctccgagggaatgtccttctcaatggcctctcattagaggcagacatcactgccaacttagacagccccagggtgacagtggcccagctggactgggacgtcgcgacggtccatcagctctctgccttccagccagatgttgtcattgcagcaggnaatgccagcccnngnantctgtgcaggcggtgtccttgcagctctacccagtctnggtctgggaaaagggaacaatggatgctgtcaggcatggacatgatggggcttccagaagagttactctgggcctccaggntgacatcaaaggacaggggtgcctcttaaggtgaccttcnagccacagccctcttgntggagacaggcatactcccnttncagtnntcaccacatggctctgtcccagagccatgccctgtgtccttcagagaccacnggaggaaaacaaccacttctgggatgaggacagggcncttgngagaaggtggtgtttggctgggccaccaaaacccctcacccctgccagcacactcagtcccctctctggtggaacagagctctgcctgtggtcctgngtcccagccctgaaanccacaggtncagcggtggncagngacanaggcccacccctcaagccagcagacnaatcngcnganacctgaaacacgaagttcanggnagnntcaggctttntgncattnaaagccctctagataggccnacgtgctgtattgcccagaagccatcgtgtcgctggtcggggtcctgcggaggctggctgcctgccgggagcaccagcgggctcctgaggtctacgtggcctttaccgtccgcaacccagagacgtgccagctgttcaccaccgagctaggccgggctgggatcagatgggaagtggaagctcgtcatgaccagaaactgtttccctacgaagagcacttggagatggcaatgctgaacctcacactgtaggactcacacacgactccaacgggattgtgagaatcaagtcactctcatgggaagaatttttatatgggaaagcggataaaactttcattggactggaatgtttggagaatgttaatttccaaatcaggaaccacaaactgccctctaataagacatcggctatctaagcgtgtgggtgccccctttctgccagcagttctggttcttaagaaaatcaccataaatcagacatgaaaattctggctccaaaaatagcattttctttgtgcaaataaaaacgtgtgtatcaagtatgatgttcccccaacgtggacacactcgttcctcacaaagccaagcccgctgcagctgccacatccctgggcttatggtgcagcaggtgcttttttcaagacaggaatcaaagtgttaggaacacggcagaaaggtgacacctggagaccaaatgcaggatgaggagtactgcagaggtcacagggaagtcacagaacagtaatacgctagcaggggcatggggcatgaagaacagaagacaggaagcgtttcagagactccaaagaagaaatcagggccaaccacagcttcccgggtcacagaacaattcattcaccaggtggcaccactgccgtcatttcagcttctggccactgggaggcgctgctcgaaagggtttgccctgagactccaagaagaagctgcgggaaggacagcaggggccctggggttttagcctctggcccaggagttatgtgtccataaccaaagggagcacagtctgcacccagctctcatcccatcagagctgctgcgactcccgcaggttcttccggaactggtttagcttgcctgcaggatcaggaaagtttgagaaaagcatctgcaaaatactaaagagcagagcttacctcattgcctgtccccaccccatcccaggtcaccacctggctgaccccaggtccccgacccaacaacaacccctcccaagtccctaactccctcacttggactcgagacccttcacaccccagcagcactccgcctccaacttgacatcacagtttctggaaacttccccgcatgtcccactttcccacacttggtgccctggagcacctcccggcctctacgtgctgcccattcccctgtgagcaccctcctctcggcctctggccaacacagtcccacccatctgtgggtaacaagggggtgtcggtgttcttttcagccttgctaaactgtctgaatcaaggatcacaaactacagcctgcaggccaaatccagcccacagcctgtgtttgtaaataaagctttattggaacaaagccacaccccttaatctacagatgatctgtggctactttcacaccacaacagagtaccatggttctgacagagactgggggaccctgtctaaatgacttctgacctggacctttactgaaaatcctcccaatcattctgttgacaagaatgatgtattactttttgcaataagaaacaagtaacctttgcaaaa

SEQ ID NO: 661111 - DNA, 3105 bp, Homo sapiens
  misc_feature (695)..(695): n is a, c, g, or t
  misc_feature (707)..(708): n is a, c, g, or t
  misc_feature (710)..(710): n is a, c, g, or t
  misc_feature (712)..(712): n is a, c, g, or t
  misc_feature (750)..(750): n is a, c, g, or t
  misc_feature (831)..(831): n is a, c, g, or t
  misc_feature (871)..(871): n is a, c, g, or t
  misc_feature (888)..(888): n is a, c, g, or t
  misc_feature (908)..(908): n is a, c, g, or t
  misc_feature (911)..(911): n is a, c, g, or t
  misc_feature (916)..(917): n is a, c, g, or t
  misc_feature (969)..(969): n is a, c, g, or t
  misc_feature (1006)..(1006): n is a, c, g, or t
  misc_feature (1011)..(1011): n is a, c, g, or t
  misc_feature (1108)..(1108): n is a, c, g, or t
  misc_feature (1124)..(1124): n is a, c, g, or t
  misc_feature (1133)..(1133): n is a, c, g, or t
  misc_feature (1143)..(1143): n is a, c, g, or t
  misc_feature (1147)..(1147): n is a, c, g, or t
  misc_feature (1152)..(1152): n is a, c, g, or t
  misc_feature (1178)..(1178): n is a, c, g, or t
  misc_feature (1183)..(1183): n is a, c, g, or t
  misc_feature (1186)..(1186): n is a, c, g, or t
  misc_feature (1189)..(1189): n is a, c, g, or t
  misc_feature (1209)..(1209): n is a, c, g, or t
  misc_feature (1212)..(1212): n is a, c, g, or t
  misc_feature (1215)..(1216): n is a, c, g, or t
  misc_feature (1226)..(1226): n is a, c, g, or t
  misc_feature (1229)..(1229): n is a, c, g, or t
  misc_feature (1234)..(1234): n is a, c, g, or t
  misc_feature (1254)..(1254): n is a, c, g, or t
  misc_feature (1462)..(1462): n is a, c, g, or t
gccgggcttccgcccggtctgccggcaacgctgcggccccgcccacgtcatggcgcccgaggagaacgcggggaccgaactcttgctgcagagtttcgagcgccgcttcctggcggccgctcactgcgctccttcccctggcagagcttagaagcaaagttaagagactcatcagattctgagctgctgcgggatattttgcagaagccctcgggaggctcggtcacactctccaagagcacagccatcatctcccacggtaccacaggcctggtcacatgggacgccgccctctaccttgcagaatgggccatcgagaacccggcagccttcactcacaggtgacctcggggcgcagggcagggcaccgaggcaggcttaccctggtgcagtcacagacacggtcccctttcctcccacctaacaggactgtcctagagcttggcagtggtgccggcctcacaggcctggccatctgcaagatgtgccgcccccgggcatacatcttcagcgactgtcacagccgggtcctcgagcagctccgagggaatgtccttctcaatggcctctcattagaggcagacatcactgccaacttagacagccccagggtgacagtggcccagctggactgggacgtcgcgacggtccatcagctctctgccttccagccagatgttgtcattgcagcaggnaatgccagcccnngnantctgtgcaggcggtgtccttgcagctctacccagtctnggtctgggaaaagggaacaatggatgctgtcaggcatggacatgatggggcttccagaagagttactctgggcctccaggntgacatcaaaggacaggggtgcctcttaaggtgaccttcnagccacagccctcttgntggagacaggcatactcccnttncagtnntcaccacatggctctgtcccagagccatgccctgtgtccttcagagaccacnggaggaaaacaaccacttctgggatgaggacagggcncttgngagaaggtggtgtttggctgggccaccaaaacccctcacccctgccagcacactcagtcccctctctggtggaacagagctctgcctgtggtcctgngtcccagccctgaaanccacaggtncagcggtggncagngacanaggcccacccctcaagccagcagacnaatcngcnganacctgaaacacgaagttcanggnagnntcaggctttntgncattnaaagccctctagataggccnacgtgctgtattgcccagaagccatcgtgtcgctggtcggggtcctgcggaggctggctgcctgccgggagcaccagcgggctcctgaggtctacgtggcctttaccgtccgcaacccagagacgtgccagctgttcaccaccgagctacgcctgtcctagcagccccacacaatacgctcatgtcctgtccccaaacaccgccatcntcaaacacatgtgctctgtttccaggccgggctgggatcagatgggaagtggaagctcgtcatgaccagaaactgtttccctacgaagagcacttggagatggcaatgctgaacctcacactgtaggactcacacacgactccaacgggattgtgagaatcaagtcactctcatgggaagaatttttatatgggaaagcggataaaactttcattggactggaatgtttggagaatgttaatttccaaatcaggaaccacaaactgccctctaataagacatcggctatctaagcgtgtgggtgccccctttctgccagcagttctggttcttaagaaaatcaccataaatcagacatgaaaattctggctccaaaaatagcattttctttgtgcaaataaaaacgtgtgtatcaagtatgatgttcccccaacgtggacacactcgttcctcacaaagccaagcccgctgcagctgccacatccctgggcttatggtgcagcaggtgcttttttcaagacaggaatcaaagtgttaggaacacggcagaaaggtgacacctggagaccaaatgcaggatgaggagtactgcagaggtcacagggaagtcacagaacagtaatacgctagcaggggcatggggcatgaagaacagaagacaggaagcgtttcagagactccaaagaagaaatcagggccaaccacagcttcccgggtcacagaacaattcattcaccaggtggcaccactgccgtcatttcagcttctggccactgggaggcgctgctcgaaagggtttgccctgagactccaagaagaagctgcgggaaggacagcaggggccctggggttttagcctctggcccaggagttatgtgtccataaccaaagggagcacagtctgcacccagctctcatcccatcagagctgctgcgactcccgcaggttcttccggaactggtttagcttgcctgcaggatcaggaaagtttgagaaaagcatctgcaaaatactaaagagcagagcttacctcattgcctgtccccaccccatcccaggtcaccacctggctgaccccaggtccccgacccaacaacaacccctcccaagtccctaactccctcacttggactcgagacccttcacaccccagcagcactccgcctccaacttgacatcacagtttctggaaacttccccgcatgtcccactttcccacacttggtgccctggagcacctcccggcctctacgtgctgcccattcccctgtgagcaccctcctctcggcctctggccaacacagtcccacccatctgtgggtaacaagggggtgtcggtgttcttttcagccttgctaaactgtctgaatcaaggatcacaaactacagcctgcaggccaaatccagcccacagcctgtgtttgtaaataaagctttattggaacaaagccacaccccttaatctacagatgatctgtggctactttcacaccacaacagagtaccatggttctgacagagactgggggaccctgtctaaatgacttctgacctggacctttactgaaaatcctcccaatcattctgttgacaagaatgatgtattactttttgcaataagaaacaagtaacctttgcaaaa

SEQ ID NO: 661112 - DNA, 117 bp, Homo sapiens
ctccagcttgtaaagaggaagttaaggtcgaagatgaaggccccatttgcttttcgggggggggtcctcggcggcttttatttaaggcttgctcagtttaacagcccaaagacagga

SEQ ID NO: 661113 - DNA, 1975 bp, Homo sapiens
gccgggcttccgcccggtctgccggcaacgctgcggccccgcccacgtcatggcgcccgaggagaacgcggggaccgaactcttgctgcagagtttcgagcgccgcttcctggcggccgctcactgcgctccttcccctggcagagcttagaagcaaagttaagagactcatcagattctgagctgctgcgggatattttgcagaagacgtgctgtattgcccagaagccatcgtgtcgctggtcggggtcctgcggaggctggctgcctgccgggagcaccagcgggctcctgaggtctacgtggcctttaccgtccgcaacccagagacgtgccagctgttcaccaccgagctaggccgggctgggatcagatgggaagtggaagctcgtcatgaccagaaactgtttccctacgaagagcacttggagatggcaatgctgaacctcacactgtaggactcacacacgactccaacgggattgtgagaatcaagtcactctcatgggaagaatttttatatgggaaagcggataaaactttcattggactggaatgtttggagaatgttaatttccaaatcaggaaccacaaactgccctctaataagacatcggctatctaagcgtgtgggtgccccctttctgccagcagttctggttcttaagaaaatcaccataaatcagacatgaaaattctggctccaaaaatagcattttctttgtgcaaataaaaacgtgtgtatcaagtatgatgttcccccaacgtggacacactcgttcctcacaaagccaagcccgctgcagctgccacatccctgggcttatggtgcagcaggtgcttttttcaagacaggaatcaaagtgttaggaacacggcagaaaggtgacacctggagaccaaatgcaggatgaggagtactgcagaggtcacagggaagtcacagaacagtaatacgctagcaggggcatggggcatgaagaacagaagacaggaagcgtttcagagactccaaagaagaaatcagggccaaccacagcttcccgggtcacagaacaattcattcaccaggtggcaccactgccgtcatttcagcttctggccactgggaggcgctgctcgaaagggtttgccctgagactccaagaagaagctgcgggaaggacagcaggggccctggggttttagcctctggcccaggagttatgtgtccataaccaaagggagcacagtctgcacccagctctcatcccatcagagctgctgcgactcccgcaggttcttccggaactggtttagcttgcctgcaggatcaggaaagtttgagaaaagcatctgcaaaatactaaagagcagagcttacctcattgcctgtccccaccccatcccaggtcaccacctggctgaccccaggtccccgacccaacaacaacccctcccaagtccctaactccctcacttggactcgagacccttcacaccccagcagcactccgcctccaacttgacatcacagtttctggaaacttccccgcatgtcccactttcccacacttggtgccctggagcacctcccggcctctacgtgctgcccattcccctgtgagcaccctcctctcggcctctggccaacacagtcccacccatctgtgggtaacaagggggtgtcggtgttcttttcagccttgctaaactgtctgaatcaaggatcacaaactacagcctgcaggccaaatccagcccacagcctgtgtttgtaaataaagctttattggaacaaagccacaccccttaatctacagatgatctgtggctactttcacaccacaacagagtaccatggttctgacagagactgggggaccctgtctaaatgacttctgacctggacctttactgaaaatcctcccaatcattctgttgacaagaatgatgtattactttttgcaataagaaacaagtaacctttgcaaaa

SEQ ID NO: 661114 - DNA, 326 bp, Homo sapiens
aggatcccctgctccggcccactctggcctgattttaggttccctggggatgaagaaggtataggcggtacccttgtaaggtgctacgaggctgttcggccaattacggtgcacagtatcctctgagctgtttggattgtcgtagttgatcacaactctggagatcttccacatctagcccacgggaggctacatctgtagcaataaggatgggtgcctttccagaacggaactcattaagtacccaatctctttctggttgactcttgtctccatggatacacatagctggccaaccatctctgcgcatccttcgagtcagatca

SEQ ID NO: 661115 - DNA, 348 bp, Homo sapiens
cgtcgacatgaatctcttccatgaagacactgcacggttctctagtaacgcagagactcgggtaagacctgaagcaggagcctctattgtcaactctgggggtactttaagtgcttatcagatcgtatgcctcgtattacttcaatttccagtgtactgattgcctcatacagtgagaaggcttagtgtttcctatttaacaattatttcccaaatgcgttaaccaacacaaacttgcaatagttatgcgtccccctcagcaggccaattgtctgtgcctcctatcatttactacggagcaggttactgctgctgttcctgcctgtgtgatgctgtgcttccgtcgac

SEQ ID NO: 661116 - DNA, 164 bp, Homo sapiens
agaattataactaagggtccttaggccaaaccccaaaattataacgagaacacaatcattaagtatttgtacattcacctcagtcctgaataatagcctacctgccactatacactctaaccaccgtgctatgtgctgagatttgggcttgccaaccatcgtct

SEQ ID NO: 661117 - DNA, 179 bp, Homo sapiens
ggctacgagaagacaatccatatgcagcaacacaaagcaaagtccagccaagatccaagaacgaacgatgatgcgaaataatgacaagagacgtgcaacgacaaatgcattgacggacgtagttaataacatgattcaagcaagaattcggaacgcaatagaaacgcgattcaagtcaa

SEQ ID NO: 661118 - DNA, 372 bp, Homo sapiens
gaccccattagcctcgctgtggccaggccaggagaagcccctcagtgtgaggacacaggagcactcagccccaggcagacccacaacctgttccagggccaggactgttccttcctgcccctagctccttccctgtctctctgtcccagtgcagttaatactggatgtttctgagtcaccagctggagggagtgtggcccttcagcctggtcaggggccccccagttggggtgggtggcttggctcatgacctcggtggaggggcccctgggcaccctgctggtggcaggaggaagccagagtggccccagaaacactccttgaagagccaataaatcacaagccccctctgcctacccccaaaaaaaaaaa

SEQ ID NO: 661119 - DNA, 148 bp, Homo sapiens
gatcagtacaggacgttggtcgatgtacctcgcacttcagttaggagacaggccatgcctttcaagtgcatctgtcactgatttcatcctctagtttccgcacagtgcccaccataagtatgtcctacaagcctggcagaaggcagac

SEQ ID NO: 661120 - DNA, 713 bp, Homo sapiens
  misc_feature (713)..(713): n is a, c, g, or t
aaataagtgattgaaaaaggggaagagaacaaaaaaaaaaaaaaaaaaaaaaaaaataaaaaaacaaaaaaaacaaaaaaaaatataaaatcaaacaagcaaatgcatgacggacctgtttttttgtggggcatccggcgtgccttgggacccccctgggttttccccaccttaatctctctttcagccgatcccctctttccctgtttggccattttccgctttggcccgggccgttccgccttttccaccggtggcgccttcttgattggcgttgggtattagcacgcgtttctcttttgtttaattgcgcggttaccttttgccttctcggctccttttttaaccattggggccttcctcgcgggtttcccttttttttcgagggatctcccctgtgtttggttcctttgttgtcccttttgttccattgttccccttcacagatcgtgtccaccaccgttttggccaaatactctctttttgggctttgcccctcttggtcatttttgcttcccattttcttggtgtcgtggcccctttatgccttatatccccctttaaaggtgccccctttttacgttgtcgggaattgcccctaagggcggtatatagtacgttttacctcattgttcatggttttgggggcgtgcttttccgttttctttgttttatcaccacccgcccccttatggtccgcacgggtccgccgn

SEQ ID NO: 661121 - DNA, 976 bp, Homo sapiens
cagtcgtgggcggctcggacagaggagccgcagggagcccgccggcgcgggtgctcacgcggggtgccaccaggatggggggtcacctgcgtacgaggggggttataaggggaggacgacggggtcgctgaagaacaccaacgggtgtgtaggggccagcgcgtgtgtcgaacgtggtggatgccagtgagcgaaggcgctggtgcgcaagggagaccacatcctgggccccgcggcggattaaaatactggggcgggggggacagccttaaccgcgcatcgtgggagcctgtggaccaactgggggcgttcttaaaaaaatgggctggacctatcggccgtattgccgtctcaaggagacccgccgtcgtccttgggggggtgtgctgcgaaaacccttccgtttgtagcaaagatgctgtgtcgccaataagaaagccggttccccgcaccggctgctaggaaccccgtggtctcgcccctctctcggattgggggcctgtaattcttgtggcacgtgccgtcgtggggtgcatgtgtctaccgccccctgcgtggttgggcacacccatttagtaacattgtttccgtggttaatggtccgccacattgatccacgacgtggacgccggggaaccggttggggtgtgcctcgcctggaatgctccacgacgccctcgtgagggcattagcagggccgctctcacaggaggccggaggggactcgagcgcgccctctctgtgtgaaaactacggcgagaaacccacctctggttttcgcatggaaagaccgcggagaataatacactccggcgcagaggggcacagggccgcttcgcccccgctcatgaccgagacggctagggagcccgagggaggaacttgaagacccaccacgggatccgggggcttcacgcgggcccgaagcgcccccctcccatcccccccgggggggaacatttttccccaacaagac

SEQ ID NO: 661122 - DNA, 102 bp, Homo sapiens
atcatatacttaaatatgagtgtaattgtctcataatgttacaaaatgcccacagcctcttacccagagccttttatatggctgcaaaaattagaaattaag

SEQ ID NO: 661123 - DNA, 261 bp, Homo sapiens
gatgaccggactgtgtgccgggagatccgccacaactccacgggctgcctgtggatgaatggaccagtgtgacaatgtgcctgggagatcttgtcttgtggactgttccaccaagcaacccctcccaggctagagcttgcggcgtggagctcgcacggaatccctccagggtctgctgagatggttgaccacggaaaatacaagctgagcttgctaaatgtcactaccatgtgggaatgattgctcaagcgacctcactcc

SEQ ID NO: 661124 - DNA, 338 bp, Homo sapiens
  misc_feature (2)..(2): n is a, c, g, or t
  misc_feature (175)..(175): n is a, c, g, or t
  misc_feature (255)..(255): n is a, c, g, or t
  misc_feature (271)..(271): n is a, c, g, or t
  misc_feature (332)..(332): n is a, c, g, or t
cngttcgacgacaccctcggctcgctcaccgcgcgcccgggcttcttacggctctatggcaacgactcgctcaattcgaccttcacccaatcgaccgtggcgcccgctggcagcacttcgcttccgggcagaaacgcggatggagttctcgccggtgcacttccagcagaggcgnggggctgacctgctactacaacagcaaaaactggagctactgctttgtggactacgagggggggcccggtacccaatttngccctattagtgagtngtattaacaattcactaggccgtccgtttttacaaacgttcgtggattgggggaaaaaccntggggg

SEQ ID NO: 661125 - DNA, 88 bp, Homo sapiens
ttgcgggtcctccttcacagccgctgagcccagaggtcccgctggcccctcctctgaagttttaggatgtcattaaaaagatgaatct

SEQ ID NO: 661126 - DNA, 1241 bp, Homo sapiens
ctggtggtgctgctgtcctggtggtgctgctgtcctggtggtgctgctgtcctggtggtgctgctgtcctggtggtgctgctcctcacacagccccgcctccatctgcagcttggtcacgatgcgttgaagacactccagcctctcaaactcgctgcggagctgcttctcccgctccaggatggccacgtgcagcttgccccactccttctccacatccagcgggtggtagccagggggcaccttgagctggcctgcttgcaccgctccctccagggattggtagatgcccttggacctgttcttgtcggcctccttggctggtagctccatctccttaaacttcaggaactgagaccacaggatctcaatctcctcgaagctggaggggaacctgcgttcctcaaaggcggccgtgtggtgtcgcatccactgaagcagcagcagcaccagctcccggtactcctgccagcgcagctgcagctcgttggccctcaccccatcctgcacgtccggcacgcggggcatggcgtcatacagcgacgagacgtaggtgatgatggacttctcgtcgggctgagggacatccacgtcctcagggtccaggagccgcgtcactcccaggtcccgctccgccacagagaaggcctggtccaggttctccaggttggtctgccggtacaccttgttcatgtcgatgagcaggggcttgtgccggtggatgatggcattgaagaggcggccgtctctccagctggaggtgaagttgtcgcatcgcaggccctggtacccctccaccattcgctgcgaccacagcagcagcttctccttggccgtcatgtcctccgactgcccactcacctggatatctgagatctggaagtgcagaatgatggtccagatgaggccaagggtcagcttggggttgccgtcagcgatgtcatcattcctgatgttcaccagcttcacctggcggtgccggaggtagtccagggcaatctggacattctgcagcttgtggaaacgcatcctccccttctcccggggcaggctgtcccccgagaggacctccagcagggagatgaggttgtggccatcgcggaggtcttcatacaggtcactgatgtgcctctgggccttgatgaggtgcttgttgacccacttggtgaaggttttcttctgcacacgatcccgctcatctgcgatgcgaatgaccgcccgctcagctgggtccaggacact

SEQ ID NO: 661127 - DNA, 1307 bp, Homo sapiens
agcggattctggcctgtcaggtcaaagacactacagcgagggaccagactccgcgacaccaccttgtctcactatctattctgccagggccccactcatgtccgcgggcctcctcgcaagagtaccgagcctcatgtacatagaaagccttgcccgtgtacccatggaggcacatgcaggagtcgaggtttgtgctttgatgccatgatggagaatagatccgtgttggatcttatccgtagggacagctaagcctcgtatggataccagtgatcccctcctggtacccctctagtgcttacccaagcttgtgggcctactagacaaagtgcctatgtgggcacccctcataatggacacgctgcgcgttggaggagagtaacctgctcttgactctccgaacatgggcaacacatgtaactacagatggcgcaccgacccacacgtaccccatcgagctcaaacctgcactgtaacacttggaagtgagccctcactagtttacccccctgcggcgactggtcaacatccgtcgaaggcggcaaccctcgcttcccaactcagtgcgtccgtcgaactaaactttttcgagtccgtgtcatcacgcgtacgggctgcagccgcatccgtttcaactcattaccccggtggtgaaaccccaccctcggaagctagctaccgatctccccaaggaggccgtagacgccggttagagtgtaagtcagcacaaaagtgggaaatagagcgcgtggacgtttaacacatacccaccggggtaaccttgcaaatggaaaccactaaaaccctaacataggccccaacagagagacacacaggcggacagcaagagacgccgaaaaagagtaggaaaccctactttcgggcacgagaaagcccacgtcggcaacaactcctggggaccctacaattctagacaatggcactgcgcccgtacttagcgacccaatcggttgcactggaacctcctggccacagaaacatcgcaagccctctactaaacatgccacgtcccagcgcgctcgcttaccaagctcatagaatgttcctcaggatcacaataggccaagcaacactacattggtcatatacacgccgactgacatgccccacaacgatcacccaaccagaagttctcgaaacgcattagcgcgtcgcgaaatggcaaagtgcagagtgccctattgccaaccaagtttcttgggggcccctcgaccgacccccggatcagtactcgcagtggaattcgcttgagttaccccttagacgagcgcaaggaaagcgctcgg

SEQ ID NO: 661128 - DNA, 332 bp, Homo sapiens
ttgtggaagacgggtagacgggccaccagcccccagaaagccgggctccacggtcttggggagctcccgtgccgctgcagccggcaggcacagccactcaccaggcgtgagctcctgcttacgtcccgctccctcggcaggctgtcccccgagaggacctccagcagggagatgaggttgtggccatcgcggaggtcttcatacaggtcactgatgtgcctctgggccttgatgaggtgcttgttgacccacttggtgaaggttttcttctgcacacgatcccgctcatctgcgatgcgaatgaccgcccgctcagctgggtccaggacact

SEQ ID NO: 661129 - DNA, 468 bp, Homo sapiens
ggaggagtcctcccgttgacaaacgcccgcgcgtccgtggcctgatgtcggcaccccccagcctgctggtctggccagtgggtgcgaaactggcagctgtgccgcgccctttaacacctacccgagtggctgacacggaccacccagtccctgggtgtgcccagtgtgtgagcctcatgactgatgcccctaactgggccattcagctgtgggtgtgcctggccatgccccagtcctcctcctcctcctccctggcctcccaccccgacgcccgcatcgtgcccacagcatccatgtagcctggctgcgcaacccccacggcctacaccagtcaccaaccaccaccatctccaaacacccgccacccaacccccctcaaaagtgcacaccacctacactatcgcagtatacgtgccacaagcacacgacacgacccgacacaccgcacacaccccccaccacccacct

SEQ ID NO: 661130 - DNA, 409 bp, Homo sapiens
atatcacttctgtctctatggattgcaactctggacattgtataaatgatgctttcagtttgctcacatattttaaatgtgggttggatgtctgctcacttgagcaggtgcggctaatgcttatacgttctactcattaatcctaataaccaccccatgaggtagatagtgtgttatccctatttcacagatgaggaaaccgtagcaccgagcagttaggcaaatgggacagagtcatagcagcactgggcaggtacgctataaagcctacactccatgtgtaagctgggacctctctttaagggagcaggcacttggtggcttgcaaacatgctcatcaagtttattcttttattctttgggttagggtgtgggtgtgtgtgtgtagatatagaagagtgcacttttg

SEQ ID NO: 661131 - DNA, 140 bp, Homo sapiens
ttcgctaggtagaggccgggttaatcggccgaggagagacagagagctgggcacaagtaattccctcctggtcccagacagtctaagaggcacagatcaacgcagaaatggacctggaattttccaatgacatcaagaaa

SEQ ID NO: 661132 - DNA, 1648 bp, Homo sapiens
  misc_feature (965)..(965): n is a, c, g, or t
tcaagcttttgttccccccatggctgcgcgggtggtcgcctacccccgcttggtgtctcccccgctcgtagtgctaccgcgggcggggcgtccactcctccgtcgtgttttttgcctgtatggccgcgcgggggcggctgtgttgactactattttctgccaagcaggaggggtgagcatggttggtggcgcacactgtgggcccttcttttttggtgtgccaccccctcgttggtggcccgcggactggtgtgtggctcgcgcgaatagcaccgcgcgtgtgttgtctcacccgctgtgtccgcggtgaatgttttctccgccggggggttgttttagttgtggtccacacccagagtagttgtcgctcgctggttctcgtcagaaaggttgttgtttgttgtgtggtgcgactgcgcgtcgccgcacggcacactctctccttcctggtggggcgcgacgcatgattgttgtgttgtaggatgggttcttcttggcgtcggcgcagcgcgtggatcgtttttggtgggcccccccttcgcgggtggtggtgcgttatcatctgtcttttgctttggtgtgtggccgacccccgctgttaggtgtggcgtcggccccctctgcagtccggtggggcagctcttgtcgtgtgtgtgtttgcccgcgcccgtagtattgtgtcatcctcgtcgtcggagaggcgacttcccttcgtgggttgtgttaacagcgctggtgcggcagcacagtcgtctggttgttgtgcatcacgatgcgtggtgtttgttgggtggcacacgcccaccgtcgtggtccccccgcgctctagtggtggtgtcccctctcgtctctctcttgttaggaggggaggccccgcgtgttttatgttgcggccccccgcaccatcatatagtaggaggagagcggtcttcttcttctcttctcctcccctcggtgttgttttnttcccccgctctcttttttctttcgtcagagggggtgcaacacacccttcgttgggcgacgccgataagcactgctttcgccccccgctgctatgattcgcatcttctctcctcctttctctgattgtgtttctctctcgcgcgcgggagtatagtatctgatacacctctgtgttgtctctcgcacgcggcacacaacactgttgttactcgcgcgcgctctttctctcgcgggagtgtctcgccccgcgcgcgtttttctctctcgcgcgtgtgtctccccgcagaggcgcgctgacacacccccactgtgtacacctctctcttctctctctcctctggtaggcgcgctctctctctctcttcttctctcttaccaccccgctctatatatattatatatataattttctctctgtagtattttgtagagacacactctctctctcttctctcgtcgaagcgccgaaaattctctctctatatatagttagagagaaggacccctccctcatacccgcgggggagacaatatagttggagaggcccccccacccctccaccacaccactctagagaacccccagatatacacatataaatattatagagcaacaaaaagagagaagagagagtcgaagccccccccaagacgggttttcacccccccccccggccccaca

SEQ ID NO: 661133 - DNA, 88 bp, Homo sapiens
atcagcgcgcgacattcgggtacccgcgcccccccctccgtcggaattcctcgagccgggatccataggatgtggagttagttttgtt

SEQ ID NO: 661134 - DNA, 232 bp, Homo sapiens
gttcccccacctctgatccttccagtacatggatcgggctcccctgctggaggtcccaaatcatgatggtcccatcttcatagcctaccacagctctcttccctgcagagaggcacacgactaagacgagggcagagggcacgctcacatacactcagcaacgggaatggggagagggacgacggaaagaacgagtggcacgggcccgggcactgcgccgccgggaaagaca

SEQ ID NO: 661135 - DNA, 1470 bp, Homo sapiens
  misc_feature (138)..(138): n is a, c, g, or t
agtctcggagagagcgccccccgtgtggggtgcttttaataaacttatgtggggtcccgcggcggccgattctaccaacaaacagcacgaccaggcgcgggtgtgttttgtcctgcggtggctgccccccctgcggtngtatgtgatagtgccatctacccgcggggcctcgctccgacgtggagtaggactcttttttgtgggggcagccgcccccccccccccggggggaggtaatgatggccgccctcctttttggggggggacaatacatatcccccccgttgggagagcgccctcgtggccgaacaagtacaggccgcggagtagaaagagctcgtgctgggaaggagaagacccgcacgagagaaggggcccccacgcgcgtggggagaggaagtgtcgtggggacacaccagccgcggtgtcacacatggggtgaagcgccccaccatgcgagagagccttcgtggcagccgcagcctcctcgtggggtggtgccccccgcaacaagggcgcctacagcggcagcggtagaagagtggagtaggcgcgccccggtgttcatcaccccgcgcggctggttgcaacacgcgcccggcggcgcgccccgcggagaattgaccccacgccgctcttggtgggcccttctcccggcgtgctccccgcgtatacctgcgccgcctcgtcttctcgcttctccggcgcgcacacaccatggagatatatgttcgccgcacgcagaccgcagcacaccgagaaaataattggagagagacacaccacacacgccactcgccgcagcagggagagtccacccacatcggcgcgtgagaaaatggtggcccacagcaagagatattatacgcgcacatggtgaggaaccaccgtcggcgaggagattgatccccgcttccccacacaaccacacgcgagaaagcaacacacatgagaaaaggggcgccacccaaggggggcacaaccgcccgcgcgtctctatagagaatggctccacagagacaccacagccgcgggtgtgcacctctatagggggcgctcgcgggagaggccacagcttggggacgcgctctatattgaagtgtaacaagagaacacgcgctcgcttgtgccgctatacacacacccggcagagttctgccccctctctctcgcgaaccacgcgggagacctcaccctcttccgccgcacacgctggtttctcgagagggttctcgcacttcttatagaggggtgaagggctctgggcgcacacatccgccaccactcgtgcgcctctttcctctctggcccctcgctgcaccccaccacaccccaactcccgcaagggccccaccctctggggaaaacccggaagaaccctctcgctcccctttcccccccttagtgctcttctcttgccctggatccccgcgccagaagactatgtaaagggaataaagagaaaagaag

SEQ ID NO: 661136 - DNA, 394 bp, Homo sapiens
gcaacaccagtaagcagcagcagcagaaacatcagtatcagcagcgtcgccaacaggagaatatgcaagcgacagagtcggaggcgagccccccactccctgaggaggacctctctaaactcttcaagccccaccaggcccctgccaggatggattcactgctcattgcaggccagattaacacttactgccagaacatcaaggagttcactgcccaaaacttaggcaaactcttcatggcccaggctcttcaagaatacaataattaagaaaaggagcctcctgagaaggcgttgagtagacagactgttgagaggccacagagtgcacttggaaaaactcatttctgtgctgcaaagcaatggtggggaggcgcagtgccgcgactgctgta

SEQ ID NO: 661137 - DNA, 588 bp, Homo sapiens
gcttgcagttggatctcagattgctgtgctagcaatcagcgagactccggtgggcgtaggaccctccgagccaggtgcaggatataatctcgtggctgcgccatttattaagccggtccgaaaggcgcaatattcgggtgggagtgacccgatttgtccaggggtgggatttcatcccttactgggtctcaaccaaaatattcctgttggaactcagtgatgataatcatagcagcactttgcacagcatcagcaggtcatctcactagttatgtccaaaaacagtacatggactatatcgcacaacaggtgccagtctgagaaggcccaacaggagttggcaacaggtgtgatgtccaacaaaactgtccagaccgcagctggcaaaatgcgcgcgttcaactgcagcatctagtgcagcctcagaactgcttacaagggtaacgcagattcagagaatccttcaacacaattacacctgtcacctttgggaacctgtaccatgtggttacttaccaagtttaccatgataactttcttaccccacagagctcattttctccacaactcgcgtttcccaaacagacc

SEQ ID NO: 661138 - DNA, 1289 bp, Homo sapiens
ctggtcttcagtattcccaggggagcaggggaacaaggtggggctgggatgtatacctagttccggcttctatgtgggatggagttggggtatagaaagttaagcagagaagatgtttccaccaagcctggtgtgagtcaatgagggagtgttgcggggtcccaggtagacgttgtgactggggggagtttgggtaacgactaggatcaggaacagtgccatatctacgggtgtaccgtgtgcacggactaagcgtcaacgatcatcgaggtcgctaggggaccatgcgctcgcattgtctccctgaacccctagcgtgtctaagttctccgaactctgtgaatacactcgactagggtgatgttgactaaaacagcggctatctcacggggtatcgaagtcggcacggtcagagcgaccctagacgtctgtgctacttccgaggaggcagcaagcgagctagagacgggctcccgaagggtgccttttgtgaggacaaaacgcgtgtggtggactagtccacattgggtgtagcagctaacgacatgcaggcagagccgcagcagcgtcccatggccttccatccttgccgagcgttctatcgtccatgctagcgatctgctgggtgtctagaggaggaattaactgtccgtggtctgtgggcctatgtctgagatagaatatccagatgctgcgtcctcactgcacgccagtgtctcagcctcctctcatgatcttaccgtctttctgcatcacgcctgagtaccaagagccactcttgtccctaggtattacaggttggaagaagcacttgatgtggactcacgtatggacaactgagcatttcgggggaacgcccaggacgattgtacagtgaacgctggtcccgtccccaaataggggtgttcccccgaggcatgttaacaccaggtagttgtggaggttgcatggtggtggtcctgagtactagcccttatcgtttggacatcttgggtcacattatgtgcagggccaatccttggggtacacagatctgctcatcaaggaaaccgaggttggcaaacctggagactctgggacagggtacgggggcctaaggtatcgggcaccccgcacaggtagtcaacaaggacacacgaagggaaattcgggccacgaaaaagaacaagtagtgagaagaccgacagtgtgagggacacgaatctagaaacacagtcaagagacatgcgggggaaacaaagaccacagtaccggtgccgagggggaactgagtaataggagaacgagag

SEQ ID NO: 661139 - DNA, 369 bp, Homo sapiens
  misc_feature (76)..(76): n is a, c, g, or t
gattttaacatttactatatatgcctcagatctatcttgatcttgttttaagaaataaaaaataggccgggcgcangatgtcacgcctgtaatcccagcactttgggaggccgaggcgggtggatcaccaggtcaggagagtttgagaccagcctggacagcacagtgaaaccccatctctactaaaaaaataacaaaaaagtagccgggaatggtggcgaatgcctgtaatcccagctacttgggaggctgaagcaggagaattgcttgaacctgggaggcggaggttgcagtagagccaagatcatgcctctgcaatccagcctgggtgacagagcaagactccatctcattacataaacaaacaaa

SEQ ID NO: 661140 - DNA, 228 bp, Homo sapiens
ttctcccgggtgcttgcgtgtgcacgtgtgtgctgcgtgtttgtgtgctgtgcagctgtgttcatgtatgtgctgcgcctgagtgtgtgtgctgtgtgtgcctgtgtgtgctgtgtgtttgtgtgtgtgctgtgttcatgtgtgctgtgcatgcgtgtgtgctgtgtgtgcatgtgtgtgctgtgtgcacgagtacatgtattgtgctgtgtgtgcgtagtagctgtg

SEQ ID NO: 661141 - DNA, 153 bp, Homo sapiens
gcagggatcaagaccgtatcccacggagctaagtcgggtcttagctgttgagccacaatgagaactctgtcatggtttatttttgatgcactctatttattaaagaaaggtgcacaaggagtgcccgtcatggttgacgcggttgacaaaccg

SEQ ID NO: 661142 - DNA, 572 bp, Homo sapiens
gactcggtatggcccaatggcgcgcgggtcacggcttctgacagtttgggtcttgcgccgagtatgtagctaggaaagctagaggttagcgaaagtggtgcagatctcgtgataggagtacaagaggccgtgaagaatcgtggcgcttgtgtccagtaagtgcatgacctgttgaggatcagagatcaatgccggcgtatagtcgaaagtgttgcccgcatgagtagtcagtgctcgggagatcgacagcagcatattgtgcttctactaacgacgggtgaacaggtgcccttctgggctcgagtataaacatgcgtgcactccatgggccctggacctgccgtaatcagttctatggtcgcgtctggtcatatcctgtagctcagcatatgtacagttcccgaggaggacgaaatccaatgacaatccatatgctagtagtacctgtgttggggctgggggcgagctagaggatggactgttgtgtatgagatgcggggattgattatcatgtataatgaatgaagcaatttgtgctttgcaagttggtggaggtggagagactctgttga

SEQ ID NO: 661143 - DNA, 546 bp, Homo sapiens
  misc_feature (144)..(144): n is a, c, g, or t
  misc_feature (165)..(165): n is a, c, g, or t
  misc_feature (206)..(206): n is a, c, g, or t
  misc_feature (270)..(270): n is a, c, g, or t
  misc_feature (310)..(310): n is a, c, g, or t
  misc_feature (423)..(423): n is a, c, g, or t
  misc_feature (495)..(495): n is a, c, g, or t
  misc_feature (545)..(545): n is a, c, g, or t
atgaccccaatacgcaaaattaaccccctaataaaactaattaaccactcattcatcgacctccccaccccatccaacatctccgcatgatgaaacttcggctcactccttggcgcctgcctgatcctccaaatcaccacaggnactattcctagccatgcactnactcaccagacgacctacaaccggccttttcatacaatcgncccacatcactgcgagacgtaaattatgggctggaatcatccggctaccttcacggccaatggngcctcaatattctttatctggcctcttcctacacatcggnacgaggcctatattacggatcatttctctactcagaaacctgaaacatcgggcattatcctacctggcttggcaacttataggcaacagcctttcataggctatgtcctaccngtggaggccaaatatcattctggaggggccacagtaattaccttactatccggccatcccatacttgggganagacctagttcaatgaatctgaggagggctactcagtggacgtccccccnc

SEQ ID NO: 661144 - DNA, 640 bp, Homo sapiens
  misc_feature (36)..(36): n is a, c, g, or t
  misc_feature (64)..(64): n is a, c, g, or t
  misc_feature (68)..(68): n is a, c, g, or t
  misc_feature (81)..(81): n is a, c, g, or t
  misc_feature (85)..(85): n is a, c, g, or t
  misc_feature (141)..(141): n is a, c, g, or t
  misc_feature (168)..(168): n is a, c, g, or t
  misc_feature (190)..(190): n is a, c, g, or t
  misc_feature (208)..(208): n is a, c, g, or t
  misc_feature (215)..(215): n is a, c, g, or t
  misc_feature (225)..(225): n is a, c, g, or t
  misc_feature (308)..(308): n is a, c, g, or t
  misc_feature (393)..(393): n is a, c, g, or t
  misc_feature (406)..(406): n is a, c, g, or t
  misc_feature (430)..(430): n is a, c, g, or t
  misc_feature (547)..(547): n is a, c, g, or t
gggggaagaggccagagaaaggaggcagtcagaccncagacctgtcgccacagggacagcgganagangtagcactaaganagancacccgagcagtccccagtccagcccccactttttggcagaggtagggtaagggtnatgtgcaccccccccccacccccaatncattggtgtcacagagggaganagtgaaaagcgcagcgtnggtttcnggcccaagtnagggagcgtagaaaggctagccttggtccagccttggcagaatgaggcccacagatgggacaataaggcacaaccctggctcnggaggccagggagtcaaaggcaaacagccggggccaaatgctcagaataaggaatgtgaatcgtaacccctacccacagagagcngagggagggcctnaaaagcagttgaaaggatgacttngcgggtagggaggaaaatacgaccgtccccctctaacagaatataaccaacgtccccctacctggggataggctggttagaatttggtttaaaggcaactgggtgacaagcaaggtngggaggatgcagagaactctcctctcactttctcctttttccccagagcttaaagtgaccctatagcgcagggagcagggtagttccttggct

SEQ ID NO: 661145 - DNA, 241 bp, Homo sapiens
gtcttgaatatatcatttctctccctctctctctctctcggtgtgtgtgtgtgtgtgtgtgtgtgtgtgtgtgtgtgtgtgtgtggcgtggggggggtcgagctccgaaacacactctcacagggcgggccccgacccccggggtgtgtgtgggtgtgtgtgtgtgtctgtgtgtgtgtgtgtgtgtgtgtgcgcgacgcgcgcgctctactgtgtggcgcgcgctcacggggagcgggct

SEQ ID NO: 661146 - DNA, 102 bp, Homo sapiens
  misc_feature (5)..(5): n is a, c, g, or t
  misc_feature (44)..(44): n is a, c, g, or t
tgctntcgggtgaagttaaataaataaggaccagccctctcganccctcccagagttattgcatttctcctcttcacatcccattgggactccgatgctcct

SEQ ID NO: 661147 - DNA, 337 bp, Homo sapiens
tgacggcatgaatgtatgaagtttaaaattagtccttatagttcgtcctagaaaacatctgtacacatcaaaagggccgtccaagggtaaacgtttcatcaaagggagggacaagaaaacaatgcacttatatcaaatcaaaacaagaagttaggtcacttaagctatgtgcatcgtttcatggcaacaggagcactctcgtcacagcttacctaccaaccttcccctccccggagtgtggctgctcattatgtcacattctaaaataagtcgataaaagcttacattgcaaatcttggcccacatggagaacactaacatgcacagtcacacatag

SEQ ID NO: 661148 - DNA, 246 bp, Homo sapiens
aatggcttttatagggaagtagcacggaatcactaacttttagcctctttcttccttgaaacccaatctgccattcaaggcatctgaaaatagaagcgcaatatgtggctcccagagagaagggggtggttgatgtcagggagtaactgaaatgtacctggtatttaaaagagcagttcagtagagagcggaagagccccagttataacaagtcgttatgctctagcactgttgcttgttccgctg

SEQ ID NO: 661149 - DNA, 493 bp, Homo sapiens
aaatacgaagcctaatccgaaggttcccaaatcagcccgcacatcctgataaactacggggtagggagcgccgagtaaatgatacgtgcgggtctcgctatgttgggaagctacgcaattttctggcttatgcccttcttatctctctaacggtcttacccttggtgtccctaagattcctcgtcgatatcgttttctattgtgcgcgattccgcggattttatctctgattagcttcgggtatatggctttgttaatcttaccctgttgtggttatcgtagctttcgagttatgtctaggctcgcgagctactatcttgctggtgaatctaaggaatcgctctaggtagaggatgggttgttttgtatggtgcgtttttagatatatttttcgattatgtttccctaattgtttcgtcgctgtttccggtaatagacttacctactcgtactccctaagcgaggtgctccttccttttacgtacctatttct

SEQ ID NO: 661150 - DNA, 177 bp, Homo sapiens
gtatttttagtagagatggggtttcaccatgttagccaggatggtctcgatctcctgacctcgtgatccacctgcctcggcctcccaaagtgctgggattacagtcatgagccaccgcgtccggccgtttctctcttacttctttacagtctctctgctcccttctgtcgtcttctc

SEQ ID NO: 661151 - DNA, 350 bp, Homo sapiens
  misc_feature (270)..(270): n is a, c, g, or t
ataatagctacgatccaaatgtttcacttggagagagaagtaaactagaatttcactctgacaaaaccttttttctgcttgctctcatttcatttctccaagttaaaactaatcctgcttttaaaactaaagttctagctgaggctctggaaaacagctacagagccaaccggacaggcgactttaatttatgtgactggaatttccacttaccactcctccaaaatattttcctatgtagaagtcatcaaggctatgcagttccagatnagttgctcctagttctttagcaagctggatcccttcggttgtactgacacagctccctctgtctgaggtacacagtgggc

SEQ ID NO: 661152 - DNA, 488 bp, Homo sapiens
  misc_feature (50)..(50): n is a, c, g, or t
  misc_feature (88)..(88): n is a, c, g, or t
  misc_feature (91)..(91): n is a, c, g, or t
  misc_feature (106)..(106): n is a, c, g, or t
  misc_feature (109)..(109): n is a, c, g, or t
  misc_feature (127)..(129): n is a, c, g, or t
  misc_feature (150)..(150): n is a, c, g, or t
  misc_feature (175)..(175): n is a, c, g, or t
  misc_feature (177)..(177): n is a, c, g, or t
  misc_feature (221)..(221): n is a, c, g, or t
  misc_feature (249)..(249): n is a, c, g, or t
  misc_feature (271)..(271): n is a, c, g, or t
  misc_feature (290)..(290): n is a, c, g, or t
  misc_feature (322)..(322): n is a, c, g, or t
  misc_feature (330)..(330): n is a, c, g, or t
  misc_feature (339)..(339): n is a, c, g, or t
  misc_feature (342)..(342): n is a, c, g, or t
  misc_feature (350)..(350): n is a, c, g, or t
  misc_feature (367)..(368): n is a, c, g, or t
  misc_feature (382)..(382): n is a, c, g, or t
  misc_feature (486)..(486): n is a, c, g, or t
ttttaaacatttttagacccagaatggtcatctcacccccagaaggagangggttccaaggggggggggggggagggagggggggggnggnccacggggggggggnganggcaaaggggaagggggnnnggggggaagaagggggagggnaggggggcgccgggaaccaaagagncngggaagggtcattgtcaccaaagtggctggtgtgggcaggagcnccaagtgcagacaaacccaccggggccnggcggggcagccctgtcatggnttctgtctttgttcctgtnagtgaacagaagacccccgacccccgccaccnagcagcanggaacaccngcngcccaganacagacaaggctctgcnntgtctccttgtgcnggtttttggcagagacgttaaagggctgaaggcctgtgggacagaaatggggagaaggagtgggatacccaagatgccctcatacgcagcgtgggttaacagtnct

SEQ ID NO: 661153 - DNA, 170 bp, Homo sapiens
tcgtgtcttgacgctggtcacctggtgtacagctcccgctcccattgccttacgaagccacctcaagtccatctcgatggccaacggacctgaatgccaggatgatgcacggcggttcctactccctcaccaccagcaccacccacaaaaggagcagcctccgcaaagtg

SEQ ID NO: 661154 - DNA, 421 bp, Homo sapiens
  misc_feature (1)..(1): n is a, c, g, or t
  misc_feature (366)..(366): n is a, c, g, or t
  misc_feature (399)..(399): n is a, c, g, or t
  misc_feature (404)..(404): n is a, c, g, or t
nagccaccatattccaaatcactgaaaaaaataaatgaattatttttatttatttatttatttttttgagatggagtctcggtctgttgcccaggctgaagtgcagtggccccatctcaactcactgcaggctccgctcctgggttcgcgccattctcctgcctcagactcccaagtagctgggactacaggcacctaccaccatgcccagctaattttttgtatttttggtggagacggggtttcaccatgttggccaggatggtcttgatctcctgacctcgtgatccgcccgcctcggcctcccagggtgctgggattgcaggcatgagccactgcgcccggccatgaaatgaattatttttnaagaggcattgattaaaagattcacagcaaatncactnagtttaagcagattttt

SEQ ID NO: 661155 - DNA, 1077 bp, Homo sapiens
gttagatcccaggggctgggcgactgagagtgtgtagctggcagcagcggcgcaggtgatgaccccatctggaccgtgcaggtgagtcccttccctccccaggctcgcttccccagccttctgaaaaaggaggtttaggggatcgaggtgctggcggggagaagcagacaccctcccagcagaggggcagtgatgggggcacgcgagacgtagcaaaggtgacatctactacggggcggagccgagactgacgcaaggctggggggctatgggcccgtttccaggcagaccagagcaagagggcagggagcggagcacaggggtaggccagcgtaggggtccagcacaggatgggggtggtacccccagggaccatgggtcagaaccgggaccaagggcccgagggacacagcgacacgatgaggtcacacaagaatggccaccgtacaaccacacgacaaagtccattgaagcaagccagggcaaccagaggcgcaaggcgaccgggccacacgggcgatttcgatcagcgcccgtaaatgcaccggaagacccgtccgaaagggggctgggcagaagcctgggacaggaacagaggcacgaatgctcgggcgaggctcgcaaggcaggtagatgccacccaggcagggccgaaagccgggccacacggtgactcgggaggacccgcggcaagagatagtcgcaggaccaagggaacgggcattgaacaagcgggagctcggagaacatcgacggagcagcaggaggaagcaccagagaagaagggcagagttggcagggggcacaaagagggatcacaggggagagcgggacagaaacgggcgacccaacgaggggcgggaacacagggaccgaaacgagaagtgataatgacacgcgagacgaacggggggcaagaccgcccagggggaggcctggcgcaatacgggggcagaccagagaagggacgacacgacgagaggggaggacacaacggggacgaatggtggggacgcagaacgcagaggatcggggcgaaagaccgaggggcggggcacggcgcgcgagagaggagga

SEQ ID NO: 661156 - DNA, 366 bp, Homo sapiens
  misc_feature (243)..(243): n is a, c, g, or t
accttaaccctgaggctgggagtttgagaccagcctggccaaaatggcgaaaccctatctctactaaaaagacaaaaattagctgggcatgatggcgggtgctgtggtcccggctactcgggaggctgaggcgggagaatcgcttgagcctgggaaggtggaggttgcggtgagccgggatcgcgccactgcactccagcctcagcctgggcaagaaggcaagaagagcagaactccatcttnaaaaaaaaaaaaaaaagggaaaaggaaaaggaaaaggaaccaaggaaatggcttggaggcttggaagggaggagaacttggcaaccagttcttggggaccggggtggggaaaaggtggtctct

SEQ ID NO: 661157 - DNA, 103 bp, Homo sapiens
atgcttgtggacaggacataaatacgggacgattaccagtagaaatgatgtggaaatgcagagccccaggaaagtagtgtaagccctgaagccctgtgcgacg

SEQ ID NO: 661158 - DNA, 845 bp, Homo sapiens
ataaatattatactagcattgaccatctcaacttctaggaatactagtatatcgctcacacctcgatatcctccctactatgcctagaaggaataatactatcgcatgttcatgatagctactctcagtaacccgtcgaacacccactccctcttagccgatatgtgcctatgccatactagtctttgccggctgcgaagcagagggggtctagccctactagtctcaatctccaacagatatggcgtaattacgaacatagaccgtaaacctactccatatgctaaaactgaatcgtacccaagacaataatattcactacgcatctgagatgactttccataaaaacgcatgaatttgagatcaaacacaatgcagcccgaacagaccgtaatatattaggcaatcatcccccctacatattttttgtagagccaacatacaagcgaacaacctcattttaggctgttccccgaatgctttttcctccgacgcccactaaagaatccccctctctctaatacgtaacgtacctgactcctaccgcctcacgaattcatggcaaagaccagctgcctatcttatccaagtgaaccacttgatcacagaagaagaaactctacctcgtctatagctaaatctcccgaacgaaatcgtccgttgaacttataacattacacaagcgcacagaacgtaatcatagttgtatatcttcgtttcgaagatccacaactgatccccacccttggcttatcatcaaccggatgaggcaacccagtcaggaacgcgtgaacgcaggcagcattactttccttattctacagcctagtaggctccctttcccg

SEQ ID NO: 661159 - DNA, 226 bp, Homo sapiens
gtcttgactacctgagtgacaggaagatctgtgatgtgcagcatttaaaattttggcataggtacaaacttgaatctcacaagctgattcacagatgggtccttaagtttaatctcctttaaagcttattttaaaaacactagtctggcagacagtaagatttaaaataagggagtttttaaaacccaagtagtgaattgacttaatagtctaccttgtgaatgaa

SEQ ID NO: 661160 - DNA, 675 bp, Homo sapiens
ttttttttaagaaactggatgttaatttcccatcaaccatttttccatgctgcttaagagcctatgcaaaaacagcttaagaccagtcaggggtgggtcctacccattcaggggcctgagcagggggagctgcagaccaggtcttccggggcgaggcgtgagcgccccagatcttcagtagggaatggcgtgaataggcacagagggcacctgtacaccttcaggaccagtctgcaaccctcaggcgtgagatagcaggtgaactcaggagcgggagcagcaccattcacccgtgaaaattcccacctggggtcacgtggcattctcagcagcagccgtggatcattcgttttacaagtcatctttacaggagtactctggtagaagtacagatcagggattgaccctcccagtggggtgtgttcacgggaaagtggggccaacgacatgtcgcagaaattcccgagaccagaatccaccagcatcaaacccactggaggtgagctccctgtggaggatgcatgggagggcacatgtccacatagcgcaagaggagaatctgtgttacacagcgcaagggtaggtacggtaacataaaaagcctccgagaaaggcggtgggcagcctgggtcagtacccaagagccggggacccggaagctgcggactggaacga

SEQ ID NO: 661161 - DNA, 168 bp, Homo sapiens
catggcccaagtcaccccccccctggtccacattcctaagggagtaaaaaaaaacaggacacaaaatggcaagcctgaaagaattgcccaggtgacctggaatggggccttaaccccaatttttttttcctaataaacaacctcctagaggccacattttttttttta

SEQ ID NO: 661162 - DNA, 154 bp, Homo sapiens
caagtataatgaacttggcgagaagctcagcaaagacccaatatcgtcatagccagatggatgccacagccgttgatgtgcctcctaccatataaagtctgaggttatcctaccatctacttctctccagccaacaagtctagtcaatcaggga

SEQ ID NO: 661163 - DNA, 209 bp, Homo sapiens
  misc_feature (41)..(41): n is a, c, g, or t
  misc_feature (69)..(69): n is a, c, g, or t
  misc_feature (80)..(80): n is a, c, g, or t
tgtctacctaacttctcggggactacactggtagttttccncctttaaagaaactggtaaattgaaacnttgttgagttnccagaatgccattaacagtgttttctttccctattccatgctttctgcctctgtgtatatatataatatatatgtatatgattgtgctgtgtatttacgaagctattaagcataatttatttgtaaaat

SEQ ID NO: 661164 - DNA, 544 bp, Homo sapiens
  misc_feature (535)..(535): n is a, c, g, or t
cttggctcccaaaggcgggattacaggcgtgagccaccgcacccacccagatctgatatctttatgtggggcctgcagggagcagggctggcaagaagtgtcagtagtgtaggacttggatgagacattttcttaaagagctttcttcagcaaaaatgtgggattttcctgtctattttcgtttatttttatggcaaaaatgtttcggccaccagaacaatcttagcacaaccaaaggttcttggctgtttttcatttagcaaaattctttctggtgttatgatatgtgttttctgtcagctaaaacttacaggaatagtgaaccacaaagatttcctgaggagctcccacatgctgtgtctgaggtttctcatatttcttttggcatcagtaacattctctaatacttcgaaattatagttggaatccagtgttaatgatttctcttcaaaaaaaacaacttaaataaaagatttgcggttttattttgcttgaaccaaggaaaagtcataatagagacaactacctactctgnccaagatgg

SEQ ID NO: 661165 - DNA, 321 bp, Homo sapiens
ctatttggcaatagtgctcgaatatctgctgcacaaaccaacctttgaagatagcttgggtaaaacttctgtgacgaaggcgaaggcatatgggtccctcttggaaagtctcgttcagtgaagatgccaggtagttcggattcagctgttacatctaagccaggaggctgtggaatcaggggcatgtttcgtgtgtataacaaaaggtgttcacttaatttccctcattttatcacattaatttttaaatagtagtaattcatgaatataaccactttcctttgaaaagaatcattaatgttttcaaacgtgtcggtaaca

SEQ ID NO: 661166 - DNA, 605 bp, Homo sapiens
  misc_feature (54)..(54): n is a, c, g, or t
  misc_feature (605)..(605): n is a, c, g, or t
ccatctccctctctcttcccttcctccccctccgctctcccctccccctccccnttcccctctccccccccccccccccctcgcttagcagtttcgctcctcccccgatggcggctctgctctcgtcactcgtcggatccccccgggcctgcagtgccttcggctcgcgctgcttctccccttttctcttccgcctgcctccttgtcttggccagcccctgtctcctcgtgcgtgccattctcaacctcttggtttgctccctttaagccttcgggctttctcacactcccctccttttccttctcttctgtttggtccctcctgcgtccctccctcctcctttctcctttgccactgccaacattccactcttgtgctgtttgctctcacttccgttgcctcccccattctgcttgccctctcccctttctgttcctcccagctcgcgcttcgtcggttgcctttctcagcacttgtctcttgctcccttttccctcctccttgccatcctttccaggccagtccccagtacatattctctgctgtttaccatcgctttcgcttcctactctgcactactagccttcgtggcctggtttcctcn

SEQ ID NO: 661167 - DNA, 377 bp, Homo sapiens
tagcttctcttcatcatccacgctagaatttgtactcctggttcacgtcccatgctaagctgtcagtcatgaagtacagagtgtagttgtgggcagccagtggctggggccgcaaggtccaacttcaccttgggcttctgttgcaaggtcagcctcttgatggagatgaggctattggacttggcatgtccaatcaccacccacacagcccctcttcacgtttctggcgggaagagaggcgcattgacagtgggcctgtgaacttcctcctctcgactccaggctggtccattcaccaaagatctggcccgtccactgcgtgatgcttgtccgttatctatgcaccgtcataatattacttcagatattactggtag

SEQ ID NO: 661168 - DNA, 748 bp, Homo sapiens
  misc_feature (572)..(572): n is a, c, g, or t
gcctttatgtcctttcttctgaaataaaaggaaaagcatttctggaaaaaaaaaaaaaaaaaaaaaaaaaaaaaaaaaaaaaaaaaaaaaaaaaaaaaacaaaaaaaaaaaaaaaaaaaaaaaaaaaaaaaaaaaaaaaaaaaaaaaaaaaaaaaaaaaagaaagaagaaacgaaaataaataaagaagagaatatataaagatagaaccagaaaccgacatgagattaatgacatgcgatcatgatcgctcgtgcgatcgacattctcctccttcaacgtttggcgactccactgatgcgaggctgagagccagcctcctctgtactgcgcgatgtatcgatcacttctgccagctctcagtctccgcgatcggcgaggatctggagtgcgatcctgatctggtgacaaagcctataagcctctgcctgtgtgacgcatcaggttacataagcatgacgtacgtgtcagctaccaagacacgacgatcacgcactatataggacaagagaggtcagtaaggcgagctaagtgtcacgacacgtcgcaacgacgcatatttgttctatggcntgcgtcgtgccactaccatatctcgcctaccacacgccagctcttgcagctaaacctagagctacgcgtctcaatgcacagcccctttacttttcctcttctatgcgtcacgtgcatcgtcacaataggctagctagatgagacgtcagacacgatatggcgcttaatgaccagtg

SEQ ID NO: 661169 - DNA, 292 bp, Homo sapiens
acaggaccagataacaaaggaatttacaaaggagacagagaatccagtcgggaaaatacacatttgcctgcctcacatggatgggaccatacaaaattttgttttggtaacccgggtgtccaccatgactccaaaaatggtgaatgttcaccattgtatattgggggggctccaaaaggacaagatatggaaacagaagcctcaccagaaccaagctagagggaatgatcaatgagctagcagtggcgatgacagctgtaaagcagggcaggaatacatggaggtccgggga

SEQ ID NO: 661170 - DNA, 183 bp, Homo sapiens
gagatctcgccattgcgccccaccctgggcaacataacaaggctccatctcaaaaaaaaaaaagaaaagaaaagacaaaaaaagggagggagggagggaaggggttcaacttattatattcaattgtatttacccaagggtataccggtgggtatacgggtaaaaacgaaatgtgggaaaggc

SEQ ID NO: 661171 - DNA, 642 bp, Homo sapiens
cgtcgcgctgtgccatattgcaatgttggccgatggtaccacgaggaagcacattccagggcccccacgaccaccacctgtccacaaaggccttcgatacgggataatcctatgttattacgctccgaagtttttttcttcgcaggatttttctgagcctttacccctcccgccttgcccctacccccccatttggagggcactggccccccacaggcatcaccccgcgttatatccccttggagtcccactcctgaacacctccgtattactcgcatccggagtatccatcacctgagctcaccatagtctatagaaccccgaacccaattattccagccctgcttattaccattttactgggtctctattttaccctcctaccagcctcagagtacttcgagtctcccttcaccctttgccgacggcatttacgggctcaaccttttttgtagcccccggcttccccggagcttcacgtcattattggctcaactttcctcactatttgcttcatccgcccactaatatttcactttacatcccaacatcactttggcttcgaacccccgcctgatactggcattttgtagatgtggtttgactatttctgtatgtctccatctattgatgagggtctta

SEQ ID NO: 661172 - DNA, 798 bp, Homo sapiens
tgagttcgctttcccggattgatctcgttagatgcctggagctcgccatgtgacttcgcgttagcccgtggttagcttatgttgtactgttttactgatatttgcggcttgcttagtagtgtgtctgggtgccttttgttttgcgggtcctcgttcatcttggcctctggagccagtgtgttataagtgcccgtggtagcatggtcgggttttcttggtttgtgtgttttttggtttccatgcgtgatcagtttggagacatgggatgcgtggtgaaagtgtggtttgtggaggttctggtatagttaccttgtaatcagtagcgagataggaaggtcgattcgttatttcttagccggcaagttgtactcgttcgctagtccgagtatagagtatagcgtttctgtttcgtggtccatacctttatatgatcctcgtaaatgataattatctccagtaatattgttttcacccaaatcttgagtagatatttgacaacagcctaacaaagttaagggcttaacagccattcagatagacagtaacaccattctgtactgatgtgcaataaaagcatccaagatctttatttgaaagttttatcttagtaatatacatttttgtatgagacaggtgattggtaacagggtgcctattttagtgcataggatcaaaattctgtgataacttgcagggctttctttctgtgttcttcaaatttatcaagggttcattttggaaactacattttaaacctattggaatcaaatgttatcttactgggggaggataatgtat

SEQ ID NO: 661173 - DNA, 2070 bp, Homo sapiens
  misc_feature (1235)..(1235): n is a, c, g, or t
  misc_feature (1276)..(1276): n is a, c, g, or t
  misc_feature (1301)..(1301): n is a, c, g, or t
  misc_feature (1303)..(1303): n is a, c, g, or t
  misc_feature (1345)..(1345): n is a, c, g, or t
  misc_feature (1451)..(1451): n is a, c, g, or t
  misc_feature (1526)..(1526): n is a, c, g, or t
  misc_feature (1567)..(1567): n is a, c, g, or t
  misc_feature (1585)..(1585): n is a, c, g, or t
  misc_feature (1617)..(1617): n is a, c, g, or t
  misc_feature (1676)..(1676): n is a, c, g, or t
  misc_feature (1682)..(1682): n is a, c, g, or t
  misc_feature (1698)..(1698): n is a, c, g, or t
agatgggttgggggagggagggggggatgtgttatgttgatgtgtggtgtaaggaggatgggtagggagtagtttgttggtgaaggttgcttggtggtggtgtgtggggagggtgaaggtaagtgttatggggttgggtgtgtggtttgtggtgggtgtggggtgggtagagagatagataatgataatgtagtgggtaaaggctagagtaaagtgaaagagagtgtgtgtggccgagagccagtgcgtatgggttagtgtgtagggatagtcgaaattgtatagtgtgttttgtatggtggatttatagaaaattgagtgcggtgtatgggaaggaaaggaagagtgtgtggagtgtagtggggatcgggtggtttgaaatgtcaggggcggggaggtaagggaaatcaatcggaaggggtgggtttgttcctatgcctatggtgtggtcgcggaccgacctagccgtgtgttgtgtggggcggatgatatggatgtcagggaagtgacaggtcccagaccgtgcctgtcgtatcggatggtaagtgtgaatgtgaggtggccggccctgtgcgtgtgtggtacgatacctgaacggtcaccataccctctctggttggttggcttttacctacgctgccgggttgagtgtgcggggggaggcaagggagtggatgtaatggaggaaggaaaggaatgagagtaaagcaaggagggtaggacgcgatctcaatcgatgtatggtgttgtagggggtggtgagggtgggttagtgcattggtcgtcgggtgggaacgatcctccgccttgtgattgatcggtcgagccagcagggatgagcaacgctaccgccggtcggtgaatgaaggagtgtgtggttggtcggtagggaagggccgccaagcatgcgggtgggtgaaggacgtgcggatcgattaatgaggggtgaagaaggagcgatgtttggtaggtggtcgtcaataaatgaggaggatggaattgtgcggaaggaaggattaagtaagtaggagtggtgtaagtgaaggaaggaccgggtcaagatagttagttgattctttgttggtcttggagtgggcgtgcagccaggccagcgaggcatggcagggggggtgaatgagtcgagtcgtgtgaagaatggtgttcgtgccgggatgcaaggaagcaggtaggagtgaacgagtggagtcggttgcgttgggtgagtggagcgcganccggcgagtcagtgagacggctctgtgcagtgaaggtgagnaaaggaagtggatgggtcggttcgntnccgttcaagtcagggcgtggcaaggcaagtaaggaaggaatngttggaaggaggcgtcccatggcgagcgagccgtgcctgtgcgtgcgggcgagtcgtgtcggtcggccagtccgaggccggcggtccgctactggtaaggtaatgnaatgcatgtagcacgcgatgcgatgctcagtgtatagatgcaccagacggtcggtcgagtcagtcgatgcggtgngttgtgttgagtgaatgtaggaacgcgtagtccggtccgtngttgtagtaaaggatganatgcgatgcgtcagccatgcgtgccagcgtgnctggccgcgactgcgggcggggcatgcatgcaggcatgcagtaggtagtaggatgcagncgtacnacgacgacggaggggngcgtgcgtgttgtcggtcgtgagtcagcggagcgcgtcagcagctgtggcgctgcagatgagaggagaggagagagagagtgatatctggagacacgcggagataatcgcgagagttgtgtttctcttgatagactctctctcgagagagtgtacacctctatagtttcttgccacctcttggcccctgtagatgtgtttattataacagagtctccagagagagaagatgtgtgtgtccacagagtgttataagaagaagagagagaagagagaagaaagctttcggagggcatttatcaagctttctggggtgcccggcagaaagagctaatcattgctgcccccatgaggcattgggccggcggcggga

SEQ ID NO: 661174 - DNA, 170 bp, Homo sapiens
caggacactgtgatctcctgcgccaacgagacactggtcatgctggtactggagggcttgattggctcccgcactcatccctctcctgagtccctctgctatttgtcttcctttcttaccttctttcatttcaccgcctatccctgttgactacctattagaactggcat

SEQ ID NO: 661175 - DNA, 731 bp, Homo sapiens
ggttcatctgtcttgtggcccccatctaggaacagacttggcataagaggagagcttcaactccctgtggtttcatccctgacccaaccaatcagcatttccctctctttctgggtctcttgtctctctctctctgggtctctgtccgaggaagagagagagaaaagaacagaagacaacaaagaaacagcaaagcagagaaaacaaaagcaaaaaaaaaagaaaaaaaaaaaaaaaaaaaacagagacgggaacgagagaggagacgacgcacgagagagagggacgcagccaaacacgacgcgggccaaagagacaacagcgcgcagacgaggagcgagacgacagcggagaggagggagagaagaagcagaggagaagggagcggcgaagacagagggacgaggacagcaggcggaggaagagaggcgcaggcacaacggagaggaaaaaaaaggcgagaagaacgcaaacgcaagaagaagcgaaggagcagaaccgcaacagaagaccacgaaaagaagaccagaaaaggcaaaaagcaacaggcgcgaggcggagcggaggagagaaagcaagggcgggaagaggatagaggagagagacggagcagagaggacaggagggagggagagaaaaaggagacagaacagagaggcagggagagagacgagagccgacagcggaggaggagaagggagagaagagcggacacacagacggggacaggg

SEQ ID NO: 661176 - DNA, 276 bp, Homo sapiens
  misc_feature (4)..(4): n is a, c, g, or t
  misc_feature (19)..(19): n is a, c, g, or t
  misc_feature (78)..(78): n is a, c, g, or t
  misc_feature (163)..(163): n is a, c, g, or t
  misc_feature (189)..(189): n is a, c, g, or t
  misc_feature (219)..(219): n is a, c, g, or t
  misc_feature (242)..(242): n is a, c, g, or t
aagntctctgccagcaganagggggtctggaatgggagtatccactgtggggctggggtccagggtttttatggactnggaaggggaaggaatgtgcttagtctgtgggctgtcttggcgaatgtgtgactcagcttggcctgggaacaatcgggctgaggtnatgattcatagaggccagacttacantccaaataaaggaaagtagagtgcccactngaacccacccggagcccactgtncccatgcccacaaaagggagaagaaactttttct

SEQ ID NO: 661177 - DNA, 205 bp, Homo sapiens
cgaattcaacatcacaaacttcttcagggccatcaggttaaacttgtaggactcattgataccccgctcctgaactcaggtgatccaaccaactcaacctcccaaagtgctgggattacaggtgtgagccagtgcgcctggccaagggacattacttttaaacattaatcgatgtgaaatcctgtttctaaattacgcactgaca

SEQ ID NO: 661178 - DNA, 245 bp, Homo sapiens
  misc_feature (115)..(115): n is a, c, g, or t
  misc_feature (153)..(153): n is a, c, g, or t
  misc_feature (162)..(162): n is a, c, g, or t
catagccttcgtgtgaaggccagtgaacagcagctgagctaattcatgaggtatttgcccttctgaagttggaatctgtaatgatttaaaacatgagactggtccagtgggcttnttgctccagacctcatgccttctggacccagacatctntgcaatctnggaactggaatacaccacttcttgtcaaggtactagcaagttgccgtggatacagaaatctctgcaggcaagttgctccagag

SEQ ID NO: 661179 - DNA, 561 bp, Homo sapiens
  misc_feature (537)..(537): n is a, c, g, or t
ccactatgtgatggcacagacgatgtagaatatgattgggccgtgatttaaagaatgctctggacatcgttgtagatatattgagagtaatcaaagataaacatagaagttggagttgtatatcaagtgatttggagattcatgctggcatgatctacttgaccagaggcagcttttcctctctaagcctatttgatatctgtcaggtggatttgagatcactcagttttaccccttgtcccattccgtagccttttgtcactgtttgtccctttgtggccatgtcagagaccacactgctgtaggctgagaagggccacagtggttcaggtgctttgaggacttggtcttggctcaataggagcctcactggtgtttgctcagattggtcagcctatgcccaaagctacttggcttaacaggctggtgacatcacacccaaaaggtggcgaagaataggaataggaaggatcagcacctattttggagtgaggaagccaatggaggtacaactcctcaattctaatcttggtagtntatttttttttttggaaacgggtt

SEQ ID NO: 661180 - DNA, 152 bp, Homo sapiens
tgaactgggaggaggagaggggggcgtcctcgcccctacagcaggcggcggtaggtggcgatctcctgctcgagcggcgtcttcacgtccagcaggatcttgtactcctgggttctgctgctccatctcgcagtggagctgggccagctgct

SEQ ID NO: 661181 - DNA, 363 bp, Homo sapiens
  misc_feature (322)..(322): n is a, c, g, or t
tcagagctggtttcaaagttcagctgcagcacatactttgggccagttatttgggttcataggacctcaggtttgtcatctagaaatgggaataatgatacctacctcctgagagataaagggcagaacaacaatttcagcaaggctctatcatttcggttatccttccctgctacagtgcaaatctctcttaaagactgtaggtctggcttccgtgaatcaaatagaaacagttacagcataagcctgggccactgtgttgccttgggatatgcatatcacctgttttaatcccaggatttgactttcctcctagtgctgnggctgattatttaatttttagataatcatgtagcacatatc

SEQ ID NO: 661182 - DNA, 888 bp, Homo sapiens
  misc_feature (14)..(14): n is a, c, g, or t
  misc_feature (133)..(133): n is a, c, g, or t
  misc_feature (205)..(205): n is a, c, g, or t
  misc_feature (221)..(221): n is a, c, g, or t
  misc_feature (233)..(233): n is a, c, g, or t
  misc_feature (278)..(278): n is a, c, g, or t
  misc_feature (283)..(283): n is a, c, g, or t
  misc_feature (287)..(287): n is a, c, g, or t
  misc_feature (306)..(306): n is a, c, g, or t
  misc_feature (309)..(310): n is a, c, g, or t
  misc_feature (356)..(356): n is a, c, g, or t
  misc_feature (375)..(375): n is a, c, g, or t
  misc_feature (407)..(407): n is a, c, g, or t
  misc_feature (423)..(423): n is a, c, g, or t
  misc_feature (442)..(443): n is a, c, g, or t
  misc_feature (465)..(465): n is a, c, g, or t
  misc_feature (504)..(504): n is a, c, g, or t
  misc_feature (525)..(527): n is a, c, g, or t
  misc_feature (529)..(529): n is a, c, g, or t
  misc_feature (550)..(550): n is a, c, g, or t
  misc_feature (563)..(564): n is a, c, g, or t
  misc_feature (566)..(566): n is a, c, g, or t
  misc_feature (585)..(585): n is a, c, g, or t
  misc_feature (625)..(625): n is a, c, g, or t
  misc_feature (650)..(650): n is a, c, g, or t
  misc_feature (652)..(652): n is a, c, g, or t
  misc_feature (689)..(689): n is a, c, g, or t
  misc_feature (696)..(696): n is a, c, g, or t
  misc_feature (765)..(765): n is a, c, g, or t
  misc_feature (798)..(798): n is a, c, g, or t
  misc_feature (877)..(877): n is a, c, g, or t
acaggcattttaanagcatttctgtggttctaagtttgcatcaagacagcctaagtttgcatctgcacaatctggatacccaaatccctctataatttccaaagacaaagacaatttttgctagttgtgtggngtcagggggaagcagtgttgccctgcaaacagtctaatgggcccaggggaccctgtttctttctcaacctgnggttgcttccttgttntccaggaaaagngattagtgcttgcttaaccaggttcctagtaaatggtcagggatnttctntgcnataatgttgcaaaagttantgnnggggaaaaaaagcacaacgggggcttcttgcccatttacacttgcnatgttagattttgaaaacngggcccttcatagtcagcacccaagtcctgtnttccaggtgttttgcnggctggttaacggcccttnntaactactttgcaattccaaangcctccctggctgcttttctgggcggggggtgggttttngtgtgcgggtgctcttaggtnnncngaggcaataacaagcccagtntaaccaattcccnncngggttgactgctgagttangcagattccagttcattaagccctgagtatagagtatgangccaacatcttttctttagtaaaancnatgccattcgtctgcctttcccttttcctcctttatntgggggnctgtttttggaaactggggtaactccctgcaggcaggcagcaggagatatctccaagtcaggctggcanggtggggtgctatcctctgtacaaccatgaggnagatgaggcaaataagatcaagagagcattttgtgaacaggcgatgacccagtttgtacctgtgctttgtggctagtgnaactgtacatc

SEQ ID NO: 661183 - DNA, 1152 bp, Homo sapiens
tgattctctctctctctctctctctctctctctctctctctctctctcacacacacacacacacgacgaacacgagccctgtctcgcgcgtgatgttctcgccgcgcaggtcgggtggcgcggtgtcaggtggtgtgtggggtccagagacagggtcggtctccggcgctgcagcgcccaggcccagctcgtacagattgtgtggcggagcagcggcagctgtacagtagtagtcgcaccacgtcgtggtcatcagaggatgccatgcggtgatgaggacctctccggttggagacgtctctctgttgaccaaaaaacaagcatggttgtaattagtgtgtgcgagcagggcaggtgtggtctctttgctgtgctcccctatccaacaagaggaatgcctattagatcgtcctcgttgaggacgaacaacggcatactttcaccacgaacaaggataggacgcgcggggacacatctcatgaaggctctcgtgcgtagtagcaagacagcgtaggccttgtgtaggaagaggagagcaggagcatgcagaagcatgcgagttgcgtcttcgtagtgcgttcttcattgtaacgcacgcagcaagcgtggcgctcgttgcgtagcgcagctatataattagtcgttgctcgttaggaagaccacgaatgaattagtctcttctcgtagagctcacctctcgtaagaagtagccccaccgcaagcattcattccagaagggggagcggacaggcaagcctatattgcccggaggcccacgaatgctacttcccgctacaatttctttacgcaatgcctgcctgcctacatacccgctacgttgtaacgtacatacgtaggtagggcaagccctgcccggttgtaacttcgcttgatagaaaagcccggcctggctgtccttagggtcggaatggaataggtaatccctaacggttggaccgctgtgttggggggggaacccccctctgttggtccaccaagtgtggcgtttgcttagccaggctaagtttgatagggacacacaggggaatttcccagggagggaaagccgcgggcagtaattttgcccccaaaaaaatggctggtatggaagcaaccagaagacgagcgttgccttccttccttccccacgga

SEQ ID NO: 661184 - DNA, 907 bp, Homo sapiens
  misc_feature (2)..(2): n is a, c, g, or t
  misc_feature (482)..(482): n is a, c, g, or t
  misc_feature (494)..(494): n is a, c, g, or t
  misc_feature (509)..(509): n is a, c, g, or t
  misc_feature (531)..(531): n is a, c, g, or t
  misc_feature (554)..(554): n is a, c, g, or t
  misc_feature (560)..(560): n is a, c, g, or t
  misc_feature (579)..(579): n is a, c, g, or t
  misc_feature (595)..(595): n is a, c, g, or t
  misc_feature (608)..(608): n is a, c, g, or t
  misc_feature (629)..(629): n is a, c, g, or t
  misc_feature (638)..(639): n is a, c, g, or t
  misc_feature (728)..(728): n is a, c, g, or t
  misc_feature (793)..(794): n is a, c, g, or t
  misc_feature (803)..(803): n is a, c, g, or t
  misc_feature (809)..(809): n is a, c, g, or t
  misc_feature (846)..(846): n is a, c, g, or t
  misc_feature (894)..(894): n is a, c, g, or t
angataaacattggttattggtgaacaatacaccctgacagctttgaagtgttcagatgctaattttaaaataaatgctgacaaataccaatcagatgttcataacacttttcaggatccacatcaacttgattatggacatagttcaatacacaagggtaagagaaagagtgtgtaatcaccaataattaaaccagaggcataattttttcaaataatttttagttacagaataaattctaactttttaaagtctaaagctacataaaactcaaagcaatctatttttctacctgaggtcaaaatgactttcctttttcctaactaaacataattcttagcattgaggtaaatctgaattcatgtggtatgctttgtcaaacttttccaaaaaattttaagccctgctttagagagaaattctcatgttacacatatatatttacatattttttcttcaaagactaatgacaatgtatgangttaataggccnggaatgggaccatgntactacgaataatatgaaatanaaagccactcatttatataaagngttccnggatggggcgatagggaangggagcacagatttangtacatatatgantgcgcgaggagttcgggagtngggcgcacnntggagaactcagccaggcgcggtggcgcacgcctgtaatcccagtactttgggaggccaaggcgggtggatcacgacgtcaggagtccnagaccagcttgacatggtgaaccctgtctctactaaaaatacaaaaattagccgagcgtggtgannacgcctgtnatcccngctactcaggaggcaaggcaggagtatttgcttgtancagggaggcggaggttgcagtgagcccagatcgcgctattgcactccngcctggacaagag

SEQ ID NO: 661185 - DNA, 273 bp, Homo sapiens
  misc_feature (137)..(137): n is a, c, g, or t
  misc_feature (176)..(176): n is a, c, g, or t
  misc_feature (207)..(207): n is a, c, g, or t
gatgggtacgtatcggctccagcaccagagcctaatgaaggtgcatcatctaactgggactcgtcatctccggcttccagactctcagttctctcggatttattggtttcttcaaagtcccgtgcacatgttcccangatcttatatcacattctcgtcttaatccaagggctagnagagtctcggagaagggctttctagaatccnctttcatggttcacctttccatgtttggcttcacagcggtttcacgagactctatttggagaactc

SEQ ID NO: 661186 - DNA, 809 bp, Homo sapiens
  misc_feature (164)..(164): n is a, c, g, or t
cacgtatccaaatggcagctactgacttcatcctggattgccgtcggtagccattttcatagtccgaccatagttcattcaacaggtagaaaccctacgagcattatagtagtgagaacctatgtttgccagtatttgtagctattgcttttactatctttagngtatgttccggtcccacatgcaaggaagtgaacgatctaaatataaagaactcgcattgttatcaaatctatgtgaaggaattcaaggaagacacaagactcttaccaaacatgagtgtgcagattacatcatatgtgcgacgcataatgccatgaggactagaggccatgacttgtttcagaaagatggcagagcagttctttggaaacccgtagatacatgagaagtggtcgattccagacccagacatagaatgtcttgaagcaatagactcccatttgagactttccggacatacgcagcagcatacaatatttgcatcgagcaatgggaaagcagtatacgctcatgcaataggaagacctatgactctttccaagatgaacttgaggattacatcaaagtgcagaaagccagtaggacctagatccaaagacttgtttcaggaatgatgagagagaactctgtggatactcatgggtaccgagcaaatggttgattctggaccctgatcgagaatgtgtgagcaaggatcttcacgatgaggcttcccgagactaccaaggaccataccatatttcaccagttggaaagccagttacctcaggtgggctaccgaaccattcaaagaggacatatgattg

SEQ ID NO: 661187 - DNA, 451 bp, Homo sapiens
acggtcagcttccttcttagtgtcataagttctcatcatttagctcccacttacaagtgagaaaatgtggtagtgggtattctgtacctgcattagttcgctaggaataatggcctccagctccatccatgttcccacaaaatacatgatctttttcttttttatggctacaaaacattctagtttttgaactgaagtattattatggctgggtgcggtggctcatgcctataatcccagcactttcagaggccaaggcaggcggatcagttgaggtcaggagttttgagactagcctggcagccatggtgaaacctagtctccactaaaatacaaaattagagagaaaccccatctgtactaaaaatacacaagatcccagctcttagggaggctcacacctgtgatcccaccacttggggtggcagctgcctgtacttccagctactca

SEQ ID NO: 661188 - DNA, 294 bp, Homo sapiens
tcaaagagatgcccatgaatacagggtctccatctctggtggattcacgatagccacaaacttcttcccatcaacaggtagaatctatttcccttccctgtgtcagggctggccttgtgacttccttttaacacagcaaaagcttcaggcttctgctttctgtgccttggaagccatcacagagaagactagctactatgagaccaccatgctgtaaggaagcccaaactagccacagaacagggagagacgctgcacaaaggaacactggcggcccagaagtgcgcctgggtg

SEQ ID NO: 661189 - DNA, 290 bp, Homo sapiens
acttggggtggctggggtggtagggtcgtttaaacccaggggttcaaggtttgggtaaacccttgtttaagtcccccccctgcagcctgggtgacaaagcaagatccttcctttccgggtggaatcccccaggcctgcccaccagtaaatggccccgctgctaacccccaagatttatagtgaatacccaggggggatggtgagttatatccttttgaaaggggcccaactgggccccaaaactgatgtttatgatttttttggaataaacgtcgaaattaactctccta

SEQ ID NO: 661190 - DNA, 542 bp, Homo sapiens
ttgaacctgtgagacagaggttatggtgagctgagatgtgccactgcactctagcctgggcaatggagcgaggctcatctcaaaaaaaaaaaaatggtcctttatgaaataaaaccaattagtatgacactttaaaaacctataatagcataatcgtacaaggccagaagaaggacaaatccctccttggtggtctaaaaaaatattggaaaccaggtgtggcccagtaagagtatatgcgtaggtgaatattctggagttaaagttggcagtggctgggcggtggcggatcgttaaaatagtattataaaatggattaaaagcctcataaaggctcatcccaaagggttacatcattatgctattttggggctcaatgggtttgactttggaataccttttacgcattatatggggggctgggtcccaagttggattaattgtagctaaatggattggtcagagtagaaaatcagagatttggaaaatgggacataaattggtggggttagaggcattttctggtaacacccatggtcatt

SEQ ID NO: 661191 - DNA, 312 bp, Homo sapiens
ccccccccccgtttttttaaaagggggacagggtccccccggtttttcacccctaggggggggggccaatggggggtgcatgggctttctgggtttccccttcccgtttggcccaaaggggatggatttggggtttggcccccccggcccccctttttggggttagggggggtgggggccccccccccttcccccgggggtggcttttttgtttcccgttttggcccaaaagttttcccccctcggggaatggggtttaaaatttaacccccgaatatgctttttttttttaaaaggttttgggggttttta

SEQ ID NO: 661192 - DNA, 788 bp, Homo sapiens
tattaatatagacttatgtgtacacgttttatagaacatcatatgatccttcaattcttatatctgagtttaagctcttaattttttttgttttttggtaaattcccgggtactctagggagtgcagttaagagaatggagccaaaattacatgcatagtcgttaacgggggtacataatccatcagccactggaattggtacacagtgacacgtgagggtgattggtaccatagaagtccatatttggacatggctattatataacggcttcttaatctcctatctttgctcagtaatactatcactacacacacaaattttcacttttggtaattctagtatcccccttccaaaaagaagctggactagagcggcagggatcagcgacgacaacagaggaatacactggtcaagaaaaaatacctccggtctgggcttttaaaccaggagcagactcaaccactcccaaacaccatccatcaacggaccgggacagcaccaagctagcccccagaagaaccctactaccatggccaccactccggacatgtccatggccacggacacgcccccagggggacctctcgcagcaacaacacacgtgcgcccaacacggtgtccaccaaaaagggggggccaaaactcaagccctccacaagccaactcggccaaaacacccaccaactggtgggcaacaaaccacagggtcaccaagtcggcaggacaaccaacaacagcaacacgaacccacaaacacaacgacacaacacacaacagcacagagca

SEQ ID NO: 661193 - DNA, 235 bp, Homo sapiens
  misc_feature (3)..(3): n is a, c, g, or t
ttnaaggctgttttggtgtctctgttgtcaccaagaaacatccagaatagatttgctgcagtaagtatcaaatctaccggacaggaaggataagccaccccgcagctcagtgagttccttggaaagccaatctggtagacgaagtgctggcctctgagaaggtgtcttctgtccgctgtccttcatgggccccagtgttgctctcagggcagttcttcctggcacattattcttc

SEQ ID NO: 661194 - DNA, 333 bp, Homo sapiens
taacaacccaggttcagattttccccttcctcatggccccggtgtgtgatgttccccttcctgtgtccaataaacgaagcagtttagtgtaatcaacctgcaaccaggtagctgactggtcacctcagggaatgttgccatatcagggactcaagttggtctacgttgctggcagattaaggactctgcagtggctgtatccaggtcagctttgctctgtcagctgcagagaaggatgcacacactgtggcaggagcacttcaaactggtggtcctcttcagccagatgaggctggccaacttccagacagactttcaggagagtattcagaa

SEQ ID NO: 661195 - DNA, 405 bp, Homo sapiens
agtcacagaaagagaaagccagacctgtgtatagactcaatggttggtataatgagcatcactacagcttcctgcataaacacacatccaggtgacaaagaagacggctcaggcttaaaacagctggtaattcacagatggctaaagagcattcacaccccattacagacatgtatataacaagaaaatttaccttgtaatttcacaatttttgtttgcctcttcttctatttttacaaataacagctctgcattcattaggatggcgactatattaaaaacaccccccccccaataatcagaacatgtccagttggtgatgatggagagaagctgcactattttcacactattggctagagtgtaaatcctctggtccctttaaaaattgaaggtgccgttcac

SEQ ID NO: 661196 - DNA, 911 bp, Homo sapiens
  misc_feature (432)..(432): n is a, c, g, or t
cctggtacggctccggattatcgggagtcgccgcccggatgcccggagcctgctgcgggccccagcgacccgcccgtcattggggacgaggacgacgatgagagctgctccggtggagtctgcggatcacagaagccaacctgaccgggcacgaggagaaggtgagcgtggagaacttcgacgctgctcaaggtgctggtgcactggtgagcctacaggcaaggtgttcgctggtgcggaacggcgggcggtgcacgacgctggggaagctgtactgccatgaaggtgctgcgcaatggcggctgctggtgcatgctgctgccagagacgcaatgagcacactgctgcaccgatgcggctcggatgctggacggctcgtgcgccagtgagcccttccgtggtcactgctgcagctacgtctttccagacggnatgccaatgctgcagcctcatcctggactattgtgagcggcggggagatgttcacccacctcgtagcagctgccatgtacttcaaggatggctgaggtgcgcgtgtagtgggggtgagatcgtgctggccctggaactacctgcacgaagctcggcatcatttaccgagacctgaaactggagaatgtgctgctggactccgagggccacattgtcctcacggacttcgggctgagcaaggagtttcctgacggagggagcaaagagccggaccttctccttcttgtggcaccatcgaggtaccatggccccgaaatcatccgtagcaagacgggggcattggcaaggctgtggacttggttggatgccctggccatcttgcctcttcgagcctgctgacggcgggcctcgccctttaccctggagggcgagaggaacacgcaggctgaggtgtactcggaggatcctgaagtggcacc

SEQ ID NO: 661197 - DNA, 338 bp, Homo sapiens
atgcactgcttcggatcggtggctcactgcccataatcccagcgctttgggaggcaaggcgggcggatcacgaggtcaggagatagagactgtcctggctaacacggtgaaaccccatctctactaaaaatacaaacaattagccggatgtggttgcaggcacctgtagtcccagctactagggaggctgaggcaggagaatggcgtgaacccaggaggcggagtttgcagtgagctgagatcgcgccacttgcctccagcctgggcgacagagcgagactccgtctcaaaaaaaaaggtgaaaggaaaaaaaaaggaattctttccccttagttaaa

SEQ ID NO: 661198 - DNA, 986 bp, Homo sapiens
ttgattccagctgtctgagatctcacatatgctccttatctgatctcgagaatttgcccccaccataataaaggtgaaaataaagaacagaaggacaagagctcataactcgtaataaaagccacccaatctccttaggttatgattaaatcacatgtgctagatggatctacttgtggatgatagcggttaaagagtccttgattggttatagaccagcagacagattccaaagaattcacatgacatcagctaagttgcaccaactttgaagtctgatattcctggacagtttctctgcgtttagatttcatgggagagaaacgattatgatcgtcagcaaattgtatcttacggttggtatcaaccaaatggagtgacttagtgtacatgaaagcgtaaagaggatgtgtggcatctttcactttgggcttgtagaagtacagacttttagtgtgatttgttaaaatcaagaaaaaccttggtgaagtcgtgtgtgaaccttaaggtctcagataggttaccgagttaagaggacccgtatcacagtaatccgggtcctaggtgcagcagtgtgatgccccagggacctttgttggccacttgcactatttaagctatgctctgccttgggatagcatatgtatcgtaagtgatgctacagaatgtatgtgaagtttcagaagaagatggggcagggttctgaaaatgggacttaatatctagttcagattaatagaaattgtggaactatgtaatagaaagcgtgttgtttgctggaacgattacagtcgagatttaaatacggatgtgaatcgaagaacatagaagagaaaaaagggggtgataaaaacgacaggcagaaagtaccattgtaaaggcccagggaggttaaagaggagggggtaagagtaggaaagagaaatggagccactggggaagaaacaaaagagaaaaagagtactggaggggataaaagaaagaac

SEQ ID NO: 661199 - DNA, 274 bp, Homo sapiens
gtggttgggtactcatgaatgggtggttgactccgtgagaggggaagaggtggactgctgaggtctgaggggttgaggactcaggcggaggttggatgtggtcaactcagcaatcggtgctgtgtttgtgttgggtggggggccctgtgcttccatgtggtgggtgttggggttgggtgtcaccgtagtggtggtgctgatgggtatcatggttggggtctgtgtgctgttgggtgtgggggttgcggtcaccgtagcgggggttgttgcgggt

SEQ ID NO: 661200 - DNA, 259 bp, Homo sapiens
  misc_feature (108)..(108): n is a, c, g, or t
gttgtggagccttaacctggtgatgtgcggatcttctaatgaatagagcatacagttggaggagcctgtggggagagaggaaactgggtgagctagcatgtctttctnttgacgttatggattgaataaacttgttaagtttggcatggaggagatagtttacggctttcaagtggcaaggacatgcagctgcctgtcaagtgttcatgagtgcagacatggcccatcttgagaaacttgtggcttcaatgcagcttta

SEQ ID NO: 661201 - DNA, 104 bp, Homo sapiens
tgacgcttgaatgtttgtgaagagaagacaagaaattaaattccgaaataaaaatcttctagacataacctcagacctagataaattttatacatttactgttt

SEQ ID NO: 661202 - DNA, 491 bp, Homo sapiens
  misc_feature (13)..(13): n is a, c, g, or t
gttaaggttctcngagaagacagcagagctgctttccgcctctttgagaccaagatcaccaaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcaagggacacccccagtacctgctggactcgaatagttggatcgaggagatgccctttgaacgcctgtgccggagcacccgccagcgggcagcctgtgcccagctcaacgacttcctccaggagtatggcactcaggggtgccaggtgtgagggctgccctcccccctcccttgggaggaccttgaacttgggacccataaagttgaaagccttctggggccccttttattaacccaacctggggcccgggcatattaaaggcttttggcagcaaagtgtcagtgttggca

SEQ ID NO: 661203 - DNA, 143 bp, Homo sapiens
agacatgatagaatcgagctggtaccgactgatctaacagaaagtgaaacaatttgatgtgggggcttctagattataggtagatataacgatttgctgatgggcaattggttgaaagagtacttatcgatagaagaggaatg

SEQ ID NO: 661204 - DNA, 233 bp, Homo sapiens
ggacttacgcgctgtcacagtatctgaagtatgtacaaaacacactcatcaacggatgtcctcttctccttttgtaattgctggctgaaaactgatcctcatgcacgttaacacccatagcgctcaattcttatggatatgcagacagtgttttggggaccaccgtggagaatctgtttcaaactaaggcgtgagcttctaagaactaagtcactaagacatcagaactcaca

SEQ ID NO: 661205 - DNA, 406 bp, Homo sapiens
acatagtctgtatatgacgaatttttctttacagtctttctagggtgtgaaatcaggtaataaaacaaatggacgaaagctacagttttctttagaaggtgctaattaatttgacgataccagttttcacgggaagaaatgtaccgatgatctgtgcagcatcttgactgggctttctgaggagttaggagttctttttcagcagtacgcacaggtacattccttctgttgatacacaatgcttgtacgaactcacagctataactttgtaatatcacaggagtcccttacccccagtagtatgtctaccatatattgtgtttacgtccgtttgtgactagggagaagggcctaaggtttaacttgatactcagaagtctcctctccgaaagattaagaaccacca

SEQ ID NO: 661206 - DNA, 86 bp, Homo sapiens
gacaaaccagtccgagagccttaagtgacattcccaagtctccaaaacaagccatccagcccaaggagggtgacattcccaagtcc

SEQ ID NO: 661207 - DNA, 1716 bp, Homo sapiens
gcccagctgtggtcgccaggaccccccagagccaagaccttctccagaaggtgacccttccctgccccaacgacacaatgtcaagcctggtgccctgaaatcacccctggaaacacatccatgaccatgaaagaatgaccctagctctacacgcaagctcccagagtgcacacatgagatgaccacgtcagagagacacaggtacggtgaccatagagacacagccacacaccgacaggacacgacgatcccatcattccatcatgacagcacacgagacagcacggaaccccagacaccaaacagccacatgggacacgcaaccgggactagccacgaaccattacccatcggacaaaggaagacaacagaccaaaaaacaaatactcacaaaacaaggaaccagtgaccacgacacacatacagaaaacagaacccagtacccaaaagaaaacccaacgacgagctgacacacacacgagcaagagaacgaagaaaacacacaacccaaaagcacagacacaaaaaaatgaacacacgaagcgaccaaacagaaacacgggagaccgccacacagtacacactaacaacagcaacacaccacacaacacacagaacaagaaagcaccacgcatgggacacaccacaggaaacagcacaacaaaacgagtccaacaccaggacaaaccatgacaaacagaaacaacaaaccgacacaacgacagaccaacacagaaccaccacaaagagacaaacaccagacacagacgacacgacacaacacaacgcaatcaaacaccaggacacgaacaacaaacacaacacacacaaacaaacaaccaaaacacagagacaaaacagcagacaacaagcgagaagccacaacacgcacaccacacagaacacaacaaacacacaacacgaaccacacaggacaacaaacacacgaagccacaacagctacacaccacacacaacgacacgaacaaagaaaagacaacgaaacaaaacacgaacagaacacaccaaccaccaatccagaagaccaacacaaaacacaaaaacagacacccatcgacaacaaagacacagacacacaaacaacaccacaacacacacaccaccacaaacaaacacaaaaaacacacaaaagcacaaaagcacagcacaacaaacacaaaaacaaagaaaaacaccgacagcacaaaccgaaaagaaaacagaaaagaaaaagccacacacacacaacaaaacaaaagaaataaagaagacaacaacaaagcgatcacacaaagcacaaagcaacaaaacaacaaagagaccacagaaaacaaaaacaaagcacaatacaagaagagaaatacagcagaacaacacacacacaacagcgagaaaaagcaaaccaacacaaagagaaaacgacccgaagcagacacgagtacaaaaaacagtacacgaagacaaagacaagcagaacaaacagaaacacgaacacaacaacccagcacaagaacaaacacacaaaacagaacaacagcacagacagacaccaacaacaaagcaaacaagcgaaaaaacaagcacaaagagacaccaacaaacaagaacaagacagaacaaacacaaggaaacaacgaaccagacacaaaacaacaaaacaaaaataaagacccgacagacgtaaaacagaaacatgagaaaaagacaaaagaaaag

SEQ ID NO: 661208 - DNA, 152 bp, Homo sapiens
tatcatttgaaaaagtaaaatgaatgaatactgttcatggtccacatgtattaaacaaaaaacatgtcaattacttggtggaaacacacagaacctggtacctgtttttttttttttttcaccacgattgtctacacctttttaagctgcag

SEQ ID NO: 661209 - DNA, 250 bp, Homo sapiens
ttcgccaggtactacaacaggcttgtgatgtcagacattaaatagtgtattaaaactcgcagtggaacacgagttgagctatgtatgcgctcgatctatttcgctgggcgtcgctccagtcggtttctgcaactcgtcgtacgtgaggtttataatctctgaaaggtaccgaattcatgtgagtggtgaaggaccacgacctagtgatgggcatcctagtatataataacttatcgcatcggtagaatgc

SEQ ID NO: 661210 - DNA, 343 bp, Homo sapiens
catattttgggggtacatgtgttaacatatttagacattgttatggataactcttttaaggaataaatttatttgggcaagtaaattctaagagtgattttggaatttcaggtttttttaaaaaatgatttatatatggaatcccacttgcctctcttactttgttctttctaccctcccctttcctattgcttcctcctcacaattcatacccttcttggctcctcctcctttctcctttggttaaagtgtattttaatttgttatatttattaaatagaactttgtggacctggttgtcaatttagagactgaaaataaacttgtttcggaaataaaaaaa

SEQ ID NO: 661211 - DNA, 1804 bp, Homo sapiens
  misc_feature (1457)..(1457): n is a, c, g, or t
gaggacggggcacaaaccctgaccatgaccccccacaggctgctgccaccgctgctgctgctgctagctctgctgctcgctgccatgcccatgtgaggctgccttgtgctgctggtgcccatgtgctgctgggcaatggtgtgttgcatgtgctggtgttgtccatgtgggtgcttgctgtgggagggagtgagtgatgtgggggtctgccatgcctgatggtgcttggctgcgtggaattgcttttgatgtgtgcttggtctcaggtgatgtgtgatgtggtgcatgtgatgttgcgtggtgtctacaagcccccttaactttgcggcccccagtgactttgcagtgttgcccaattccgtggcccatatgtgatctgcactgatggtgcctggccttttttgccgtgggccgggcttgcattggcttcggggccctgaaggtggcgcggtctttgcccttttcccggtggaccctggctgccggccgcttttgctttgttctcgccactggatgcggcacggaacttcccttacgctcgggacgcaggtaaagacccgcccaatatgctatggtgctagctttggccccaggccccaaacgatgtggatttggttagaaaacgccttgcaatgtgagtgaaccctaataccatggactggtggaagattcgcgatgggggcgatccctttcctttatcccgaagtggccaccttttctcctaatggccccccgaataatttcttttggcgtgggagttttccttccccaaagagggcacacaaagcttatgagcgcaatttttgtgggccccccataatttagcccgcggggttaaacgagaaacgacatttcctttggggcaacctgtccacagggtgtaggccagcttatgacgcaatggacaaaaatgccttcccacaacgtaagacagttagggagggtggattccataagccgcgggaagggggggtgcgcgcttcaaaagaagagccgaagcatattcatattaagcagtgttgttggccacgcacaagaattttttgtgttgttggaaacccccaaatatgttccgcgagagcggcggcccatttctatcacatattacacgccgcgggtgctgacaatacaagtgtcgcgtggtgcgccacaggtgttttgtcgctgcgttgcttatttctagctctatcccacaccaaaggtgggggctgggccatagtgtgccggcacaccgcgaagttgcgtactgttcacaccattttatgtccgtattgggggagattggtattggattagcgggcgactttccggggaatcttgcgggcagcaacaagtggattaccgcctttctgcgccctagtggtggcgtcttcattcccaaagagcagttttggcgcagaaagtttggggagcacaaggcgatatcccgtatatcccgtttggtccgcacacagagntttgagggcagaagatgtgataaaagacgggggggaccttaagacaagcgcgttgtggtgcgcggggcgaacctatgcgaagggggggggtgcactttagtgacatgggtggtgacccaataccgctgtggagccacagctgggccaacccacatttttgctcaaggcgctttgatacaaatttccagcttcccaaaccacaataaaatagcgaactcgcggaaggggtggcgcccttccaaagaattccacaaccccttttctaaggtgggcacgccgtggcgccacctatatgttggtggccccaccattacaaccgcgtccttgtttttttgtgcatccaactc

SEQ ID NO: 661212 - DNA, 122 bp, Homo sapiens
ctggagcttctggcatacctggagcttctggcatacttgaccttctggcatacctgtgaccttctggcatacctggaccttctggtatgccagaaggtccatggtatgccagtgtggatcct

SEQ ID NO: 661213 - DNA, 490 bp, Homo sapiens
catggtggcgcatgcctgtaatcccagctacttaggaggttgaggcgggagaatcgcttaaacccaggagggggaggttgcaatgagccgagattgggccattgcactccagtctgggcaacaagagcaaaaccctgtctcaaaaaaaaagaaaatcaactaatgtaatacatcacattagcaaaatgaagataaaccacatgaacttctcaattgatttagcaaaaaaaaaaaaaaaagggtttttccaaatttcaacccccttttcgttgattaaaattccctcaattaaccaaaggagaagggaatttcccttcaacttggaaagagggccattttttataaacctctcacaggcataattattcggatatcccaagggcggtggaaagagactgtgaaaaggcttttcctctctttagaggattaacaaaaccagaggaccaaaaggattgcctggtgttttcacccactttcttatttcaatttc

SEQ ID NO: 661214 - DNA, 690 bp, Homo sapiens
  misc_feature (459)..(459): n is a, c, g, or t
ttcgcgccgtgagatagggtcaacgccgacgccgggttcatcgagcagcaacactttcggttcgcccaccagggtacaggccagaccgagtttttgtttcatcccaccggagagcttgcccgccagcgtccggtaaacggcccaagagacgtaaactccagcaggcgagcaaaagtttgcttacgtgcctcgccggtgacgctgcgcaaatccgcgtacagattgaggttctccatcaccgtgagatcttcatacagaccaaatttctgcggcatataaccgagcacggcgtgaagcgcgccgctcgtttttgatcggatcaaagccaatcaccgtggcactgccgctgtcgggtttcagtaatcccgccaacatccgcatcagcgtggttttacctgcaccgtccggccccaccaaccccgtcacataaccggcgtgaatggtacaatcgagcggccnacggcgggcttgtccatgcccggaaaccgttttcccaggccgttcaccgtgataacggcatcattcatgtcctgcctcgtcaccgaattgtaccgtcactgcattccctgcgtaacgcatcatcggcgtcggtcaccacaatacgcaggcgatagacgaggtcggtacgcagatccggcgtttcgacggttttcggggtaaattcagcagtcggcgaaacgaaaccaatct

SEQ ID NO: 661215 - DNA, 240 bp, Homo sapiens
tctacgaggactccccagtccaccacctgcgtacgttgcagtcattctgaaaggagctttccctgtcattcactttccaaccatgcttccaatcttcatccaactgctcacatttgtcatttttccaacaccaagtctacacattctgcaatcaacagcagcagtagtttttttttttttttttttttttttttttttttttttttttttgtaattagaggggggggggggggggggggg

SEQ ID NO: 661216 - DNA, 211 bp, Homo sapiens
ccccccccccccggggggggggttttagggccctttttaaaaatggggggggtttccaaaaaccttttttttcccccccctgttgggggggccccccccccccccccccccccttcttggggtgggggggggggggtttcccccccccccctgggcctttttttttttttgggtttttccgggggccccttaaacggtccccgttttttta

SEQ ID NO: 661217 - DNA, 419 bp, Homo sapiens
cgcagcatggtacaaatcatcaacatcctcatacacgtaccgtcatactcctcaacctcctcactgtcatcatcctcctcttcatcactgtctaccatctaggcattcttgccattctttgcccccttggctgggatggcagcacacttcttaccaggagtagctaccaatgctttgcctggtgtggctcccttctggccaggtgtggtaactgctttggctggtgtagctgtcttcttggcaggtgttgctgctgccttttagcctggagtgacagctgctttcttggctggtgtggcaactgcaacctttttcgttggggaaacgaccaccttctttgctgaggtagcagcagccttcttgcctttcttctgaggtatgacgacctcttctccactgctatcatcttcttcatcttc

SEQ ID NO: 661218 - DNA, 327 bp, Homo sapiens
tccccgtacgcccaaaaacaataatgaagtgttctgtgtgctaacaacatagcttttaaaaaaaaaaaaaaggtaaaacaaatttctgcatttttataaaacttgataaaaaatagtttttcaaactgtccagtccccagaggtccacagttttcaaaaatgcacacacttcatttggcatctccagcaccttcagttttctgggcctggtctgtttgggcatctccattttctgcggggtttttcccctccttgccagcataagcttttccttttttcccttggggaaccttctctccctcctttgggcgtccggggggggacccg

SEQ ID NO: 661219 - DNA, 127 bp, Homo sapiens
  misc_feature (56)..(56): n is a, c, g, or t
  misc_feature (75)..(75): n is a, c, g, or t
  misc_feature (80)..(80): n is a, c, g, or t
tcggcgacttagaggatccccccggaagatggactcttcatcctattaagattaantgtaaccttaagtcagatnacgtnctctctctcctcaaaaccattcatctgtctgtccacctgtccaggcg

SEQ ID NO: 661220 - DNA, 112 bp, Homo sapiens
ccggaaaaaagagcaccaaagaagaaagaagaagacaagacaaaagaagagaaaaaaagacacaaaaaagacaagagcgacaaagggaaacaaacaaccggcaaacagaaag

SEQ ID NO: 661221 - DNA, 437 bp, Homo sapiens
ttatctttcttaaagtacagctttaacatcataaaaaaggattttaagggagtgatcaatcattctcacctaacctgacaatatcattagcatacgtatcctgacaataccctagaaaggtccttcttgagttgcacagtgaaaaattaaagggattcttgcaggagtatttagagaatcagaatccgcaacgcagggtcagatgtttcagttaaatgaaggactttgttcaaggcacaaacaagagtagggatattttgatggtatgaacaccaacccttggcctccgttccggcctgtttgcagttaaaggtcttggcagcctgtcagggagtggagccatgttattgattcctaaagaagggacagcatccaagggaaataattggtcttatttcccctcggagaggaattaaaaagaaagtatcaaaaaaaaa

SEQ ID NO: 661222 - DNA, 301 bp, Homo sapiens
cccagtctgaccccatcagagtatatcaatatgaaggacatgtgacagataaagaagatgccatctgctcccatcagagatgaatgaataaagaaaaggtggtatatatatacaatggaatatcaggcagcctttaaaagaaggaaatcttgtcatatgctacaacatggatgaacctcaaggacgttttactaagcaaaataaaccagtgacaaaagtacaaagactgtatgattccactcatgtgaaccatgtagagtagtcgaaatcacagaaactaattagaagggattgccagagg

SEQ ID NO: 661223 - DNA, 167 bp, Homo sapiens
atcagctcgtacccacagtgctggaggaggatgaaaagaagcggtgcctgggagtccataacagctcagagactgtggctccccactctggtccagacctatgtgctccagtgtggacccaagagcagtcacctaccctatcacctgtaagtctgggggtttggctt

SEQ ID NO: 661224 - DNA, 113 bp, Homo sapiens
catgagtctcgctgttgacggcccaggcagatatagtaggcctgactctcccggagagtgataaccgatggagtgagagacggactgtgacagtcaagagtgccatgcaggcg

SEQ ID NO: 661225 - DNA, 585 bp, Homo sapiens
atcacatgactgcactgtctcgtctcgacactagaggcccctgttgctgcagtcgcctggggtcattggctgatcccggtagtcttcccctgtgtagaccgtcgtcatccagacacacatgccattcacgcagcggccgtgctggtgacagtcattagggcagctcatgtcactgcagtcatagcccttgaagccttgctcacatacacatttgccctcgaaacagcggccccgactgtgacagtcattggggcaccgtagctggctgcagtcctccccagtatagccctcatcacacacacaactgcccattgacacagcggccatggccactgcagccattgggacacttgagctccccacagtcagctccagtgaaaccatcatcacactcacaccgcccgtctatacagcggccacgattgtgacagtcagcaggacacctcttctcgctgcagtccacaccggcaaacgcctcatcacatacacactgcccctcctcacaccgggcctgggtgtggcaggcatgtgggcaggtgggttcccgcagtcttcacctgtaaggcttcttcgcagaccaggtgc

SEQ ID NO: 661226 - DNA, 594 bp, Homo sapiens
agcgggcgggggcagggcggtgggcgccgggcggggccgcgcgctcgcccatcacgcggccgcccgagcccggagcgcggctccgcgcctcgttccggccgctcggggaggggtcaggtcatgttcccttccagagtccggcgactctgaggcaggttccgcgggcgccgctgggaggagccggagctgccggaggaggcggcccgcgtgctcctccggcagctctggctcctccgagcgtggctgcctcgcggggaagccggtccgtacaagaagctcgagcacgagaaccccgaggaacacggaaaaaaatggaacgacagaaccgacatcacgagagaggccgggcaggaaaaagagcagcgcggggaccggcaaccccgcctccgcgcagaggcacgatgtcgcacagcagaaaggtggtagaaaaggaggagcacacgggcgaaacggcgcggcgcaccccccgagacgaccagcggccagcgaagcccgccggccccgaagcgaaaaacacaagaagacaaaaaacaaaccgcggagcaaccagaaataagaaaaaagaaaatacaagggggtaaagacaataggaca

SEQ ID NO: 661227 - DNA, 139 bp, Homo sapiens
gactagctttgtgaggataccggacttgtgaggagacccagaacatgagttgttaaaatgccttccgcctctgtacaatcccagagttgcctcatcacactggctcccgtctgctgagggctgaggctgagcctgggac

SEQ ID NO: 661228 - DNA, 366 bp, Homo sapiens
aacaaatattacaaagggtatgatgaaaagatgcctagaggtaagagatgaaaatagacgtggagcttttatatccatcccaggcatgccaccctccaggaactttcatgagttcaactattcagaaacttcccacaccctgtcatttgcagtttttatagaagctttgttaggtaggcataattgattaaaccattgaccgctggtgatcaacttaaccttgagcccctttttcctctctaaaggatggggctagggccaaaagtcccaaccgtctaatcatttctggtgaccagcccccatcctgaagctacctaggagctgccagccatctggcaactcattagcacacaaaaagacatcact

SEQ ID NO: 661229 - DNA, 645 bp, Homo sapiens
  misc_feature (174)..(174): n is a, c, g, or t
  misc_feature (352)..(352): n is a, c, g, or t
gccggcccctgtatatatctggcgcttctccttagcctccttcattctctaggccaaaagtatagcatattctgcagcctcttctatatttttctatggtacgctgcttcttcagagcaatacgccgccgtattgtagctgcagagacacagtaggagtaacaaagacgctganatctatgggtgctttaggtcctagagtttctatacccttctattatattaagaggctttctatacaaacatactaggcgagacatacatctatctttagcagagattagaaaagtattgcagattctagctagctcttataggggcccaggcggcgcaggcactggtagtatcagtcnacgtcaggaatatcctatctctcctattttttacaattaaccaagtatgagaacgctcagatttgcatccacaatgcaaccacgaactgattttctctttctttctccagttctccttggtctgtaacaggaattgccccttactcagtagcaggcggacacggccatgggtcaagacaccctgcttcatggggaaacttgtttgtcgttcccaccactgattcggaccacataacccttccattcttcaccccgagcgtcagcagcaacttctgtggccatcccgaaatatc

SEQ ID NO: 661230 - DNA, 109 bp, Homo sapiens
ggcccatcagctcttcttatactgctcacctggtctcatgctgggcccgctaattcctgcagcgcatcgccagccggctctcatactcacgctgcttcccattgtcaat

SEQ ID NO: 661231 - DNA, 177 bp, Homo sapiens
aacatgtcatctcttctctctcccaacacacacatatatccccaagccatctgaaaatgagctgcagagcagatatgaatctttgccaggtacatcctcagactcaaaacattctctggcacaatcactcacactcaataaatctaactgctaactattatttagttagcataccca

SEQ ID NO: 661232 - DNA, 727 bp, Homo sapiens
gggcacaacactgataagtcactgtcatgctaacattttttgtaatgagctactttgacaatacttccataattttctcaaatgatacagattttgcctcatctctctcgctgtcacacacaaaacttttggccataatggggaaccttatgattctcccttataattgcaaaacactagaaactctcatttatttcacctcttctcttgcagacaagggaacaccccagacatggtatcagagatccacatgacaggcccaatgtgcctcattgagaacactaatgggcgactgatggcgaatccagaagctctgaagatcctttctgccattacgcagcctgtggtggtggtggcgactgtgggccgctagcgcacaggaaaatcctacctgattaacaagctggctcagaagaaaaagggtgagtggcatgagcaaagctctgccaagtcccttctgtccatctacacagtcagcctccatcacgaggatgtgaagagagaaagagatgaggatgaatatggaaagctaactttccattcacagtcgggctccttatcttcatgctgctctaagggataattttaaattcattaattattcccatgatacattagtttccctttcaaaagcacaaactgtgcctttcctaaaaggagtaagactgtaataaaaataattaatgtacataataataactataataaactacaatttttatgccgt

SEQ ID NO: 661233 - DNA, 893 bp, Homo sapiens
ggctgctgcaaatgcttggttcagatcgcagcggaaaacaacctgggagagggcgtcattgtcagagatcaacgttcaatatcatcgccctctccctatgactacaagcgccaacctggcaacctacagtagaagccagagatgtaggcgggaagtgcctggactcgctagtcaactgacgctgatggatagtcctgttttgcaaatcgccgcaacattgtgtggtcggagtagaatattcgtggaagagagtgagaacgctgcaacaacgctgaccgagccgatctgcgctgtccgtgggctggatcctaactctggtggaacgaatggatgaacgaatatagcaacaataactgcagaaatactggatcgctttacttcccagaggatgctacgtaggacgcatctctggagaggacttgaggcccaggtagtgtggccatcatcggagcgtagtgcagcgcgtacctgtggatgcgagaaagggacacatagcgagcgagggtcgtgccgcgatcgtaccctgctgcacaatccctgacatcagctaactacaacgtccgattccaaggcccagtcaggcgaacaggtgaccccgactgcagggcatccttaatagttctgagacgaagaccgaggcatgaagaaatgagggtgcgaggtactcgagactggagttgatgggagcagactgtgcaggtgacagttcttacagcaccccagggatcctggtaggaagcacgcggatccggaacattgtagccaagtacctcttgtcaacagtgttatccacgcgatgctgctgggagttcggagacgggtaacccagggcccgtgaacgtcattggtgggtcaggacagatccggaatacgccccggaaggacctaatcaa

SEQ ID NO: 661234 - DNA, 132 bp, Homo sapiens
cccaaatatactaaagtaggatcttaggcaatgagttatccaaggcacctgttacagactggaaaagattcattttctgagtttgcccgtactcccgggctccggatctggctggaaagtaaaatgagccac

SEQ ID NO: 661235 - DNA, 290 bp, Homo sapiens
gagaaggaatgcagggcagcctctggttgcagagagcagcacccagtttgacagctagcaatgcaattgtgactcagacctcacaagtacaggaaatgggttttgcccaacaaccaaaaggagcaaaaaaggttttgaacttggaaatttccaaaaaagaccccacccagtaaaattggtttttcagcctgtgagattttcagcagagaacccagtcaagtgtgtccagacgtccaacctacagaactgtgagataataaatagatacttattttaaaaaacaaaaaaaa

SEQ ID NO: 661236 - DNA, 216 bp, Homo sapiens
tacgatcgagctcggtaccgcatgtgctgtagccagcggagtgggaagagttttacccgtcgctcccgcctgcgcgggaacgacgcgtgaaaggatttaagacatgccgccatctaaagacacagtcaaggaatttgacttcaacgccagggatttcgagcgcgttcgcggcttgatctacaagcgcgccggcatttcgctggcctacagcacatg

SEQ ID NO: 661237 - DNA, 1037 bp, Homo sapiens
  misc_feature (280)..(280): n is a, c, g, or t
  misc_feature (387)..(387): n is a, c, g, or t
  misc_feature (395)..(395): n is a, c, g, or t
  misc_feature (399)..(399): n is a, c, g, or t
  misc_feature (402)..(404): n is a, c, g, or t
  misc_feature (410)..(410): n is a, c, g, or t
  misc_feature (442)..(442): n is a, c, g, or t
  misc_feature (469)..(470): n is a, c, g, or t
  misc_feature (483)..(483): n is a, c, g, or t
  misc_feature (487)..(487): n is a, c, g, or t
  misc_feature (528)..(528): n is a, c, g, or t
  misc_feature (530)..(530): n is a, c, g, or t
  misc_feature (545)..(545): n is a, c, g, or t
  misc_feature (549)..(549): n is a, c, g, or t
  misc_feature (556)..(557): n is a, c, g, or t
  misc_feature (564)..(564): n is a, c, g, or t
  misc_feature (569)..(569): n is a, c, g, or t
gactttcatgctagagggtcatgatgatggaataccgagtgtgacagggtgcaacagaaggaaacatggcgtgccatatagtgtttgagtccattggcaagtttggcctggccattagctgatagcaagaagcgtgatgaactctgccttatataatgtcggatagctagggcacagagctgatcatcatatgaccgatatccgatggagtagcaggacatagtaggtaggggaagggactcattttctcatcccgtgggtacagaaaccaattatcttngactgccgtactcgaccacgtaatgtgccagtcatcactggtagcaaagatttacagaatgtcaacatcacactgcgcatcctcttccggcctgtcgccagccagcnttcctcgncatnatnnnaccagncatcggagaggactatgatgagcgtgtgctgncgtccatcacaactgagatcctcaagnncagtggtggctcncttngatgctggagaactaatcacccagagagagctggtctccangncaggtgagcgacgancttnacagagnngagccgncaacnattggggctcatcctggatgacgtgtccttgacacaatcgtgacgctctcggggaaggagttcactagtaagcggtggaagccaaactaggtggctctagctaggaagcagacgagggccagattcgtggtggacaaagggctgagcaacggaaaaaggcggccatcatctctgctgagcggcgactcctcaggcagactgagctgattgccaactcatctggtccactgcaaggggatggcctgatcgagtctgcgcaagctggaagcatgcgtaggacgtcgtgtaccaggctctctacgctctcggaacatcgacctatcctgctcagtcggggctagtccgtgcgtcctccagctgccccagttgatgggcccaccctgtactgcacctccgtgggctgactggggccacaggcccctgactgattcttaacacagcttccttctgctcccacccagaaatcac

SEQ ID NO: 661238 - DNA, 671 bp, Homo sapiens
ggcggcggcgccagcgccaccgtccggtccacccgccagcccgcacagccgcgccgccgccgagcgtttcgtgagcggcgctccgaggatcaggaatggggcttcgggcgctgggcgcgctccgaacccggcgcacgtaagagcctgggagcgcccgatgcctgccctgtgctgccctggatgccccatcgcctatggacctgggagatgcttggaaattgcaacctgcctgttccccgtaggagcctgctgcccccgggaccccctgtgcactgtgctgcaccctgtgtcagcatggcccccggatgagagactggctgcctcccgaactgcgcctgatccctgcgttggcctgtgtgcatgctgccacgctgatgccccctaggctgaccgcatgggccacatgcatgctcagcctgccgtgtgccccctctggaaaccatgacccccggctgctgggcccatggatgccatggcctatagggtcctggtgcctgcgcgtgggccacctcagccgcggagggcgcgcaggctgctcttcgccttcacgctctcgctctcctgcacttacctgtgttacagcttcctgtgctgctgcgacgacctgggtcggagccgcctcctcggcgcgcctcgctgcctccgcggccccagcgcgggcgtgcagaaac

SEQ ID NO: 661239 - DNA, 457 bp, Homo sapiens
  misc_feature (83)..(83): n is a, c, g, or t
cagaaatcatattttatacataatttagcattatcatacatcttggctaaataataccatacaatcgtagtggtcagaagagngggggggggggggggggaaggaggggggggggggggggggagggggagggggggggcggggggggggaggggggaggggggggggggaaggcgaggggaaacggtgcacgagtgagaaacagatggtccaggtgcgtacaacctgaagagaaaagaactgggtttaatggtttaagaaaaagcacagctttttcaccttcatcttgtataatttcatagattggctgacttagggtctttcaatagtttgggaattgaaagattcttgttatatatagctagtttgggtttgtttttgttttaactatgttgaaggttaggtgagatgggcaaataggcttaactattttgaaggttggatgaaaagagatggg

SEQ ID NO: 661240 - DNA, 184 bp, Homo sapiens
tacgcattgaaggccaaaattactgcatactgagggtcatgttccaacatcactgaagccatcataacatcttttttatgcactgggccaatgttaattccgtgcatcagggcacttcgtgatgttttcatgcaattccagctcgagcttccaaatgaacccagttgtagaaacttgacacggt

SEQ ID NO: 661241 - DNA, 505 bp, Homo sapiens
  misc_feature (51)..(51): n is a, c, g, or t
  misc_feature (102)..(102): n is a, c, g, or t
  misc_feature (105)..(105): n is a, c, g, or t
  misc_feature (465)..(465): n is a, c, g, or t
  misc_feature (476)..(476): n is a, c, g, or t
  misc_feature (491)..(492): n is a, c, g, or t
tcccccatcggaacccaatgagcccccatgattcaattatctttcactttnccccttccacaacacataggaatggtgggggaacaattcaagatgagattnagncccgacacagagtcaaaccatatcaccctgcttggcatcttgccaccaacaccctgaatctgttagaaatgcaaattaaccaagtgccagaacctttcatggtttcctcttgcctaggaatggagtcccagatccctaatgcatctcggtgccctgagtgccatggctgctgctgcacttcagtatgtctgagaccagtgcagccactgggacttctctcccttcctttccctgcaagctgccttcacgcctggctcttctgcaccacctttcctctgtgggacttgtttatttgcactcttttgtttaccagctcctaagatctttgaggcttagtccagcccatcgatctggagtagnctatgcttttncttcctagagcttgnngtatttgcaatga

SEQ ID NO: 661242 - DNA, 246 bp, Homo sapiens
gatctgatagctgatgaacagctcttcttaaattacaaacagaaacacaaagaaggaatgaggaaaaaccccagtgacttccaaggtgtgaagctgtcccctcctccctgccaccctcccagtgctcattagctgtccttgtgaaggtggcagagtgactcagagtgggatcagtctccagtggtgccctgtggctgaagctgggtgaggcagatgagtccttgaggccacagacgctgggcaacc

SEQ ID NO: 661243 - DNA, 389 bp, Homo sapiens
tccttactctctcacggacggggttttgctgtgtttgccaggctggtcatgaactcctgagctcaggtgatccgcccaccttggcctcccaaagtgctggggttccaggtgtgagccacggcgcctggcccagaaccttaagttcttgatgtacagagaacggcagcgtcagtgaagtgtgatttctgtttttttgtttccactaattgtgagcaaacattagggtggggactgcgctgcttgtgtgggtcccacaggcttcttggagcacagtgtcagcagagaaggggaatgggggtcctcattgcggggagcagttttgcctgggatgctgtgagtttctcagagggaagctaagtggacagactgttctggcaagagggaaggat

SEQ ID NO: 661244 - DNA, 347 bp, Homo sapiens
gtgagttgactgaacgaagcctacccgaagttcatgaaagtcgaggatatacggaccgctacgccttctgagccctcctttccctagtggggcgttgctagagactgtgtgtatagtttacacacccaacaccatcagtgccagctgagtactgacatgtggatagagggtgactgaataattaagactggattatgaaagtcaacagctctttcccctcagctcgttctcctgaaatgactggcttcccctcaaattggcacgtgagattagctacacttctccccagcgggtacatgatacatgatcccaggttccagtgtagaagctgagtcccccattctcga

SEQ ID NO: 661245 - DNA, 760 bp, Homo sapiens
  misc_feature (121)..(121): n is a, c, g, or t
  misc_feature (194)..(194): n is a, c, g, or t
  misc_feature (270)..(270): n is a, c, g, or t
  misc_feature (279)..(279): n is a, c, g, or t
  misc_feature (281)..(281): n is a, c, g, or t
  misc_feature (307)..(307): n is a, c, g, or t
  misc_feature (385)..(385): n is a, c, g, or t
  misc_feature (452)..(452): n is a, c, g, or t
  misc_feature (729)..(729): n is a, c, g, or t
ccagaacacaggggtcgtgaaaactaccccaaaaagccaaaatgggaaaggaaaagactcaaaacaacaaagtcgtcattggacacgtagattcgggcaagtccaccactactggccaacngaacaaaaaaagcgggggcatcgacaaaagaaccattgaaaaaattgagaaggaggcagcagagatgggaaanggctccttcaagtatgcctgggtcttggaaaaactgaaagcagagcgtgaacgtggtaacaccaatgaaatctccntgtggaaanangagaccagcaagtactaagtgactancaatgaagccccaggacacagagactttaacaaaaacaagaatacagggacatctcaggctgactgtgctgtcctgantgtagcagcaggggtaggtgaatttgaagctggtaactccaagaaagggcagacccgagagcatgcncttctggcttacacactgggtgtgaaacaactaaatgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaagatggcaatgcagtggaacacgctgcttgagntctggactcatctacacaactcgtcaactga

SEQ ID NO: 661246 - DNA, 694 bp, Homo sapiens
  misc_feature (480)..(480): n is a, c, g, or t
caaaatgcccagccccaagctttagcgaatctttaacccccaaaattttacgcaatacttctgcctcctgagaagttcctcctctggaagccacaaactaaagggtttcttaaacccccccgcgcgcctttcaaaataaactttttccccgtgcgaacaaaaaagtcttttctaaaaacgcattgttggaagtcaacaggtgcaccccgcgcatcccccgcagtcaatagcccctcataaagggccacactaacttcttgtgaagtcataaaagtcaaggtctctctaccccgctttaagatacattttaaacattcattggtgaatgctaacaatatcttcatcccgtcatttttttaaaaaaggagtttatccccacgtgtcgcatcataaagaccccctttaaacctcctccccacgggagatcttgtcctcccttagcatcccccttttaccccctttacttaaccccgaccgcantatggaagaaatcactattggagcgagtattaggagtgaacccacttgtgggagaataatattaatacatttctagagaggggaaaatgtgaatgaccaccagaattcccggcgaagcgccgacatagacaaagaattcaaggcaggaaatatagcggggacattatgaaaactatacgaaacaccatccttctatacaaatcaatagtacaag

SEQ ID NO: 661247 - DNA, 253 bp, Homo sapiens
  misc_feature (141)..(141): n is a, c, g, or t
  misc_feature (148)..(148): n is a, c, g, or t
  misc_feature (155)..(155): n is a, c, g, or t
  misc_feature (169)..(169): n is a, c, g, or t
ctcccaagtagctggaattataggcgcatgccgccacacccggctgattttttgtatttttagtagagtcagggtttcaccgtgttgcccaggctggagtagatatcctgacttcgggtgatctgcccacctgggcctccngaagtgntgggatngcaggtgtgagccnccgcacccggctctatttagctttttaaaaattatttcctttcaagggcccctccccacaataaagatgctctccgacaaaaat

SEQ ID NO: 661248 - DNA, 403 bp, Homo sapiens
  misc_feature (3)..(3): n is a, c, g, or t
  misc_feature (20)..(20): n is a, c, g, or t
  misc_feature (30)..(30): n is a, c, g, or t
  misc_feature (69)..(69): n is a, c, g, or t
  misc_feature (121)..(121): n is a, c, g, or t
  misc_feature (127)..(127): n is a, c, g, or t
  misc_feature (309)..(309): n is a, c, g, or t
  misc_feature (315)..(315): n is a, c, g, or t
tancccctgagatggatcanttgagttatnactttggtaacctttacacagcccaataaccaaattaancatcattatctgagtttaaaataggctgtaaatctcgaagccctggtaatangcaganacttacaaccagggagtcataaaatgacattaaatgacacttggaaacacaacccagaaagtactctgaatgaatgggaaggaaggagaacgtcactgaaaggagagtaggtgggctcatccctctgtgtgtgatgcaaggattcttcaagtcacagcattttgctctaacatggccacttnaaatgnactttcttcatctctcttcacgttgcctgtgtctccttcaagactagacaattccttctttgagtattgcttgaaatactgcaaggaa

SEQ ID NO: 661249 - DNA, 639 bp, Homo sapiens
caaataatacgcgtcgtccccaatgtcacaaaaaaggaaagaaatacccagggaacgcggccgcccatatatatataaatcctatactctcatattagaataaataggctcgctcataaataaagggcccattaatttatgggtggggtttgccagcgccttggcctactgctttgtgaagggtaatttgagcaccaggtttccccctcagaagaggttccagtcaccagaagacactgaaccctcagctctataaaacctggagggacagtgaagccctattattcacagcacataagattctaggacacatatttggactttttcccacaagaacctcggaagacactccttccccccctctcatgaatactgagcttgcacacttgggcacctgccacagcgtgaggtcagggaagtgggttaatgctttctgaaaaagggtattccttgatccgtgtcccccaagtccccacagccttggggtccatgcagagcccacagtgcaagagacgtggctccccgttgagatccatctgatctgccggcacagtcactttgtcactcagaaacagatatgcgattgaatatggggagtcgccgggggtctcccacggtctggggtggcgcaaaaactcc

SEQ ID NO: 661250 - DNA, 99 bp, Homo sapiens
  misc_feature (98)..(98): n is a, c, g, or t
gtttggaacggcaaaaaaaaatttttttttctctttttggggggggttaaaagggaacccaaaacatttaaataaaactttccaaatatttccggggna

SEQ ID NO: 661251 - DNA, 1290 bp, Homo sapiens
  misc_feature (906)..(906): n is a, c, g, or t
tgggttttaaaaacttagggactaaaattatatttaaaatatgggctataatgtgggtattgaatctaactattttgggcaaaatgttaaactatcccccacttttatgttgtcaaatatttatcactatctatgcagtcctggttttttatggtttggtttaattttggtttggttttgagagtctgggctctggtccacccaggctgggagtcgcagtgcgctgtagatctggcaaaactcttctggccccccggtgtgttccaagcgcagatatctcctctggcctacaggctctcccccagaatgtacgtctgagaagtattaacaggtgtgcgccgccgcacacacacatcttgggggctaaaatatttggggtattaaattaagtaagaagaccgggggtttcacagcgcatgttgtgtggcgccatagagcgcccgggtctctctctcctgtgacccctcaggggggtgatcctcagcgccccaacctctgctgcgcccttctacacaaagggtcggcgtggagattctcccaggcgcggtgtgagcgcccccccctgtttgtcccacaggccccaaactatctctatatcacacgggtctgtgtgacacatgtgagacaacctttgtttgccccacaaaaaccacaacgcccttttggtgtctgtgtgtacgcacaccacccaccattattttttcttcacctgtgaaaaccgccgtgttttgtagaaaatctacaaagcgctttattattatccaccttttttctccaccggtagaattctcggactcttttttgagagaggtatcacctccaacagggggtcttgaagaaacagcagcatctgtgtcgtcggggtcacccccacctgttgaaacaacaacattcttatcaaagagngggggcgccccaaaataatttttcttccccccttttaggaaaaaagaaacctctttttcttcccccctccttttttttttaatgttgtggggccccccccctattattttttttttaacatgtcgttcggggacctttatacaactctcttttggcagaacaaaactttttcgcgcctctacgaacaacgcgggaaaccatggaaaattgtgggactctccgcgaaaatttgaaacaactatcgttggtccccttttataaagaaacgcctattagtattataaaccttgtggttccccccccatttgtgggcccaacacattattttttttctctccccccccttgttgggccacactttccccgtgggggccttggacaagc

SEQ ID NO: 661252 - DNA, 266 bp, Homo sapiens
ctctcagctccaggcaggtactgtatatctgtagcacggcagagatctctttccttgacccatctttcacctagtaaataacattttgcttattcacttttgccaggcttatgggggtggcgataggaattctccccatctagctttacttttaggtgagttctctgtgtctagatcttaaagggacagtctttttcagtgttcatgcacctctacctctttgtctgtccaacactctgcacttgtgtctctggcatcagcttgga

SEQ ID NO: 661253 - DNA, 1365 bp, Homo sapiens
aaggactcctttgtggccttcatggcttgattacttattcccaagggaaaaaaaaacacacaaaaaaaaaaaacacaaaaacaaaaaacaaaaaaaaaaagagagggtggcgcgcacataaacagaaatctctcctcccagacgggcgtcacacactccacacaacgccacccgcactttctcgcccgaaccaggcgcggcccacccaaaattagtgggtgaccccatttataatataagccagaagcacaatgcccgtcatatatactaaccaaaagctacacatcatatcttgcacaaccaaactgcttaaatacatgatgaaaaatctcctgttgcaacagagacacacactatattacaatacatgtaagacgtgcgtgaaccacatcacgctcgcgggggccaacagcacacacaccccacacacaagaggcaaagcacaaagcagacatcctacgagagggcgcaacccctctcacacaccaagtattttaaaaagggcgttatacccagcggcgggaccaaaaagacaagacaggcggcaaaaaaaacaggagtagcaggcgtgtagcacaaagacaacttcctggccgaaccaaaacggtagaacacaatagatttctaggatgccacaaacacttcatacaaccacacgagagaggccagccaacacgaccgaataaaaaaccccgacgacaaacacgaaaccagcgaaacaaccaccacccaacacgacacgaccaaacgcgccaagaggcgagcaacgaacaagccaaacgccagatcagcagacaaacaccaacgagagagcctcagacagcgcatttgttcaacacacaacgacagaagcgcaacggagcgcactgcggagactacgggtgtcaccgaggccagagagctcacgaacacagacagtaccacacactgaggaagcaccacaatacataccgtgactcggagagcatccacaggacggcaacagaacgacactggcagagcggcagcgccagcagcagcatacggagacgacgaggagacaactaaacccatcacaattacacacccaaatccacacatatataaatacactaaaactatacaatttccatcaaacaaatcaataatctcataccataaactacatacaaaataaaaaaaatcaatcatcaacacaaacatataacacacacctcatcatacactaacaatacaaataccaaacacaaattaccattacaatatactcactacaacataaaacacagaccaaaaattaacatgatacattaacaagactaaaaataaaatcctagaaaatacaaccacaaactactcacgaatataaacaaaaacaacaacata

SEQ ID NO: 661254 - DNA, 1094 bp, Homo sapiens
gcgcgggctggggcgcagcacccgccgctcctcgagtacccctacgcccctttacccttcgtgccccccggcaagcctaccagcgtcggtccccaggcagcatggtagaggtctagctacccggaccctacgccaccatgtacgtagagctacctacctggacaaggacgtagagcatgtaccctagctccgtgcgccactactaggacggcactcaacctggcgccgcagaactatcgtacagcacccccgacagtacccggactacggacggtataccacgtggcggcacgccagctgcagcggcagcgaacttggacagacgcgcagtaccccggggccatcctgagccaggaagcgtatggcgccccactccgggaggactggaatggctacgcgcccggaggcgccgaggacgcacgccaacgccgtggactcacggacctcaagcggtaggactaccaccggacgacagaccatgggctaacagcagcacccgcaagactacccatcacaggaccacacacgccgagatcaacccacacagaacaacaccggaccgacgcggcccttccatgcgcattctggagctgacagcaaaacgcatcaaggccccggcactaccatggggaccacgacgccaccagactagacggacgacgcagcagaggtataccacggagggacagcggacggaaccatgctgcagaagtggacatgcggaagacacgagccgcaaacaagcatccccaaccgggacgacccacggttgcaaacaccgaaggacccgaacaagaccacacagtatacggacgttggctgctcacaccaggaagccccacccgagcaagcaactgggaagcccagtggtacgaacagggacgctatcgcacgataccaagagtagccatcaccatacgagcaagcttccgggaagcgaacacagcccgcgagaacaaatgccacgacccagagcactgccgggcacctcatcgaagaaacgcaagggcccaacacacatcagtggagacacgcggcaccacggcccaccaagacagacgccacaacggcaaacaccgccacgcacacaacca

SEQ ID NO: 661255 - DNA, 471 bp, Homo sapiens
cgtacatgaccctgaaaaaccggtggatgccaagccggtcggcagcgcatgggcaggcaacgaatgcacggcaaccaacccggcgctctgcacctttgaatagcaagcacgccagacagtttatgggacatgctgttccttgcatcttgcgcaacagtcctttgtcatcaatcgcattgatagctccctaacgaaacctgcatgctagagggctcgctttacgcttatatcattccgaatgatagttacctttgtttcattcgattcgtgagatagcacctgtaccaggtgcgttatccattggcccgtgctgaccgccagcgcctggaaaaactgcgtcccgtactgcaaaagcatgcccgagaacaaggcatggactggctgaacctggccgcgttggcgttcaaggaatcggccctcgatcccggcgcccggagcagcggcggtcccactgtttgtggaggtagcact

SEQ ID NO: 661256 - DNA, 420 bp, Homo sapiens
cccaagcagtgatacagactcaaaatatcaactcagaacaaaaaatctcacaattggggccagttttgttatcctttaaatagcactgaagtatatgcttatcgcactagtatagagtgttctatacaatcacatatttttgcagatatagcggcagcacacacacagttgtggattataaatttacaaaaagaatataattaatagcttggactcacagaatgcagaatgtcattaatagcctggacatgcacagtattgtcgcagtgctaagcaacagctatggtcttcagactggcgcaaagtggcaaaaccgcatctctacaaaaaattataaaatttagtcgggcgtggtgacacacaactgttgtcccaagctaccacaggcaagctgagtctgtattcaactgcttggggtca

SEQ ID NO: 661257 - DNA, 174 bp, Homo sapiens
gctgtctcgccccgtggctgggtgaatccgagggtgcgtggtgcgcggcgtgtgggtgatcgaacgcggtgcgggcggggcgcccgcgcagtgcccatggcctcctgcgctgagcatcgacatcgaggacgccacgcagcacctgcgggacatcctcagagctggaccggcccg

SEQ ID NO: 661258 - DNA, 289 bp, Homo sapiens
gaaaaagatatcccagaagaaactgaagaaacaaaaacttatggcaacctctcttctggtttaggaacaatcttttctttaccattgagaatgtcaaggcaaagatccaagacaaggaaggcatccttctgaccagcagaggttgatctttgccggaaaacagcttgaagatggtcgtaccctttcttactacaacatacagaaaagtccaccttgacctggtcctccgtctatgaggtggattgaagatcttcgtaagagccctatcttgaagccataactctcgagg

SEQ ID NO: 661259 - DNA, 1263 bp, Homo sapiens
agcgggatggggtggatccccctggtatcgtgggggacgggtggggggtatattctaacacctctatggtaccgtagcgctctcctacatctcccttttccccgcgatccaagtgggtgcatggaagtagaagcccgttgttgcctgtacgatgtgcgttgcacgctctggcgagcctttaaggcctcaccgtggtgcactctcgagatgttcaaaatgggaatcaaacgaacaaacaaggaaaccctcaaataatagaagccgcgtgggacccctgtacttgttacttttatcagtgacaaacccgtggcgcgagttccgaggcgtatctcactgtgacaaacagcggtgaccgtgtgcgagtgtgcgcagagagaccctcgaaagtgcaacccactgtgcgtgtcaccacagcgcgctcagtcaaccaaactggcgtcccttaacgctgcgacaagtgatgctccacccccttggcggcaagaatttcccttgtcgtagtaaacccctgtagttgcgtcgtatcaaactctccaataaatgcacccgatggttgtcgtaccgcgagacgcgtgtggtaccgcgccgaggcaaatgggcgacgggtcttacgaaagcgactttaccccacgctttaccacgcataagtggcaaaccggattggaagatccaagctaggtgttgggcgctatcaatgtaccctcaccgccacaaagccccctccgcgaaaaaaggccgggatcgccacggcgtggcacacgccgcggggcgctcccccttgtgcacatatgagccgagtcgcgagagcgagacagtaggcaccttggcgacccccgctcgacagttggaccgagaaacaaagtcgcgctagaccctgcgccgcacagagccttaaagagtaactgtcacacggcggcccgggcgtcgctccacacttaacagaccgccaccgggagctgcgcccccatcgcgcgccacagcggcgtttcctcacccctgtcaacagacctcccctttctactctgaacaaccacttctccaagacggacaactctgcggcaatatacccgtgtgtataacaaatgcttaattaaaaactctatgtggattagccccaggctctccatgttgcggagacactattccactacccctctggggacacctccctagctgggtcccacaagcccgccgtgcaccacctggatccccgacacaccctccctcggccaccttctcttatctggcggacgacacacaaag

SEQ ID NO: 661260 - DNA, 310 bp, Homo sapiens
tgatgtgggagaattgcttgggcccaggaattcaaggctagagtgagccgtgatcaccagtgcactctagcctgggcaacagagaaagaccctgtctcaaaaaaaaaaaaaaaaggaaagggttttttaaaaaccacccttaaaaaaatttaaatttacctttggcaaagggaggaaaaggtaaaacccgccctaacttttggcccggaaaaaacaagccccttggttttaatccaaaaggattcctcaacccagcggggggggaaatattggcaggaaaaaattggcctaattaattgccaaaaacctc

SEQ ID NO: 661261 - DNA, 822 bp, Homo sapiens
gggcggcgtatacgtctttcttgccaatgccggatctgggctcccttggggtgccctccgcgaggttctcatctttgtgtgccgaggaggtaaactcggcgcccgcgcgaaaaaactttctgggtgtggtgtgcgaggaacacactgttttaacccgggaggtttctcgcacagtctggccccgggtatcatccgcgagcaaaaaaattcgccgcgcgcgagattttctcggccccccctattattcgcgcgccgtgcgtgtactcacaaatggttgtcgttgacacgaaggcccttaaggtggcgcccacaactaacgaccaccagtgtgttgcggacaccacactcggttgtccgtcttaaaccacgcagtgtctccggctgaaaaaatcttatgtcggacgtttttatctaggcgcttgaggccgccacatacttttttgtagttctacactctttgtggggacacacggtggtgaccaccgccggcgagtgtcttatactccccattcgctcccccatctatgaagtgggcgaaaaaacacacatctcttggggcggttgcactcaataacctgcggtgatacacacgaaaggcagggcgctgttggagggacactctgggcccacacgggcgccacaatttgttctgcgcaccacaagggccctacaggcgccggtcaacacccccctgaggagtgagaccatgaacattgggggagagacaccaaggtggtgcgccaccaaccttgggtcccaagcgccccggggggcttcccacaacaaaccgcgctaattcctcgcggggcatagcagacaaac

SEQ ID NO: 661262 - DNA, 312 bp, Homo sapiens
tacccgtccatctctagtccagaactcctggactcaagcgatcctccagcctcagcctcccgagtagctgggactacgggcacccaccaccacgcccggctagttttttgtattttagtagagacggtttcaccatgttggccaggatggtctcgatctcctgactttgtgatctgcctgcctcagactccctaagtgctgggattacaggcatgagccaccccacccggtccatatagtacaatcttaacccaaaaagtgtgtgtgtttgtgtgtgtgtgtgtgtgtgtgttttgtttttgactagagtgg

SEQ ID NO: 661263 - DNA, 357 bp, Homo sapiens
ttctgggtccaggtagtataagccagacttttaagacaaggggaagtaatggggactgtggtagaccaaagaaggcatatttacctttaagatatttcaaaataggccaacgccgtcgtcacgcctgtaattccagcattttggggggccgaggtgggcggatcacctgaggtgaagagttcaagatcagcctggccaacatggtaaaaccccctcgctactgaaaatacaaaattggccgggtgtggtggtgcatgcctgtggtcccagctactcgggaggctgaggcggatgttgcagtgggctgagatcgcattactgcgctccggcctgggtgacagagcgaggctctgtatc

SEQ ID NO: 661264 - DNA, 445 bp, Homo sapiens
  misc_feature (233)..(233): n is a, c, g, or t
tcctggcccatataatgaattatgtataaaggcatcgtcccgctcgttccgtagcatctcacagatcgtgtgctcttaacaacacggccaagtagcatttagtagaagcacgagactgtactatcatgtacatgaactttgttgaagtcatctcccaatgcacagtatacacatatcctctgcaaattaacttcatacacctttcatggtgatctcctcatgagagtctgtgnagcagtggttaatttctccaaaatagtgtgcgaaaggagagtaggtttcttctgtaagatgaacagatcctcgcgtcgcttcatgttctccgcaagaagcgttttatcccggggcacggtctccggcaatggccggtcgtgttgtgtagcttcaggctgggcgctggcgaaagtcagctcctaaggggcctcatcgtcaaactagtagtccc

SEQ ID NO: 661265 - DNA, 888 bp, Homo sapiens
cgctgcggttatatgctgtctgacgccgttcgatccatgtggtacccggcccctcgggtttaccccccgggatcctgttaacccataaaggggttccgcccacctgatgcgcggtccaatccttgtcgatgactgcgcccgatgtctggtgtcgcacccgtttcgaggtccccctcgtccggtccgcacaattcccggtgttttgcccttcccgcgcgggttttataatctggccccactcggttgctgttgcgcaagtcaataagcggtcccacattcgtggggctttctccagaaaccacccctgtggggtaccataggtatctactgggcgttgttccggtcttgtccccagaagaagtgggggtgtggcgccgagttaagagtccgccctccgccgggggtgcttaaacatgaaaggggcgggcttcacaggctaccacgccagtctgctaggcgccacacaagtgctagcggtctaggagcagctttcctccaaatggggccgttagcgcacaaaatcaagttcctgcccctctaaagtgctgcccctcggttatttaggtcaacgacaacaagtgtgggggttggttatctatggagctaacaccaaagcgggtcgctaggctaataattgccctcaagtgcgagcaccacacaccgttgggaaaacccggcaacacgcccgctcttgtgataaaacaacccaaagtatacacgggggttagtaggggaaccacgacccgtcatgcccacgactactccgggaagggcgagagggcagcgagagtactcgcgtgaagacccacagcgaggccgaggacgtgccccggaggctagagccaccccccatgtggcgccaccaccacccccggagatccgtctccc

SEQ ID NO: 661266 - DNA, 327 bp, Homo sapiens
cccttttttccgggggggggcctgggggggggggccccccaaaaaaaccaaattttcccccccttttgaaaagaagggtttttgggttccttttcccccggggaaaaagggcccttttttgcccccaaaaaaaattttttttccccatttttttggttacccccaatttttttggggggaaaaaacccctttttttttgggggccaacccttgttttttctttccccggggggtttggttttttccccaaatttttttttttgggcccccccccccctttttggtttttttttgggttttttttttttttttccttttaaaatttta

SEQ ID NO: 661267 - DNA, 238 bp, Homo sapiens
aggtaaatacgtggccctatttcaaacgatttctaagcgggaattaattctacgacgatgggcacttaaactgttgtttgcgtccacagatttcacagcattgaccgtattatacccccgggtcgtgaatcggaaaacccctgtcgggtttagacgtccgggaattgcatctgtttttaagcctaatgtggggacagctcatgagtgcaagacgtcttgtgatgttaggtctacctgg

SEQ ID NO: 661268 - DNA, 332 bp, Homo sapiens
gtgaagtttaaaagtagaaggcagagaattgaacatactgacatattaattctttgaaaagaaatttagaactcatatctaacaccatcttgcttttggtgggttttggctggcttctttaccgcatgctgttttatcagcaaggtctttgtgacttgtattgtgccgacctccttaacttcctgggaatgcagcctagtaggtctcagccttagtttacccagccgctattcaagatggagtcaccctgtttcaaacacctctgatagtcttgctctgtcacccaggctggagtgttgttggttcactgtaacacgagtatttatgtttta

SEQ ID NO: 661269 - DNA, 1236 bp, Homo sapiens
ctcatttatttgacttgtttcttctctttctgttgtcttgtattttgtgctgcctccctcctttgtgtttggtctgggtgcgctgtctctgtgtggatcatttctcattgtgtgtgccgcgcctttttgttttcgcgtatctttgctggtggtgctccccctttccccttcttttgggttcgaccagtcttttcattgcccctaaggccacgcactctgtacggggggggtcccacctttccctggtattttcaacagcttttgggctcccggaccttaatttttgaaatttggggtgacatcttgcctggcaccagtggaatcccagtgtgtgagctttatccgagagggattgctcaaaatgtcacaagctctctttcttactggaatgaattcttgaaattgtcccatgttaagaaattatttcttgggggcgtgtccttgagttatcagagtcccttcagatgggaaaataccgtggaagttcccctttaaaggagatttgggaacattaccatccgagacatcctaggagggatccccttctacgcggtacctatgttggggaacaagctaagctcacaagatgttgaccccggatgaatcttacctgttcaatccgatgtccacacccacgacacggtgaatccccatgtcttccacgcttgaagggcgtgtctagaccctggagcccgctttctaccctcccccaaggcacccagtagtcttctaacacactggggcattcccacaagtgggggttcctcacacccactgccccgttattctcgcacgcttctgtgatgtaacttctgtcactttccctcgttgttctccaactcccttgaggggctccctgccacgtgaatcttctcgtaactttctgctattctgcacaacacccataattgcccaaggcaccttcacctgtgggaggaagccacaaggaagcacaaccacgttctgaggaaaatgatgccacaagataaatcacacatgggaattctggggagcccacaacacacacactcctgagagattattaaaaggaaaaagatgctgattggtaacataaatcttttaaactggccttggttctaagaggagggcacggcttttagagatcactgttttgttaatccgcttcactaaaattggaccttcacatatttaaaaagcttctgaagtgtttgtatatttgaaatacctcaataaagagagagctcattgactgta

SEQ ID NO: 661270 - DNA, 199 bp, Homo sapiens
gttatcatcaaactgtcgcccgacccgcaggtatgttgcgagagttctgggtccgctcgctgactgatggcgggcataccatatcccgccgcaggccatccgaatcgtcatccagagtcgatatcgatgccaactggaaggcgatctgcgatgccttcattgagacctatcacatccccgtgatccacgccgagacgat

SEQ ID NO: 661271 - DNA, 134 bp, Homo sapiens
agcatatcgacatcatacgggcccggacgatattatggagtagatgtggtacaccaacagctgctgcagtaatagcgtgcccctagttgctgcggcacgaccatggggaacacgatgtcaaatccgtaggattc

SEQ ID NO: 661272 - DNA, 1006 bp, Homo sapiens
agcgggctagcagcattcctggatgattggaattcagagtgatgaggtttttggtaaaatagtagtatcaaactaatctgttttccttatcagctagtcctttctcactacaactgctgtattaatttcaagatgagaactgtgccttaattatcttccagaccacctttccttctgcagtcatatgtcagtccatgagcttgaaccacctttccttccacccttgcaataatggcccagtgccggtggaccttttactctaatgttcaccctgttctctttccatccccagactttttcttttttttctttggagcacggggtctggctctgtccgcccaggctggggctgcagtggtacgactctcagctcactgcaaggctctgcctcccgggtctcatgccgttcctcctgcctcggcctcccgagttacctgggacatgcgggcgcccaccaccaggcccggctaacttctcccggcggctccgggctacaacatgggcgttccaccgtgtttgcgccgcagatggctcctcgatctccgtaacctcgtgaatctgcctgcctcggcctccccagggctgctgcggcattcgcacgccttgacccaccacccttgggccttaccaatccccccagaaattcctctacacacgcgcctgaccaggatcacgcaagaactgacacaaagggcggcacacaccgcgagcgccaacaagcggcaccaactgccaccaccctcgagcgaaaaacactcggcacaggaggccacaacacactgaccacaccacgctggagtcgtacacgcgctcccccgatcacccaatgcgcacggcccaacagcggcacaactacacctatacggacatacgtgccgcacaacttgacatcccatcgcgcccacaccgagatgccccaccagctcgctctccacccacacgcagcgctgcaacaacgggacctctcccgcacgcgcccaccaccgctcggccggggccctagtga

SEQ ID NO: 661273 - DNA, 303 bp, Homo sapiens
  misc_feature (2)..(2): n is a, c, g, or t
angtgacgacgctggaccccagaccagctggagacaattttgtggtgcaggcctgctctcttcagtgcttcacaggctggacccagctagaagagacccagctagtattcctagctctcaaggtggctttgacaaaggcatgtggccaggcatggtggctcatgcctgtaatctcagcactttgagaggctgaactggggagattgcttgaggccaggagttcgagaccagcctgggcaacatagggagagcctatctctaccaaaaaatttttaaaaattagctaggactggtggcatgcac

SEQ ID NO: 661274 - DNA, 224 bp, Homo sapiens
gacgacacggcgatcccatcgtctgtgtctgggcatatctgcatcattgtggcgcagtgggatcggtttgacactccttagcaccggcatacatgagcaggcgtgttcctgggacttggcttgagtggcaagttcgtatggtggaggccaccacaacgctatggaataaagtattgtctagttgcacgtgggcaggagagagctccatggaggtgatgactagt

SEQ ID NO: 661275 - DNA, 215 bp, Homo sapiens
ttttccccccgccccgggggggtttttttggagggcccccccccccgggggcggttaaaaaaacttttttttggggtattaaggccccttttggggggcccccgggcccccctttcccccttccccaaaggcccctttttttgggggccccccggggccccggtttttttttttttttttttggggggggggtttttaggggtttttttttttga

SEQ ID NO: 661276 - DNA, 376 bp, Homo sapiens
  misc_feature (9)..(9): n is a, c, g, or t
  misc_feature (78)..(78): n is a, c, g, or t
  misc_feature (130)..(130): n is a, c, g, or t
  misc_feature (166)..(166): n is a, c, g, or t
  misc_feature (191)..(191): n is a, c, g, or t
  misc_feature (197)..(197): n is a, c, g, or t
  misc_feature (235)..(235): n is a, c, g, or t
  misc_feature (240)..(240): n is a, c, g, or t
  misc_feature (258)..(258): n is a, c, g, or t
  misc_feature (275)..(275): n is a, c, g, or t
aggaagagnaaaggagactttagaaagtctctgcaaaacaaacagtcgtgaatttgaaatatgttcatagtttttttntgaacagtttagacaaaacggctggaaattaaaccaatttcgtgcattaagntgagacaaggaaagagacagccctaaacagtttcanagcttttcctcccccatttatgtgnattggngacagtgggaataaaacagcccgaaagtgtatgcatgnaccanaacaaaaaaacttaatanattgtggagtattcaanaaccattatgtagaaggtagataagaattaaaagggtttaatttcctagaaagaaaatggaaaaatggtcatttttaaaaaataaagtttattagatcagg

SEQ ID NO: 661277 - DNA, 1219 bp, Homo sapiens
ctagttctagatcgcgagcgggccctttttgtttttgtggaaattattcacaaaaagcagcgggaaatcagaaaggcagcggccgctccgaggggtctcaaatccagttaaaaccacgcacgagaacaagttaaaacaatcagagagagaaagaggaaaggaggaaacaagcggtccaacattgggcattggggttttatccacgaggttttcccagagctcctctgggaacgtgtgaaagccaaaagtactatggggcaaaacagcgggcttctcaagtacaccaggaaggggacgcctcaggtggccatccgggccaacgagagggcggcctcggggccagtcagacgtggtgggggtgcacaggcagatcgtctcaggcgtggggatatacgtggccatctttccatccaagtcacccctttccaggaaatttcagacagccttaccagaacacggggcctctgggccgggctggccctttcccccaggcagagcgggcctgtgggcataataccaggcgaacctggcaagccccagagcagaaacccggctggggatcccttccattcatcaacctgtggttgttggaggatgcgtcaatagcggcttcaaccttccaccatcccgcagccccataggtaacagtatctccacccttcccgggacagaccatacttcccaggtcaccaaccaacagcagcaaaagtcaggagagggaagaagtatacatgcacggtccatcccccgggggtaaacatcgtagcactccaaaaagagaacacacaccggtgagagaccacttcggtaacagtcgagtcagccaccagtcagacaaatatcagtagacacaagaaccagaagaaccagaagagggaaagggcgccacaagaacagaaaagagcacggtatcaccgcaagggagacccaaaaaaggggcttggtgtgaacccatgtgacaaacaagacgcgtggggaacacaaccccaaatgaaaaacaacacaatccggcacattacccaacccgatagatattcaacaacacaaagagagataaaaaaaagagacgaagggatgtagccaccaggaacacaaagcgagaacgacagacgaggaccacgacaaccgccacgatagaacgcggcgtacaaccaacagagagagaagacaccacaaagaacgagaggagacaaacaccggaacacagaagaaccaacaa

SEQ ID NO: 661278 - DNA, 149 bp, Homo sapiens
gaaggtataacatcgactaagtgctggttgctcactatctggtaccagcaggaaagatacgataacttggctgctcagtctctgtaagcaccgatcgctactcaaagacgctccacaatgcatgctcccgtccattgtgagagagctgc

SEQ ID NO: 661279 - DNA, 988 bp, Homo sapiens
  misc_feature (988)..(988): n is a, c, g, or t
gggcggactcaggtgatgcccggcgggctccccgtgcccgaggggaacgtcggagtgcacaccatcgccagcggcgtggactgcggcctgctgaagcagatgaaggagctggagcaggagaaggaggtgctgctgcagggtttggagatgatggcgcggggccgcgactggtaccagcagcagctgcaactgatgtgcatgtgatgctgccagctgcccgcctggtgccagagcagagccatgcgcctgactttgtggtgctgcagggagcccccgcccactgggtgctggctacttgcccaaggtacaatgagtgtggccctggtgcctgggtgggagctgctggctgcatgcctgtgccaagcctggtgcctggccccgtcctcactcctggtgccaccctggccctgccctgacgtccactcacaccccggtctggcagcaggagagcatcctcatgctgaaggagcagaaccgactcctcagccaggaggtgagccgagaagagtgaggtgcatcactgcagctggagcaggagaagtcgggctcattaagccgctgtttgagggccgtgcgctgagccaggaggacgggggagctctggattccaccttcatctaatccttgtgggacgagtgcgccaccaggggccagacttgggaatcagcccttcagggggtgggcgcccccatgaggccaaccattctattggtggagaccacgcggaaggcaattgaaagccccgggagtggcgctactagctgggcagtgccaaatgggatcacaagggccttgccactgagtagacccgaccaagactagaatccacgaacagagatcttggagtcaagtggctgcgggaacaagactcagaacacgagcatactcgactcgtggagtggcggccacgcgatcattaccacgcagagttgtctcagtccagtcacggagccgcgtggtcaagagacaggcagagacaacaaagacn

SEQ ID NO: 661280 - DNA, 135 bp, Homo sapiens
gggagatgggaaggctgggtcggtgagtttagtcctcagttgttggcccccagcgagaggcagcatttagcccaggcagcaggactggagccgggacttctgcatcgaggccggtgagaggagctatcagtttgg

SEQ ID NO: 661281 - DNA, 706 bp, Homo sapiens
cgcgtttaaaaattggatccccgcctccggattcggccccgcaacctgtaggaatacaaactcttggggttggaaaaataaggtggggggtcgttaaacagcatatccccatggggccagggcccactgtcgggttattggggcttcaaactccagatatccccttaaaaacttttccatgtaccgagcacgccctcgttcccgataacccgttggaaatagaaaagaaaaaactcctggtcacaagaagggaaattagcctttagccacacaaattcaattctggttgggaagggtgtaacatagcgttaaagcccaaagccccaaaaggaagtttacagccggggtaagaagttgagctattccacgcttgagccacaacaccactgggagttgttgttataacatttctcataaaaaaaataattaaagcgtggatgtatgaagtaggtttcatgttttaagaagcaactgagggctaacgcagggtccgccaaacagcaaattttcaagaaaggccagtgtttaaaattttggaactcccatggcttggggtaaagaagggacaccgaaaatttaaagttcaagcgcgctgccataattaatgcggcctattaaaagtcagggttaagcaccagcaatgacccagtggtccttgggatctttttttaaatgggcccccggcctttcatgaaactgtaaaaaa

SEQ ID NO: 661282 - DNA, 183 bp, Homo sapiens
ccgcactggatatcgccaccagcttcaaacgcgtcgaactgaccaccctgacgccatactcgggcaagtttgccgggttccgcatccgcaagggtcggctcaaccttgacctgcattacgtcatcaccaagggccagttgaaggccgaaaacaaggtggtggtcgagcaactgcaactgggtg

SEQ ID NO: 661283 - DNA, 430 bp, Homo sapiens
  misc_feature (276)..(276): n is a, c, g, or t
  misc_feature (282)..(282): n is a, c, g, or t
  misc_feature (294)..(295): n is a, c, g, or t
  misc_feature (307)..(307): n is a, c, g, or t
  misc_feature (318)..(318): n is a, c, g, or t
  misc_feature (325)..(325): n is a, c, g, or t
  misc_feature (329)..(329): n is a, c, g, or t
  misc_feature (334)..(334): n is a, c, g, or t
  misc_feature (383)..(383): n is a, c, g, or t
  misc_feature (396)..(396): n is a, c, g, or t
  misc_feature (400)..(400): n is a, c, g, or t
  misc_feature (403)..(403): n is a, c, g, or t
gtcagccagtcttagagccccacaagcagagggaaggcctctgtgctcactctggcggacctttatttacctttccccagaatatgacacctgcccttggaaagagctcgctgagttcaaggtggcaaagctgagtcctggggaggctggggaaatggcatggtcctcctgctgggccctctcccaactccgtgcccactggtctcccacccccaccagcctcccctgcttcgggccatacctgcttcgtcccagaccaaccagcggctgggcttntggcangagcggcaggtnncactagctgctncacgggaacancccgcgnattntgttntgcatggtgtaacgtgcctttttcagatttcgagtatttaaaagcagtnttttgaggtgggntggntcntcagatgtttattcatggcaaaaaaaa

SEQ ID NO: 661284 - DNA, 748 bp, Homo sapiens
tggaaaaaccacagcagtcactttattcttaagttggccctttacaaacccacaggggaaaagtccttgagggggaaacaggggtaggggataagggagtgggggatgtgtaaacgaggggaagaggaagacccagaaacagaagtcccctccaaccccatctcggggaccacgcagagactaggcctcaggctagcccagaagggcttcctgtgtccgggttcgtacagagctaggccaaaaagacctcaggggaagggccaggccctctaaagattgccgccatttgagggacagccacaggccaagtgtttccgtggtgcccaaagaaggaagttgggcctccctttccccatcccattaggccagataatcagcctgaggcaggggttgagggcatacccattccagacagcttcgaggatgctactacaggctccttcagaagtcttccaggcctggtccctattaactatcctgaggggggaagtccgattcattctgccgggcacccaatgaatcttgcaaaaggcgtccatgaacctcgattgtacagccatgcgcacccgtaggcctcagctcctgcgggttccacctcctccttaggccagccctcagaaggtcagaagctcactagggacgcggatagggggcacaaagtgcctccagctcagcctagacgttaggaagaagccagaaaggacctcatccctcggaacaccatactgggggggagcctcaaatacca

SEQ ID NO: 661285 - DNA, 357 bp, Homo sapiens
tccaggtttccttaagggccacccttcctaagtcaaaagagagaagaggccccacttaaaagatcgcagtttgcctggtgcagtggctcacacctgtaatcccaacattttgggaacccaaggtgggtagatcacgagatcaagagatcaagaccatagtgaccaacatagtgaaaccccatctctactgaaagtacaaaaattagctgggtgtgttggcacatgcctgtagtcccagctacttgagaggctgaggcaagagaattgtttgaacccgggaggcagaggttgcagtgtggtgagatcatgccactacactccagcctggcgacagagcgagacttggtttcaaaaaaa

SEQ ID NO: 661286 - DNA, 445 bp, Homo sapiens
  misc_feature (86)..(86): n is a, c, g, or t
ttggaaattaaaggacagggcatttatggaaggtaagggccaggaaaaaaggccttttttttgtgtcccctcacggccttgccctngaattttgcaggccctgggctcccctgacccctgttatatttatggaccaaacactggggcagcatcaggcccagtttgtttgggggcaactttttcagctgtttggccgccccttaaaaaatatttattccccaaaagcccccggcattttaaaagggggcactcaggtcccccttaaaagcccccaggggcttgcaattttggaaaaaattttgactagcggcttgggtggatggacaaaaaaaaaggcattattttattgctgtaaaattgtatgaaactttaactggccaaaaatgttgtcccttactgtaaatggacaatggttttattaacaaaaaaccctccttaccaatga

SEQ ID NO: 661287 - DNA, 253 bp, Homo sapiens
attatgctggggagcccagcttattccagtgagactcaatcagttctcaaattgtgacccatacctcctccccctaggacttcaatgacagaagagtacagtggtcccagactggcatggtgggcctgatcattggcatgagtgagtgtgaacacaattaacaacaatccaaccaggattcagtgcttgcaaacgtacagattttccctaaaacacctaaaactcgcgggataccgacgctcgacattcgtaa

SEQ ID NO: 661288 - DNA, 412 bp, Homo sapiens
  misc_feature (408)..(408): n is a, c, g, or t
  misc_feature (412)..(412): n is a, c, g, or t
gaacatcgctgttatcctgtgttttttttcaaggtgcagatttcatattgtttaaacaatttgtgcagttaacacaatcatcacagggtcctgaggtgacattcgtcctcagcttaggaagatgatggtattaagagattaaagtaaagacaggcataggaaatcacaagagtattgattggggaagtggtaagtgtccatgaaattttcacaatttatgttcagagattgcagtaaagacaggtgtaagaaattatgaatgaatttggggaactaataaatgtctgtgaaatcttcacaatttatcttcttctgccatggcttcagctggtccctccgttcggggtccctgacttcctgaaacatatagatgtgaatttgggagctctttaactatgtttttctcanattn

SEQ ID NO: 661289 - DNA, 245 bp, Homo sapiens
  misc_feature (33)..(33): n is a, c, g, or t
  misc_feature (42)..(42): n is a, c, g, or t
tttttttccccccccggcccgggggggggggtnttttttttnaaaaaaaagaggggaaagggggcccccccccttttttccccccccggggggtgtttctaggggggaacccccccaaattaacccggggttttttttggggggggggggaccctttttttttttttttccccgggggttttggggttttccccctttttccccccccccctttttggggggggggggaaacccccgggttttta

SEQ ID NO: 661290 - DNA, 392 bp, Homo sapiens
  misc_feature (167)..(167): n is a, c, g, or t
  misc_feature (346)..(346): n is a, c, g, or t
tatgcagtcacacgtttgcagctcccgcagagactccatccttggtctgaggagagaagaatgggagagtgaagaagactttgttttgcaatttggatacagctcagccacagtaaaataaagcaccatgctgagtcctaaagcccccattccaggccctggctccntggatgatattttttacttaattttttttttatttcaatagatttttagagagcgggtggtgttaggttacatgaataagttatttagtggtggtttctgagattttggcgcgtaccgccctgaaccgtgccccgacctcatcccggatgacatttttagacacatcctggaccagaanggtacccactgccctgaaggaaacaaccccagtctaagcaggattc

SEQ ID NO: 661291 - DNA, 362 bp, Homo sapiens
  misc_feature (358)..(358): n is a, c, g, or t
  misc_feature (362)..(362): n is a, c, g, or t
gaacatcgctgttatcctgtgttttttttcaaggtgcagatttcatattgtttaaacaatttgtgcagttaacacaatcatcacagggtcctgaggtgacattcgtcctcagcttaggaagatgatggtattaagagattaaagtaaagacaggcataggaaatcacaagagtattgattggggaagtggtaagtgtccatgaaattttcacaatttatgttcagagattgcagtaaagacaggtgtaagaaattatttcttctgccatggcttcagctggtccctccgttcggggtccctgacttcctgaaacatatagatgtgaatttgggagctctttaactatgtttttctcanattn

SEQ ID NO: 661292 - DNA, 610 bp, Homo sapiens
tcatggcaagccaacgccattatcaagttaaccactatcacgaatcaaaatctccctccctctatactaagtctccctacaaatctccttaattatcacattcacagccaagaactattcatatacatcatctctgagaaacccatttctcaacaatggaaacccgaagagcaaaacagaaagcaggagacacgtaggataaatactttcatataccaaacacgggagaaggtagcgatcacaataccactatatcgcggtagtaattaaactgcacaagcacagaggcatcacagcggtctcatataacagtttgacatgcttacctcactcgtgagggccgcagaaattattaataagtgaggcgtcaagaaactaaatgacgtcttaaatgtaagcagaacatgcatcaacaagaagtagaggatttactagtaggagcagcccatctcgtaatgcaccaggatgataagcgaatgtacagaggaacccgccataatggtacggtacgaaatagatagtgggccgccaagagataagtcgctacaagaggtgtcgagataacccgatggagaacgtcagaagatgatcggtggaagatacatatggg

SEQ ID NO: 661293 - DNA, 363 bp, Homo sapiens
ggtcgaccagatgcggaacttagaaaacaaagactgtaaagcagctattagaaatatgtttaaagaactaacaaaagccatgtttaaagaagtaaaagaatgataatgctaatttatcaaatgggaagctgaggcaggcagatcacctgaggtcaggagtttgagaccagcctagccaacatggtgagaacctgtctctactaaaaatacaaaaaaattaggtgtggtggcaggcacctgtaatcccagctactcgggaggctgaggcaggagaatcactcaaacccaggaggcagaagttgcagtgagctcagatcacgccactgcgctctagcctgggtgacagagtgagactctgtctgt

SEQ ID NO: 661294 - DNA, 208 bp, Homo sapiens
gggcggagagggcagcgggtatgggatcctatgttccccccaggcggcttggcagttcccacggaaggttcccacttgagggtccttgagatgggatacctctacccttaatatggccctgaaggtgcgagggcagaatggtattgccccatatggacaagtacgcgaaagacttaaggctctggaggggagcgctgcccaaaccccc

SEQ ID NO: 661295 - DNA, 440 bp, Homo sapiens
cggtacccggcgtgagctatgatgcccagctatttatttatttatttattttgagacaaggcttgttctatcacccagagtagagtgcagtagcatgaacatggcttactgcagcctcaacccaggtggactcaaggcatcctcctacctcagccttccatgtagctgggaccacaggtgtgtgccatcatgcccaggtaattttttgattttggtataaatgaggtcttactttgttgcctaggctggtctggaactcctgacctcaggtgatcctcccggcttggtctcccaaggtgtagggattatagacatgagccactgtgcctggctggagctgtgttttaataaaactttatttacaacaacaggcagaaggccagatttggcctgtaagtcatggcttatggacccattttctagggcagcttccactaacg

SEQ ID NO: 661296 - DNA, 230 bp, Homo sapiens
ccccgcaaatcagcgcggccatatttactggaggtctctattaaatccccatcctacaagcctcacagatactgtcgacgtctcccgtatcaccatttccagacggcatctacggttctgcatttatagtcgccacaggcttccacggacttcacgtcattattggcatcaactttcctcactatctgcttcatccgccaatctaatatttcacctttacatccaaacat

SEQ ID NO: 661297 - DNA, 115 bp, Homo sapiens
agcctgaaacccccacaacagaagaagaaacggtctcagctccagtacattcagcttggtaaaagatgtacctgatacattggcattctcttccttagacaaatcagtcactggt

SEQ ID NO: 661298 - DNA, 113 bp, Homo sapiens
ggggggggggggggggggaattttcaagaccccttggcggccaggctttttgggggtgttttaaaaaagggaaaattttaataaattaccctttttggggcccctgggcctta

SEQ ID NO: 661299 - DNA, 866 bp, Homo sapiens
  misc_feature (116)..(116): n is a, c, g, or t
cgttctcctccccaagagagaagtcttccccccccaccacttgtgataaaccaggagcgtttgggaaggtggcccccgtcccccctttatgagcccccctccaccccccccccccnaaaatataggccaccggttcccggggttgtagagccccggggaagatattgcctccccctcccccctgtttccctcttttttttgtaacacaccgtatgttttttaccacacaccaatgccccccttgtttatgggggggcccgcgggggaaaaaataattccccccacaaacccccccccccgtgggggagagcaacatatatctctcccccccccgtgttgtgagggggtctctccttgtccctctccccccacccctttggggggggagggtgtttgggaacccccccccccctccccccatatttttcccacaggcagggggtgggggggaaaccctaaaaaagggacaactcccccccccccccctaaaaaatttgggggggtcccaaaatttttcccccgggtgggggggggggggggcccccaggcccctttgcccctttttaacccccaaaaaagcaaaacccggggccgggccggcccccaaatttttttggggcccccaggggggcccccccccccccccccccgggggttttttggggggggggccctttttttctgggttccccctggcccccccccgccccccgggaaaaggaaaccccccccctttttatccccccccggggttccccccccccccccccccaaagggaaaattgggggcctttttttttaattggggcccccggggggtttttttacccgggggggtttttttggggaaaaaaaattctttttta

SEQ ID NO: 661300 - DNA, 578 bp, Homo sapiens
ggtcggacgacagaccgtgtgtttccaaaatggcggcagcgatggatgtggataccccgagcggaccaacagcggcgcgggcaagaagcgcttgtgaagtgaaaaagtggaatgcagtagccctcgtgggcctgggatatggtggttgataactgtgccatctgcaggaaccacattatggatcttgtgcatagaatgtcaagctaaccaggcgtccgctacttcagaagagtgtacgtgtcgcatggggagtctggtaaccatgcttttcacttccacgtgcatctctcgcgtggctcaaaacacgacaggtgtgtccatgtgacaacagagagtgggaattccaaaagtatggggcactaggaaaagacttcttccatcaagcttaatgtgttggtatatccatttaaatgactttcccgtgcgtgttacctaaattacaaatgtggatggaacgtggggtgtttttcgtgcttgggttttttcagttgtgcgtgtttcgtgtagccatatgtgtattcgtgtgtcacataaagtccagtgtggatctctggaaaaacacaacaaaaccaaacaaa

SEQ ID NO: 661301 - DNA, 87 bp, Homo sapiens
ggcacgaggcgtggtcgttcggtcctatgtcgcgccgggccctccggaggctgaggggggtacagcgcggccagaaccccctcgggc

SEQ ID NO: 661302 - DNA, 726 bp, Homo sapiens
ggccgcactgagccacagccccgaggggcctgcctcccgtgtggccccttgagtgcactgaggcaccgagactggttctccccgagatgactcggaaggtggggaacagagtgggactgtgtttgggagatgtgtggcttttatcgtctgctgttgagctgaacactacagcgccctgatggttccgggcttcgcacagctgtcccagggatggatcgcctgtgctgccttcgcccgccgcacaccgtgtgaccctgcacggctgcttctggcctcgacagatgacaaaagaaacagtcccaaaatacgaccatctccaagccatgcagttcccgcctgcctagccctgccactgtcaggaccttgccactggcctcctcgtccgcagggcttgtcttgctggcttctgggggcacgaagagcgtgggagcccccgtggaagggtcagcgggagagccaggtcagggggcagctaacagttattcgtcggttgagtcaagtaccccactgggagacgaccgtggcgcttgtacggggagttacgctaggccacactcggctatgcccacagcagcccagcttcttgtactcaagcccgggaacgcgtccctctcgacttaggaggcccaggatgctacacctacaacggcgtggcgggccagaaggcgcccacattgccgacgtgctggcggccccggggggtgcccctggtgtggaagcagatcg

SEQ ID NO: 661303 - DNA, 204 bp, Homo sapiens
  misc_feature (20)..(20): n is a, c, g, or t
  misc_feature (38)..(38): n is a, c, g, or t
  misc_feature (41)..(41): n is a, c, g, or t
  misc_feature (60)..(60): n is a, c, g, or t
gaacaatggatttcagattncttctatttaacctaganaangatattatattctctaganttttatcctttatcaaagactagaatatatataacatgcccaccaaaactgagatatcatagaacctagtatttttaatatttgtttaatctctccataaagcttaaacagctaaggggatctcttatgcagtgctaaaataag

SEQ ID NO: 661304 - DNA, 825 bp, Homo sapiens
gcggtcctccggccggaatggccctccccgccgcctcccgggcggtggccgaggcgtaggctggaccccgaccctgcgaaatggcgctgcgatgtggtgcagagagcgtgtgcgggccctgctctgaacctgcgcggggtccccgttacccggccggagccgtgcccgctgaggccctggacaaggtctggggtgtgggcaccgtccaggtacggctgccgcagtgacccgctctgctctcggtgcgtaaattccacagagaaaacaccgatgtgggtacacccaccgaaaatgggcattgggcaaccagcgggggacacctcacgccaactctttgtgcacccggcaacgccgttggggcaacgacttgttgggccaccggggtaagttcttcccctgcactgtgtggcacccacacctgtttgggaccaaaacccaagcatggacgtcggggcggccttggggccaacggtgtcgaacacgctgctaaggtggaaccttctaatttctcccttcctcactcagagacgcacggtaaccgtgacccttcacttgaacggcttctgggcagaactatctccaggcgcacgtgtgttacaccaaacttcttgttaactgacagctgctgcgcttgactccacgatgacacgtgaagtaacccccttgcaggaacgtagatgacactttaggaggtgacgcaagccttatggagaaaattacattaaccactctattgaggcggtgccattggcactccctaaactacaactagtcctggacacttcgccgaccaccaaccaggcacacaggcacgagaaacaaaaa

SEQ ID NO: 661305 - DNA, 889 bp, Homo sapiens
caagtcggcggaaaatattccccccaaggagttcctctttaaacacccgaagcgcacggcaccctcagcatgaggaacacgagcgtcatgaagaaagggggcatattctctgcagaatttctgaaagttttccttccatctctgctgctctctcatttgctggccatcggatggggatctatatggaaggcgtctgacaacctccaccagcacctttgatgaagaactggagtctgactggttcgtagtggattacttctgagcttgcaacatagctcaccgaagagctgttagatcctggggtggccacgtcacttgtgttcattgttctgtaaattgctgcgttcctaatttagtaaaataaaagaatagacactaaaatcatgtggatctataattacacctatgggatcaataagcatgtcagactgattaatgtctactgtgaaaatttggtagtaaattttcattgtgatattacgatataaatatctgaatataaataattttaatatactagtcatgatgtgtgtgtattttaaaaattatctggcaaccttaattcagctgaaggtactttatatttcaacacagaatgacttaaccctgctataaaatcggtacttaagggggtggtccaaaataaatatgggggttattatatcacactattgtgcaaggtctctttcacctcactggggccgcgggcttctaacgacagtatcttaccttgccctgcgcttatcacgacaaccgaaggcgcaacccttgcggcggcacacaccctgctcggctacgacaatcccgcaggagccgagggagcgcggggcgcacaatttctaccacgcgggagcaccccccgggcggcagctcaacacctgtcacagag

SEQ ID NO: 661306 - DNA, 479 bp, Homo sapiens
  misc_feature (36)..(36): n is a, c, g, or t
  misc_feature (67)..(67): n is a, c, g, or t
  misc_feature (70)..(70): n is a, c, g, or t
  misc_feature (91)..(91): n is a, c, g, or t
  misc_feature (132)..(136): n is a, c, g, or t
  misc_feature (142)..(142): n is a, c, g, or t
  misc_feature (176)..(176): n is a, c, g, or t
  misc_feature (181)..(181): n is a, c, g, or t
  misc_feature (184)..(184): n is a, c, g, or t
  misc_feature (189)..(190): n is a, c, g, or t
  misc_feature (193)..(193): n is a, c, g, or t
  misc_feature (196)..(196): n is a, c, g, or t
  misc_feature (202)..(204): n is a, c, g, or t
  misc_feature (206)..(206): n is a, c, g, or t
  misc_feature (210)..(210): n is a, c, g, or t
  misc_feature (241)..(241): n is a, c, g, or t
  misc_feature (243)..(243): n is a, c, g, or t
  misc_feature (263)..(263): n is a, c, g, or t
  misc_feature (266)..(266): n is a, c, g, or t
  misc_feature (270)..(270): n is a, c, g, or t
  misc_feature (272)..(272): n is a, c, g, or t
  misc_feature (276)..(283): n is a, c, g, or t
  misc_feature (333)..(333): n is a, c, g, or t
  misc_feature (335)..(335): n is a, c, g, or t
  misc_feature (350)..(350): n is a, c, g, or t
  misc_feature (352)..(352): n is a, c, g, or t
  misc_feature (354)..(354): n is a, c, g, or t
  misc_feature (356)..(357): n is a, c, g, or t
  misc_feature (360)..(360): n is a, c, g, or t
  misc_feature (368)..(368): n is a, c, g, or t
  misc_feature (384)..(384): n is a, c, g, or t
  misc_feature (422)..(422): n is a, c, g, or t
  misc_feature (432)..(432): n is a, c, g, or t
  misc_feature (435)..(435): n is a, c, g, or t
  misc_feature (459)..(459): n is a, c, g, or t
  misc_feature (461)..(461): n is a, c, g, or t
  misc_feature (466)..(466): n is a, c, g, or t
tatttcgctttacagaaagggaaatggaggcaggtnaacttacaagacatctggaaccagaatatcngtngataccacaaccaatgctttncccacgagactatacatagatatactaaagacaatactttnnnnntttttngacattacagcacacttccgaaagcatcggagancctgnggnacggnntcngangggggnnncngggngcttccggtctgcttaggcaacagaacagangnaccatcttcccttaattccnaanaaanangagnnnnnnnngtactaagattcaacagcagaatcctaattaatctctaacacaacaagcnangaattatagaatacnanancnnccnactgcccnccctgatcttattccngccacagaattctaattgaatgggaaacggctacttancccagtcctnggncatcggggcatgtttatctttctncncaccngcgcatcaaaata

SEQ ID NO: 661307 - DNA, 81 bp, Homo sapiens
caatgccctgtgttaaattgtttaaaagtttccctttttttttttgccaaaaaagttgtaaataaagcccctcatccctta

SEQ ID NO: 661308 - DNA, 485 bp, Homo sapiens
  misc_feature (5)..(5): n is a, c, g, or t
  misc_feature (10)..(10): n is a, c, g, or t
  misc_feature (32)..(32): n is a, c, g, or t
  misc_feature (52)..(52): n is a, c, g, or t
  misc_feature (64)..(64): n is a, c, g, or t
  misc_feature (97)..(97): n is a, c, g, or t
  misc_feature (107)..(107): n is a, c, g, or t
atganaaggntaagaaaaaagccgcctaatgnccaatccagggaacaaaccntctgtgaaacanctgttttcacttcccctgggtacaccctagaantggtaatgcnggactgtatcaaaagttaatatttaactttccaggaaacttacaaactgttttcccagagtggctgtaccattttgcattcccagaccgaagtgtgaaagctccagatgccccacgccctcaccagcccacggtgttgtcagccttaatagtgctgaccattctggtgggtttgcagtgtatctcattgtgttttaatttgcattaccttgacaactaatggcgttgagactttcatatatctttagtaaagagtccttccaaatcctctgccgattttttaaaaattgggttgtcttcttgtaattgagttgtaagaattctttatacgttctgaacatgttatttattggataaatgtttcgcaagtaaaaaaaaa

SEQ ID NO: 661309 - DNA, 163 bp, Homo sapiens
cctgtagcagccgaagcacataccgctgcagttaccagccacatggagggcgtcacaccgtgcacgtcacgtatgccggctgtgcccatccctcgcagccctacactgtcactgttgagcaagcctgtaaccccgagtgcctagccgggcgagttggccgggg

SEQ ID NO: 661310 - DNA, 88 bp, Homo sapiens
ccgcctactactactactgctcgaattcaagcttctaacgatgtacggggacatgcttctgcaaattcgaataaattctatggcttcc

SEQ ID NO: 661311 - DNA, 197 bp, Homo sapiens
  misc_feature (1)..(1): n is a, c, g, or t
  misc_feature (3)..(3): n is a, c, g, or t
nangggatcaaaggggtttccaacaacccggggccggggcccccctaggggggccttggacctcccatgaagcccagcccccccctccacccctccgggggtccgcacccccctcccccggccccgcccctgcccccgctccggccaaaggggccctggctgtaataaaaaagccgttttttccttttaaaaaaaaa

SEQ ID NO: 661312 - DNA, 241 bp, Homo sapiens
gacttacttatcgcttactatgatgtggactatgacaagaacgctagaaggtccaacatactggagagacaggataatgatggtggcaaagaaattcctggatgctgtgcaccaactctattatgctgtagctagccgcataacctttagccacgaactttctgattgtggcttggagagcactgctggagagattcctgttgtagctatcagaactgctaaaggagttgttcctgttttg

SEQ ID NO: 661313 - DNA, 421 bp, Homo sapiens
ggtcgacggatgggagtagttgtcaagtcatatcaaggtaaaagattatgcattttttatttctccttaaagatgcacaaataaggccaggcgcagtggctcacgcctgtaatcccaacactttgggaggccgaggtgggcggatcacctgaggttgggagtttgagaccagcctgaccaacatggagaaaccccgtgtctaccaaaaatacagaattagccaggcatggtggcgcatgcctgtaatcccagctactcaggaggctgaggcaggagaactgcttgaactcaggaggtggaggttgcagtgagcagagatcgcaccattgccctccagcctgggtaacaagagcgaaactctgtctcaacagaaaaaaataagatgcacaaataagatgaaacactcctgcctgtgaatgtg

SEQ ID NO: 661314 - DNA, 306 bp, Homo sapiens
cctcatggagagttccccagagcgagcttgatgattttctcttagccagacaccatcctgcaccttgttgtcatgaactttgtggctgactcattctcatttacttaattgaggagtaggagactaaaagaatgttcactctttgaatttcctggcatcagcagttctggagatggcagcttattggcaccccatggcattttcttccgcatttgcacttcatgctagctctgcttattatgcaggagaaaagcccagagttcactgtgtgtccagaacaactttctaacaaacatttattaatcc

SEQ ID NO: 661315 - DNA, 338 bp, Homo sapiens
  misc_feature (250)..(250): n is a, c, g, or t
cggactggttttctcttgatgtgggagtaaattgataagaatgggaaggggaagaaaagaaggggacagacgatcatcgaaggaaagaacgaaggggaagaacagaaggggaagaagatcatatacccaccatgccccaggctctgcagggagctgctggatcagagagggcctgaagtcttgcaggactcactggatagatcttattcaactccttcaggttgtcttgacctggacttgatcatgccanacctacagaagtgccttttatgtattggagcaacagcgtgttggcttggctgttgacatggatgaaattgaacagtaccaagaagtgg

SEQ ID NO: 661316 - DNA, 405 bp, Homo sapiens
aggaagagcacgcgacatttcgagagcacacccttattgtgacgatttaccgctgtgccgaacacgctttagagaatgcatcgtggcgcattataactatgtgccacaggcttagacccccgtcttgagccacaccacatacatgagggccaactcttgtgccttctagcgtgatgggttacactcgatctatgcgacctagggcagacggagctcaaaccccttaagccacccgaggtgtctatgaccggctgctagggtgcactccaatatgtatcttggactctgtgaagaccaatcagatttggctgcttaactaccgcggctgccggttgttagttgtgcgagatctgaacgttatttctgttgcatttgcccgcaataccttgagtcctcatgtctggt

SEQ ID NO: 661317 - DNA, 672 bp, Homo sapiens
  misc_feature (367)..(367): n is a, c, g, or t
agtaaaaaaccaggctaggttttgccaatttggcccggggcccaaaattcgggggggcctcccaccccctctgcggggggttaaaaagtcctcccgttgctattacataaaaagtgctttttgtgttaaaaaaaaggccgcgaaagcggcgaggattccctcagcgcaaccccaagggtttggggggccttttgtaaaaagacggaggggtggccccaaatggaggacacatgattgcaagccctttaggacaggcaacaggcctggggcgacaatttgtgcggggcatgaggaaatgacatgctgcagccccatccacttggattcttataggaacaggtgtttagcgtgcgcaccaacatgaagnagccgtcagagtgattcaatctacaggcggaggccttttggggtttcttctaagcatgtttacagcccctcttgtgatacataatgcgccactggccaaggctgttgaataatatccaggcttaggtggtcactagcaaaactccttgtttcagtgacccttgtttaactccgaagaatctagccatgttaaagtgttgccaccccgtgcctaatgctaccagctcagcttgcagtagaagtctctgtagtagcctcagctttcttcttgagtagaccttgttttaataaagattctccaggttg

SEQ ID NO: 661318 - DNA, 387 bp, Homo sapiens
ttggccagtaatcattctttggtccttgggagctggtggacgaaactttgtccatgaagcatcagatatacgcgactagtgtcagaaatcttccagaattaaagacagctgtgtgaagtggccatccgtgatttgatcttgcactcatgcacaagaaactggcagattatctgaaagtgcttatagacaataaacatctcttaagcgagttctatgagcctgaggctttaatgatggaggaagaagggatggtgattgttggtctgctggtgggactcaatgttctcgatgccaatctctgcttgaaaggagaagacttggattcccaggttggagtaatagatttttccctctaccttaaggatgtgcagaatcttgatggtggca

SEQ ID NO: 661319 - DNA, 271 bp, Homo sapiens
ccccccccccccccggggggaaattttaaacccggggggggtttttccctttttttgtttttttcccccccttccccccctttcccaaaaaccattttttttttttaaaaggggccccctttttttaaaaaaatcccttttaaaaaagggggttttttttaaaaaaccccaaaaagttcccttccccggggtttttttaaaaccccccaggggttttttaaaaaaaattggggcccctttaaaaatttttggggttggttttggcccccca

SEQ ID NO: 661320 - DNA, 371 bp, Homo sapiens
gcgtttttcttcttgtgcttttgtgtttccctggggctcagaccgcccactcgcggcgccgcgcctcggtccgcgggccccgccccccgggggaccgcagcacgccgcagcgccccaccgaccgggaggcaccaccgccggccaccacccgcaccaccgccagccaccgccccagcgcgcacacgcgagcgccgagcacaccccgccctcggacccacgccagcccgaagccgccccgagcacccgccgaccacagagcaggccacgcccgaccgggaacacgagccccctggcacgacgacaacggcccgccccggcaccccccgcgcgcacccacgcccccggccggccccggggccacggccacagaa

SEQ ID NO: 661321 - DNA, 234 bp, Homo sapiens
aactgtgacatcagtcactactggaactgcacaaaactggccactgacaaaaatgacccccatttgtgagacttcattgagacacataacctccatgagcaggtgaaagccatcaaagaattgggtgaacacgtgatcaacttgcgcaagatggagagcgcccgaatctgacttggcggaatatctctttgagaagcacaccctggaagaacaccatctcttcagggtaccgag

SEQ ID NO: 661322 - DNA, 672 bp, Homo sapiens
  misc_feature (170)..(170): n is a, c, g, or t
  misc_feature (245)..(245): n is a, c, g, or t
tgggttcccccaacaggtttaatttaaaaaatagagataagggtcaactctgtgagaaaaaaccaaaggcgggggccatcgtgggaaggtgctacattcaccttcctctccttcttatacttctccttgggaacagcaaatatttcgtggattttctttcgtgcaagccnccgaggcaggtgcgaggagtggcgtttctttacagcgagccgagttcctttctcagaggaaacgtgggcgccaangaatgtttctctgggggaacacatattattatctctgtgggtatctcttttgcacgaaaatatatatgtgtgtctctatatatgtccgatctcctctaactatgtgtgggggcatctatttctctcccagagggcaccacaaatcttggaaatatggggagagcttaaaaatatctctggtgtctccggtgttataagaacacaggggcctctatatttctcttcacagatccacagtgagacccaggtggagactttattctcttctctctctgtggtctctccagagaacacaccacggtgcgtcatatttctcacaatatcacggtgcactctctctccttatgtcgggcctctttcccaaagagtggggcgagaacaacaaaggagaaaaggcctccccccaaagaggagggggagcaccaag

SEQ ID NO: 661323 - DNA, 158 bp, Homo sapiens
gatgatcttgatcattgcaacctctgcgcccaggttcaagtgattcccctggctcagactcccgagtagactggattacaggcgcctgccagtgcagccggctaatttttttttaattttttttttttttatttatttttaattttttttatatttta

SEQ ID NO: 661324 - DNA, 706 bp, Homo sapiens
gggatgtgaggggcgcctctgcccggccgcccctactgggaagtgaggagcccctctgcccggccaccaccccgtctgggaggtgtacccaacagctcattgagaacgggccatgatgacaatggcggctttgtggaatagaaagcggggaaaggtggggaaaagattgagaaatcggatggttgccgtgtctgtgtggaaagaagtagacatgggagacttttcattttgttctgtactaagaaaaattcttatcctgttgatctgtgaccttacccccaaccccgtgctctctgaaacatgtgctgtgtccactcagggttaaatggattaagggcggtacaagatgtgctttgttaaacagatgcttgaaggcagcatgctccttaagagtcatcaccactccctaatcttaagtacccagggacacaaacgctgcggaaggccgcagggtcctttgcctaggaaaaccagagtaccttgttcacttgtttatctgctgaccttcccttcactattgtcctatgaccctggcaaattcccctctgcgagaaacacccaagaatgatcaattaaacataatcaataaataaataaaataaaacaaaattcacttctcatattaacaaaaaaatacttaattggccgccgtttacaacgtcgggactgggaatacccggcgttccccaattaattgccttgcccg

SEQ ID NO: 661325 - DNA, 244 bp, Homo sapiens
  misc_feature (9)..(9): n is a, c, g, or t
  misc_feature (14)..(14): n is a, c, g, or t
  misc_feature (30)..(30): n is a, c, g, or t
  misc_feature (47)..(47): n is a, c, g, or t
  misc_feature (81)..(81): n is a, c, g, or t
  misc_feature (143)..(143): n is a, c, g, or t
  misc_feature (146)..(146): n is a, c, g, or t
  misc_feature (181)..(181): n is a, c, g, or t
acctcttgnacttntgaaaggatctcaggnatccccagagatcagcngattatacttgcttcattttcctgaggttcttanaggcccttctatggacgtcatgagctgagctaagatttaatcttgcagatcgtattgcacangcnttcagcgtggactaggtctaggacattcgacaganatatggtcacagggagcgattagctctgtggctactgctaagcaggagtacactgcaccacta

SEQ ID NO: 661326 - DNA, 473 bp, Homo sapiens
accaaatgcccgacatacacacagcctgctctcactgaaggacatgagatgtggaaaggttcacttaaaaaaaaaaaaaagcacattagggtttttcttaatggcacagtacaatgaaaaaaacagaaaacagaccagagccctatggtccagataacacctacggaccttggaaaagaatagaaaaaataaaagcacatggttaaaaaactccacacagggcaaaaataatacaagattactgggggagggtcaccaagcactccgggtcccttcccatgaaaaataagtgcttattactttcggggatccctttctcaaaaacttcttattgatggacccagctttcaccagaatacatgctcttttaaatttaggccctgaagaatcagagtccattataggctctacaccttttcccactatatttatctcagaccagggttctaccctttcaaagaacagctgtggta

SEQ ID NO: 661327 - DNA, 280 bp, Homo sapiens
actttgctacatagagattgtatcgtagtcatggccttgcttaacttgatgctactatggacgagttcgtccatcattctcttggtcatttgtttgcggctgcactcatgacgcctacgaagagtcaatttgggcatcccagagttattttctaggattaactgtgcatcataccttgtgatccgcctcttcttattactttaggcagttctaaagctgactatgggttttgaagctatctgatgtcacaattgaacaaccgacgggtgaaggagcacag

SEQ ID NO: 661328 - DNA, 300 bp, Homo sapiens
cctcatttgtatgaggattattacttattggtgacgcaaatctatatgtagaacttaaaggatcagtagcaattaggagcggaaagcccccaatatgtagaaaaggttatgtgtacaccacctccaaaaataaaaaatggaaaacacacctttagtagaagtagaagtattagagtatcttgatgcagtaacttatagttgtagatcctgcacctggaccagatccattttcacttattggagagagcacgatttattgtaggtgacaattcagtgtggagtcgtgctgctccagagtgt

SEQ ID NO: 661329 - DNA, 210 bp, Homo sapiens
tctagaggatccggtgttatcgatgcccagggtctagcctcgtggccagaagcattttagccaactccgggtctgctccactctcttccttcttccgccgcttgttcctcagctcccttagggtgaactggcttcaggatttcacggttgctccttccacccacccgcacaatgctggtgggtggcatcgataaacaccgggtaccgagc

SEQ ID NO: 661330 - DNA, 194 bp, Homo sapiens
cgctgccagtgtgggttgaccacgtgagggtaatactgactgatggttgattgtagactattgggctgttacattgtcagttccgtgttttaaatctgacgcaggcttatgcggaggagaatgttttcctgttacttatactacaccattagttcttatactagggtgatagacattggaccaaattgggatgt

SEQ ID NO: 661331 - DNA, 294 bp, Homo sapiens
actctaaggatcctgcagaggcgttaggtatgatatcacagatttaggaaataggtatatctctacgagctaaggataaggagcagctgcaggactgctgatgcacattaaggaaaccccagcaaaggatctaaggcaaaaatgaacttgatgtttccagtgaacaacacccagtcagttggggtggctgcacaatgagagggaaagtccagatgaagtcacagagataaggcaacggggtcccactccacatagggtttcatgtggcacgataagaaagtctggcggggttat

SEQ ID NO: 661332 - DNA, 377 bp, Homo sapiens
agagtgaattccaggacagcccgggcgacacagagaaaccctgtctcaaaaaaaaccaaaacaaaaaccaaaaccaaaaaaaaagtatttataatgttaagggccaggtttcttgctctgacacagtgatagaaaaatattggcacccagatacacttaaaaaaagttttaatgcttaatgtaggtgacaattgtatattactggatttagctgggcactaatttacagattcacactctgagtccagctgtagcagaagatagaaggatgggagatgaataaggcagccactgctgtggaccactgttgcaggtccccatatcctcccagccatccaggccagcaggtggcgcttgaagcttttctctcacagggc

SEQ ID NO: 661333 - DNA, 313 bp, Homo sapiens
actggcccggctctgggggctcccgtatcccctgctctaggcaggtggcgcgtctgctttgctctgtcctccagccaccgttcttgcgctgtccccatgatcgagagcctcctgtctgcgtggccatcctgaggatctggcagagtgcccagggtagccccaggtcttctaaagccccatctagaccaccctccatgtcaggtactgagcgaggcccctgatccttctctctggaggaagagggaagcccaggagtcctgtttgtcaaacatcggtggctaccgctcctcttccagagctggctctgcttttc

SEQ ID NO: 661334 - DNA, 163 bp, Homo sapiens
gacaagcaaggctacggttttgataaattccaatcttgctgatccttcttgtgcattcttcacttcttgagctcactcccaaatatcctatttgtactatgttcactacctaataggattatttacagcgtcatgctatcaaaccagtgccaagctgcacttg

SEQ ID NO: 661335 - DNA, 404 bp, Homo sapiens
aaatcggttatctggcacgtcatcaaacccaagcacatttgcccacacaccccaaattaccaacgattgcatttaatcattctgaatatgcacgactcggtggtgaggacttctattcagttgatgtgttaccacgtagtttgggcagtgaagctgtccgattattgtttaatgatcagcgttctgtgctggagcaaacaaaggcaacaagcgtgattgtgccgtatcgtttacctgaatttgggggcgaatcgttgaatcgaatgataccaaatgattgatttgattagtgcataagggataacaaaagggcaacacactggcaattagcttggctattccggcagagatagccagtattgccggtataatcgaacgggcatcaaaaaaagcgatcgtcagat

SEQ ID NO: 661336 - DNA, 420 bp, Homo sapiens
gtacaacagtaggcagaggacattacagatccatatgcggtctagtcatatcttctatcagcacagataccactagttatttctgtcatcagagatagaatcatgatagaatatattcatcctccaccccagggatataaggtgctggtcatgggcatcatgcctacattcagttgaagggaattcttgtagttttccaaagaggttgtgctcatgcattttcatcagttccagctgctgcacatcctcatcaccacttagaatggtcatgacaggccaggtgcgcgggctcatgcctgtaatcccagcattttgggaggccagggcaggtggatcgcttgagatcaggacgtcaagactagcctggccaacatggcaaaaccccgtctctactaaaatacaaaaattagccaggcgtgg

SEQ ID NO: 661337 - DNA, 355 bp, Homo sapiens
  misc_feature (145)..(145): n is a, c, g, or t
  misc_feature (163)..(163): n is a, c, g, or t
  misc_feature (185)..(185): n is a, c, g, or t
  misc_feature (201)..(201): n is a, c, g, or t
  misc_feature (223)..(223): n is a, c, g, or t
  misc_feature (227)..(228): n is a, c, g, or t
  misc_feature (238)..(238): n is a, c, g, or t
  misc_feature (252)..(252): n is a, c, g, or t
  misc_feature (259)..(259): n is a, c, g, or t
  misc_feature (270)..(270): n is a, c, g, or t
  misc_feature (285)..(285): n is a, c, g, or t
  misc_feature (290)..(290): n is a, c, g, or t
  misc_feature (298)..(298): n is a, c, g, or t
  misc_feature (305)..(305): n is a, c, g, or t
  misc_feature (308)..(308): n is a, c, g, or t
  misc_feature (323)..(323): n is a, c, g, or t
  misc_feature (325)..(325): n is a, c, g, or t
  misc_feature (332)..(332): n is a, c, g, or t
  misc_feature (334)..(334): n is a, c, g, or t
  misc_feature (349)..(349): n is a, c, g, or t
gtcctgaaaaaaatttttgggaaggggtccaaacaaagacagaacagcatccggaccaatgccatccctttgggcagtgcccaggctggacaggagcctggccctggggaaaaaagggcctgttgcatcagcctttgaccttggncagccccccctgcccccnctgggtttttggggccccttgnccccccttcagccccngggcctttccttgccctttggntccnnaaatcagacngttccctgttcccngcccccncagggttttanggttttcatgccctntcccnaaaacctnttttttntgncccccccccccagantngggcccncnaataaagctgttttntttcca

SEQ ID NO: 661338 - DNA, 343 bp, Homo sapiens
atgcagcccaaaacgatttgtaaactttattaaacattatgataattttgtttctctcatcagctattgttagtgttagtgtattttatgtgtggcccaagacaattcttcttccagtgtggcccacgggaagccaaaagattgaccacccctggtatagaggaatttcttgagatatatacattccatacatacaggaaatacccgcttattattgattgataatttggctgtttgtagactttaggttaaaagatactttcctcaaatttcaaaggtattcttcccctgttttctactttccatcactgtcgctaaaaccatgcttccattctagttcttc

SEQ ID NO: 661339 - DNA, 468 bp, Homo sapiens
  misc_feature (189)..(189): n is a, c, g, or t
cataaagattccccatgtttgttgacttagaggcattttcaggcttttttttaatattcccccaaatatgcagagaagaaatgtttttgttaaccttggataccacaaagcccccaaaataggaaggttttttctagaaaatcccaaatgaaaggttaaagaggctattttaaacccctggggcccttntttaggaaaggggctcccccccaaaaattggggtgcttttccgggggcccaacccaaaaaggtttgggaaaatccgggtcagggggaatttttccctttttcaaaccccggggggggccccccctggaaaaagctttcctttaaaaaaaggggggttcaaaacattttgcccccccaataggttttttttttttttttaaccttttgggggggaaaggattttttaaaagtttgtcttccaagggttttataaaaaggaaaaaaaggtttttcccttta

SEQ ID NO: 661340 - DNA, 475 bp, Homo sapiens
caatatgtcactttattattgggattttttttcccattaggcacatccctgtcaatgacctcacttttagggaaatcaaccagtcttggaagcaactgaccaaatcagttgataattctggaccctcttaacacacatcaattatcactgggtagggattatctttaatgctgtcttacaactattgataacatgggagtcaagagtgtcacatctttaaatacatatagaattgccagaggtacataattatatatctatgcacacatacagaaaaatacaagactgtttttccacaatatttaatttatacactactgtaactatatgcaacttttgaagacaggttaaggggtacaagtaactgtttagagcaagtaagtagtttggaccaatattatcttaatgaaatggtttttcgctccctcccttttatgtgacgacatactatgacattacaaaacatgcccaatcc

SEQ ID NO: 661341 - DNA, 3248 bp, Homo sapiens
  misc_feature (3171)..(3171): n is a, c, g, or t
  misc_feature (3189)..(3189): n is a, c, g, or t
  misc_feature (3199)..(3199): n is a, c, g, or t
  misc_feature (3206)..(3206): n is a, c, g, or t
tttttttaaaaacgagagtgttatttctttatttgtgggaaattacggtatctattttcttccaaacgtaataataattcttagaaaatagggactcctttttgcggaataatccatagggggcgaggccaactctcgggagtcgaggtatcttctccccaaccactgctcttattttaattattgcagacggaagttgaaaactattgacatagtaaatagctctgggtggcttgaaacgaaagtttaactttgcggacaaacaggacttattgtagggggtggtcaaaatagtcccggcggggcggggccatgacccctgacgtcgccggtccggcgcgcagttcagtttggcggttccggtaccgctctcacattggggcgggatgtgggagcggctgaactgcgcagcagaggacttttattctcgtctccttcagaaatttaatgaagaaaagaaaggaatccgtaaagacccatttctctatgaggctgatgtccaagtgcagttgatcagcaaaggccaaccaaaccctttgaaaaatattctaaatgaaaatgacatagtattcatagtggaaaaagtgcctttagaaaaggaagaaacaagtcatattgaagaacttcaatctgaagaaactgccatatctgatttctctactggcgaaaatgttggaccacttgctttaccagttgggaaggcaaggcagttaattggactttacaccatggctcacaatcctaatatgacccatttgaagattaatctgccagttactgcccttcctcccctttgggtaagatgtgacagttcagatcctgaaggtacttgttggctaggagctgagcttatcacaacaaacaacagcattacaggaattgtcttatatgtggtcagttgtaaagctgataaaaattattctgtaaatcttgaaaacctaaaaaatttacacaagaaaagacatcacttgtctactgtaacatccaaaggctttgcccagtatgagctctttaagtcctctgccttggatgatacaatcacagcatcacaaactgcgatcgctttggatatttcctggagtcctgtggatgagattcttcaaatccctccactctcttcaactgcaactctgaatattaaagtggaatcaggagagcccagaggtcctttgaatcatctctacagagaactgaaatttcttcttgttttggctgatggtttgaggactggtgtcactgaatggctcgagcccctggaagcaaaatctgctgttgaacttgttcaggaatttctgaatgacttaaataagctggatggatttggtgattctacaaaaaaagacactgaggttgagaccttgaagcatgacactgctgcagtcgatcgttccgtcaagcgtcttttcaaagttcggagtgatcttgattttgctgagcaactgtggtgcaaaatgagcagtagtgtgatttcataccaagacttggtgaagtgtttcacattgatcatccagagtctacaacgtggtgatatacagccatggctccatagtggaagtaacagtttactaagtaagctcattcatcagtcttatcatggaaccatggacacagtttctctcagtgggactattccagttcaaatgcttttggaaattggtttggacaaactaaagaaagattatatcagttttttcataggtcaggaacttgcatctttgaatcatttggaatacttcattgctccatcagtagatatacaagaacaggtttatcgtgtccaaaaactccaccatattctagaaatattagtcagttgcatgcctttcattaaatctcaacatgaactcctcttttctttaacacagatctgcataaagtattacaaacaaaatcctcttgatgagcaacacatttttcagctgccagtcagaccaactgctgtaaagaacttatatcaaagtgagaagccacagaaatggagagtggaaatatatagtggtcaaaagaagattaagacagtttggcaactgagtgacagctcacccatagaccatctgaattttcacaaacctgatttttcggaattaacactaaacggtagcctggaagaaaggatattctttactaacatggttacctgcagccaggtgcatttcaagtgaagtgtgctgatgaagtcctctataagcacaagccaaaaagagaaagagaaaaaaaggtaattattgtagaacctgaaaacagcaatgtatggaaaccctcaaagcagaaaagggaggaagatcctgaagattctcttatgaagctccaaaattgataatcctgtctcagctctgcctcctcaggaggagcattagtagaacagcagtgatgaggacacagagggagcagacagtgggtaccacgatctccgtaaccatttgcatgtgacttagcaagggctctgaaatgacaaagagaacgagcaccacaaatgagaacaggatcattttagtaaatacagctttatcccaaaagctttaactgtattgggaaaacttaaaaaatagcatcctcaaattttctgattcttatttgccatgaaatagaacttagtaaattaaatgttatttgaaaatgttataagagctttgtaaatatttcagaaaatatgggataaatgcctgaatttggttcttctacaggtgctataataaagtccatctctcaatacttatactttctaaattcatctcagaatattagcagccatattccacagttcctataatttttactgggggggattgtgataggaaagtccttgggaaacatttccaatctttcaaaatattattgtgtatcttaagaagtataggaacttgtatgttgaaatgttgtatggtagttcttgtatagttaaataataatctttttaagagttaatgataagcatatgttatgtgcattattaataaaatagtggccacttaggtaatacccacttttatcttgtgtgctggggtactctggttactgagataaataaggcactggacatcctcacgtggagttcacaggctcatcagtgaattctgtaccacatttcaacctggttatttaagttaatggaatatacattcttagtatgcctgatattaaattgtgagggggatgcatgtgttatgggcnaaaatagagttggagatnggttgcttcntttgtcncataagtgggtgttaaaggaggatttgttgcttggaaaaggg

SEQ ID NO: 661342 - DNA, 180 bp, Homo sapiens
aacactaccacatagatgtttcttgtgcatatatctctttgtttttgcagtatatctgtaggatcaactttcttgagtggaattgtcaggtcaccgggttttgtgcacttcactatgtatatatatgccacgtggtgtcacatatatatgtcacattccctccacattgtttacgtgtgc

SEQ ID NO: 661343 - DNA, 1379 bp, Homo sapiens
tttttttaaaaacgagagtgttatttctttatttgtgggaaattacggtatctattttcttccaaacgtaataataattcttagaaaatagggactcctttttgcggaataatccatagggggcgaggccaactctcgggagtcgaggtatcttctccccaaccactgctcttattttaattattgcagacggaagttgaaaactattgacatagtaaatagctctgggtggcttgaaacgaaagtttaactttgcggacaaacaggacttattgtagggggtggtcaaaatagtcccggcggggcggggccatgacccctgacgtcgccggtccggcgcgcagttcagtttggcggttccggtaccgctctcacattggggcgggatgtgggagcggctgaactgcgcagcagaggacttttattctcgtctccttcagaaatttaatgaagaaaagaaaggaatccgtaaagacccatttctctatgaggctgatgtccaagtgcagttgatcagcaaaggccaaccaaaccctttgaaaaatattctaaatgaaaatgacatagtattcatagtggaaaaagtgcctttagaaaaggaagaaacaagtcatattgaagaacttcaatctgaagaaactgccatatctgatttctctactggcgaaaatgttggaccacttgctttaccagttgggaaggcaaggcagttaattggactttacaccatggctcacaatcctaatatgacccatttgaagattaatctgccagttactgcccttcctcccctttgggtaagatgtgacagttcagatcctgaaggtacttgttggctaggagctgagcttatcacaacaaacaacagcattacaggaattgtcttatatgtggtcagttgtaaagctgataaaaattattctgtaaatcttgaaaacctaaaaaatttacacaagaaaagacatcacttgtctactgtaacatccaaaggctttgcccagtatgagctctttaagtcctctgccttggatgatacaatcacagcatcacaaactgcgatcgctttggatatttcctggagtcctgtggatgagattcttcaaatccctccactctcttcaaactggcaaatccggaatatttaaaggtgggaatcaagggagaagcccaaagggtccttggaactcaccttcttaacgaggaaaccggacatatctttcctgggtatggcgagcagggattcacgcacgtgggcgtcccttcagagtgtgtctagactccgtgtgatgccaactgtcgcttgtaacagtgtacgaaaacggaaaggacgaaaaaccggacggatgcgaggcctccaacacaacacggtgaacataaca

SEQ ID NO: 661344 - DNA, 100 bp, Homo sapiens
gaaaagtctcgatagagagacagcatagactctgagtccgatggtcgttaagtgaacgtcgatggatatattcctctacttggtatgcggtgctacagta

SEQ ID NO: 661345 - DNA, 3343 bp, Homo sapiens
  misc_feature (3266)..(3266): n is a, c, g, or t
  misc_feature (3284)..(3284): n is a, c, g, or t
  misc_feature (3294)..(3294): n is a, c, g, or t
  misc_feature (3301)..(3301): n is a, c, g, or t
tttttttaaaaacgagagtgttatttctttatttgtgggaaattacggtatctattttcttccaaacgtaataataattcttagaaaatagggactcctttttgcggaataatccatagggggcgaggccaactctcgggagtcgaggtatcttctccccaaccactgctcttattttaattattgcagacggaagttgaaaactattgacatagtaaatagctctgggtggcttgaaacgaaagtttaactttgcggacaaacaggacttattgtagggggtggtcaaaatagtcccggcggggcggggccatgacccctgacgtcgccggtccggcgcgcagttcagtttggcggttccggtaccgctctcacattggggcgggatgtgggagcggctgaactgcgcagcagaggacttttattctcgtctccttcagtgtcctgcagagataaagtgatgactgactcctgagtgtgaataacgggagagataatgtagttctgtttttcacatgtggttctgcgtttcaggaaatttaatgaagaaaagaaaggaatccgtaaagacccatttctctatgaggctgatgtccaagtgcagttgatcagcaaaggccaaccaaaccctttgaaaaatattctaaatgaaaatgacatagtattcatagtggaaaaagtgcctttagaaaaggaagaaacaagtcatattgaagaacttcaatctgaagaaactgccatatctgatttctctactggcgaaaatgttggaccacttgctttaccagttgggaaggcaaggcagttaattggactttacaccatggctcacaatcctaatatgacccatttgaagattaatctgccagttactgcccttcctcccctttgggtaagatgtgacagttcagatcctgaaggtacttgttggctaggagctgagcttatcacaacaaacaacagcattacaggaattgtcttatatgtggtcagttgtaaagctgataaaaattattctgtaaatcttgaaaacctaaaaaatttacacaagaaaagacatcacttgtctactgtaacatccaaaggctttgcccagtatgagctctttaagtcctctgccttggatgatacaatcacagcatcacaaactgcgatcgctttggatatttcctggagtcctgtggatgagattcttcaaatccctccactctcttcaactgcaactctgaatattaaagtggaatcaggagagcccagaggtcctttgaatcatctctacagagaactgaaatttcttcttgttttggctgatggtttgaggactggtgtcactgaatggctcgagcccctggaagcaaaatctgctgttgaacttgttcaggaatttctgaatgacttaaataagctggatggatttggtgattctacaaaaaaagacactgaggttgagaccttgaagcatgacactgctgcagtcgatcgttccgtcaagcgtcttttcaaagttcggagtgatcttgattttgctgagcaactgtggtgcaaaatgagcagtagtgtgatttcataccaagacttggtgaagtgtttcacattgatcatccagagtctacaacgtggtgatatacagccatggctccatagtggaagtaacagtttactaagtaagctcattcatcagtcttatcatggaaccatggacacagtttctctcagtgggactattccagttcaaatgcttttggaaattggtttggacaaactaaagaaagattatatcagttttttcataggtcaggaacttgcatctttgaatcatttggaatacttcattgctccatcagtagatatacaagaacaggtttatcgtgtccaaaaactccaccatattctagaaatattagtcagttgcatgcctttcattaaatctcaacatgaactcctcttttctttaacacagatctgcataaagtattacaaacaaaatcctcttgatgagcaacacatttttcagctgccagtcagaccaactgctgtaaagaacttatatcaaagtgagaagccacagaaatggagagtggaaatatatagtggtcaaaagaagattaagacagtttggcaactgagtgacagctcacccatagaccatctgaattttcacaaacctgatttttcggaattaacactaaacggtagcctggaagaaaggatattctttactaacatggttacctgcagccaggtgcatttcaagtgaagtgtgctgatgaagtcctctataagcacaagccaaaaagagaaagagaaaaaaaggtaattattgtagaacctgaaaacagcaatgtatggaaaccctcaaagcagaaaagggaggaagatcctgaagattctcttatgaagctccaaaattgataatcctgtctcagctctgcctcctcaggaggagcattagtagaacagcagtgatgaggacacagagggagcagacagtgggtaccacgatctccgtaaccatttgcatgtgacttagcaagggctctgaaatgacaaagagaacgagcaccacaaatgagaacaggatcattttagtaaatacagctttatcccaaaagctttaactgtattgggaaaacttaaaaaatagcatcctcaaattttctgattcttatttgccatgaaatagaacttagtaaattaaatgttatttgaaaatgttataagagctttgtaaatatttcagaaaatatgggataaatgcctgaatttggttcttctacaggtgctataataaagtccatctctcaatacttatactttctaaattcatctcagaatattagcagccatattccacagttcctataatttttactgggggggattgtgataggaaagtccttgggaaacatttccaatctttcaaaatattattgtgtatcttaagaagtataggaacttgtatgttgaaatgttgtatggtagttcttgtatagttaaataataatctttttaagagttaatgataagcatatgttatgtgcattattaataaaatagtggccacttaggtaatacccacttttatcttgtgtgctggggtactctggttactgagataaataaggcactggacatcctcacgtggagttcacaggctcatcagtgaattctgtaccacatttcaacctggttatttaagttaatggaatatacattcttagtatgcctgatattaaattgtgagggggatgcatgtgttatgggcnaaaatagagttggagatnggttgcttcntttgtcncataagtgggtgttaaaggaggatttgttgcttggaaaaggg

SEQ ID NO: 661346 - DNA, 547 bp, Homo sapiens
  misc_feature (92)..(95): n is a, c, g, or t
  misc_feature (98)..(99): n is a, c, g, or t
  misc_feature (113)..(113): n is a, c, g, or t
  misc_feature (188)..(188): n is a, c, g, or t
  misc_feature (191)..(191): n is a, c, g, or t
tgcaggtcagccagctggccatgtgtgggccctgtctgggccagccaccttgtgtcctggagtggaggcagcacagacagtgagtgacgaannnnagnnaggacgaggaggantgaggaagacgaggaggcattggctgtgcagcccgtggaggggccacccctctgtcctaccccagccctggcctnagnctccaggccccgagctggacatgccgaccgttatgagcccatgttgccatatcatgaattgccgcctagacctatggcccccctgtaggtcgtcctgtgtggatggatatgatgcttgcacatcttggtgcctccatgctccctacatggggcccctcagttgtgccccatgtggcctccccactcagagcctggccagccctcctgcccgtgacgccctgcagctcaggtctcaggagacccacaccacccctcagcacctcaggaatgccacagaaggcagcaaagtcacggagccctcagccccttgccaaggcctttggttagcaatcggggaccttcaggccaccttccac

SEQ ID NO: 661347 - DNA, 122 bp, Homo sapiens
ttcttggatcgtaaacataagctcatccattgcaccttccctggcctcccggagtgcggcgtgtgatacagcagggacctggccgccgcgccgagcccgagtttggggacgtggagagctgg

SEQ ID NO: 661348 - DNA, 3100 bp, Homo sapiens
  misc_feature (3023)..(3023): n is a, c, g, or t
  misc_feature (3041)..(3041): n is a, c, g, or t
  misc_feature (3051)..(3051): n is a, c, g, or t
  misc_feature (3058)..(3058): n is a, c, g, or t
tttttttaaaaacgagagtgttatttctttatttgtgggaaattacggtatctattttcttccaaacgtaataataattcttagaaaatagggactcctttttgcggaataatccatagggggcgaggccaactctcgggagtcgaggtatcttctccccaaccactgctcttattttaattattgcagacggaagttgaaaactattgacatagtaaatagctctgggtggcttgaaacgaaagtttaactttgcggacaaacaggacttattgtagggggtggtcaaaatagtcccggcggggcggggccatgacccctgacgtcgccggtccggcgcgcagttcagtttggcggttccggtaccgctctcacattggggcgggatgtgggagcggctgaactgcgcagcagaggacttttattctcgtctccttcacctttagaaaaggaagaaacaagtcatattgaagaacttcaatctgaagaaactgccatatctgatttctctactggcgaaaatgttggaccacttgctttaccagttgggaaggcaaggcagttaattggactttacaccatggctcacaatcctaatatgacccatttgaagattaatctgccagttactgcccttcctcccctttgggtaagatgtgacagttcagatcctgaaggtacttgttggctaggagctgagcttatcacaacaaacaacagcattacaggaattgtcttatatgtggtcagttgtaaagctgataaaaattattctgtaaatcttgaaaacctaaaaaatttacacaagaaaagacatcacttgtctactgtaacatccaaaggctttgcccagtatgagctctttaagtcctctgccttggatgatacaatcacagcatcacaaactgcgatcgctttggatatttcctggagtcctgtggatgagattcttcaaatccctccactctcttcaactgcaactctgaatattaaagtggaatcaggagagcccagaggtcctttgaatcatctctacagagaactgaaatttcttcttgttttggctgatggtttgaggactggtgtcactgaatggctcgagcccctggaagcaaaatctgctgttgaacttgttcaggaatttctgaatgacttaaataagctggatggatttggtgattctacaaaaaaagacactgaggttgagaccttgaagcatgacactgctgcagtcgatcgttccgtcaagcgtcttttcaaagttcggagtgatcttgattttgctgagcaactgtggtgcaaaatgagcagtagtgtgatttcataccaagacttggtgaagtgtttcacattgatcatccagagtctacaacgtggtgatatacagccatggctccatagtggaagtaacagtttactaagtaagctcattcatcagtcttatcatggaaccatggacacagtttctctcagtgggactattccagttcaaatgcttttggaaattggtttggacaaactaaagaaagattatatcagttttttcataggtcaggaacttgcatctttgaatcatttggaatacttcattgctccatcagtagatatacaagaacaggtttatcgtgtccaaaaactccaccatattctagaaatattagtcagttgcatgcctttcattaaatctcaacatgaactcctcttttctttaacacagatctgcataaagtattacaaacaaaatcctcttgatgagcaacacatttttcagctgccagtcagaccaactgctgtaaagaacttatatcaaagtgagaagccacagaaatggagagtggaaatatatagtggtcaaaagaagattaagacagtttggcaactgagtgacagctcacccatagaccatctgaattttcacaaacctgatttttcggaattaacactaaacggtagcctggaagaaaggatattctttactaacatggttacctgcagccaggtgcatttcaagtgaagtgtgctgatgaagtcctctataagcacaagccaaaaagagaaagagaaaaaaaggtaattattgtagaacctgaaaacagcaatgtatggaaaccctcaaagcagaaaagggaggaagatcctgaagattctcttatgaagctccaaaattgataatcctgtctcagctctgcctcctcaggaggagcattagtagaacagcagtgatgaggacacagagggagcagacagtgggtaccacgatctccgtaaccatttgcatgtgacttagcaagggctctgaaatgacaaagagaacgagcaccacaaatgagaacaggatcattttagtaaatacagctttatcccaaaagctttaactgtattgggaaaacttaaaaaatagcatcctcaaattttctgattcttatttgccatgaaatagaacttagtaaattaaatgttatttgaaaatgttataagagctttgtaaatatttcagaaaatatgggataaatgcctgaatttggttcttctacaggtgctataataaagtccatctctcaatacttatactttctaaattcatctcagaatattagcagccatattccacagttcctataatttttactgggggggattgtgataggaaagtccttgggaaacatttccaatctttcaaaatattattgtgtatcttaagaagtataggaacttgtatgttgaaatgttgtatggtagttcttgtatagttaaataataatctttttaagagttaatgataagcatatgttatgtgcattattaataaaatagtggccacttaggtaatacccacttttatcttgtgtgctggggtactctggttactgagataaataaggcactggacatcctcacgtggagttcacaggctcatcagtgaattctgtaccacatttcaacctggttatttaagttaatggaatatacattcttagtatgcctgatattaaattgtgagggggatgcatgtgttatgggcnaaaatagagttggagatnggttgcttcntttgtcncataagtgggtgttaaaggaggatttgttgcttggaaaaggg

SEQ ID NO: 661349 - DNA, 546 bp, Homo sapiens
  misc_feature (283)..(283): n is a, c, g, or t
ctacaggatcttggaatcctcctgctgctgttctcatggttctcctgagctccctgtgtttgctgctccccgacgaggacgcattgcccttcctgactctcgcctcgagggacccagccaagatgggaaaactgagtgcgtccaagaggggcctggatcgatacgtggtgactgttctaatatatagctgcccttctatctaccctactgtgctgcctagtgccacgtgctggccacacatgctgcacacactgctcggcagcacgcttgtacctgggcccanccttggttgtccacggtcttggcagacgggcagcagtgtccccagtgtgcccaatgatctacaagttactactccctcgctggcctcccctgcctctcctcgctgggccctcggattcctatagcctttggtaccctagtgcagctggtgagaagcttcagccgtaggacaggagcaggctccaaggggctgcagagcagctactctgaggaatatctgaggaacctcctttgcaggaagaagctgggaagcagcaggaggaa

SEQ ID NO: 661350 - DNA, 3137 bp, Homo sapiens
  misc_feature (3060)..(3060): n is a, c, g, or t
  misc_feature (3078)..(3078): n is a, c, g, or t
  misc_feature (3088)..(3088): n is a, c, g, or t
  misc_feature (3095)..(3095): n is a, c, g, or t
tttttttaaaaacgagagtgttatttctttatttgtgggaaattacggtatctattttcttccaaacgtaataataattcttagaaaatagggactcctttttgcggaataatccatagggggcgaggccaactctcgggagtcgaggtatcttctccccaaccactgctcttattttaattattgcagacggaagttgaaaactattgacatagtaaatagctctgggtggcttgaaacgaaagtttaactttgcggacaaacaggacttattgtagggggtggtcaaaatagtcccggcggggcggggccatgacccctgacgtcgccggtccggcgcgcagttcagtttggcggttccggtaccgctctcacattggggcgggatgtgggagcggctgaactgcgcagcagaggacttttattctcgtctccttcagaaatttaatgaagaaaagaaaggaatccgtaaagacccatttctctatgaggctgatgtccaagtgcagttgatcagcaaaggccaaccaaaccctttgaaaaatattctaaatgaaaatgacatagtattcatagtggaaaaagtgcctttagaaaaggaagaaacaagtcatattgaagaacttcaatctgaagaaactgccatatctgatttctctactggcgaaaatgttggaccacttgctttaccagttgggaaggcaaggcagttaattggactttacaccatggctcacaatcctaatatgacccatttgaagattaatctgccagttactgcccttcctccccttgctgataaaaattattctgtaaatcttgaaaacctaaaaaatttacacaagaaaagacatcacttgtctactgtaacatccaaaggctttgcccagtatgagctctttaagtcctctgccttggatgatacaatcacagcatcacaaactgcgatcgctttggatatttcctggagtcctgtggatgagattcttcaaatccctccactctcttcaactgcaactctgaatattaaagtggaatcaggagagcccagaggtcctttgaatcatctctacagagaactgaaatttcttcttgttttggctgatggtttgaggactggtgtcactgaatggctcgagcccctggaagcaaaatctgctgttgaacttgttcaggaatttctgaatgacttaaataagctggatggatttggtgattctacaaaaaaagacactgaggttgagaccttgaagcatgacactgctgcagtcgatcgttccgtcaagcgtcttttcaaagttcggagtgatcttgattttgctgagcaactgtggtgcaaaatgagcagtagtgtgatttcataccaagacttggtgaagtgtttcacattgatcatccagagtctacaacgtggtgatatacagccatggctccatagtggaagtaacagtttactaagtaagctcattcatcagtcttatcatggaaccatggacacagtttctctcagtgggactattccagttcaaatgcttttggaaattggtttggacaaactaaagaaagattatatcagttttttcataggtcaggaacttgcatctttgaatcatttggaatacttcattgctccatcagtagatatacaagaacaggtttatcgtgtccaaaaactccaccatattctagaaatattagtcagttgcatgcctttcattaaatctcaacatgaactcctcttttctttaacacagatctgcataaagtattacaaacaaaatcctcttgatgagcaacacatttttcagctgccagtcagaccaactgctgtaaagaacttatatcaaagtgagaagccacagaaatggagagtggaaatatatagtggtcaaaagaagattaagacagtttggcaactgagtgacagctcacccatagaccatctgaattttcacaaacctgatttttcggaattaacactaaacggtagcctggaagaaaggatattctttactaacatggttacctgcagccaggtgcatttcaagtgaagtgtgctgatgaagtcctctataagcacaagccaaaaagagaaagagaaaaaaaggtaattattgtagaacctgaaaacagcaatgtatggaaaccctcaaagcagaaaagggaggaagatcctgaagattctcttatgaagctccaaaattgataatcctgtctcagctctgcctcctcaggaggagcattagtagaacagcagtgatgaggacacagagggagcagacagtgggtaccacgatctccgtaaccatttgcatgtgacttagcaagggctctgaaatgacaaagagaacgagcaccacaaatgagaacaggatcattttagtaaatacagctttatcccaaaagctttaactgtattgggaaaacttaaaaaatagcatcctcaaattttctgattcttatttgccatgaaatagaacttagtaaattaaatgttatttgaaaatgttataagagctttgtaaatatttcagaaaatatgggataaatgcctgaatttggttcttctacaggtgctataataaagtccatctctcaatacttatactttctaaattcatctcagaatattagcagccatattccacagttcctataatttttactgggggggattgtgataggaaagtccttgggaaacatttccaatctttcaaaatattattgtgtatcttaagaagtataggaacttgtatgttgaaatgttgtatggtagttcttgtatagttaaataataatctttttaagagttaatgataagcatatgttatgtgcattattaataaaatagtggccacttaggtaatacccacttttatcttgtgtgctggggtactctggttactgagataaataaggcactggacatcctcacgtggagttcacaggctcatcagtgaattctgtaccacatttcaacctggttatttaagttaatggaatatacattcttagtatgcctgatattaaattgtgagggggatgcatgtgttatgggcnaaaatagagttggagatnggttgcttcntttgtcncataagtgggtgttaaaggaggatttgttgcttggaaaaggg

SEQ ID NO: 661351 - DNA, 169 bp, Homo sapiens
gaggggccttcagacacttaacgttattaactctcctttaaatatctcacacacacacacacactaacaccatacgtgtattctatacaattttgacactttcattctgccaaagtgattctttcattactatgattcaagttgtttttatccatcctgtcttacaaat

SEQ ID NO: 661352 - DNA, 391 bp, Homo sapiens
  misc_feature (57)..(57): n is a, c, g, or t
  misc_feature (99)..(99): n is a, c, g, or t
  misc_feature (102)..(102): n is a, c, g, or t
  misc_feature (292)..(292): n is a, c, g, or t
gtacttaatctttaaaaatcttcaaagggcacccatttttctttagttaacaatgtncgaaagattgcattgatgtgattaaattcccaggaccctcanttntttagggatggactaaatggccgctatcatagcttataacagtatcttgaatgtgatggtgcttatgttgagaagtaaagtttacatctttaaacttttatcttttaatctcatttttccatgaacattttgaattctcctcatcgttatatgtttgtatgcaagtgagtgtgtggttgtatgagctttnatcagcctagacagggtgaaacagacaaacctcacctttagtctttctaaatgtgaaggcttaatcttgttctcaccccattgtagttctcttgaaagg

SEQ ID NO: 661353 - DNA, 2424 bp, Homo sapiens
  misc_feature (2347)..(2347): n is a, c, g, or t
  misc_feature (2365)..(2365): n is a, c, g, or t
  misc_feature (2375)..(2375): n is a, c, g, or t
  misc_feature (2382)..(2382): n is a, c, g, or t
aatgtgagggattacagttttgtagctctgacaatgtaattttgagttgtgcctttacatttctttctttcatttcctatagctgataaaaattattctgtaaatcttgaaaacctaaaaaatttacacaagaaaagacatcacttgtctactgtaacatccaaaggctttgcccagtatgagctctttaagtcctctgccttggatgatacaatcacagcatcacaaactgcgatcgctttggatatttcctggagtcctgtggatgagattcttcaaatccctccactctcttcaactgcaactctgaatattaaagtggaatcaggagagcccagaggtcctttgaatcatctctacagagaactgaaatttcttcttgttttggctgatggtttgaggactggtgtcactgaatggctcgagcccctggaagcaaaatctgctgttgaacttgttcaggaatttctgaatgacttaaataagctggatggatttggtgattctacaaaaaaagacactgaggttgagaccttgaagcatgacactgctgcagtcgatcgttccgtcaagcgtcttttcaaagttcggagtgatcttgattttgctgagcaactgtggtgcaaaatgagcagtagtgtgatttcataccaagacttggtgaagtgtttcacattgatcatccagagtctacaacgtggtgatatacagccatggctccatagtggaagtaacagtttactaagtaagctcattcatcagtcttatcatggaaccatggacacagtttctctcagtgggactattccagttcaaatgcttttggaaattggtttggacaaactaaagaaagattatatcagttttttcataggtcaggaacttgcatctttgaatcatttggaatacttcattgctccatcagtagatatacaagaacaggtttatcgtgtccaaaaactccaccatattctagaaatattagtcagttgcatgcctttcattaaatctcaacatgaactcctcttttctttaacacagatctgcataaagtattacaaacaaaatcctcttgatgagcaacacatttttcagctgccagtcagaccaactgctgtaaagaacttatatcaaagtgagaagccacagaaatggagagtggaaatatatagtggtcaaaagaagattaagacagtttggcaactgagtgacagctcacccatagaccatctgaattttcacaaacctgatttttcggaattaacactaaacggtagcctggaagaaaggatattctttactaacatggttacctgcagccaggtgcatttcaagtgaagtgtgctgatgaagtcctctataagcacaagccaaaaagagaaagagaaaaaaaggtaattattgtagaacctgaaaacagcaatgtatggaaaccctcaaagcagaaaagggaggaagatcctgaagattctcttatgaagctccaaaattgataatcctgtctcagctctgcctcctcaggaggagcattagtagaacagcagtgatgaggacacagagggagcagacagtgggtaccacgatctccgtaaccatttgcatgtgacttagcaagggctctgaaatgacaaagagaacgagcaccacaaatgagaacaggatcattttagtaaatacagctttatcccaaaagctttaactgtattgggaaaacttaaaaaatagcatcctcaaattttctgattcttatttgccatgaaatagaacttagtaaattaaatgttatttgaaaatgttataagagctttgtaaatatttcagaaaatatgggataaatgcctgaatttggttcttctacaggtgctataataaagtccatctctcaatacttatactttctaaattcatctcagaatattagcagccatattccacagttcctataatttttactgggggggattgtgataggaaagtccttgggaaacatttccaatctttcaaaatattattgtgtatcttaagaagtataggaacttgtatgttgaaatgttgtatggtagttcttgtatagttaaataataatctttttaagagttaatgataagcatatgttatgtgcattattaataaaatagtggccacttaggtaatacccacttttatcttgtgtgctggggtactctggttactgagataaataaggcactggacatcctcacgtggagttcacaggctcatcagtgaattctgtaccacatttcaacctggttatttaagttaatggaatatacattcttagtatgcctgatattaaattgtgagggggatgcatgtgttatgggcnaaaatagagttggagatnggttgcttcntttgtcncataagtgggtgttaaaggaggatttgttgcttggaaaaggg

SEQ ID NO: 661354 - DNA, 1109 bp, Homo sapiens
  misc_feature (600)..(600): n is a, c, g, or t
  misc_feature (690)..(690): n is a, c, g, or t
ccacaaaaccgggtttacgacaggacatattttcaacccccccttagaccccttgtgatgtcccaaatgcctcccattattcttattgaattttgtgatccctcgtagattcctgtgatcaagcccttgtggtgactttataaccccggcttggtccaattggggaagaaggttgtgaacacagtcccacgcccacctttaaaagggggactttattgggtgttcccacaagccttgggttttgagggagcggtggcctgaccaccccccttgtgacgggcccaaagaggttgaaataatttcgagagggaacacagtttgggcgtttcaagaaaccttagcgtaatttgctgtgcccccatttggaaaagaaaattggtgggtggttgtttatacttacacgcccttgcgtatgaaatgcccacgagaagttctggaacacatgtgttaatgccaaaccctcgtgtcccacgttgcggtgtgcttcgcgtggacaacaaccccacgttgcccacaaaaggagaatggctctcccaccccacgagaggagaactcggttaaccacatagatgtacacacctgagatgccccacagagacnccgctggggggatacctcgggcggagtccctcgcccacaaatttgccctgagaggcaccgagactttgagaaactcggcccacggaaagntatatggttaataatgttgtatacctgagatatatcaccctataaagagtgagaacttctttcacaaaagtggctctctcgtaactatggaaaggaatcccaaggcacgaattttctttggtcttgctccacggaatgggtggtgaaataatggccgaataagagaaaatccttaaacctaccacgaatggaaaatctccctatagtatttatacctcactgaattcccgtccaaaggaagcacgagttgttaaagaggtactggaaataaggggctgaaggagtctataattcccctattgcacattttccttaatgtataaattttccacagaatggtgaatgttacttttcagtgtactcatatgtctcattttcatctaaaattaaatggcaggaaacacaggactgcatagaga

SEQ ID NO: 661355 - DNA, 2425 bp, Homo sapiens
  misc_feature (2402)..(2402): n is a, c, g, or t
tttttttaaaaacgagagtgttatttctttatttgtgggaaattacggtatctattttcttccaaacgtaataataattcttagaaaatagggactcctttttgcggaataatccatagggggcgaggccaactctcgggagtcgaggtatcttctccccaaccactgctcttattttaattattgcagacggaagttgaaaactattgacatagtaaatagctctgggtggcttgaaacgaaagtttaactttgcggacaaacaggacttattgtagggggtggtcaaaatagtcccggcggggcggggccatgacccctgacgtcgccggtccggcgcgcagttcagtttggcggttccggtaccgctctcacattggggcgggatgtgggagcggctgaactgcgcagcagaggacttttattctcgtctccttcagtgtcctgcagagataaagtgatgactgactcctgagtgtgaataacgggagagataatgtagttctgtttttcacatgtggttctgcgtttcaggaaatttaatgaagaaaagaaaggaatccgtaaagacccatttctctatgaggctgatgtccaagtgcagttgatcagcaaaggccaaccaaaccctttgaaaaatattctaaatgaaaatgacatagtattcatagtggaaaaagtgcctttagaaaaggaagaaacaagtcatattgaagaacttcaatctgaagaaactgccatatctgatttctctactggcgaaaatgttggaccacttgctttaccagttgggaaggcaaggcagttaattggactttacaccatggctcacaatcctaatatgacccatttgaagattaatctgccagttactgcccttcctcccctttgggtaagatgtgacagttcagatcctgaaggtacttgttggctaggagctgagcttatcacaacaaacaacagcattacaggaattgtcttatatgtggtcagttgtaaagctgataaaaattattctgtaaatcttgaaaacctaaaaaatttacacaagaaaagacatcacttgtctactgtaacatccaaaggctttgcccagtatgagctctttaagtcctctgccttggatgatacaatcacagcatcacaaactgcgatcgctttggatatttcctggagtcctgtggatgagattcttcaaatccctccactctcttcaactgcaactctgaatattaaagtggaatcaggagagcccagaggtcctttgaatcatctctacagagaactgaaatttcttcttgttttggctgatggtttgaggactggtgtcactgaatggctcgagcccctggaagcaaaatctgctgttgaacttgttcaggaatttctgaatgacttaaataagctggatggatttggtgattctacaaaaaaagacactgaggttgagaccttgaagcatgacactgctgcagtcgatcgttccgtcaagcgtcttttcaaagttcggagtgatcttgattttgctgagcaactgtggtgcaaaatgagcagtagtgtgatttcataccaagacttggtgaagtgtttcacattgatcatccagagtctacaacgtggtgatatacagccatggctccatagtggaagtaacagtttactaagtaagctcattcatcagtcttatcatggaaccatggacacagtttctctcagtgggactattccagttcaaatgcttttggaaattggtttggacaaactaaagaaagattatatcagttttttcataggtcaggaacttgcatctttgaatcatttggaatacttcattgctccatcagtagatatacaagaacaggtttatcgtgtccaaaaactccaccatattctagaaatattagtcagttgcatgcctttcattaaatctcaacatgaactcctcttttctttaacacagatctgcataaagtattacaaacaaaatcctcttgatgagcaacacatttttcagctgccagtcagaccaactgctgtaaagaacttatatcaaagtgagaagccacagaaatggagagtggaaatatatagtggtcaaaagaagattaagacagtttggcaactgagtgacagctcacccatagaccatctgaattttcacaaacctgatttttcggaattaacactaaacggtagcctggaagaaaggatattctttactaacatggttacctgcagccaggtgcatttcaagtgaagtgtgctgatgaagtcctctataaggctggagtgcagtggtgtgatctcagctcactgcaaccttcacctcccaggagaatggcgtgaacccgggaggtggagcttgcagtgagccaagatcgcgctactgcactctagcctgngcgacagagcaaaactccgtctc

SEQ ID NO: 661356 - DNA, 1117 bp, Homo sapiens
ggtggcgctggcgaggtgcgaggcccacgactctgaccctgctccctgccttcagccaagggccccgtgcagcgtcggtcctacatactggcaactgtccgttgggtcttgaactcattatagtgccgatctatccatgcgtgacatgcataagttgtccgcggaagtgacaagaccaccgatgcaagccacgggctgagatgctctattgcaagagggaaggcataatgtgcaccagacatctgtcagttgctgggcccgctccgaggaaacacggcaaagagcgacgaagtcgattcgtgtgctatgtgccacgggccactgcatgtggcctctagtatgtcgaaagaatgccgatgttcggaacatcaatgctatcaaaaatgacagggggcagttgacgttgatgaggaactgcaattcaccaatgtttatggcgtcaaccgagagatacacgtcactacttgcgccaaatggccagaacataagatccatctagttctggattgacgaccaggactaggcatgagtcgaaggtagacccagtgaaagccattgtaggatgaacgcatggaatttcttactcgtaaagagcaatgcgcgttcgagccttgtctgtgtacatgggcttcgggataagaatcattctagaggcccatttgagtcccgctgtgccattctctcccgtggtgcacaaaagcttgaaccgaaaggccccgagaattccctctagccagggcttgattggcagtgttcattcggcacaagggcagcccgggtacccctgaacaggtggattgaacggcctctggaagggcccatccattttttcacggggaccaatgggcagtatcttgaagcgccggcgcgctggaaacaaccttgtaagtcccaccgcatcacaagggaagtcggactccatttagaccggtggggacacgtgcttcacacggccttgtccaaaaccccaacccacattggggtcaacgcgcacagggccgcccggtgtatgtcgacacttaacaaccacagaacctggcaaccggtgtgcggctgggggcaactccaccaagaactactggcccccccgtccgggtctaacatcccagtggtaggc

SEQ ID NO: 661357 - DNA, 2394 bp, Homo sapiens
tttttttaaaaacgagagtgttatttctttatttgtgggaaattacggtatctattttcttccaaacgtaataataattcttagaaaatagggactcctttttgcggaataatccatagggggcgaggccaactctcgggagtcgaggtatcttctccccaaccactgctcttattttaattattgcagacggaagttgaaaactattgacatagtaaatagctctgggtggcttgaaacgaaagtttaactttgcggacaaacaggacttattgtagggggtggtcaaaatagtcccggcggggcggggccatgacccctgacgtcgccggtccggcgcgcagttcagtttggcggttccggtaccgctctcacattggggcgggatgtgggagcggctgaactgcgcagcagaggacttttattctcgtctccttcagtgtcctgcagagataaagtgatgactgactcctgagtgtgaataacgggagagataatgtagttctgtttttcacatgtggttctgcgtttcaggaaatttaatgaagaaaagaaaggaatccgtaaagacccatttctctatgaggctgatgtccaagtgcagttgatcagcaaaggccaaccaaaccctttgaaaaatattctaaatgaaaatgacatagtattcatagtggaaaaagtgcctttagaaaaggaagaaacaagtcatattgaagaacttcaatctgaagaaactgccatatctgatttctctactggcgaaaatgttggaccacttgctttaccagttgggaaggcaaggcagttaattggactttacaccatggctcacaatcctaatatgacccatttgaagattaatctgccagttactgcccttcctcccctttgggtaagatgtgacagttcagatcctgaaggtacttgttggctaggagctgagcttatcacaacaaacaacagcattacaggaattgtcttatatgtggtcagttgtaaagctgataaaaattattctgtaaatcttgaaaacctaaaaaatttacacaagaaaagacatcacttgtctactgtaacatccaaaggctttgcccagtatgagctctttaagtcctctgccttggatgatacaatcacagcatcacaaactgcgatcgctttggatatttcctggagtcctgtggatgagattcttcaaatccctccactctcttcaactgcaactctgaatattaaagtggaatcaggagagcccagaggtcctttgaatcatctctacagagaactgaaatttcttcttgttttggctgatggtttgaggactggtgtcactgaatggctcgagcccctggaagcaaaatctgctgttgaacttgttcaggaatttctgaatgacttaaataagctggatggatttggtgattctacaaaaaaagacactgaggttgagaccttgaagcatgacactgctgcagtcgatcgttccgtcaagcgtcttttcaaagttcggagtgatcttgattttgctgagcaactgtggtgcaaaatgagcagtagtgtgatttcataccaagacttggtgaagtgtttcacattgatcatccagagtctacaacgtggtgatatacagccatggctccatagtggaagtaacagtttactaagtaagctcattcatcagtcttatcatggaaccatggacacagtttctctcagtgggactattccagttcaaatgcttttggaaattggtttggacaaactaaagaaagattatatcagttttttcataggtcaggaacttgcatctttgaatcatttggaatacttcattgctccatcagtagatatacaagaacaggtttatcgtgtccaaaaactccaccatattctagaaatattagtcagttgcatgcctttcattaaatctcaacatgaactcctcttttctttaacacagatctgcataaagtattacaaacaaaatcctcttgatgagcaacacatttttcagctgccagtcagaccaactgctgtaaagaacttatatcaaagtgagaagccacagaaatggagagtggaaatatatagtggtcaaaagaagattaagacagtttggcaactgagtgacagctcacccatagaccatctgaattttcacaaacctgatttttcggaattaacactaaacggtagcctggaagaaaggatattctttactaacatggttacctgcagccaggtgcatttcaagtgaagtgtgctgatgaagtcctctataaggctggagtgcagtggtgtgatctcagctcactgcaaccttcacctcccaggttcaagcgattctcctgcctcagcctcccaagtaaatgggattacagcacaagccaaaaa

SEQ ID NO: 661358 - DNA, 468 bp, Homo sapiens
  misc_feature (14)..(14): n is a, c, g, or t
  misc_feature (40)..(40): n is a, c, g, or t
  misc_feature (49)..(49): n is a, c, g, or t
  misc_feature (67)..(67): n is a, c, g, or t
  misc_feature (106)..(106): n is a, c, g, or t
  misc_feature (169)..(169): n is a, c, g, or t
  misc_feature (171)..(171): n is a, c, g, or t
  misc_feature (193)..(193): n is a, c, g, or t
  misc_feature (272)..(272): n is a, c, g, or t
  misc_feature (312)..(312): n is a, c, g, or t
aatgaatctccccnggtaaatggctgctgtggctgccccnatccccaantgttgcaaccaacccaanagctccctaagtggcctcaatgggtgccctcacttgccnaaactggggcctgcccataaataactggccccaggtaccaatgccccaggttggaccccctgntnctggctgtgcacccccctggancctgccctcccttgggacccagggggagactcctggcctcagccagtgcctccccggcccatctgggtggggtgcccanaaaccctgtgcccccagtttctgctttctggctctgcttnccagggatctaacctggggggtctcagcaattctgtggcagcacatagacagcgatgaacctacccgcccacagcccattttgaggaagaggtgatggcggcaggcaatgcaagagctcagtttattaaatgtgtgcgagtcggacaaaaaaaaaa

SEQ ID NO: 661359 - DNA, 1474 bp, Homo sapiens
tttttttaaaaacgagagtgttatttctttatttgtgggaaattacggtatctattttcttccaaacgtaataataattcttagaaaatagggactcctttttgcggaataatccatagggggcgaggccaactctcgggagtcgaggtatcttctccccaaccactgctcttattttaattattgcagacggaagttgaaaactattgacatagtaaatagctctgggtggcttgaaacgaaagtttaactttgcggacaaacaggacttattgtagggggtggtcaaaatagtcccggcggggcggggccatgacccctgacgtcgccggtccggcgcgcagttcagtttggcggttccggtaccgctctcacattggggcgggatgtgggagcggctgaactgcgcagcagaggacttttattctcgtctccttcagtgtcctgcagagataaagtgatgactgactcctgagtgtgaataacgggagagataatgtagttctgtttttcacatgtggttctgcgtttcaggaaatttaatgaagaaaagaaaggaatccgtaaagacccatttctctatgaggctgatgtccaagtgcagttgatcagcaaaggccaaccaaaccctttgaaaaatattctaaatgaaaatgacatagtattcatagtggaaaaagtgcctttagaaaaggaagaaacaagtcatattgaagaacttcaatctgaagaaactgccatatctgatttctctactggcgaaaatgttggaccacttgctttaccagttgggaaggcaaggcagttaattggactttacaccatggctcacaatcctaatatgacccatttgaagattaatctgccagttactgcccttcctcccctttgggtaagatgtgacagttcagatcctgaaggtacttgttggctaggagctgagcttatcacaacaaacaacagcattacaggaattgtcttatatgtggtcagttgtaaagctgataaaaattattctgtaaatcttgaaaacctaaaaaatttacacaagaaaagacatcacttgtctactgtaacatccaaaggctttgcccagtatgagctctttaagtcctctgccttggatgatacaatcacagcatcacaaactgcgatcgctttggatatttcctggagtcctgtggatgagattcttcaaatccctccactctcttcaaactggcaaatccggaatatttaaaggtgggaatcaagggagaagcccaaagggtccttggaactcaccttcttaacgaggaaaccggacatatctttcctgggtatggcgagcagggattcacgcacgtgggcgtcccttcagagtgtgtctagactccgtgtgatgccaactgtcgcttgtaacagtgtacgaaaacggaaaggacgaaaaaccggacggatgcgaggcctccaacacaacacggtgaacataaca

SEQ ID NO: 661360 - DNA, 171 bp, Homo sapiens
cggcgatccgtccttcgatgagagcctcgcgaggcatggctgcaatctcccaggtctgtcagatcgggtttccatagccgtggtcgtcatccaaccataaatggctgtagtggtctacttgtatacgggtttagggtttgatgaccgggtttgatgacgggtaccgagctc

SEQ ID NO: 661361 - DNA, 149 bp, Homo sapiens
  misc_feature (9)..(9): n is a, c, g, or t
  misc_feature (115)..(115): n is a, c, g, or t
tatagtggncccgcggtatgtttacgaatagatcattgcccctacggcgatctcagcagtccgcaggtgcgcaactgagcgaggtgtcgggacacttttggttggtgatcgtcgngcgcccagatcaattcgcagacacatagctcgcc

SEQ ID NO: 661362 - DNA, 166 bp, Homo sapiens
cctgggctcaaaatctcaggtgtaggcagagccctgtaacttcaggaggctctaggggagaatccatttccttgcctatttcagcttctagagtccatctgccctcctcagcttgtgaaccttccttcatcaaagccagcactcctgccaaaacgggtaccgagct

SEQ ID NO: 661363 - DNA, 126 bp, Homo sapiens
ggaagcccgcgcacacgggctggtagttaaagatcgaccctgacctactcggttatgttatctatagattacagacattacgtatagaaaagcactgtgaaaatccctgtcctcttttgagttctc

SEQ ID NO: 661364 - DNA, 295 bp, Homo sapiens
ctttgtatgagcctggattaaaaatggcgtcctcctctcagtcccagtttcttcccttctcagcatctcaaagccttccccaagttagctccagggcttgggagaaagtgtttcccttcaacaggccctggtgtgtgatgttccctaccctgtgtttgggggcgaggggagggaacttagaggatgcgtcaataggtgcagcaaaccaccatggcacatgtatacctatgtaataagcctgcacgttctacacatgtatcctagaacttaaagtaaaatttaaaaaattaaaaat

SEQ ID NO: 661365 - DNA, 139 bp, Homo sapiens
acccactcgatacagcgaccaaaatccagcaaacagaacaacatcattttcctcaataaagttcacgcaaccgtcattgggtacaaaggctgtgatttacttgccattcttggtatgaacaacagtggggtaccgagct

SEQ ID NO: 661366 - DNA, 138 bp, Homo sapiens
aaaaattttgggggggggggggggaaatttaaccccaaacccccccgggggttcccccccccccctttttcccccccccgggtttggttgggggggttttccccccccccccccccttttaaattttttgggtcccca

SEQ ID NO: 661367 - DNA, 173 bp, Homo sapiens
tctcgtaccgcacgctagggcatcagccaggagcagatcaggagtccgggcgtcttcaaccacttcgacaaggatcatggggggcgctggggccgagagttcaaggctgcctcattagctgggctagaagtggaagaagaaccggcagggtgagggcgagttcaaccgcatca

SEQ ID NO: 661368 - DNA, 127 bp, Homo sapiens
  misc_feature (98)..(98): n is a, c, g, or t
gaagatccccaaccatcaaggtgataaatgagtttctgggggagggaggcatcggccgggcccctactttgcaggaccacacacctctgtcgcccttncaccttcttcgcagaacaatgtgtcacag

SEQ ID NO: 661369 - DNA, 889 bp, Homo sapiens
ggggaaaatggcggacgggaaggcggcaggacggatgaagcctgaaaagtcgcagcgagctggatgccgtcggagtatctgatgaagaagcagaaaaatctgtgaaataatatagacggtttatcttccagtgaaatggaggggtaatagttccagtcgcagcgcatgagaagcgatcagcgtgaagaagaagctggctgagactcctcgaacatgagcctacataggatctccaagtcggatttggcattaggtagtcagactgacgagagaaagcgatcagccatatccatcaacacttgtactccaagtcatgcctaaagaaactgttccaactgttgctccaaatactctttcatgtagcagtagcttgcaagtgaaggatgaagatggataccagcagcatcagttgggaccaaatttccttcaggtaatcggagacgcatgggttttctgaataaagcagtaaggtgtgggagcgaagtgtaaaagtctgcatctggagctgtgcgatgatcaagacaattaattgatgtttgaaataggggtgtgcgtgtgggtgtacagtgacagggatcagcttgcttttataacaggaatgctatcagacctatcttggagccgcttgtggtaactactggcagtatggaggacgattgagtggtacactaataaagtgagaggtggattagaggtactcatgttttatatacagatacaggcattgctattggtgttcagtgatagttcaaggtccggatgtagaaacccatggactttggaatggttttgaacatgtttggctaagggactattgtttaagggagaatttaactatctagtgtgtgcgagctaaagagtttgaagaacggagaactactcggggtga

SEQ ID NO: 661370 - DNA, 364 bp, Homo sapiens
tctgagagtacctgtcttcagagctgacttattctgattagggctcatcttatcaacacattaaattaccctaaaatcttgggactgatcttttattaatactcttaggtcgggggaaacatttccttggagggattctcttccaaggctgcccctcctttgcttcctccacagagacctggtacctgacacgaaagagatggacagagtaccagggagcagcagttcccagctcctgtcagactctctctgtccctaaagttgtcacagctattttcacattgtccacctggacagccaaccaagcattccctaccctcctggcttcagtctggaagatccccagacacaatggcacgtggat

SEQ ID NO: 661371 - DNA, 258 bp, Homo sapiens
  misc_feature (33)..(33): n is a, c, g, or t
atttttaagggggccaaaacccctttaaaaaantttttttaaagggcccttttgcccttttttgggccaatgggccccaaaatttttttttgtttgcccaaaaaaaaataaggttttaaaggaaagagcccccttgcctttgtgggtgttttttttcccccggtttaaccagggccgggggccaaaaaggatttttttgaaaccctttttccctttcttttggcccaaaaaattctttgggtttccttttcccgggga

SEQ ID NO: 661372 - DNA, 389 bp, Homo sapiens
  misc_feature (11)..(11): n is a, c, g, or t
  misc_feature (69)..(69): n is a, c, g, or t
  misc_feature (243)..(243): n is a, c, g, or t
  misc_feature (251)..(251): n is a, c, g, or t
  misc_feature (268)..(268): n is a, c, g, or t
cccccttgtanattggcaaagtgctgtgtgttgtttggtgttactaattttcttcttattgctattatngtaaaaaaaaaaaaaaaaaaaaaaaaggaagtccttgtgtctgtcctcagaatacctcacagtctaatcaggagaccaacaaaattacaaaagcacactcagagcagtgatgggtatgaagagctcaggacagaagcaggacttccctgggctgtagagcccacgaggccgtanttctcttntgcctgtggctctacanccccaggccagcaagagaagctacggggagggctcacatagagggagagacaggggtgtccttccccacttcccagggttgagacaagcataagcaaatatttaaatactgtattttttta

SEQ ID NO: 661373 - DNA, 580 bp, Homo sapiens
  misc_feature (35)..(36): n is a, c, g, or t
  misc_feature (41)..(41): n is a, c, g, or t
  misc_feature (49)..(49): n is a, c, g, or t
  misc_feature (52)..(52): n is a, c, g, or t
  misc_feature (55)..(55): n is a, c, g, or t
  misc_feature (158)..(158): n is a, c, g, or t
  misc_feature (202)..(202): n is a, c, g, or t
  misc_feature (362)..(362): n is a, c, g, or t
  misc_feature (376)..(376): n is a, c, g, or t
  misc_feature (405)..(405): n is a, c, g, or t
  misc_feature (419)..(419): n is a, c, g, or t
  misc_feature (438)..(438): n is a, c, g, or t
  misc_feature (457)..(457): n is a, c, g, or t
  misc_feature (466)..(466): n is a, c, g, or t
  misc_feature (471)..(471): n is a, c, g, or t
  misc_feature (482)..(482): n is a, c, g, or t
  misc_feature (488)..(488): n is a, c, g, or t
  misc_feature (527)..(527): n is a, c, g, or t
  misc_feature (529)..(529): n is a, c, g, or t
  misc_feature (532)..(532): n is a, c, g, or t
  misc_feature (534)..(534): n is a, c, g, or t
  misc_feature (536)..(536): n is a, c, g, or t
  misc_feature (540)..(540): n is a, c, g, or t
  misc_feature (552)..(552): n is a, c, g, or t
aggataaagagataggcaaccaggccccctgcacnngggcnccgcagtnccnctnccggacacaccggttcatacagttccctgcccatgaccttcgctcagggatcccctttgaagggttagggtcccagttcccagtggaaaaaacaggccagganaagtgcgtgccaagcttaggcagatgtttccccagtgaccccanagccctggggtatagtttttgccccctccaaggaaagacccccttttggggacatggggtggagggcaggacctaaaggccccaaaggaaggcccccttccggggctgtttccccaggaggaaaggaaggggctttgtgtgccccccaggaggaaaaggnccttagttctgggntcaaacccccctttccgtgtatccccccncaaatgcaagctcnccaaggtcccctttcagtnccctttcctacaccctggncgggccctnccgcncacccccccanagcacncccccccccatgggagtgtgctcaggagttgcgggcagngnggncntntgtncccaagggggcngaatttcccataaagggcttagccctta

SEQ ID NO: 661374 - DNA, 249 bp, Homo sapiens
tggggatcaaatgacagcgttaggcctccccgagtggtcccatccagagcggctgcttggttcgggttcctcgtgtctcgctcactggcttcaataatctggagaatcttgttttggcaagaattcctagcaaagatcttccctgagatttctcctgtgcctcctgttggctctctttgcatctggcctcatccaccgagtctgtgtcaccaactgcttcatcttctccatagttggtctgtaatacat

SEQ ID NO: 661375 - DNA, 1538 bp, Homo sapiens
gaaagaccttgaaaatttagggctcacccacctcattggatctcctttcctccggcgcatatatgcatggcgtttttcactggatataagactctatcacaaggtgaaactgatggctaaatccactttgctctatgaagcaactaggaaacgcactacaaactacgcacagcacacacatagcaagcacaaccacgctgcaccacgcacgagctccacgttacaccacgcacaactctgcccaaacagctctaaccacacacgagacctgcgccacctctaccactccaactctgcagcgacagcacagcaagcgcagcaacgccacgcacaactcctaccactgcagacaaacacacgcaacacgctctacacgcaagctcctttcccctaacctactctcctcaacccgcacctgcactccgcactctctacacaccgcttcacctgctctctcgaacgcaaacccccctgcacccctctccccacacgcttaaccacctgcaacacgcacgcacgcctcgcacacgcaaattttctcacgcgccctctcccttgcacaactcccccacccctctgcctttattccacacaaaccacattctacccctgcacccacacaacacgcgcaacacgcacacgcaacacaccccttacacggaacccttcctactacagacacggccacacgccacaacggcaaacccctttccgcgctgccacacacacacgcaaacgcaagcggcaccgcgcacaaggaacgccccgcgccacagcgggcaacaccagtacccccaaacgcctggaaagttgccacggacacacaacgcctctccggcggaacgccaaggcctacacccaacagaacctcggaaccgcgcacaccacacaacggcccccttgggagacgcctctcagacaactcggcacaggcggctcccaaaccagcaatcacagcccagagaccccggccagacgcaacctataccgcacttccaccaaaggcccacacgcaggaggacacggcgccacaccaaccaacaccggccttggaactcacggccccggagcgcctacggcacgagacaaaccccgcggcaaaccccttccccaacaccggcgtcaacggacagcaaaccacctcaagcgcacgccaggcgccaaatcccagcgcgcgttccgcccatctaacaaagacgcggccgccgcaccgcaacgacccgccccttctactatgctgagcacacacggcaacgtcgcagcacaccacaccgacccgaacgacggcacacgcgacaacacggcgaaccagactctcttccgcagcgccagacaaccgcccattctaccacaagcacacacggacacccttctaccgttggcgcctccctacgccagcgacactcacggtacacacgcgcaaccacacaccctacgaacacttggcaagagtcccctagctgcagacgcccccccatttgtgcaacacgcgcaatctccgggcccttccggacaaccacccacctttggacaacgcc

SEQ ID NO: 661376 - DNA, 120 bp, Homo sapiens
  misc_feature (91)..(91): n is a, c, g, or t
taaaacgccttcaggaggctctggagcggcagaaggagttcgatgccaagcaataacaagatgcaacgtctgtcggctcccaagacagaangaatgcaaaattgacatcttaagtctggg

SEQ ID NO: 661377 - DNA, 210 bp, Homo sapiens
gcgagagacacaagcaagagcagggaaaactgccttataaatccgtcagacctcgtgagaacccactatcacgaaaacaacatgggggaaactgcccccgtgagccaatcacctcccaactgggtattacaattcgagatgagatttgggtgggggcacagagcctaaccatatcaccacctctcttttgaggacccaggcccccatcag

SEQ ID NO: 661378 - DNA, 302 bp, Homo sapiens
tctcccctgggttgctgcgtcccagctcaatctcagaagagagtgaggacccgacagagcacagggatctggctggccccactgacctgtgacctcaggagagcaggccaataaatcgctgctggggcagtaaagcaggcgtgtcacctcactgcttcaggtcccttcccctgagtaggcccagacctcccagggtatctttcccttggggtcagtgggctgctggctctcagggaattcggagcatgatctcaggtgtttggtcatcccggggagaccagccgaggttaagaagcaaggct

SEQ ID NO: 661379 - DNA, 942 bp, Homo sapiens
cgctctatagtataatttataaatataaatattccctctatctaacttccaagacatcaactatccgtacccctcccgtattgactttccaaaattactcggcgcgaaaaatgttttcttgggtgtccgcccatgtttattggtccccccctccttacgcttctcctgtctcccccctcctggttctccccctttgccctttaaatttcttcgcgcaacccacaaatcaatttgccgtttccacgacaacctttaccgccctccacgcactgtccaagacctctataacgtgtttgcctttttgtagtgcttccagagggttcttttccccccgggaatttccggccgttgtccacttgcgggcggtcgccctttcccccccgattatggggggctctggtcccctaaacgcctcatcccgcgtaatatcgcctgtgtgttccccacgtcgcggctataacacccgcgttttatctggcgctcaggggtttttctaacccccgggccggctccccaatttgtgtgtattagcccttcacgccgtggcacctcattaattctgcgcacggcggtatctcacccagcattgaacgggcgttcttgatgtcacccctacgcagcctcccggattcgtggcctttcccgctcaccctgtttctgtcgggcgactttcgggatccaccaatttcgtgtcacacacgggctactccacgggttataccggtctatgttttggtcgcgcacaacgttacctgcccctagtattgtggttctgttcccccgacgtgataaatgttgctccatcaccacacggcgcccagcaaccggcaaggttcgggttttgaaggcctcgccgccgcggatcccttggcaatggttttcaataaatggtttaaatatttgatagtcacccaatttttgggaaggtccttacacaaaaca

SEQ ID NO: 661380 - DNA, 414 bp, Homo sapiens
  misc_feature (42)..(42): n is a, c, g, or t
  misc_feature (68)..(68): n is a, c, g, or t
  misc_feature (76)..(76): n is a, c, g, or t
  misc_feature (80)..(80): n is a, c, g, or t
  misc_feature (90)..(90): n is a, c, g, or t
  misc_feature (94)..(94): n is a, c, g, or t
  misc_feature (104)..(104): n is a, c, g, or t
  misc_feature (109)..(109): n is a, c, g, or t
  misc_feature (117)..(118): n is a, c, g, or t
  misc_feature (149)..(149): n is a, c, g, or t
  misc_feature (154)..(154): n is a, c, g, or t
  misc_feature (160)..(160): n is a, c, g, or t
  misc_feature (163)..(164): n is a, c, g, or t
  misc_feature (169)..(169): n is a, c, g, or t
  misc_feature (185)..(185): n is a, c, g, or t
  misc_feature (204)..(204): n is a, c, g, or t
  misc_feature (222)..(222): n is a, c, g, or t
  misc_feature (229)..(230): n is a, c, g, or t
  misc_feature (237)..(237): n is a, c, g, or t
  misc_feature (247)..(247): n is a, c, g, or t
  misc_feature (310)..(310): n is a, c, g, or t
  misc_feature (372)..(372): n is a, c, g, or t
  misc_feature (399)..(399): n is a, c, g, or t
caaagcataggtaaatatttttctttattaagcttctcactnagaagccctctttattttggtaaatntcactctntttnttaggagatntctncttttccatnaaatnaaatattnnctaaagccctgaaagaggcaagactacaatnggctnaaacanttnntatancaaccccagataagtncttcattttctttttatantagaagcaggtccatttnttttttnntttcctncacatctttngagtagttattacttctcagtttttccccccttaaactgcattgcctattcttttttcctganatgctatcaggtatcagtgtgttgaatacatactgcttgtgtatcagacttacgttactgtnatcaccattaaaagaattgcagccttnttccccatgaccttc

SEQ ID NO: 661381 - DNA, 123 bp, Homo sapiens
cagtggtgcatgatagagagcaggccttctactgaaggagtgactcaggaaggaggaggggaaggtgacaatgcccctgtggcaggagcccggtggccatgggatcattttaaacttgagacc

SEQ ID NO: 661382 - DNA, 137 bp, Homo sapiens
cttctgggtcgatctaaggatcccgtctcctgctggggttatttgtgttggctgaggaagaagaggaggcgccgcttactgatgctccgcttactgatgctcccttactgaacgcttactgatgctccgcttactga

SEQ ID NO: 661383 - DNA, 866 bp, Homo sapiens
tataatactagcattgaccatctcacttctaggaatactagtatatcgctcacacctcatatcctccctactatgcctagaaggaataatactatcgctgttcatatagctactctcataagcctcaacatccactccctcttagccaatatgtgcctatgccatactagtctttgccgcctgcgaagcagcggtgggcctagccctactagtctcaatctccaagcacatatggctagactacgtacataactaaacctactccaatgctaaaactaatcgtcccaacaaattatattaacttaccatgaatgatttccaaaaaaacatagtgtggaagtcaacacaacacccacaggcctaattataagcatcatccctctgcttattgtgtgtaaccaaatcaacaacaacctataaggtgttcccaaccttttcctccgacccaataaaaggccacctctaataataactacatgagtctaacccctcagaaggcatgggagcaaagtgccacgttatccagtgaccacgtatacacgaaaagaactctagccttcgtttataaagtctcctacgaagtctccttagtataacatcacaggcacagaacaagtcagataaagatgatctgggagcaaattatcccacccggatatcatcaccgggaggaacagccgaagcggaagaggcaaaagtcgatgaaaccaaaggcctacatacaggagagtaatcaaacaggcgaactcacacaggacgcaaataacggcacaaatgagcaagaacagagacagacatacaagggcacggaaggaacaggagagaccacgaaccggccggaacgcccccacccccccccgggggag

SEQ ID NO: 661384 - DNA, 112 bp, Homo sapiens
tgtgatctagaggatcctagcaggtacatttcctgggatggtgttaggaggggaattaaagctaagtccaatggctctttaataccagaatgggctctgacacaagagccct

SEQ ID NO: 661385 - DNA, 927 bp, Homo sapiens
gctcagagggcagcgaggaggtttcacgccgtgtgcggtggcggccgtctgaggtgggggcaccgcggaaggtggaggcggggccgcgcacggaaggccccgagtcgagcgcacacgaggggcgcccctgagcaagtgaggagtcctccggccccgaggcctgaattcagcccgggtgaccgggcccaccagcgccgggtgtccctcgggaggggtccccggttggttccctgaagcagaggtcctgcgggttcccgggagggtgtcctggtctctccccggcctcggattccatttctcggcccttggtggcgtcgggctgctcgtgtggtcgggggggcagagggcgccgtcatagtggcgagacgggggactctcaggcccgctttggaaggtcctggggatctctgggcgcggatctggggcaggcggggttcccgcgagaagcctcaggagcttccgggggccgcaggggtcctgggggcccccaggggcggggaaggcggcaaaacgcgaaaagggggatagccccagaggcccttggccgcgcaagaagggggtttcccttggaggggaccatccgccggcattggttccccttgggaaggttcatgggggcggaagggggcgctcggggcctcccaacgggggcgtggcgcgcagcgttgggggggcattcaccagggggaaagacgcttttgtgccctaccgtgtgggcgagccgttggttgccggtgaggaacccggggttattaaggagccagcgacggcttgtggtagaaacccccaaggggggcctggcacgtttccagggcccccaaaggtttctgtgtttcaccaagcccgataagcgcgccaggggggcttaaggttttgcaggcgcagtctggggacacacatggggggcccacacacactttttcgcaa

SEQ ID NO: 661386 - DNA, 220 bp, Homo sapiens
tgttcctcatagaggccacggacgtgactgtggtgtggtgggggggtcttaaaataactttttagcccccgtcttcctatttttgagtttggttcagactcttaagcagctccatgcaactgctattatatttattgactgacaacgactcccattctaaatgtttttctctctgcctagatcactttcatctccgtgcgccgtctactcacacttgggt

SEQ ID NO: 661387 - DNA, 387 bp, Homo sapiens
aacgaatgtcatggctcacctggtaaggactcagccaccggacaccagctcgaaacgcccattgccctcgtatgtggttttattgccaacagcagtggctgcgctcgatagccaggtgtctacttgcacctgcgccgaaaaagcgtggcctctggcaggagctccgccgaccagcactaccagagattggcctgggcgtagctgggcgtcccgttcggtagggttgtgccattgcgctaactcgatgggtttaccgtcgagttgaggatgctgaagcgtcaggttgaaaaagccctggcggccaaacctgtagccagtctcattggccggcacgccttgaaaacgtagcgcaatcaccgcagcctccacgcagatcacgttcagacg

SEQ ID NO: 661388 - DNA, 121 bp, Homo sapiens
  misc_feature (102)..(102): n is a, c, g, or t
gcttagaggatccctgcatgtgtaggacatttacagtcaatccagtgggtaaccaggggattctgtctgcatcatgcaggggttactagtgtgggactactngacctgactggtcccctcg

SEQ ID NO: 661389 - DNA, 489 bp, Homo sapiens
atcccccgggctgcagggaattcggcacgaggcgagtattacacagcgcttttttctttttttgggtgtggacctcactcgcgggccaaaaccgggagagtgcaaatcttggtcataccattttacatttttaccaactcacaatactgttgggcaaaaatcttctataaactattggcaaaaaaatcctccaatttacattcttttgggtccttttttcccacagatatagatttacttccgggttccgagagaaagacttattgggggtgcctgagcaagactgtctttaagattcacttggtggtctcatccaataaactcctgggttttcacataaagcgcgcctctttattgtgaatttttttcatggaactgggttcaatttcagaaaaatattaacggggtgatttccaacgtcaacactgatccttttttttaaaaaaccctccaatcaaagcccagaacccccgcaaagatcggtccttc

SEQ ID NO: 661390 - DNA, 102 bp, Homo sapiens
gcggcgcctactactactactgctcgaattcaagcttctaacgatgtacggggacatgttacctccttcagttgataataaacctttctgagatgcaaaaaa

SEQ ID NO: 661391 - DNA, 727 bp, Homo sapiens
gtactcaacttcctttcatattagcatcatcaaccccataaggtgaattagagggttgatgatgctagtatgaaaggaagttgagtaccgtgtatggatccgctaattaccatcatcaaccctctaattcacctgtatgggggaaagtgcttctattatggtgttgtagcatagctattattgatcatcttccttcatatctctttctcttgataaaaactgtattgtagatactcgtgcatgatgctttccaccgcaacagagtatctctttcaattagttctctatgttataagtagcagctgttcattatgcgaatatattctgctgcacagtcacaatctaaatgtacattttggcaaaagattgggtacttagttgcctgttactgagttagctactactcttttggaccaaagcaacgatgagagcaagtacttttcacacttgttaagatggagttataactgtcataccattcgggatattatgatcccaagtagtctattttatagacttggacttgtatcggtatgttggactcgttgatacaactttgggccaaatttcttagcgagaagaaactttctcctgagtcactttaggcttctatcctactttagcaaactatggtaagaacctggatgttttctcacagtgactatgtgcaccaacgttacaagttgtcccaacaggtctgcataacggagccattttccattacaaa

SEQ ID NO: 661392 - DNA, 670 bp, Homo sapiens
ttgtacgtagaagctggtaaagctttggttacggtcctggttccctaccagtattactaaacatgtcgcagttgctccacaggcatgtggtttgacctttttttcaagcttctagagagggaacggaagcagaagtgggacatcgagggctctggtgtcctctgcgctgggtgtggaatgctgctgcgacctgtcccttctgctggctcaggcaagtgtcttctggccctaggcattatctgtggggaaagggttcttaagtcctctgatgcttccatcttcctggtttaggccatgtgcccagaaacctggactgatcttgtcttttagagtagtgaacccctgggccactgaagagtaacgatggctccactggtacaccgaaagagagggatggaatcaacaggcagggggcctttgataagccttaggacaggaaactgagaactatgtcatctttggagcttttcaatactattggagtgattatgtatctttcgtaaacagggaaaataagtgttacaaaagcatctttgtatgtcagtttgttggcatccctcccccagcaccctgggtggtgttagaagaatgacgcaaaaaaaatccatcaccctttcgttactagaaagactcgttaatgattcaaaaaaaccaagactaagaacattaa

SEQ ID NO: 661393 - DNA, 197 bp, Homo sapiens
cactttcctaagtgtccctctgttgctgttccctgttgtttacactgactgaatattcttcaggcaccttggttcccagtgtctcatcctctatctgattggaacagactagacatcacctctgtcccaaagcagagtattcctggcaatttctagctcactggcattctcatcaatctccttgtcaggggagaaga

SEQ ID NO: 661394 - DNA, 951 bp, Homo sapiens
ctccttaattataacatgcacagccacagaagtaatcatattggatatcgttcttcgaagcctacacttatcccgcaccgttgggtatcatcacccgatgaggcaatcaggcagaacgccgtgaacgcaggcacatacttcctattctacaccctaggtaggctccctttcccgctactcatcgtgctaagtttacacgtcacaagcaccgctaggcgtcgactaaacgattcgtacgtacatcaccctcagctggcccgaaggaactatcaagactcctgagccaacgaactgtaatgtagtgacgtagcgttgactacaaatagacttctatagtaaagataccttctttacggagtccacttatgagtccctaaagcccatgtcgaagcccccatcgctgggtcaagtagtactgtgccgcagtactcttgaaactaggcggctatggtatagatacgcctcagcacgtcattctcaatcccctgtacaaaacatagtagctctacccttcgcttgtactatcccgtatgaggcataattataacaagctccatctgcctacgaaaaacagactagaatcgcgtcattgcagtactcttcaatcaggcacatagccgtcgtagtaacagcattctcatcaagacccctgaagcttcactgggcagtcattctcataatcgccacggacttacattctcattactattctggcttagcaacgtcaactacgaaagcactcacagtcgcatcataatcctctctccacggacttccaactctaactcccaataatagcttttgatgacttctaggaaggctcgataaacttggcttaacccccattatttaactatggggagaaccccatgtgccacataaacccgctgttccgagtccaatatcactctcctaataacggactcactacatagtacaggctataatacc

SEQ ID NO: 661395 - DNA, 367 bp, Homo sapiens
tgtacacttcattcctggttttcagagatttctacaaccaagacctcaattctttttcagagaatattgctgcttatatgctatccatcttcagggatttactttccactagtgaccctgttcaacttgattcaataagggcaagaatattttcttcaggctgcattcaaactcaccttttttttctctgcagctgtaagaactcccagctccttggagacttttaagaacaaactgaaaatgctcttatttgtctaggcttagctgtcggctaatatgctaagagtgtattttatattgtattttcatcatagccctttgaaatgctttgcataaaagaccctttataactgtcaaaaaaaaaaaa

SEQ ID NO: 661396 - DNA, 173 bp, Homo sapiens
  misc_feature (19)..(19): n is a, c, g, or t
ctctagaggatcgcggcgnaattaatttttggagtttatttaatatcgggagcagattgtgtaataaatgtatattgagaataagacggcttttgaccttttagggtctagggctgtaaagcgtctcagggttgcttgcgaacgagccattgcactccgggcgggtaccgagc

SEQ ID NO: 661397 - DNA, 210 bp, Homo sapiens
aggttgactggggccccctttggtaagggctgggaaaatgaaccaagttgggagcaaagcaggttttgagccccccttaataaggaacacatggtttacttcctatttcctgggacacaggtcatttccagcttccaaaattagaaaaattttttaaaaaaatccccccccccttcattgtaaaaaaaaaaatttggccttttttttcca

SEQ ID NO: 661398 - DNA, 801 bp, Homo sapiens
tctggagtccagatgggctcaggaagccccacggaatccagactgaccaaggctaaacattcctgaaatggaacccactcaaagatgtgtaaaaatggcggaattgtgttcccagtctgagaacttgtgaagtaaggcacctctcaaggaagctagatcacgatctgaccactttgagtttgccgaactcttagatgccagaagtccaactgggaaaggggaaagaagcaaaccaccttattgaccccactgacacgagaacactgggtcattgcccttagactactagaaggcagctcacccaagtccgttacccaaagagttccaacagcctatcaatcggatataattgaccactccataggtttcttatagagaaactaccctatagaattagacggccccggaaaatactgctcacatgctcacttacccattacaagacaatgccaaccaccacttatcactgtgtcaccccactatgacagacccaagatgataaaacgtcggctaaccacgtgttggcacacggcaccggggaaataaggtctccacaacccccacctggttagagcacgaacggggcaccacgcctctttcacggagaactggccatagctatggaagcttaaagccaagcctttgagcccgctgctccctttctagaaattgatcgccaccaacaccccggtgtaggtagaagcgatgttcattcccagaaaatttaggatagagtgccaatggagaactgggtaaattcaaatcatgttcatcccttccatgaatactgtgtagttgcta

SEQ ID NO: 661399 - DNA, 193 bp, Homo sapiens
  misc_feature (1)..(1): n is a, c, g, or t
  misc_feature (43)..(44): n is a, c, g, or t
ntctatttatgtactgcaaaggttgcttgaaagtatgaaacgnnctgctcacagaactaaatatgaacagctttattaaggagatggctcatcccaggataaagacagcaacagatgatatagagaagattacaccaaacaaatctgctgtaaactgcatttacccttaggagatgataaactaaagatgaag

SEQ ID NO: 661400 - DNA, 757 bp, Homo sapiens
cacaaaggaaattagaaaatattcataactaaatgaaaatgaaaacacaatatatcaaaattgtgagatactagaaaatatttgtgggccgggcgcggtggctcatgcctgtaatcccagcacttgggaggccgaggtgggcggatcacgaggtcaggagattgagaccatcctggctaacatggtgaaaccccatctctactaaatatacaaaaaattagccgggcgtggtggcaggtgcctgtggtcccagctactcgggaggctgaggcgggagaatggtgtgaacctgggaggcggaacttgcagtgagccaagatcgcgccactgcactccagcctgggtgacaaaagcaagactccgtctcaaaagaaaaacaaaagaaccatatctgtaattaaatgaacatgaaaacacagtatatcaaaattgtgggatacagtaatacagtgctttagaaggaaacttcagcctttaaaagaaaggtctaaaatcagtgacctaacattctgcttaatagaaagagaacatctaaatagaagagaaataatacagagctaaaagtagatgagatagaaaaaacgcgggtgaggtggtcactcctgtaactacccagcaaaatcgtggttgggcaaggtggagcggatggattgaagttaaggactcagagaccaacccggggcaaaatagccaaaacaacaaaaagtattaaaatagcaacataacggaagaaacaggacatggaacgacaacaaac

SEQ ID NO: 661401 - DNA, 457 bp, Homo sapiens
  misc_feature (27)..(27): n is a, c, g, or t
  misc_feature (149)..(149): n is a, c, g, or t
  misc_feature (360)..(360): n is a, c, g, or t
  misc_feature (362)..(362): n is a, c, g, or t
ttgttcccctaagttgtgggaagcaanaatccgtgggccgcaataacgggcggggcaaggccctgaaagtgcaagctaatgtttccaagtgtcctctgggtgtttcccaagagcaaacaggaaacgaataaatctctgatgggagtctnactctgtcaccccaggctggagtgcagtggcacgatctccgctcactgcaagctccacctccccaggttcacaccatcctcctgcctcagcctcccgagttgcagggactacagcacccgccacaatgcccggctatttttttgtgtttttagtagagatggggtttcactatgttagccaggatggtcttgatctcctgacctcattacncngccgactccggctcccaaagtgctggaattacaaggcgtgagacaccgcgcctggctccatcaaatgactttttaaataaaaatacggtctcacc

SEQ ID NO: 661402 - DNA, 272 bp, Homo sapiens
aacaaatagctagtctagtaaaatttacctgttctaaagatgaggccaggcacggtggctcatgcccgtatcccagcactttgagagcgtaaggtgggaggatcgcttgagcccaggaggtggaggctgcagtgagccgcgattgcaccactgcactccagcctgacgtacagagcaagactctgtctcataaaaactagttttcttttaattattttttttgggtactatacttttaaaaggtcccgtaaaaaagcatggggtaccgagct

SEQ ID NO: 661403 - DNA, 544 bp, Homo sapiens
gaggaccccagactcgagttatgtaggtctatacgtgcttttagagtctaaagaaagtcctgaacgaatatcaattaagcttacactcacaaaaacttaaaatgtataacaggagtgaataagtacatagataaactcggaatatgttcctgcagggcaacaggtccacatgcacacatctaacactggacagcataaagttaagggagagaacttaagaagggcccttaacatatatataacacataaaatatgacatcgaagaaacaaggtaccacctcatatttaaccttaaggatcctacttcggactatccaaacggatataaaaatatgcatgcctgacgggtgaaaagcctgggaaataatctggggacatagtttctctacaaaagggcaaagtaaattaaaattaacactcatccctcagcggtataaatatgctcataaaagcaaccttctagtaaaaggcagccaagatccttaaaaggagtctatcgggaccatttcgggggcaaggagacccagggcttccagaaacagta

SEQ ID NO: 661404 - DNA, 453 bp, Homo sapiens
aagacaaattatagattagaaaaagaagaacactcagcagcaagaaagccagccaccatgaggctaatacaggaaagtactcggtgaatggtgtgtctgtcactcagcacagtcattgacaacacttaaccattaattgcaagaaaacagcagttttatgcgagctttttttggcctgtctgctcagttaaatctttgtgaccacttctaatttttttctttgtgcagaggctgctttcctcttttcttctttagtccctcaaagtcatttaaacgtatatagatccttcttgacttacagtggggttaggtccagagagacacattgtaagtaaaaaaatctgaagtcaaaaatgcatgatattttcaaattataatgtttatctagagatagccccatcataagtcaaggagtgtagtgaatacatatcaattttgctccattgtaaagtc

SEQ ID NO: 661405 - DNA, 105 bp, Homo sapiens
gaactcctcacacccaattaggaccatctatcacctatagagactaatgttagattagtacatgaaacatcttctccgataagctcgtcagttaagcatgactga

SEQ ID NO: 661406 - DNA, 357 bp, Homo sapiens
tggaagaattaaataattcagctgggcatggtgggtcacgcctgtaatcccaacactttgggaggctgaggcaggaggatcacttgagcccaggattttgagattaataatattatttattactattattcaagctttgttaaatcaaacctaaagctcttggaactttaagttattctgagccttgacaggaattggtctctgcagcctgagtcatggggcatgcagctgcaacttccacctattttttttttttctgtaattacttagggaagacccaaatgggcaccaggaggataagacttcccttaggatcccccactttaggatccacccacccctttttcttcagggggg

SEQ ID NO: 661407 - DNA, 968 bp, Homo sapiens
  misc_feature (246)..(246): n is a, c, g, or t
ggttcggcgcatcgatgtgcctcgggttccgcgccccgattgagcagttccttggtccggtagtgtcggacctgggtaatctgtagtgaaaggcgctgctggaccaggtggctaaagcagagatctaggtcctctgtggtagctcggatgcattcatcgctggtctaagtaaacctctcgcaaggagggactgcaccagattgctgtgaactttctatagccatggcaccattcgaatcagtagantgttcaagtgagtgtatccagtaggagcttctctcctacgatagagttgggaagtagcggcatggtagcttgggaagcataacatggacggttgtaccacgatgactgtcagtgtcggatgaactacagctgactttgtgtctcacgtgggattgcttcattgtactaacatgcacgcatgtggatttgcctcagttggagcactgggatagaccgagcctatggggaaagctagtgagggagagaggaagacagatcacatgagtccacgattgctgacggataggctcaaaagagggagctctcgacggatgacccatggtcagcttgagtggcagaggtatgaatgactgggtaatgggtggaggaaacgcgaggtgccattcatggttaggtaatacacgtatgacttggcttctgtgttgaactgatacttttccaactaggaactagaataggcccatttgagtcctacttttttatatatagggttgatacttgtcttgtagagaggttacttgatgggatcaagatggaaggggaataatgctttttcctcgagttgtgaacaaattaccttgattgacatagggtttggagtgttattactggtatcttaagcaagaagtgacgtactcagggatataatcgaaaagtaaggatggtgaggcagtagtgaaatattgagtttaagcttcattaaatcggtcatggatgggaga

SEQ ID NO: 661408 - DNA, 308 bp, Homo sapiens
cccgagtaatgtggggactgatgaggccatcgctctctggcatggggctctccgtcgtgcgtcacctgctgctgccgcttgttgctcctgtagctgttggtgtgactatacccctcaggggttattgtattgttccctcacctatgttaccggtgagaaaagagatcgtgtgtgttccccagtataatatatgctccctgcccaatcattcgattcgctgtaccatgtgtcaccaaggaacctacttgtaccatgactgtccaggcccggtccaggatacagactgcgacgagtgtgagagcggctcc

SEQ ID NO: 661409 - DNA, 550 bp, Homo sapiens
  misc_feature (4)..(4): n is a, c, g, or t
  misc_feature (92)..(92): n is a, c, g, or t
  misc_feature (95)..(95): n is a, c, g, or t
  misc_feature (218)..(218): n is a, c, g, or t
  misc_feature (228)..(228): n is a, c, g, or t
  misc_feature (280)..(280): n is a, c, g, or t
  misc_feature (295)..(295): n is a, c, g, or t
  misc_feature (301)..(301): n is a, c, g, or t
  misc_feature (316)..(316): n is a, c, g, or t
  misc_feature (325)..(325): n is a, c, g, or t
  misc_feature (337)..(337): n is a, c, g, or t
  misc_feature (343)..(343): n is a, c, g, or t
  misc_feature (383)..(383): n is a, c, g, or t
  misc_feature (401)..(401): n is a, c, g, or t
  misc_feature (443)..(443): n is a, c, g, or t
  misc_feature (467)..(467): n is a, c, g, or t
  misc_feature (546)..(546): n is a, c, g, or t
ctanaacggggtgaaggcaagctctagctcctcttagccccgcctttgggagcttggcagtcctggaggggccctcgcggcctcagcggganatnatccggacaaactcttcaaagtccactcgtccatccccattgaggtccaaatctcggataatttcctctatgtctcggtgtcccacctgatgacccaggagcttcctcatagcctctcgcagntaaatggtgnttatttccccatcaccattggtgttaaactttcggaaagcatctcgaagttnatttaaaaaaataanatatgntgtctctgccaggantttaggccncattagctccangaagtnatcaaaatttaaatggccaaccaggttcatgttgatctgntgggacagttcgatgagntccatctcggtgggcatgtagcccatggtgcgcatgcagttncccagatcccggcagttgatgtanccatccttgtccttgtcgaattctctgaaggcctctcggagctcttcaatttcctctggtcgcagtgatctatcctggncaaa

SEQ ID NO: 661410 - DNA, 747 bp, Homo sapiens
caatggcttggtcgggctgtgtttaattggccgagggctgaccccagatgagtccctagctgcccaccgccgcgccgtcctagttaccattacaccccgtggatggagccgcatgtctgtccgcattccggccccagtctactcatcatcgcgcaatccatgagcaggctgaggccgatacccagcagctgcttgtcctgaccttcctcttgctgcccgaaccatctggggtgcgcccgttccccagatttccgcgagacatgaggggcgttcgatggcgccaacgcgtcaggtgggctcgtgggcctgtcagatctcgtcgttgctcgttcctcgttgcttctaggcgaacctacgacttggacaaggttaagatgtcccaagcaccgttgtctccctttcccaagaacaataccatttctgtgcacatccttggaggcgagattgatgctccgtttgcagagggccgagagtaagtgcaaagtcactggagtgcagggcagaggggtccatggcatacccgcagcgccatgggagggtatcatgtatcacttcattctctctccccgtcactggtatgggttcagagcaatgcctagggcccctctctgctcccctgcctagtggggtggtagtggctacctctcaggcccaatagtccctgctcctcttagaatcttcaacaagtggcaggccacctctgggcaggacacttgcgtctggcaccaggaggtgaggcagacacac

SEQ ID NO: 661411 - DNA, 156 bp, Homo sapiens
ggctgctagctgactcttgaggatccccttcctctcctcccacctcagcctcccaagtagctggaactgcaggggtgcaccaccatgcctggctaattttttaaattttgtagagatgagagtctccctgttttgcctaggctggccttgaatccc

SEQ ID NO: 661412 - DNA, 169 bp, Homo sapiens
cgcggaccgtgctgggagcggcgcggctggagcgcagcgccgaagggactgcagggctgaagtgtgcgggacacaagcccccgaatagccccggctgccacatcgcagacccaagcacgcgcgccgggcccagctgagccgcctcatgaaccgccccggcgcaggcacc

SEQ ID NO: 661413 - DNA, 375 bp, Homo sapiens
  misc_feature (13)..(13): n is a, c, g, or t
  misc_feature (32)..(32): n is a, c, g, or t
  misc_feature (34)..(34): n is a, c, g, or t
  misc_feature (36)..(36): n is a, c, g, or t
  misc_feature (48)..(51): n is a, c, g, or t
  misc_feature (58)..(59): n is a, c, g, or t
  misc_feature (63)..(64): n is a, c, g, or t
  misc_feature (103)..(103): n is a, c, g, or t
  misc_feature (112)..(112): n is a, c, g, or t
  misc_feature (116)..(116): n is a, c, g, or t
  misc_feature (118)..(118): n is a, c, g, or t
  misc_feature (120)..(120): n is a, c, g, or t
  misc_feature (125)..(125): n is a, c, g, or t
  misc_feature (128)..(128): n is a, c, g, or t
  misc_feature (130)..(130): n is a, c, g, or t
  misc_feature (135)..(135): n is a, c, g, or t
  misc_feature (145)..(145): n is a, c, g, or t
  misc_feature (147)..(147): n is a, c, g, or t
  misc_feature (150)..(150): n is a, c, g, or t
  misc_feature (152)..(152): n is a, c, g, or t
  misc_feature (158)..(159): n is a, c, g, or t
  misc_feature (162)..(162): n is a, c, g, or t
  misc_feature (167)..(169): n is a, c, g, or t
  misc_feature (173)..(174): n is a, c, g, or t
  misc_feature (180)..(181): n is a, c, g, or t
  misc_feature (185)..(185): n is a, c, g, or t
  misc_feature (191)..(194): n is a, c, g, or t
  misc_feature (219)..(219): n is a, c, g, or t
  misc_feature (222)..(222): n is a, c, g, or t
  misc_feature (225)..(228): n is a, c, g, or t
  misc_feature (306)..(306): n is a, c, g, or t
  misc_feature (346)..(346): n is a, c, g, or t
ggcgggcgcaaangcgggtcggccgcggagangngntgcagctcggcnnnncccggcnncccnnccccccgggcgccagccaacccccccgccggccgggccnaccccgccntacnancnccagnggngngagcncgggggggantncanangccccnnaanagaannnaaanncggggnngganaaacgnnnngtggggtattggaggttcaggaatnatngtnnnncttgtgttaaggagtgtactaggccgttagctactcctttggcgaaaaccaaacaaaactcgatatgggggaaaaaancaaaaaaaagagagggattaaccattacgcaaaacaaganggttatagcgttaaaaaaggatgtcaggc

SEQ ID NO: 661414 - DNA, 868 bp, Homo sapiens
agcgagcggagtggtggggtggtcgagtctcggaaaccggtatcgctggcagaatggatgaccaagtgattgacaagagcaggatggcagaacttcatagaagctttgtgcatctatttgatcaatagaggggtgactggaagctataagcaacaaagggaagtgggaaactggtaactgagtagtggtacgtgggagcatgaatcccagcaggaatactggagttagatggaacacgtgattaactgcaacagtagagtgactggagtgggtcaatggtcacaaaatatgaactattcactggaaatttactgaaccagagtgaatggacaagagagagagatgaacagagaacaagaacaggggatagaagagcattcaagagacagcattccaggtgttgtttgagtgaatggatgggttgaatgtgctatatagaaatgttggcagaagcattcggcaatgtgattgaccgagaacttggagagaagttaggcagagtgaagaagtcgactgaaattgatcagggaaaagcaagagtttgcgatggtggatggtcaggtgaatactgatgaagagtgtagtacagatgtgatgacggtgaacgtggcataccgtgtttcgagaatgtgtctacatatactgtgtactacaaagggtcatcaggcatttccttatttgcatgtaaccttatctgtacagggtgcttcccaaaggggtgggaatatatgcaggtttcgacattacggaatcagtcctccaggtggctgccatccttactgtatttgtctacaagcttttgaaacagtgtcagccaggtggatgggggccgggaatatcacggtgacagtactaagggcggattcga

SEQ ID NO: 661415 - DNA, 277 bp, Homo sapiens
agaatgaggctgggattggcagctcatgcttgtaatcccagcattttgagaggccaaggtgggagtattgcttgagtgcgggagtttgagctggcaagatagtgagactctatctctagaaaaaaaaattaaaaattagtcaagcattgtggagcatgcctgtagtcccagctacttaggagcctgaggtgggaggatccattaagcccaggaggtcaaggctgtaatgagccgtgattacaccaccgcactccagcctgggtgacagaatgagatt

SEQ ID NO: 661416 - DNA, 418 bp, Homo sapiens
caccacttgctttcttggatttcttaggctgaggtgggcggggtgcccgagtccccttgtcatcttcgtcaactgcagttcggcctcgatgtttctctgccttccgtttcttcttcttctcctttttctctctcttccgcttgggcttagatattgggccctgggatagggcagccagttgttcatgtactgcccgcagctgttcctgtagttctgccaaacgatgggccctttcttcctctgagtccgagctttcactctcctcttcttcctcctcctcttcctcatcctcctcttcttcctcagaggagctatcactgctactctcctcactggaggattctgaagaggatttggccaggccagggggcaaggcagttgagattggtaaaggccctggttccagtggttcatctgg

SEQ ID NO: 661417 - DNA, 662 bp, Homo sapiens
  misc_feature (198)..(198): n is a, c, g, or t
  misc_feature (344)..(345): n is a, c, g, or t
  misc_feature (368)..(368): n is a, c, g, or t
  misc_feature (374)..(374): n is a, c, g, or t
  misc_feature (380)..(380): n is a, c, g, or t
  misc_feature (478)..(478): n is a, c, g, or t
  misc_feature (585)..(585): n is a, c, g, or t
gtacagtaatgaaaactatactatcaaaatgtgaataaaattatagtcagccataaacatgcataatgacaaatatttaagattgcagacgggaccaggtattcttaattgggaaaacagtcaagtgaccatcatagctttttattctgaaaacattccttcatagttcagttagcttaaacaaaaacaagagaaacnaaaaaacattttgtttttcctattacaaaaaactcccactttttttgttacaaaaagtaatagaaaatggtaatagttaacattcattgagctgttaatatgtataagtgtccttggtggctaaaatggctatgaggtaacattcnnatttccaatctcttcaagggctntccttntaaacnattccccatgcaagtaaacactattattatcctcattttttagttgaggaaactgaggctcatagaggttgaaagatttattcaagatcccaaaaggnctttgggggggggccaaaggcttgtggggaacttggggactctggggatttcaatccagcctaacccatagtttatatgtatatgcacacatacatacatatatgtngtgtataaatgtacacttttcttaaggaaaccatttttgtgacaaaggaaatttggccctttagcttgaaaacccaa

SEQ ID NO: 661418 - DNA, 489 bp, Homo sapiens
gatcatccagacaaaggatttagataagagaagagggcataagtcaaagttctggaacatgccagtgcttaaaggttttctataaaaggaggagccagtaaagaagactgagaagaagtggccagggagagaagagaggcagaagaagatagattcactgaagggagggtttcaagaaggaagaaatggtaaacaacatgtaatatatctgagatgtcaaggaagatgaggattgaaaaatggccattggatttaaagccttgaaggtcatcggtgacctttgtgagaaacattttggtggagaggttggaaaaacctagtagattagagcctagtggatagtgaggacgtggagacagtctgggtaactgactgtttttggaagcttagccatgaaggggtagtgtatggaggtataagtgggaccaagagagggttttccttagatatgggagagatataccatgttacgtgccagtgcaaaggatc

SEQ ID NO: 661419 - DNA, 662 bp, Homo sapiens
  misc_feature (499)..(499): n is a, c, g, or t
ggttagttttcgaagtaactgctaagccgtcttccaaagatggctgtatcattttgcattcccaccagcaatgaataagagctcctcttgatccacatcctcaccagcatttggtgttactagtgttttggatttttgccattctaatagatgtgtagtagtatctcactgctgcttcaatttgcaattccttaatgacatatgacatttagcatcttttcatatggttatttgtcaacctctttgatgatttgtctgttcaaatcatttgcccattttttaattgggttgttcattttcttattgttgagatttaagtgttaacacgccttgatcagatgtgtcttttgcaaatatttttcccagatcatggcttggcttttcatacttttttttttcttttttgagatggagtctctctctgttgcccacgctggagtgcagaggtgcagacttggctcacttgaactttcaccccgctggttaagcaattcttctnccctatactcctgaggagctgggatacaggcgcctgcaccatgcccagatagtttttgatgttaaggacttggttttgcatgtagccacgctggtcttgactcctgaccctagggattcacccactaggcctcccctggtgggttacacgatgagcccccttt

SEQ ID NO: 661420 - DNA, 285 bp, Homo sapiens
aaggaaaggaaaggaggaccggggagatgggaaggtcctcagccattcagcacatgcggacgagctccgccccatgggcccgtcaccctgacaggatatgcctcacaaacgcttcatagtggctacaccattttacattcccaccaacagaagtaaatgttcaaatatctccacatcttctccaataatcattattgtccacttttttgattacagccatccaggtagcaataaaacggtcactcattatggtttttatttgcatttccctgttcggtttatact

SEQ ID NO: 661421 - DNA, 1005 bp, Homo sapiens
ttgctggctgtgagccacctccctcgcgtgcagcccgcaacgggaatggagtaaatgggagaccctgtcgacctgtgccacggggatcagcgatgtgaattaaacgcaactctttgtccacccatctggaagccgagaagcctctgagtgcgctatggggcggtggaggacgacggcttggaaaacggagagactggggagaaatcacgctggacatcatctccatggcggagacaaccatgactgccagacggagacttgagctggagatggcacacaaacttcagcgtctccgggaagtctcggtccgccgggagtctgagctcaggttcatgctgtgcaatcttgcacaaactatcttaccttctctgagcctcggtggcctcatctgttaaaatagccatgcatccacgtatctcgcagggttggtcatgaggagtaaacagagatcaagcgtattacagtgctcagtccagtgcctgctaccacgatggatgacatccagctctgccaggacatcatggacttgaagcaggagctgcagaacttgcgtcgccatcccaagacaaaacgaaaccaccacactgccgaagcagacgagacggatgagctaaatccagcaagactcacgacactggtgcagaccacgagacttcctggtggacgactgcggcaggtcgagcggacacgggacgcaagcagaacatcaagacaaggctgacaccctgagacacagtcaacacccaaaaacgacaccaatcccagccagaccggccgcacaacccaaccccaccagcaacccgcgcgccaccgggcggcatgccaaggactgcggggggacaccaaggggaccaagtagacgaaatcgctcactgcccagggaacgggcaagaacagagcaaacacagagaggaagaaacccagagaggaagaaaaacaagcacaaggaagcaagacagcagaaagacaagaacacagggaaagcgcagagacaaaagaccgaaa

SEQ ID NO: 661422 - DNA, 1291 bp, Homo sapiens
  misc_feature (763)..(763): n is a, c, g, or t
  misc_feature (1070)..(1070): n is a, c, g, or t
tgggacttaaaaatgagcttaattggttggttttccttaagtgcatttatcgatgtaaacagagcatgttaaagattcccggggagagcagactatggctgatatgtgggttttaatggaaaagaaacgatgatgccaagggttgggatggacagcagcttaaggaggaaaaaaaaaaaaaaagagaaaaaaagaacagggctggtgacaccccctgtggggtgtttgactctggtgccccagtgcgacagtccctataggggcaaagcaaactctgtgtcaaaactagaacccattggtatggcacggttggaaaaatcaaggccaaattggctggttgcgcggccagttttgccggccgtggagaatggctctggtggtcctgggcgcctatggtcccacacccaagggggtggcaacacacctgtggcgtcttgtgtacccccgagaatacaccccacaggtgtttctgcgcccactcgccgcgatcctgtcccaaacagagaccagagtaaatccgggctgcgacagtgggggaccccactacaacagatatgtgcgcgcgatacacattatcacaatgatacttccccgacaggctcaccaaacaacagaaccactgtccgccgagatctcggggagacacataaacgcggcgggaacgagacccatccagacaagcaaatgtgcggggcggcgcccaactctctgcggcgcgacgcgctcagacagaacggagacgggtggtgcgccccccacaaangttcttccagcgggagagggacaccacctattcgtcaaaccacggcgactgaggagagcgatagagagtacacaccaccggggaaggagatcacaacctgtgcgaccaaaccgacaaaacaaccacacagtggggtggcacccccctcattaggacaatgcgtctcccagcatgagggggagcaccccggcaaaagaaccggcgcggccccgagtggcaaacaacccacataagcgcccccccccggtgcgttccttcgtggcacacacaggcagaaagaacgggagcgtggaccgccacggagggncgctaccattgtcacccagtcaccaacaaaaaggggcattacaacacacgaggaggatagccccccatcaacaaataagtggacgccatccgcctcatggggaggtcacaacaccagccgtttaaacaacgcagacaaccacaatgtgtgaggggtccgccaaacacatgtgtggctttggcgccaccactgtgcgccaccaaacatctagcgacaaaaca

SEQ ID NO: 661423 - DNA, 410 bp, Homo sapiens
gccagtgtctgggaggcaaggtggaaggactgttgagcccaggagttgagaccagccgtgggtaacacagcaagaccccatctctacaaaacatttttaaaaattagttgggcatggtggtatgtgcctatagtcctggctactcaagaatctgaggcaggaggatcactggagcccaggagtttgaagttgcagtgaactataatcatgccactgtactttatcctggacgacaaagggagactctgtctctttttagaaaaaaaaaaaaaaggaggaggcaaaagtaggaggggaggatgactagaatccagaggacctaaaaccagaaaatatgactccagagccataatccgggggtatgaccaacagggcggggaaccgagcccgaatccgaacccagggccata

SEQ ID NO: 661424 - DNA, 199 bp, Homo sapiens
ctgagtctggttaataactgtgcgaacacgggccatggatatcctggatgactcggatcttagagagcttggaggcctgaaccgcctgtcacttatggcgacgcgcatgctatggaacagctccaaccttcaggacgtccagatgtaacagcagctcctccttctactcccctgcgaaaaatttcgagacatatgatat

SEQ ID NO: 661425 - DNA, 561 bp, Homo sapiens
  misc_feature (545)..(545): n is a, c, g, or t
gtccaaacagtgccgcatgttctttttagtttccatacatcgtctgtcccagagtgaggagaagttgatctccttcccacatccaccacaggctgcgtgagggaagcctggctccccacaacttgctccttctccagccctgcccccctcaattaaaacaatgctttcttttttcttttctttttttttgagacggagtcttgctctgtcacccaggctggagtgcagtggcgcgatcttggctcaccatagattcaaatgatcctcccacctcagcgtcccgagtagctgggactacaggtgcatgccaccacgcctaatttttttttttttgtattttagtagagacggggtttcactgtgttggccagtatggtcttcatctcctgacctcgtgatctgcctgccccggcctcccaaagtgctgggattacaggtgtgagccaccgcacctggcctgtttttcatctttgtgtcccagaattgccttacatttctggagatacaaagatgaatagaaacctcatctgattaatacatacttncagctcaacattttgg

SEQ ID NO: 661426 - DNA, 593 bp, Homo sapiens
cagaggatcgcatgccaataactccatctaaagtccagaccaaagaaagaatcttaagaactatgagacaaaagtgtcaggtaacccatatgttaatctaacttattagattaaaggacatttttcagcagaaatctcacagatcagaagggattagggtcctatctttagctgccttaaacaaaataattgtcaggcaagaaatttgaatccagcaatcctaaggttcataaatgaaggagagataaattatttttcagacaaatgctgacagaatttaccacttccaagccagcactacaagaaatgctataggagttctaaatcttgaaacaaaacctcgaagtacaccaaaataaaaccttcttaaagcataaatctcacagggaaagcaataactgacaatggggggaaaaaacaaggtattcaagcaacaactagcatgatgcatataacagtgcttcacatcttaatactaatgaacgtaaatggcctaaatgttccacttaaaagatacagaatggcaggatcgattaaaatccacaaccaagtatctgctgtatacaagagactcacctaatacataagcactc

SEQ ID NO: 661427 - DNA, 169 bp, Homo sapiens
tttcaggaatctgagagcctggatcagaaacacactgctgcggagagagatcgggaagctgacagaggagctgaagcacctgacagaggcactgaaggagcacgagaagatgcgcccgctgctgctctgccctatgaactgtagcgccagcgcctcccccggccggacc

SEQ ID NO: 661428 - DNA, 136 bp, Homo sapiens
aaaggggttttttaaacccccaaaaacttttttaaaaaaggggctttgggtttggcataaaacaaagttaaaaataaattttttttatttcccccccctttccccggggtcaatcaaattaaagggggttttccta

SEQ ID NO: 661429 - DNA, 282 bp, Homo sapiens
gggcccccccccccccctcggggggggcctttttttttggcccccccccccggggggttttgccccctttttttttattttttcaaaaccccccccccccggggcccctttgggggcctttcttttcccgggggggggtgggcccccgctttttttttttttccccccccttccccccggggttttgggttttttgggcccctgtttttttccgggggggcccccgggtttttccccgggggtttttttttcctaattaaacccccccgggcccccctggga

SEQ ID NO: 661430 - DNA, 391 bp, Homo sapiens
  misc_feature (2)..(2): n is a, c, g, or t
gnccaggactgtgtctgtggtgcctgaggttccagagggtgcaggaggagcaagggtcacaagagaggggcatgctggggacatggcacgaggtgttagaaggtgaaagaaggcatgaacattgtggaagccatggagcgttttgggtccaggaatggcaagaccagcaagaagatcaccatttccgactgtggacagctctaatttcttttgacttgcgggcattttacccatcaaaccattccttctgtagctcaggagagcgtccctaccccatctgctcgcaatgtcctgtaatctctgctctcactgaagttctttgggttccatattttcctcattccccttcaagtctagctggattgcaaagttaagtttatgattatgaata

SEQ ID NO: 661431 - DNA, 506 bp, Homo sapiens
gcacgagggaaactgtagtaaatttaccaaaatatctccgaataaaaagaagaggaacatcttttaatgaattatagagtacaaaagaatcatttaaaagagagggcgagtgaaaacatgaaaagaaacgttactaacttaattgaccttaaagtagcttcaccagttaagtgcattattgatcattccatgaataaccatttttaaagactaagatgctgagttgtgttatatagagagaaaaaaacgtactttcagtttccatatgaggtggagcgcaggtcataggtatgccggctcattgttttctattttaaaaagtaaaaaatatgctgctaaaggaacacgtgagaaattacattctccctaggtctgcgataacgcggtaatattacactgcccgccgccttccatgcctttggaaagcagacaatgatgctaggcggcgcccagcagtataaacttttcttgcttataaccagaacctctatcacaaaattagaaac

SEQ ID NO: 661432 - DNA, 604 bp, Homo sapiens
gatcaggtaggaggtcagcacaagattacgggttcataaagaacctgctgataaaactggttgcagtataagttagccggcctataacccaccaataccaagtatggcgatcaagagtgacctctgttcgtcctcattgctacactcctcaccagcgccatgacagtttacaaatgccatggctggccaggcgcggtggctcacgcctgtaatcctagcattttgggaggccaaggagggcagatcacctaaggtcaggagttcaagaccagcgtggccaacgtggcgaaaccctatctctactaaaaataccaaaattagctgggcatggtggcgcgtgcctgtaatcccagctactaggggggctgaggcaggaggatcgcttgaacccgggaggtggaggttgcagtgagctgagattgtaccattgcactccagcctgggcaacagagcgagagtctgtctcaaacaaacaaacaaaaaaacaaatgccacgtcaacatcaggacgttaacctttagaccctatatggtctaaaaaggggaggcatgaataatacaccccttgtttagcatatcatcaagaaataaccataaaaatgggg

SEQ ID NO: 661433 - DNA, 121 bp, Homo sapiens
ggtattatcatctgatccttacatcttggtagctgctttttactaatatctagctccctatctttattatcttaaaagaatatacaggccgggtgcagtggctcatgcctgtaatcccaga

SEQ ID NO: 661434 - DNA, 133 bp, Homo sapiens
agcgctcagcttactttaaatggatcctctgtgatggtgatagagttcagaaagatcaagccaaagaatgcgaagcaaccagagcgtaacgaaaagcgggtattggggtctgggtatggccagcgctgtggta

SEQ ID NO: 661435 - DNA, 243 bp, Homo sapiens
agtcgtctctacacgatcccctccttggcccgcaggcctggattagccggattgccttactaacgatttcctccgtatctgactgcaactcagcactcagctgcatgcgagcacaatgatgagccctgctggcagcaggttgcgtcttcgacgtgcaggatcacttgatacttagcggttattccagcttgacgggcggaccattctgatgccaaactggcctccaggagacttgtctatcat

SEQ ID NO: 661436 - DNA, 261 bp, Homo sapiens
accctgctatgtatgtgtgcacgtgtgcctgtatacgcatacctctaaaatttctcatgagtcccagtatgcgtcgcctgagaataagagcattttcctatggaaccacgatactttttgtaaatttttttttgccttgagacagggtctctctcgctctattgcccaggctggtctcaaactcctgggctcaagcagtctactcatctcagcactctgggaggccaagacgggcggatcacaaggtcaagagattgagac

SEQ ID NO: 661437 - DNA, 718 bp, Homo sapiens
gaatactgaggaccccagatgacgtggaactaatagctccctaacacacctgtggctacgcccgaaccccagtgtgtttctgccgaaagtcggaacattaatcaaggaaagcaacatccattgtacttatgacgactatataggatcattcgtgtacacaccaataaagttcccgtaggtgaacgtaggtaagagctaaaccacgttttgacatctgtcttcgcaacttggcaaggggaaaaactgtctgtcactctgacatgccataaatagttagctttgcatccacaaacgtccccaggtgtagaaaaaggcatgccgaaacagatgaagttctggacacgcctaagaattcattgaagtcccatctagttactcattggaacggctgtacatcgatcggtcggcccaaagagcgcgtgcaagtgtatgtgtgacctgggtccgtggtgttacccctctgctaaatatactgcctgtcatctactttattagctcgatatgttacatatatttatatcgtcagtatagctgtgcgagggtgtgcccttgaggtatacctaggttgaccaccttggatactagtgacttcgatcctgataaattccgataccatgaatgcttaacagttaaagttcatcgacaaggagtttctgtctgtacagacaaactggcaagtgttcccattaagatacgggggccatgcgccttaagtgca

SEQ ID NO: 661438 - DNA, 1200 bp, Homo sapiens
taggcttggcccttgagtttattccacaaaaccacggaaaaggatactgaaagggagctcttgccagcctccaagcaaggaggccccagcagccagttcttccagcccctttgagcccttttgtgtgttaggcccacacccaaaagaggaaaaccagtgtggtggtgcgcgaaggtacagtggcaaggcactttgtgaaaacattcccagttttaccggggggtgaaattgtgaactttacctctgtgaaacagatgtgaaaaggggacatgtgcaaatttggcgtgagcacatgtggagggtgtggggtagtagggtgaaaactcagtggtccgtgggttattaacccaggtttcctccaggtttaggggtgagcccgcccggtcgtggaactcagggggtgggcgggcccacacacccagggagtgaaggcggtggaacttcggcgggaaggaggaaaggggtgctcctgggaccagtggtcggcgaagaaaacgaaagccgtaaacgttatactctccagccaaagtgggaaaggccgtgctccagggggtttccccacagggttcgaacgtgggccgtggggtgaaatccgtggcaattcttatcaagcctcatattgcggggaccaaagaataatctttccttctggtcgggggtggcgaaaagatgagggggacactccgggccccttgcccactggggggcccatggggggattgtggccgaaaagagcgtggaacaagggggttgtgaatcgcctgtggccccccagaaaaacatttcccagggtagaacggggcatggggttaataagggctcactcgatcgtgggccggggtcttggttccaaagattccccttggcccatgtgtgaacacccactggtgcccctggggcgcctggaaaaaaagatggtgcccccgaagttaacagtgtctcccacacacgtggctatcttccccccttaggaatatggggcggaggaccttggacagagaccttcaaaagaggtcccaaaaccgctgaaacaacggggagcgggttagacgcgcccccactcacagagtgccgcagggcacaatcccaggaaccaaaagccggagaaaagaacgacgggaggcacacacaaccacagacgaagccgaaggtacccgccgagatgcacaaagaagtgagacacacacccgctgcgacaca

SEQ ID NO: 661439 - DNA, 731 bp, Homo sapiens
agcggctctcttccacagtgaggcctacagcgccgccgcttgtgctgcagccatgtctctaggtgatccctgaaaagttccaggcatattgtagcggagatactcaacagccaacatcgatgggcggggaaaatagccttggccatcactggcattaagggtgtgggccgaagatatgactcatgtggtgtcgaggaaacgcagacattgtacctcaccaacgcagggacgaggagaaccatcactgagagatgaggaatgagaacgtgtgatacacacattatgcagaatccacgccagtactaagatcgcacagactggattcttgaacatgactacgaacgtgatgtacaatggatgtgacaagatatcacgccaggatcctacgaccaaatggctcgtggaacaaacatagctcgcgtgaagacctcggagtcgactgaaggaaggatttcagggcgccataccagggggctgcgtcgacttctggggcctacgtgtccgaggggcaggcacaccaagaacattgggccgtcgtggtgccgtaaccgtgcggtgtgtccaagaagaaataacctctgtacggacttgctctgtataataagatacgtttatactatacaaaaaatgtacatgaagattgtgctgccaaggcagatatctcagataacgggagataacaatagaaggggggccccggaagccagatctaggaacctgaagagggaaaa

SEQ ID NO: 661440 - DNA, 137 bp, Homo sapiens
agtcctcccacctcagtgtctcaagtagctgggactatagacacacaccactgctcctggtgtgatgtttgttttgttttgttttgttttgtttttattgagacggatctcctgggcgacagagtgagactccatct

SEQ ID NO: 661441 - DNA, 337 bp, Homo sapiens
tataagctgttcaattagacggagacatgtattctctttattatgcctatttgggttggggtttctggtacatgtaactgacagcataccactataccatgtgttcctaattccctatcccacaactaacaataaaaaataacatctcatttatggttttaagttcctcatgttaacttaaaaatatatcataaccaagctggttatatattgaaatggtatacatcaaaaccacgtaaaatagagtgcatcaggtcctttgtctttccaagctcaacctgcctttccaagctcaaccagcctctttgcttcctgtggggcagggaaatgggaaggt

SEQ ID NO: 661442 - DNA, 206 bp, Homo sapiens
cccgtttctaccaaaaatacaaaaattagcccgggcgtggtagcgtgtgccactgtagtcccagctattcagaaggctgaggcaggagattcacttgaacccgggaggtggaggttcaagtaagctgagataacgctactcattcctccttgggcgcacagagtaaagactctgcctcaaaccaaaaaccccaacacaccagatat

SEQ ID NO: 661443 - DNA, 372 bp, Homo sapiens
gtgtaaactgacaggctgaacacatgacaagaattattattggtttatattactttccccagagaaagaacttacacagaggggactggcatagttaagactgcccgagccttttcttttcttttctcttttcttttcttggcttttttcttttctttttttggagacagactgtcactctgtcgcccatgcgggagtgcaggggcacagtctgggctcactgcaacctctgcctcccgggttcgggtgattctcctgcctcagccagtagctgggatggcaggcgcccaccactatgccgggctaatttttggtatttttagtagagacagggtttcaccatgtgggccaggcgggtctccaactccggag

SEQ ID NO: 661444 - DNA, 132 bp, Homo sapiens
ccgaaacagtacatggctattgaagagtatactgatagcattggaggaatacggcgtttgaggtcttggcgagtgttatggtgaggttagcgatggacgtcggattgttgctgccggtacaaatctagagtt

SEQ ID NO: 661445 - DNA, 160 bp, Homo sapiens
  misc_feature (119)..(119): n is a, c, g, or t
ggcagcactggtggggccccaaccatgggctgggaccgtcttcttcttgggctctctctcactgcacagctctgtgacctctctcataggtcttgaactctagagcacccctcgcgtgntctactctgcccccaggggaagacgggccacgcatttatcc

SEQ ID NO: 661446 - DNA, 184 bp, Homo sapiens
tgaatcggctgtattgggcctatcctcgaaacactggggctggccaaactcttggttcttcaacaggcgcattttactgtgtagcttttggttccattgtttggagaccttgcctgggcacagtttggtccgttagacttaaacgttgaatttttttttttttttttttttttttttttttttt

SEQ ID NO: 661447 - DNA, 317 bp, Homo sapiens
gagagggagtctcactctgttgcccaggctggagtgcaatggtatgatcttggctcactgcaacctctgcctcctgggttcaagcaattcttctgtgttagcccccccagtaggtgggactacaggtgtgtgccaccacacctggctgttttgtatttttagtacagacggggtttcaccatattggccaggctggtctcgaactcctgacctcattatctacctgcctcagcctcccaaagtgctaggattacaggtgtgagccaccacgccctgcaacattaaatattttattaatttcatctttttcaagaaat

SEQ ID NO: 661448 - DNA, 1317 bp, Homo sapiens
  misc_feature (479)..(479): n is a, c, g, or t
  misc_feature (1131)..(1131): n is a, c, g, or t
tggtctgggaggaagggggaccccaaaactcattgggcagcagaggttgagaacgaagcttcacaaaagagtgtctaagcaacagccaccctcagttatataaattccagaaaacaccgtggctagtgtgggtattggcaaaccttccccaactcaagtttcaccagaaaactcaggtgaaaaacgaggtttggagtttcaccacgtgagtgggtggctcgggtgaatctcaggctcataggaaaattcgacttcttcattaaacgagccaattcccataacgtgatctcgtggtacccagaaaaagagttcaataccgtggaagcccagacaaaaaaaatatgtgaaagagaaagcgtggtccgaaaatgggagggtctctccacatgtgtgttgacaccactgtgaacacaagccgaagggggttccgagctctaagcgcccgtgaccgcagggagcctcaaataccccgcgcgggngtctaagtgggtgtgagacgcggccatactaaacacgcgtgggcccgaacacatgtggggttcctataaaggaaacacaactcttatctcgtcctataaattttgtgtgacgtgtcacgccccatctgttgagcaccacagggtgtatacccgcgtggagcatgtgaaaccgagaaacaacgcgcgggctctttggaaccccacgtggccgggaacaaacacattcatgtggcggaaataacacatcacgggggtgtcgacaactagcgtttcgaggaccattcttctacaacatcttgtatatacgtttcctacacaccctttagtgtggtggggcacccatgtggggacactttatacagacgcccccctttctaaagaatcttgtgggcgcgcgtttaacccatcgtcggaacaggggccaaacatacaccaccaacacccaaggtgggctcgcacacattacattgggcgtcgccccgtggtctaccaattgggacaccaaaaaacgtcatggtggacagaagacgctctctcgaccccccgttgatcagggcgacaccgcggagcaaccgccggtctcagtccaaagacagcacacacaggggcaatctcccggggccatgcaacaacgtgggacaacgcaacaacncactcaaccccacacctcgcacaaaccgtcctcaaactcacaacattacagcccgttgaacagtgagcagcaaaatcccgaccaacttgtaaacagcaatgtcgcaagaacactcaaacgagagcacaccaaacagagacagatcgccgccggacgggcacacacgccgactaaccccgacggggc

SEQ ID NO: 661449 - DNA, 1029 bp, Homo sapiens
  misc_feature (147)..(147): n is a, c, g, or t
ggacacagtctgatctgccgcactcgttccaatatctgacagatgtcctctgtccagcgtacgtgatactcgcgaattaataagcagaatcgcttcgcttcgtagggtctaattagagtagaggtatcacggcgatgtgtccttggngtggattatggctggggtacgacggctcctccgccacacgcggtgatttacggatccatggggtgcggtgcgtcacgcgcagcactcctaggggccgctagaattggctgcgcgacgattgggtgcagcaacctggactcctaatggtgtagcagaaggcatggcgcgcaagaaacgactgagctcgcgcattctcttgagcaccgtaaaaatacccaccatttggagacactggtcatcgatctcccatctgtagtagggtaactggtacccacagactcttgggcatccagatcctgttcatatatggcgaagctgccgacgctcagcccctgcgaacgaagtctacgcgctagatggctgcatgaatgcggatggacgcgcgcctgaaacctgcgacaaggaagccacctgaggaagatcacatactgaaatcggcaattcaatggttttgatcgagctgttgatcacgctcgggcccaatgtactcttgcacagtccgaggtccagtgctagtcctcgatctacgcactctggtgttcgtagcacttggaaagtaagtgattgtgactctgagactatgggcccttgacctccaacacctgcgtgtccacattgcgtgacgcagtgcgttttaccgaccactgcctcctatgggcacaagtgacctgccgtttttaggaggctagggcattgtccccgggggactcgtagagggggactttacccttcaattggaacatttcatctaggtgcccgcgcgcttgtcctactaggtcttcaaccaacaagggtcccgtaacggggaaagagcgttgcgttgacctccacagaaacagctgagggtacgtcctgccctggtaacttgaagaaggcaatagc

SEQ ID NO: 661450 - DNA, 563 bp, Homo sapiens
  misc_feature (29)..(29): n is a, c, g, or t
  misc_feature (154)..(154): n is a, c, g, or t
atatgcagtagtggatccttgtcaatatntgtgatgttttccctggacaccagtgtgtaactgatcaaatacattttttttaaataatgtgattaaacacatgctggtctttttttttttcctcccccaaagccatcacatagatgtgggatanaattaatcctgtggaaatgatctcagatgatgatgagttactccgacattcctctctcccttgtttcatatttgctaaaaataactttgtttgcaatgccatttatcccaaagtccataattacaggcttcttagaattataaggacggcaggccggcgtttgggatcaatgtcttgttctgaacagatccagcgtggacgtcttcaaggcaagagttttcgttttacattgtcctcactcttaaagcatccctcgaattcattaaggtttatatacaacgtattttggaatatatattttggtactttttcagagcatctttgtgggttgtacagggaaaaacgacaagtcattgctcagaactacagccttttctgtatcaataaacaagtggagacgagcaccgca

SEQ ID NO: 661451 - DNA, 433 bp, Homo sapiens
tggagtaagaagatctagcacagtccttgtagcctggtgaaggatgtgattggggctgtagacagcaaagtggcagttatgaaaagaaagtgcgtctcacatgagatttatacccaagaaccgatagccagtccatcatgaggatgaagagtggtccgatgtttgcccaaggacagatttgaaacggaagaagcttgtacggtgatggggagtgtgtttctgcaagaatgccgcagggaggttgaacgaggttccaagcacggtcttctctactggacattttcagttttccttcaagaaaaagacccagaagtacatctttgcatcaattggacccgaagtccaccagtgatctctttcaaagcaagctgatttggtgagagaagtgggcacatgaggcgaaagggaacatacctgatcagcctggggatga

SEQ ID NO: 661452 - DNA, 117 bp, Homo sapiens
gcgatggcacaatcatcgctcactgtagccttaaactcctgggctcccgccacagcctcctgagtagctagggctgcaattgtgtaccatcatacccacaattttaaagttaaattg

SEQ ID NO: 661453 - DNA, 1147 bp, Homo sapiens
agcggagtgcaggcgaactgcagggcaaacaggtgggcgcagtccgagtggatggagagcaggaacagagaggggcagacacagatgatagttgttcgtgatctcggacctcagtgcagagagccgtcgcgagcaaaaacgatacgagaagcgaaggacgtggcgctgttgctcgtaaggaagactcggctgctccatcccactcatccactggcacctgtgtctgcgtcacgcatcgttccagagggaaatgtcggcgaaggctggaaccatcagacagaggctggggacacatcaggtctattctgccccagcaaggcttcgataggaacgagccgtagtgacataatgcactctctcgcaaggagggctcaggaacatctgcttcgggcgtcacatatacagtcgtggtcctttgcgggctgcatcgaaaacgcagcgtagagctgtaaccagcaacgtgagattccggtgtcgggtcaacccggagtcaatggctacatactggcctatgatggatattagagattccggccgtatcattaggtcaaacaagcgaccagcctatgccgctatcgacctttgacaagtttagacaaaaagtcgtgtgagacgaaaggctagtttttacaagttttgggctttctatcagaaatatatatcgtataatcaaatcccgtaaagatggaccgctaatcatggagggacagttgtcttcgagtggtgtatcatggaaatcttagaagtgaatactggcaaaatcgaaggggaaaaaattaaatcatgcccactatttgctaaatcgttactgaacaaaaatatacaagagaagagaaaaaggtttcattccacggaagtcttcgcggggggcgatccgggggcccagaagtaaaggggggcgctctgggataggtccccatggtcgaagtgcggggggggggtgcccgggtgtttcggacgtgggcgttatttaggatgccacctctggtaaatacgttgtgcaagcggcgctttacaaactgtaccgaaagctttgggtaggcatgtaaacttaacttgggggcgcaaaaaacctgtggtgtaccccgtgggtgtatgaactgcaacgggttacattacgggtatcaaacaatttttccacgataaa

SEQ ID NO: 661454 - DNA, 399 bp, Homo sapiens
  misc_feature (311)..(311): n is a, c, g, or t
  misc_feature (364)..(364): n is a, c, g, or t
  misc_feature (374)..(374): n is a, c, g, or t
  misc_feature (396)..(396): n is a, c, g, or t
ccacacctgtgaccatgacaatttagaacagaagaaaggtcttgaacccataccatggtatttcatcaattctaagatgccactgattgtaggaaggaccattattttatatatcactaagaacaaaaaggaatgttgccaattaaactatgatgtggtgtcttagctgtaatacttatgcagtaattgattatactaacctctcattgctttgacaattctttcatctattctgaaggatttgggcaagatctccaaatatattcagggatgcatttcatagcatgtgctatgcccaatgtttctccaanttgacaggggcacattaaatcacctggggcatcttgtttaaaaatgttagggntctggactgnggtgggtctggggggtgggccngga

SEQ ID NO: 661455 - DNA, 338 bp, Homo sapiens
ggtcgaccaaatgaaatatctcaattataaaagcagcatggccgggcacggtggctcaggcctgtaatcccagcactttgggaggctgagcaaggtgggtggatcacttgaggccaggagttcgagaccagcctggccaacacggtgagaccctgtctttactaaaaatacaaaaattagccaggcgcaccactgtagtcccagctactcaggctgaggcaggagaatcgcttgaactgaggcagaggctacagtgagtggagatcacgccactgcaactccagcttgggtgacagagtgagaccgtctcaaaaagaggagaaagaaaaaagtcgacg

SEQ ID NO: 661456 - DNA, 155 bp, Homo sapiens
  misc_feature (14)..(14): n is a, c, g, or t
  misc_feature (132)..(132): n is a, c, g, or t
ggcctttaaaaatnaaactgccaccggaactgctttaaaaatgtttggttcacagccttcactggattacctattggagcaaacaaagtgtaaccatgtaaaacctgtgagcttgtattgatatctcatggntagagttccaagcgaatgggtct

SEQ ID NO: 661457 - DNA, 158 bp, Homo sapiens
tggctaccccaaactgttgcatcaggtacccccattctatcatcaacgggtacaaaccgagtcctggccttgtctgtggagacggattacacctttcccacttgctaaaaggtcaaggccttcttggctgatccatctgcctttgtggctgctgcccc

SEQ ID NO: 661458 - DNA, 395 bp, Homo sapiens
ggaagtccagatgcgggtaatctatgaaagaaacaaactgacatatctaggcagacagttatctatgtaggtctgagggtcagcagctgtaagtctccttccttatggctcttgagatccacacataataactattagccctaaacaagggctcctcccacctaccacctgtagccccagttgaaaagcatgcataatgagctagaggtacagcctggatactggaatagcagcccacataaacataaaggaggatgtccctggtctgttccatccccacggatggtgtagctgctgggcaacagtgttggcttcttttaagtaccccctaacctcctcacccatctccaaactgactagcactcagagggacttatgataacaggtcagctccc

SEQ ID NO: 661459 - DNA, 145 bp, Homo sapiens
tggttcttgttgcgcaatgacgacatggtcggctcgcagctgctcctcagcgaactcgaggagaactgcataatgctgtccttgctcccctcggacagcgcgccgtccgggatctcgatgtagagtgctgccgacactcagcact

SEQ ID NO: 661460 - DNA, 140 bp, Homo sapiens
ttctggtctattgggcgccggtgcagcaagcgtctcgcagcagttcctgctctggcgccgatgtcaggtcgggattgtggagcgtcgcatatgctgacaacacaccggctgcatctcctcgtctggaacaggaattgcac

SEQ ID NO: 661461 - DNA, 452 bp, Homo sapiens
cgcgtggttgattctcctgttgttgggtcacggtgagtatggatggtctgcaacatggagaggatcatgaaggcacaagctttgagggactcaggcatggctggttacatgtcttctaagaagaccatggagatcacccagagaacccaatcatggaagagctgagaaagagggctgatgctgacaaaaacgacaagtctgtgaaggatttggttcttctcttgcacgagactgctttgttgacatctgggttcagccttgatgaccctaacaccttcggcaaccgcatccacagaatgttgaagcttggtctgagcattgatgatgatgctgctggagaagtcgatgttgacatgccagccctcgaggaagctgatgctgaggaatccaagatggaggaagtcgactaagcttggtgtttctaggttgtttctgattttactgattagtag

SEQ ID NO: 661462 - DNA, 156 bp, Homo sapiens
ggaaaggggaatttttttgggccccccttggtttttttttttgggggggggggttttaagttttttgttttttaaacccggcctttttttgggggcccccccccccccaaattttgccccgaatttttggcccccctttaaaagttttttttggga

SEQ ID NO: 661463 - DNA, 408 bp, Homo sapiens
tttatctctttattttaaattcatttttcaagccttactgtattggcattttatatctagtacaatgtagaatgaatatgctaacagcaggcacccttgttttatttctgattttaaagacatgcttaccacatttcactattaagtttgatgtttgcagcagatattttgcgaatatctttgatcactttaaggaagttccttcctattcacaattttctaagatgtttttaaaattatgaatgaatcttgacttctaccaaacatattttccgtatctagtgagatgatcatataatttttctgctttaacttgttaatatgatgacttacatgacatgatgttttctttcggttaagccaacctggatttactgagataagctccatgttgtcatgccatattca

SEQ ID NO: 661464 - DNA, 390 bp, Homo sapiens
  misc_feature (3)..(3): n is a, c, g, or t
  misc_feature (5)..(5): n is a, c, g, or t
  misc_feature (7)..(7): n is a, c, g, or t
  misc_feature (329)..(329): n is a, c, g, or t
  misc_feature (335)..(335): n is a, c, g, or t
  misc_feature (376)..(376): n is a, c, g, or t
ctntnantttatgaatgcctgtaacgataatagtcactcttggttactgagctacagctgtggtctagaactgttgtgaacgcttgtcataatgtcatagaatcttaccaatagcttttcaggataggtgctgttattctaatcttttccatgtggcaactgtgatgcagacattgtcccaggtcagacagctgttaggtctggaaccaagacaagtattccttcaggaaaaccccagagtcctcactcctggctgttgcacttggaatcttccctttccttgtaggacacacacacacacccccccacacccctttagagggcatggnttatantttgttacattcatttattggaacgggcataggtgtttccngggtaggcagccta

SEQ ID NO: 661465 - DNA, 1464 bp, Homo sapiens
gacctctctatacctgcttgcaaaaattacacatggagtaactatttttaaagcttatttttcaattcataacaaaagcacatttattttcagtcaaagtggatgatgtctccctcttttcccctattctcaattgttggcttgaatcttttatcattttacatcaaattctcccccatacccacttcctgatactttggtactctttcctgctcaggtcccttcattggtacttaggagttttactcatgtaataggtataacagaaaatatcgtccagctcgggatagcaaagcatggagaataaaacaagatagctaaaacaaagaaacaacagccccaagacaacaagagtgatggaaacacatagaaccactcagaaaagccatacacgaaccaacccgaggggcaccgcggccccgagcggcacatagacaactggacacaggggtccacaaggaaaccagagacagagcacagcgcggcactcacacacaaactaacacaagcgccgagagaaaaaagaaaaacgcactggcaacaaacacacacgatggcaccagaagagccaaaaggggaacaactacacgagacaacaaagagccggaattcatattacccgacagcggggggaaaaaaaacaaacacgacaacaaaacaacacacgaatgcaacaacgaaagacgaatgcagaacaagacaaaaaagcaacaacgacgagggaggcggaagggagcgagaaggacgcgagaggaggacagacaggaaaaggcgagaacacgagagaaaggcgcagacggaggaccgagcaggaacacagagcggcaagagagcaaaacgcgaacacgagcagcgaagcgagggaccgacagcgaagagagcgagagcaggcagcccggaaagcaaggaagccgagacgggacgacgcagacgggagcggaggagaggagcgaaggacagcaacggccgaaagccgcaggagaacagcgggcgagcaacgcggaccagaccacgcgagggccagcaccgcgaacaggcagcagggtggaggcagacgaagagagacggaagcgcgggagccgacgcacggcgatcaacaacacgaaagagcagaccacgcgcgagcgggggaccgacgggaagcgaagacgacggaccgcacggcaagagcacaagacagtgaagcgacaggaggagcagcgcagacacgaggagaagagaccgacagactcagaacggagcacagcagagagaagacagcgcgagaagcggaggaggaacggggacagcgacgacgcaccaagcagaagagagtgcagcaacaaccggcaggaaacaaggcgcaggctaggacatacaccggagacagcacgggagaagagggaagggaaagaacgagagcgcgcaaagaccagagacagggagacacggcagacagagcgccgacaaagaagaggggagagg

SEQ ID NO: 661466 - DNA, 294 bp, Homo sapiens
tcatctctacacggatccccttcgtcgaacaacaacggctcggttacgcttgctttgtacgggctcatggttagtggttacatgagggcaatcttctagatcaaataataagaaggtaatacctactaagaagaattttatggagaaagggacgcgcgcggcgggatttagggtcgaagccgcactcttaaggggtggattttcctatttatcctttgagttgtggtattccacaatgtaatacttattagatagtacggctaggagggtgttgatttgccgttgcttcttcga

SEQ ID NO: 661467 - DNA, 353 bp, Homo sapiens
tcaagactgcgtgaatggatggtcctggcggtctctactaaaatacaaaaatggccgggcatggtggcgggcgcctgtggtcccagctactctgggagtgctgagtgcaggacaatcacttgtactcagtgaggcagagtttgcagtgagctaacattgcaccattgcactccagcctgggcaaaaagagccagacttcatctcaaaaaaaaaaaattaaaattggaaagttcaaaaatactcctttgatcaggggccatagaatgggatgtggtgtaagtaggctttgacaccaaaatccattatctaggtacatctctgtcagattggcggcatgacaacctggcaatgga

SEQ ID NO: 661468 - DNA, 457 bp, Homo sapiens
tctgtaacttagggatcataaataccttgggcagtatggctgttttcacgatattgattcttcctaccgatgagcatggaatgttcttccatttgttgtatcctcttttatttctttgagcagtggtttgtagttctccttgaagaggtccttcacatcccttgtaagttggattcctaagtattttattgtctttgaagcaattgtgaatgggagttcactcatgatttggctctctgttattggtgtataagaatgcttgtgatttttgtagattgattttgtgtcctgagactttgctgaagttgcttatcagcttaaggagattttgagctgagacaatggggttttctagatatacaatcatgtcatctgcaaacagggacaatttgacttcctcttttcctaattgaataccctttatttccttctcctgcctaagttcagagccaggggg

SEQ ID NO: 661469 - DNA, 371 bp, Homo sapiens
  misc_feature (39)..(39): n is a, c, g, or t
cactgctcggactgggcacggtggctcacgcctgttatnccagcactttggaggcaaggccggtggatcacctgagatcaggagtttgagaccactctttccaacaaggagaaaacccgtctctactaaaaagacaaaaattagctgggtgtggtggcaggcacctgtaatcccagctactggggaggctgaggcaggagaatcacttgatcttgggaggcggaggttgcagtgagctgagatcgcgaaactgcactccagcctaggcaacagagtgagactctgtctcaaagaaaagagagaaaatgtgactcaatctcacaaccacaagaagctgaattttgcctcccaattcagcatgcctggaagag

SEQ ID NO: 661470 - DNA, 142 bp, Homo sapiens
tgagaattagtggttgtatttggatggaaaaacagctgctgtgtaattttattttgctatcgttattttaaatggacatttggtttgaaatggtagatgtctacttttgcaaactgaaagagaatgaccttacctttggatg

SEQ ID NO: 661471 - DNA, 764 bp, Homo sapiens
cataataatgatgacatttgactaccacaactcaagggctacatagaaaaatccaccccttacgagtgcggattcgatcctatatcgcccgtgcgcgttccttactccataaaagtcttcttcagtaagctatgaggctacttataattttgagcgtatgaaattcgcctcttctcttaaaccccgtacccatgagcccttactaaacaatgtaatgctgccacttaatagatgatgtcatcccctcattattaatctcaatcatccgtcagcccataaagttcttggaccgtagttgagtgacatacaacaaaaggatcagaactgaacacgacataaacaataagaagaaacaagaagcggaggggcccagtgccatcagaaagcccgccaaaggggcccaaccaagtcaccgcgcatcacaggaattcttggaccaaagggggttcactcaatggcggagccagtataagtaaggccatagcaaagggctcgacgctcctaaaacggtgcggggactgggggaaatcaggcaagctcggttaatgatttcgccgaagggaaccctgatttcagagcgggcggtcccaaccatttgtgacacaaatcactagacgcagcatttgaatgcctttcatacggtccatatctctaccttcatagagagtataaatggtctcaacagagcgtactaaggcgaccagtcgaaagatacgctaccgagtctgattcttgccctcttaaccagcgcagcgaaagggggc

SEQ ID NO: 661472 - DNA, 269 bp, Homo sapiens
  misc_feature (81)..(81): n is a, c, g, or t
  misc_feature (92)..(92): n is a, c, g, or t
  misc_feature (174)..(174): n is a, c, g, or t
  misc_feature (180)..(180): n is a, c, g, or t
  misc_feature (192)..(192): n is a, c, g, or t
caggtcgactctaaggaatcccctatttccacaggtcaaggtatatttatatactcatctgaactttcaaaagaagttaanggggagatatnctcaacaggcaaaaataagatatccaatctatggtccaagtttatggctccgatataaataaggggctataaacccgtatcnggaaancagtggcgcagngcgtgcttaatgggccagccattgaaaaccaaggtctcattctactcggtctttcagcaggtcagggggtaccggag

SEQ ID NO: 661473 - DNA, 220 bp, Homo sapiens
gcggccgcgtcgactgattaagtcactcacttctctgccaccctcatacttctttggactttgcttcttgccagctggagcgaaatagatggtggggaagcctctgacttcatatggagaaggcacatcattggctgtagcatccattttggcaatgacaatattgggatctttactgagcttctctcccaactctttggtcgacgcggccgcgaattta

SEQ ID NO: 661474 - DNA, 1666 bp, Homo sapiens
ctgcagcgccttcctggaggtgggggccgcccgcgccatggccgccgcccagcccaagtaccccgccggggcgaccgcccggcgcctggcccggggctgctggtccgccctctgggactacgagacgcccaaggtgatcgtggtgaggaaccggcgcctgggggtcctgtaccgcgccgtgcagctgctcatcctgctctacttcgtgtggtacgtattcatcgtgcagaaaagctaccaggagagcgagacgggccccgagagctccatcatcaccaaggtcaaggggatcaccacgtccgagcacaaagtgtgggacgtggaggagtacgtgaagccccccgaggggggcagcgtgttcagcatcatcaccagggtcgaggccacccactcccagacccagggaacctgccccgagagcataagggtccacaacgccacctgcctctccgacgccgactgcgtggctggggagctggacatgctgggaaacggcctgaggaccgggcgctgtgtgccctattaccaggggccctccaagacctgcgaggtgttcggctggtgcccggtggaagatggggcctctgtcagccaatttctgggtacgatggccccaaatttcaccatcctcatcaagaacagcatccactaccccaaattccacttctccaagggcaacatcgccgaccgcacagacgggtacctgaagcgctgcacgttccacgaggcctccgacctctactgccccatcttcaagctgggctttatcgtggagaaggctggggagagcttcacagagctcgcacacaagggtggtgtcatcggggtcattatcaactgggactgtgacctggacctgcctgcatcggagtgcaaccccaagtactccttccggaggcttgaccccaagcacgtgcctgcctcgtcaggctacaacttcaggtttgccaaatactacaagatcaatggcaccaccacccgcacgctcatcaaggcctacgggatccgcattgacgtcattgtgcatggacaggccgggaagttcagcctgattcccaccattattaatctggccacagctctgacttccgtcggggtgggctccttcctgtgcgactggatcttgctaacattcatgaacaaaaacaaggtctacagccataagaaatttgacaagatggtggacactcctgcctccgagcctgcccaagcctccacacccacagaccccaaaggtttggctcaactctgagctcctttccatctcactggactgcagacccggcctggtggggccagagagtccccagctagggacctgcacgtggacgtgggcacctcagtagcggagcatctccacgaaacggggcaccacaggatccctgtgcaagggctgggggcacgctctggccccaggcttgtgccccaccctggcatacagcccctgacacctcctccccagctggtccctacagggctgctcacttcccatcacctctcacagccacctggaacccaagccagctgagctctgaggggctctgctcccggtcttgggccctgggaaccccaccccaccccaccccacaggcgttgtaacctcgaatctgcccagactcttcccttagaagtcacaacatactcagtccaataaacctgtgagcag

SEQ ID NO: 661475 - DNA, 315 bp, Homo sapiens
gggggacaacgcaacctccagtgggggcgcgcacagacagggcacggcttaggaggaatcctgggggacaacgcaacctccagtgggggcgcgcacagacagggcacggcttaggaggattcctggtggacaatgcaacctacagtgggggcgcgcacagacagggcacggcttaggaggaatcctgggggacgatgcaacctccggcggaggcgcgcacagacagggcacggcttaggaggaatcctgggggacaatgcaacctccggtgggggcgcgcacagacagggcacggcttaggaggaatcccggcgg

SEQ ID NO: 661476 - DNA, 205 bp, Homo sapiens
ggaaaagcttgggacactgtccagagtagataccccgttgtctccatggtaccaggtacgtgactaccgaggagcctcagcaggcctacagccatcccctctaccagcagagccacctgtcccagcaccagcagcgtgaggacagtcagctgaagacctactctagtgactgacaggcccagtgccatgctgagctcccattttg

SEQ ID NO: 661477 - DNA, 1867 bp, Homo sapiens
ctgcagcgccttcctggaggtgggggccgcccgcgccatggccgccgcccagcccaagtaccccgccggggcgaccgcccggcgcctggcccggggctgctggtccgccctctgggactacgagacgcccaaggtgatcgtggtgaggaaccggcgcctgggggtcctgtaccgcgccgtgcagctgctcatcctgctctacttcgtgtggtacgtattcatcgtgcagaaaagctaccaggagagcgagacgggccccgagagctccatcatcaccaaggtcaaggggatcaccacgtccgagcacaaagtgtgggacgtggaggagtacgtgaagccccccgaggggggcagcgtgttcagcatcatcaccagggtcgaggccacccactcccagacccagggaacctgccccgagagcataagggtccacaacgccacctgcctctccgacgccgactgcgtggctggggagctggacatgctgggaaacggcctgaggaccgggcgctgtgtgccctattaccaggggccctccaagacctgcgaggtgttcggctggtgcccggtggaagatggggcctctgtcagccaatttctgggtacgatggccccaaatttcaccatcctcatcaagaacagcatccactaccccaaattccacttctccaagggcaacatcgccgaccgcacagacgggtacctgaagcgctgcacgttccacgaggcctccgacctctactgccccatcttcaagctgggctttatcgtggagaaggctggggagagcttcacagagctcgcacacaagggtggtgtcatcggggtcattatcaactgggactgtgacctggacctgcctgcatcggagtgcaaccccaagtactccttccggaggcttgaccccaagcacgtgcctgcctcgtcaggctacaacttcaggtttgccaaatactacaagatcaatggcaccaccacccgcacgctcatcaaggcctacgggatccgcattgacgtcattgtgcatggacaggccgggaagttcagcctgattcccaccattattaatctggccacagctctgacttccgtcggggtgggctccttcctgtgcgactggatcttgctaacattcatgaacaaaaacaaggtctacagccataagaaatttgacaaggtgtgtacgccgagccacccctcaggtagctggcctgtgacccttgcccgtgtattgggccaggcccctcccgaacccggccaccgctccgaggaccagcaccccagccctccatcaggccaggagggccaacaaggggcagagtgtggcccagccttcccgcccctgcggccttgccccatctctgccccttctgagcagatggtggacactcctgcctccgagcctgcccaagcctccacacccacagaccccaaaggtttggctcaactctgagctcctttccatctcactggactgcagacccggcctggtggggccagagagtccccagctagggacctgcacgtggacgtgggcacctcagtagcggagcatctccacgaaacggggcaccacaggatccctgtgcaagggctgggggcacgctctggccccaggcttgtgccccaccctggcatacagcccctgacacctcctccccagctggtccctacagggctgctcacttcccatcacctctcacagccacctggaacccaagccagctgagctctgaggggctctgctcccggtcttgggccctgggaaccccaccccaccccaccccacaggcgttgtaacctcgaatctgcccagactcttcccttagaagtcacaacatactcagtccaataaacctgtgagcag

SEQ ID NO: 661478 - DNA, 1795 bp, Homo sapiens
ctgcagcgccttcctggaggtgggggccgcccgcgccatggccgccgcccagcccaagtaccccgccggggcgaccgcccggcgcctggcccggggctgctggtccgccctctgggactacgagacgcccaaggtgatcgtggtgaggaaccggcgcctgggggtcctgtaccgcgccgtgcagctgctcatcctgctctacttcgtgtggtacgtattcatcgtgcagaaaagctaccaggagagcgagacgggccccgagagctccatcatcaccaaggtcaaggggatcaccacgtccgagcacaaagtgtgggacgtggaggagtacgtgaagccccccgagagcataagggtccacaacgccacctgcctctccgacgccgactgcgtggctggggagctggacatgctgggaaacggcctgaggaccgggcgctgtgtgccctattaccaggggccctccaagacctgcgaggtgttcggctggtgcccggtggaagatggggcctctgtcagccaatttctgggtacgatggccccaaatttcaccatcctcatcaagaacagcatccactaccccaaattccacttctccaagggcaacatcgccgaccgcacagacgggtacctgaagcgctgcacgttccacgaggcctccgacctctactgccccatcttcaagctgggctttatcgtggagaaggctggggagagcttcacagagctcgcacacaagggtggtgtcatcggggtcattatcaactgggactgtgacctggacctgcctgcatcggagtgcaaccccaagtactccttccggaggcttgaccccaagcacgtgcctgcctcgtcaggctacaacttcaggtttgccaaatactacaagatcaatggcaccaccacccgcacgctcatcaaggcctacgggatccgcattgacgtcattgtgcatggacaggccgggaagttcagcctgattcccaccattattaatctggccacagctctgacttccgtcggggtgggctccttcctgtgcgactggatcttgctaacattcatgaacaaaaacaaggtctacagccataagaaatttgacaaggtgtgtacgccgagccacccctcaggtagctggcctgtgacccttgcccgtgtattgggccaggcccctcccgaacccggccaccgctccgaggaccagcaccccagccctccatcaggccaggagggccaacaaggggcagagtgtggcccagccttcccgcccctgcggccttgccccatctctgccccttctgagcagatggtggacactcctgcctccgagcctgcccaagcctccacacccacagaccccaaaggtttggctcaactctgagctcctttccatctcactggactgcagacccggcctggtggggccagagagtccccagctagggacctgcacgtggacgtgggcacctcagtagcggagcatctccacgaaacggggcaccacaggatccctgtgcaagggctgggggcacgctctggccccaggcttgtgccccaccctggcatacagcccctgacacctcctccccagctggtccctacagggctgctcacttcccatcacctctcacagccacctggaacccaagccagctgagctctgaggggctctgctcccggtcttgggccctgggaaccccaccccaccccaccccacaggcgttgtaacctcgaatctgcccagactcttcccttagaagtcacaacatactcagtccaataaacctgtgagcag

SEQ ID NO: 661479 - DNA, 143 bp, Homo sapiens
ttctttttcctctattagcaaaccctatttatagctgcccaagagaaaagagtgtatgtttggcgtggacgaagatcggtttgaatctcatgaaccttgagtgctggagcatcctgatctgtctctatgccaccactggccac

SEQ ID NO: 661480 - DNA, 489 bp, Homo sapiens
tgtgaagggccaaattagagaatgaaaagaagaaaagagaaatagcagaaaaggagaaggagagaatagaacgtgaaaaggaagagctaatggaacgtcttaaacaaattggagagcagacaattaaaggtctgaaaggacctagaagaacagactcgaaaaggtctaaaacttggatcaagaacgaaaacgagcaaaagaagaaggcgaacgactttgaaaaggagcgtcgcgctgctgaagagaggaagagttgccatagcaaaacaagctgccgaccagatgaagaatccggagccggttagcagcagaacttgctgaattcactggccaggattgcacttctagaggaagcccagaagaaaaaggaagagggaactactgagtggcaacacaaagcttttggaggcccaggaagacttggaacagacccaagaagagtttaaaactgtgattgtctgccacccctcattcgcttattccataagg

SEQ ID NO: 661481 - DNA, 1945 bp, Homo sapiens
ctgcagcgccttcctggaggtgggggccgcccgcgccatggccgccgcccagcccaagtaccccgccggggcgaccgcccggcgcctggcccggggctgctggtccgccctctgggactacgagacgcccaaggtgatcgtggtgaggaaccggcgcctgggggtcctgtaccgcgccgtgcagctgctcatcctgctctacttcgtgtggtacgtattcatcgtgcagaaaagctaccaggagagcgagacgggccccgagagctccatcatcaccaaggtcaaggggatcaccacgtccgagcacaaagtgtgggacgtggaggagtacgtgaagccccccgaggggggcagcgtgttcagcatcatcaccagggtcgaggccacccactcccagacccagggaacctgccccgagagcataagggtccacaacgccacctgcctctccgacgccgactgcgtggctggggagctggacatgctgggaaacggcctgaggaccgggcgctgtgtgccctattaccaggggccctccaagacctgcgaggtgttcggctggtgcccggtggaagatggggcctctgtcagccaatttctgggtacgatggccccaaatttcaccatcctcatcaagaacagcatccactaccccaaattccacttctccaagggcaacatcgccgaccgcacagacgggtacctgaagcgctgcacgttccacgaggcctccgacctctactgccccatcttcaagctgggctttatcgtggagaaggctggggagagcttcacagagctcgcacacaagggtggtgtcatcggggtcattatcaactgggactgtgacctggacctgcctgcatcggagtgcaaccccaagtactccttccggaggcttgaccccaagcacgtgcctgcctcgtcaggctacaacttcaggtttgccaaatactacaagatcaatggcaccaccacccgcacgctcatcaaggcctacgggatccgcattgacgtcattgtgcatggacaggccgggaagttcagcctgattcccaccattattaatctggccacagctctgacttccgtcggggtggtaaggaaccctctctggggtcccagcgggtgcggggggtccaccaggcccttacacaccggtctctgctggccccagggctccttcctgtgcgactggatcttgctaacattcatgaacaaaaacaaggtctacagccataagaaatttgacaaggtgtgtacgccgagccacccctcaggtagctggcctgtgacccttgcccgtgtattgggccaggcccctcccgaacccggccaccgctccgaggaccagcaccccagccctccatcaggccaggagggccaacaaggggcagagtgtggcccagccttcccgcccctgcggccttgccccatctctgccccttctgagcagatggtggacactcctgcctccgagcctgcccaagcctccacacccacagaccccaaaggtttggctcaactctgagctcctttccatctcactggactgcagacccggcctggtggggccagagagtccccagctagggacctgcacgtggacgtgggcacctcagtagcggagcatctccacgaaacggggcaccacaggatccctgtgcaagggctgggggcacgctctggccccaggcttgtgccccaccctggcatacagcccctgacacctcctccccagctggtccctacagggctgctcacttcccatcacctctcacagccacctggaacccaagccagctgagctctgaggggctctgctcccggtcttgggccctgggaaccccaccccaccccaccccacaggcgttgtaacctcgaatctgcccagactcttcccttagaagtcacaacatactcagtccaataaacctgtgagcag

SEQ ID NO: 661482 - DNA, 1648 bp, Homo sapiens
ctgcagcgccttcctggaggtgggggccgcccgcgccatggccgccgcccagcccaagtaccccgccggggcgaccgcccggcgcctggcccggggctgctggtccgccctctgggactacgagacgcccaaggtgatcgtggtggtacgtattcatcgtgcagaaaagctaccaggagagcgagacgggccccgagagctccatcatcaccaaggtcaaggggatcaccacgtccgagcacaaagtgtgggacgtggaggagtacgtgaagccggcctgaggaccgggcgctgtgtgccctattaccaggggccctccaagacctgcgaggtgttcggctggtgcccggtggaagatggggcctctgtcagccaatttctgggtacgatggccccaaatttcaccatcctcatcaagaacagcatccactaccccaaattccacttctccaagggcaacatcgccgaccgcacagacgggtacctgaagcgctgcacgttccacgaggcctccgacctctactgccccatcttcaagctgggctttatcgtggagaaggctggggagagcttcacagagctcgcacacaagggtggtgtcatcggggtcattatcaactgggactgtgacctggacctgcctgcatcggagtgcaaccccaagtactccttccggaggcttgaccccaagcacgtgcctgcctcgtcaggctacaacttcaggtttgccaaatactacaagatcaatggcaccaccacccgcacgctcatcaaggcctacgggatccgcattgacgtcattgtgcatggacaggccgggaagttcagcctgattcccaccattattaatctggccacagctctgacttccgtcggggtgggctccttcctgtgcgactggatcttgctaacattcatgaacaaaaacaaggtctacagccataagaaatttgacaaggtgtgtacgccgagccacccctcaggtagctggcctgtgacccttgcccgtgtattgggccaggcccctcccgaacccggccaccgctccgaggaccagcaccccagccctccatcaggccaggagggccaacaaggggcagagtgtggcccagccttcccgcccctgcggccttgccccatctctgccccttctgagcagatggtggacactcctgcctccgagcctgcccaagcctccacacccacagaccccaaaggtttggctcaactctgagctcctttccatctcactggactgcagacccggcctggtggggccagagagtccccagctagggacctgcacgtggacgtgggcacctcagtagcggagcatctccacgaaacggggcaccacaggatccctgtgcaagggctgggggcacgctctggccccaggcttgtgccccaccctggcatacagcccctgacacctcctccccagctggtccctacagggctgctcacttcccatcacctctcacagccacctggaacccaagccagctgagctctgaggggctctgctcccggtcttgggccctgggaaccccaccccaccccaccccacaggcgttgtaacctcgaatctgcccagactcttcccttagaagtcacaacatactcagtccaataaacctgtgagcag

SEQ ID NO: 661483 - DNA, 1871 bp, Homo sapiens
ggcacagcaggaccgtcattgactgccatgagcgcgctgttgcgggtgctgcgcacggtggtgccccaagcgtgatgtgtgcctgcggttggggaccagttgccagggaccggggtcgcgccgtgcataatgagccttgtaaccacaactgaggagcgcggccagcccctgttccgaagaatttaaccggcctccttcgttcaacgaactcgttaccctggtgtccagctaatcatttttcccccccttttccatggattattcccttctggacagggttgaacctccttacaaggacggcaaccatgtgggaattcccttactgacaggacaaacggcagtgcgcagttggattgacattatcgacgaaatctggtctacatattgatgggtacgaaaaatacctcgggcgggaacaacatggctcaaaattggacggattgccaccaaagggacgcccattgaattccccatttaaacaattcagtgtaaccgcgatgggaaaagctacgcatatggtgcgcgaactatctcttcccttaacaaggggctcactcatctcggcaatttagtggtaccctcccctacaaacttggggaaggactcccctattgaacaaagcattaagcaggcacgagctgctttgggaggatacgtgactcctactcgctgttgggaaaatagggtccaaagattccctcttggtggcagacatttatcactgttgaagctccttggaatttgcgcgcctactggctgaccgtgacaccggtggcactatgggctcaactcggatgatcctgaagcccaaaggtacagactttgtgtgtcaaacgttcaccggttccggaacactctatggtgcaccatcgcccagtaacccaacctgtatgtgacaaaaggcgtttggttaccaagagggcgaacagggtttaccgctctctttccgcttctctacttcctcgtcttcgaataacagccaacagcacacccacaagccagaagaaacatgagactaaagaccgccaccaacagacacacagccgcgagcaaagaagaggagaagagaaagagaaggagaagagggaggacagaacaaagaaaacacaagaaacaaagagagacagccgaaaaaaggagaggacagaaaggagagaggaaagaagaagaagaaaagacaagagagaagagacacaacgagaagaggaggagagaacacgggaagaaagagagacagcacaagcaagcagaggcaagaagagagacaagagaagaaggaaaaagagaagaaagacaaagaaacaagaaagacaaaggagacagaacacacgacaagaaagaaacgaggaaaaccaaggagcacaagaaaaggagaaaagaagagcaaacagagcgacagacagaaaatgcagaaacaagagacgaaaatgagaaacaaaaggaagaagcaaaatagaagaaacagaaggaagagaaaaagagagaagagagcagaagcagacgaaggagggaaggagacaacaagacgaacaggcaaaaaagacgagagacagaggcaggaacgaggagcgagacagagaccgaaagcagagacacaggcgagaagaaaagagagaacgagagagagaaagagacagcgaaagaaacacagaacgaacacgaacaggaccgaaagagagagcgaagcgagcacgcgagacaagaccgaagaaacgaagggaaacagcaacacacaagaacaagagacacgagagacagaagagcagcaggaagacagaaaacacacgaacacccacgccacacgacaacagcaacaaaagacaacaaccaaagaaaagcacgacacagagcagacgagcacccgaaagaga

SEQ ID NO: 661484 - DNA, 1598 bp, Homo sapiens
ctgcagcgccttcctggaggtgggggccgcccgcgccatggccgccgcccagcccaagtaccccgccggggcgaccgcccggcgcctggcccggggctgctggtccgccctctgggactacgagacgcccaaggtgatcgtgccccgagagcataagggtccacaacgccacctgcctctccgacgccgactgcgtggctggggagctggacatgctgggaaacggcctgaggaccgggcgctgtgtgccctattaccaggggccctccaagacctgcgaggtgttcggctggtgcccggtggaagatggggcctctgtcagccaatttctgggtacgatggccccaaatttcaccatcctcatcaagaacagcatccactaccccaaattccacttctccaagggcaacatcgccgaccgcacagacgggtacctgaagcgctgcacgttccacgaggcctccgacctctactgccccatcttcaagctgggctttatcgtggagaaggctggggagagcttcacagagctcgcacacaagggtggtgtcatcggggtcattatcaactgggactgtgacctggacctgcctgcatcggagtgcaaccccaagtactccttccggaggcttgaccccaagcacgtgcctgcctcgtcaggctacaacttcaggtttgccaaatactacaagatcaatggcaccaccacccgcacgctcatcaaggcctacgggatccgcattgacgtcattgtgcatggacaggccgggaagttcagcctgattcccaccattattaatctggccacagctctgacttccgtcggggtgggctccttcctgtgcgactggatcttgctaacattcatgaacaaaaacaaggtctacagccataagaaatttgacaaggtgtgtacgccgagccacccctcaggtagctggcctgtgacccttgcccgtgtattgggccaggcccctcccgaacccggccaccgctccgaggaccagcaccccagccctccatcaggccaggagggccaacaaggggcagagtgtggcccagccttcccgcccctgcggccttgccccatctctgccccttctgagcagatggtggacactcctgcctccgagcctgcccaagcctccacacccacagaccccaaaggtttggctcaactctgagctcctttccatctcactggactgcagacccggcctggtggggccagagagtccccagctagggacctgcacgtggacgtgggcacctcagtagcggagcatctccacgaaacggggcaccacaggatccctgtgcaagggctgggggcacgctctggccccaggcttgtgccccaccctggcatacagcccctgacacctcctccccagctggtccctacagggctgctcacttcccatcacctctcacagccacctggaacccaagccagctgagctctgaggggctctgctcccggtcttgggccctgggaaccccaccccaccccaccccacaggcgttgtaacctcgaatctgcccagactcttcccttagaagtcacaacatactcagtccaataaacctgtgagcag

SEQ ID NO: 661485 - DNA, 427 bp, Homo sapiens
cgttagtacccatttagtgacaaaggattaaaccatccctctggatgttaatttggaagatgtaaattatatgttgtttaaatttttccaggcatctgaaccccttatctgctagccaatgtaagattcccacagagttatctgggattctgattttttaaatagcacatatcattaacccattttctttaaatgtaagaagagcagctaaatttttataagattatcagatttttctaaggccccagaaatgtaagaaaaaaatccctttatattgaaaaaagatgcagtcacccccccctcaaacaggcccaaactttaaaaatttcttcacccatctaatgctataaagatttttgttcttcctgttcacaaccagttgtataacagaaatactagctactgttttccttcctgtgtggaagta

SEQ ID NO: 661486 - DNA, 131 bp, Homo sapiens
tgactctacaggatctccgtcgacggtaccaacaagtcttaatattcattctttccaatgcccactatggaagagttagaaaaatagaacatatgcttcttacactagcacgagaggaaaatatgcatcca

SEQ ID NO: 661487 - DNA, 175 bp, Homo sapiens
tctcagaggttcacgcactctcatcaatagcggcacagttcagaaatagtcagaccacatctacaaaatgccagtatcaggcggcggcttctaacccgaagtgatgtttggatgtaaagtgaaatattagttggcggatgcgctataaatagagcaggttggggtaccgagctcg

SEQ ID NO: 661488 - DNA, 947 bp, Homo sapiens
ggctcttcatgttgctgcgggggcacagtcccttccggcagcacaagatcaacgacaagcatgagatcgagcgcgtgatgctgacgatggccgtgggagctgccccgagctccttctcccctgaactacgactcccatgctggaggggttgctgcagagggatgtcaagccggagattgggctgcctgggccgaggggctcaggaggtgaaagagagccccttgtttccgctccctggactggcagatggtcttctatgccgaagtaccctcccccgactgatccccccagcgaggggacggtgaacgcggccgcacgcctatcgtaccattggctccgttacgagtgcagtgaggtgactagcataaacggaactcaaggattagctgtgatcatgctgagtcacggaggctcatacgcgcaagcgttccccgctcacacactctcgggagcggctggcagcaaggaggttggacagagagcgtgtgcgttacgatcaaccactcaaccggcatgcagacaggacccgggcatggtaggcatcggcaaggaagagccgggaaccaagcacgctggggccagtgacggaagacatacgcccttgggcaaaggacgtgcattcatgcagtggctacgatgtccgaacgattgggcaagcctccttcgctgacccaagtggcaggcggctgagtagcattcgtacctgtacccgcaacgcgcctcgagtgggcgggggggaggcgcgaggccccgcggagacctggtgaccatggaggagatccagatcggtgggggagacgcggatcacggagcgcacagtggctgctcctcaagatccgcggaggggaaacggcaataagcagtgcgatagcgacccgagctgggtgcagaggaagaaggagtgcgcgaggctccgagaggcccaggagctgggccagcgggtgacc

SEQ ID NO: 661489 - DNA, 236 bp, Homo sapiens
cacactatatgtattattaagtagagacggggtgtcaccatgtaggtacaggctagatctcgaactcctgacctcatgatctgcccaccttgggctcaccaagtgctgggattacaggcgcaacccaccgcaccatctctgtatacattcacagacgtgtgtgtgtgcatttgtgtgtgtgtagtgtatatatggtttgttcgtttaaatagcaccaccttggattctgtgctata

SEQ ID NO: 661490 - DNA, 414 bp, Homo sapiens
  misc_feature (12)..(12): n is a, c, g, or t
tctggacagctngctagatatcaaacactactagagacaagaaaaataaataaataaaaatagcttctctttaggccatgaaataaataaaattaaaatctcccttgaaatttaaaacttaaatgtgaaaaagattacaaagaatattttccaagtgaagaatgacaaagaacagagtacacacatacacacacacacacacacaaaaactgaggaaacatataatatgttaacagggaggattaggttaataacaatattagcatctcatttatttcacattttattaatttatctgttcatcatctcatttattcctcacaattaatctcctaagggaggttaatatttaaccccattttgggccgggtgtgggtgggcttcacacctgttaattcccaggcactttgggga

SEQ ID NO: 661491 - DNA, 557 bp, Homo sapiens
tctaagtcatgaagagggtgtagtcaggaagcatctaatccgaggggctaggcagctgagctggccctggctcccacaggcccttcctctaccactggcttcgatacaccgggcctggagaactagagaaggacccggaggggcctgggagccgtgccttcagctctacagcatggtagcagtctcactcctacctggtaatttaagattccagagagtggcacctcccggtgcccaagaatagatgctgactgtactcctcccaggcgccccttccccctccgatcccaccaaccctcagagccacccctaacgagatacttcgtatcttcaacgcagccctgctttgggctgccctggtgctgccacacttcaggctcttctcctttcacaaccttctgtggctcacagaacccttggagccaatggagactgtctcacgagggcactggtggcccgacagcctggcacagggcagtgggacagggcatggccaggtggccactccagacccctggcttttcactgctggttgccttagaacctttcttacatta

SEQ ID NO: 661492 - DNA, 125 bp, Homo sapiens
agtgattacgcagttatgaggacgtcacttgtatcccctagctggttactgacggtggggcagtaataacaggacgagatagtgggggtcttagttggacttggttctttgctggcctctgtgct

SEQ ID NO: 661493 - DNA, 904 bp, Homo sapiens
  misc_feature (423)..(423): n is a, c, g, or t
agcgggctacccgggtaacgggtcccggctgctgtgaagctcccgcggggccgggatggacctcgaggaggcggaagagtttcattagaacgctgtactcagtgtgctagcctgtctcatagggggtactaaacgagacatatagatcgaatgaaatataggacgctatctagaatctatcaaaacttacctgaggatgattgtcatgacagttgttaactacgtgaatctttattcctgggataatgcctaaataaaagaagactggcgtcggacgcggggttatcgacaacataaaaatatacggaaaatgaatatcagaggactgaacgaacatacgatataatttcaacaaaagataacctgttatgatgacccttagacacttgcgttaacgatgacccggataatcaacaatcctgnaaagatatcaactcctacaataagacatcgaaaccaagaacaccatggatagaggagaacccaatatggcatctaacccgaacaataactattcaagacaaattcacaaacacaagaagaccgcaaaaaaatggaccacccagaaagaaaacacccggactgcatgagcaccaattaaggcaacgaactggacaagagcttgatcattcatcaaaataacgggctcagacccattcgaattgattagaagttcacacaattttccaactcttgcaacaatatatatcaaacatgcgctatgtaacacctatatgaaaccatctgagccgcttaattaaaagtcttatggcctcttacaaagctgactgaaaacacttgtaccaataacaactggcaaagacaacgactatggatcgacagttgaagagctaaaagaatactgcggaggactttatataatttataactttgaatgggaatc

SEQ ID NO: 661494 - DNA, 132 bp, Homo sapiens
atatgctgtctagtctgtgccgagcagttatatgggtggggtaggacagaagattcaataagagataatgaagatgggatggaggtggatacatacaaagttgctggacagatgaggatgcagatgttgatc

SEQ ID NO: 661495 - DNA, 275 bp, Homo sapiens
tgaggtgatctacccgatcttatctaaatggctgtcagattcttcttgtaacctttaaggacatgaatttttcttagtcttgaagacatgtgagatctgtatttttttttttggtaaaaaaggtgaatttttgggtcctctaattggtggtggcccggtgtactccctgggtggtaaagtcatctgaatcctgggttctcttaatactcaccaggtacaaataacgggtatgtttaataacgccgcagctagggtacacagccatttaggtatgt

SEQ ID NO: 661496 - DNA, 442 bp, Homo sapiens
  misc_feature (287)..(287): n is a, c, g, or t
cgcatactctcggctcagctctgagtagctgggattacagggcattgcacacacccagctaatttggtatttaaggtagagacggggtctccatgtgggtcaggctggtctcaaactcctgacctcaggtgatccggcccgcctcggcctcccaaagtgatgagattacaggcgtgaaccaccaggccccaccaaaaaaagttcttcatttacagaaaagatcatgacgcaggggacgggactataaagcagaccaaaattccccagaggcccgtctcctatctcgnctaagaagcaaaaaccttagagcaatttgcagggacacccgtggagtggaagcaacaggggctgggtaaggaggtaaggaacacataaagcttaagccatgggggaggaatgggaataaatactaggacttgactgcaaaagaaagacttatgac

SEQ ID NO: 661497 - DNA, 1435 bp, Homo sapiens
  misc_feature (928)..(928): n is a, c, g, or t
  misc_feature (1194)..(1194): n is a, c, g, or t
tcactgttgttgtctctttgttgatgatagtgtttccttctcctaacatgtgttttcccctcgttggtgtggggggggaacctacttcccaactacacacacagttgtgggtgttctctgtgttgtttgaattgttatacttggcttcgtgtatgatacacctctcctgtttggtgcggcactatcctgtctggatggtgttcttttgtttggggctcccatcgtggctgatggggtgggtgggtgagtgccccgctttttgttcaaccagcactctgcgtcttggttggccaaattatcctccttttttgggtatcgctctcttggtgcccccgcctttcgtgactgttgtagacgcgtctttggtttttctaggggggtgcacccctctttttggcccgcacgtctcgtcgcagatgagtcccccccccgacttggggggttgtcgccactccgcaatgtagtgagagcgacccgcccaacgatgttgtgttgtgtaaaatcacagcgagctgctcgtctcgatagcatggtcttgacaccgcgggtggtttgtgctctctgtgtgagcgatgcgctctatttttttgtgcgctgcgtctttgtttccccccgctcgcgctcactgcatgactcgccctccttttgtgtcacatcgctcgcttatggatgggcctctcctctatatattctcgccagcgcgctggtgttgacccccccgcctcgtagtgggtagacccatctctctcgggcgggtgtgagcgagagaatgttattttcttgcgcacgcgcgctcttcctcgcctgcttcttgttgtagatagaaacctctctcgctgtcgagggggctgttatctcataaataggcgcgcgagattttttctcacaagagagagaagggagacacatatattccttttcgtgaatnattctcgcgcggaccccctttaaaggggcggagatatatctgtttatgtggcgctcagctctttttgtgagagagtggaagagacaatatagtcgccttacattcatgttgtcgcggcagagcgtggtattcggtgtcctcacccctctctcccaagatagaagccctctttttttccctctgaaaagtgcacacacttatcccacgaaagaggtcacatacacagggtgttatcacaacaccgagagccacactagagctccacnggtggttccttcggagagcggcattgagaggggacacaccaccgccgcaaaaactccttacagcttttcatagaaggagacgaattggggccaccgagaacacctcggggagagagaagggccaaattctccttttttgaggggttatatgtgagaccccgcgtgggggttgttatattttttttttttttatatatttataaattttggttttaaaaaacccctcccattttgaaaggga

SEQ ID NO: 661498 - DNA, 1024 bp, Homo sapiens
cggacgcgtgggtcgcagctcatggtagcggaacgcaaggctaaggccgagtgttgatgagctgcggatgccgaatacggtgaattggaggagagggatcgaagggagagcaagaagatcgacggatgaaggatgccctgttgggcattcggcaggcagaaggtagcagatagaacgacctgcatcgccaggctggagtgccaccaacatgaggaggaggtctgtctcagagactggatgtgactggtcaggcttttgatggacatgccggaacagaccggtcggttgctactgtcagttgcgccgataaggatgatgccaactttaatcctatggtgtcagagcggatcaacgggccataccagagttctcaagctgctgcgggcacggagaaggactgagttgggcgagccggtccttgagcctcgaaatgtcccaggtggatgccctagctgctgactgtgcagaatctggatggagatcgtcgcgacgccttggtggaggcaagctcgcgggcgtgttgaagacaggtgctgtctgctgctcatggcacagcgcctggagctcaaccaaagcgtaaggctgtagaagcctgccagctgtgcgaggacctgaacgtgcacgctggagtcccgtgcacactcgggtgcggggagatccacaccttgctgcagaagccgtggtgatcgtgagaaaggagagttcacctaggaagtgtcaagaggacctctgcctgttggcgggcagctggaaaagcccagcaaaggtgggtctacgcgaatgcgagcaacacctcagagggaatccaggggcacaggaggggtgacggtcctgtggtttaccgggaagagtcgccttacacaggttccggtatggtcaatgtatggtgccatatgcgcaaaaataccagtacgagctgtcgcgacacacatactggagaaacaagagacacacggggggtataaagaagagagagaataatgcagtacgaaagaatctaggcgtgaaggatcgtgttgactag

SEQ ID NO: 661499 - DNA, 576 bp, Homo sapiens
ggcggtcccgcggcccgcacaagaggggaaagggtgtccatggcggatgagacggaccacctcattctcctggctatcatggccatcaccttcgacgtctgctccttgcctttcacgattttcgcatatatgaatgaaacctcttcccgaaaggagaaatgggacctccgagctcttagggttttatcaattaattcaataattgacccttgggtctttgccattcttaggcctcctgttctgagactaatgcgttcagacctatgttgacggatttcattatagagcaccagatgcgtcacagacttgctgtgctacacagtcagatgccagtgaacaggctgacctttgaggtcagtagtttgtgcttagctatatagcatctggaagatcattctggaattgctccctggagaaatgagaacagtgtgtgaacacaatgaagctgtcctaataggcactctatgtaacgtgtcagaaggagctacacaacctatcctgaatgagcatggtacttggcctttgaggaacccggtgtatcgaagaccccctgtctattgagttgctttattggtg

SEQ ID NO: 661500 - DNA, 295 bp, Homo sapiens
tgcgacacgaggatttgtgtgaggcaaaaggtgtgataggctgccagaaggacataagcagtcctttcccattctattagctccctaaattagccaaatagagacttcttttgtcaaatcaggaaatctcacaaaggtcaattcagatctgacattgacagacagttttgtcataacccgttgcactgcagcacctagtacagttccttggaaacagcgtggctcagtaaatttttactgattgattaaatgtggggccagaagattgttagaagagtccctttctgggttgcta

SEQ ID NO: 661501 - DNA, 428 bp, Homo sapiens
ctgtgtctctttaggtgtgcttatctgggagggagttgtgtgtctgtttccatacatcttcctgcagctgcaggcatacccccaggtctgcttttagcttccctatcttagtgcacctgaagggaaagaatgtgcttattaaggcccactgttatactggggcccaatgtatgagggtgaagtttggcaattacccaagagactttccccccacctccctctgtgcctgagctgtctcatctatgttttactgtctgctctttctgtctgcttgttgttagaagagaagtgattttcttgaaatgcatgaggctggaaagggagctggcacttaaagtggcggtgtttgtccgagaggatggtgctcctgctctgtcacagtgggcatggggattcagccactgccaccgaatttcaagagcccaagc

SEQ ID NO: 661502 - DNA, 352 bp, Homo sapiens
ctatttacatcatcattactaattatactaattataacactttgcggcggttcaaaacgtttctctctacaaaaggctttcatgattattattttggtcctaataacaatcctatgacacagacagaaggaatggtgcccacccattttacagatgggcacatgccattcagaaaggcttcaacacccaatcattaagtggtggaccgggctgtaatgcaagcctttgaattatgagttaacatacctttccatacactgtgcacacactttaatattttgcacgttaaaatgatgtgagatcatctttctatgttttaaatactctttatatatgcccagttaatacatat

SEQ ID NO: 661503 - DNA, 1644 bp, Homo sapiens
  misc_feature (858)..(858): n is a, c, g, or t
  misc_feature (1227)..(1227): n is a, c, g, or t
attctagttgcttgtggagtagcatgttgcgtcggtcggctgtgcttgtatgatattgcgagtgttgtcttggtgccgcccttattttgtgtggtcaggctccagcggttgatgagttgtgttcgttgtggtgaggggacaggccttggttgccacggcctggtctcgtctccccttgtgtttgggaacgacatgttgcggtctgtgttgttgtgtgtgaggtgttggtttatgtttggccacggcgtccccccttgctcgccccggtgtgggtgggtgtggtcgatactatgtgctgttactatgatcatcctccccacttctctgcgggggttacagaccacttttttcccgcggctgagcccacctccctggagtgtgctggggggacataaacaaggggcgggtacatcatttttttttagatgaggagagacactggggtggatgacacacacacgaggaggtggcgcgcccagagggggtggtcttcattaatgtcgtttccgtggccagctggtgggggtatgagtcgccccgtgctgctctaggcgagtgttccccccccaaagaatgagtgtctgtgaatgagaagtgccatgaagctggttgggggggccgtcactctccgggtgagccgccccgacgagcgatgaggttgtgttgttgttagaagtagtgaaaaggggtagaaggattgtggtgtgcagcacccgcttgttttatagaaggagggtttgttttttgtgtgagtgtgggtgtttggcgcttgtgttcgttatgttgtgtgtgtgtgtgtgttctttttttgggagacgcacacgttctctggcattcttgggtgcaacaccaccccancgcgcttcgggggggtgcgcacaccagcttggcgcactgtgagtggtttttgcgcacacccgcttgtagtgcctctcccccgcggtgtgcacagacgcacagatatactttgggggctcgcacacacgccgctccccgcccacagtttatatctttgggaggagatacacacagtgtgtgcacccgcgttatgccacacacccctcgggcgtgggaatattctcttgtgtttgtgtgtcttggtatgagagagacacacagaggtgtgtgacgcaccgcacacttgtgtggcccccagcgtgttgtgtgttcgcacacaactctctctctgggcttctcacgcgcgcatttccacacaccgccctctgntgcgccttctcccccacacagcagtggtgtctctagagagtgtacacacagcgggtgtgaggcccccgccaccaccccgcgcctcatattgttttgcttcttcgctgttgtttacatatttaataagattgtgggggggggtgtccccacgattgtgtacaccctcgggctgtgttcttcgcaaactcctccgcgcgccttgtaggagcgcgtctcctctctgggctccacaagcccacctatccacgcttctcacagcgtgttttttacactataaaagagacacctagccctcttttttttttaatactgcctccccatcgtgaagagattggctttcacccctcccccccatcgagttttgagaggccctcccaccccccctagaactgtaaatccccaaaaacctttttttta

SEQ ID NO: 661504 - DNA, 237 bp, Homo sapiens
gccctgacaaagacacatagcctaccccttcctgtactatccctatgagaacaagctccaatgcatactcttcaacatcattcaccggcgcagtcatttctcataaatcgccccacggggctttaccattccttcaatttacttatttctggcctaggcaaaacttcaaaacttaacgaaacggccactccaacaggttcggccatccaattaaattcccttcttcttctaagggaa

SEQ ID NO: 661505 - DNA, 317 bp, Homo sapiens
  misc_feature (17)..(17): n is a, c, g, or t
  misc_feature (23)..(23): n is a, c, g, or t
  misc_feature (174)..(174): n is a, c, g, or t
  misc_feature (228)..(228): n is a, c, g, or t
cttttataacatggtanctgtanagatgatctgggtaaggctgggcatggtgctcacgcctgtagtcccagcactttgggaggccgaagtggctgaatcatctgacgtcaggagttcgagaccagcctgggcaacatggcggaaccctgtctctactaaaaataaaaaaattgnccaggtatggtggtgcatgcctgtaatcccaactacttgggaggctgaagcgtnagaatcgcttgaacccgggaggcggaggttgcagtgagctgagattgtgcctctgcattccagcctgggtgacagtgagacgccatctc

SEQ ID NO: 661506 - DNA, 667 bp, Homo sapiens
  misc_feature (448)..(448): n is a, c, g, or t
cagggtggctcccacctgtaatcccagcactttgggaggccaaggcgggatgatcacttgaggtcaggagttcgagaccagcctgaccaacatgataaaactctgtccctactaaaaatacaaaattagctgggcatgatggcacatacctgtagtcctagctacttgggaggctaaggcaggagaatcacttgacacctaggaggcagaggttgcagtgagctgagatcacgccattgcactccagctgggcaacaagaacgaaactctgtctcaaaaaaaaaagaaaaaaagaaaaaaagcatatcaaggtattttttttttggtttttttttttgggacccgggacctcgtgtgttattcgggaaaggtccgggaaatttgcagtttatacgccgtggggcctcttatatgtggcaaatgtgcagttccctgtgggattacccancgtgggtggtagacttcttagaacagcgttccgtgaaacttcctttatagagcctctccgagttcctcattctttaaaaacaagagcattattgttggcgggtgtcgcttttaccttcaaacaagaacgtgcgtgggggggatactcataattaccaccttttagagagcccatttttacacggggtttttaattaccccagtattgaagagggcgatt

SEQ ID NO: 661507 - DNA, 615 bp, Homo sapiens
ttgctatacaccagtatgttgaccagatgtacaagttttcatcgctaacctgtcatgctcaggaggataggacagttgtgcttggttgcaacgtagtagacaggacagagcgtcactctagtccataattgtcctcagtatcggtcaacgcaacgatacagaaaagttcctcagtgcacatagagcatccacattattgcatgtaataccagaagatcacgacacagcagttcgccggtacaatccactgcacactgtggcctatacactttgtacatttaattgatatttgtgctgaggtgatattcctgtctaaaagaacaacattgtcttttcttttctagcacagagttatgcattcaaagatgcattacctagttagtttcctatatattcatgccatcttgaaaagacagactatggtgtaaccatgattctattatgtattggtacgtctgtagaccaagatataattttttaacaaataagtttatttcttttcaaggtttacaaattaacaaaggtgcaccttgtatttacaaattgccattatagatgaggagcgtgcattgcacagtcattttgttctaagagtaatattgtcaatgtaataga

SEQ ID NO: 661508 - DNA, 523 bp, Homo sapiens
cgtctcatcatagaatcctactcatagtcagtctccccgtagaacctgtcctgcacaaggtgctcggaatcatgcagcaacaacttttgcgctatacacattgagccattattcttaaaaaacaactcattttataaccaaggaaattgaggcttatagttagaccatagtctaagctgcttctgtgtttacaccctgctctgtctatctccagagctctatgatgggatattatcctgaattacaaggcttatttaggaatccatttgagtccagaactaggctccaaaatatatcggaatttagtatattataccgtataatttccaatcaatgagaaaaagatgattactcaatgtattaagtctgataaatgctgattaatacataccctagatctgcgtaatttataattaagatgaggttcaatatactcacaattcgacgtgtttggcgaggtctcacaatctcggccgaaggtcatagacacgtcttacattgcatcaggattcagaatatgata

SEQ ID NO: 661509 - DNA, 1098 bp, Homo sapiens
  misc_feature (362)..(362): n is a, c, g, or t
cggcacgtaagcgaatggcacacggtaggaaggaatgggaagaggcagagcttcaacgtcgtaagtaacctccccaaagcacgagaggcagactctgatacagcagttccaagccatggttaaagctttagtagaaggaagcagtccaggtgagaaagcgagacagccttggttggagaacccactctggtcggccgagtggaatgctatgctgaagtgaccgctcgatcggaatggcatcatggaggaactaccgtggcttgtcattggcagtctgatcccgtcacaggcggtcctcgatcgcagttctccgaagaccgttaacgggtcggtctactggtccgcggcatggagagagcaanatgactcgtggcgttatgatatccacatccgttacactgtacccagcacatagtgttcgcgtgccgtgttgaaccccagaatatacatgcgcctggcctcaagactgacacactacccaagggctgagtgaatcaaccatccgtccaccgggtgcaatttgaataggacatagggatggatatccaaaaggccattctctcatgcatcataacatagaggtaccttactagtagggcgcgaacgaagacttgcaacgacgcgaaaattctcgagtgacggtctccgttccagcgtagcagggccgcctgtcgaagaactaaatggaaccgaggtctcgagcctggcaacgtcccaggatccattcaggagtaaccccctatagtgggtaaacgtttcgccggggttgaaggacatcctgaagggagcagttgaagggggaagaaatgccacaactcgttttccacatctcccacttattcccatccctcttgtccactcaaagagcgcggttatccatagaaattaaaccggaaaaagaactactctctatggcccgggggaaggctttctttaccaaagacacctaggtttgtagggttaaacgtgggaattccgtgggaggctggggaaacggaggtcaaggggaatataggaagggaaactcttcggatgccggggccgggcctcgaagagtaagataaccgggtgatgtaaattagccccacgagatactaa

SEQ ID NO: 661510 - DNA, 253 bp, Homo sapiens
gttcatctcatttgctgtgaacctaagatgctctgaaaaataacagcctactataataaagttgaaaagatgccatgtttgaagaatgctgtccacgtaagcacaatctcttctcccttatagcttctgttcttggtagagctacttcgattaacaatggtgcctggcatagttacacagagtaccataggactagaccttttcttcgagtacagtgcatctacccaacgggtaccgagctctgcaattcgtc

SEQ ID NO: 661511 - DNA, 115 bp, Homo sapiens
aacattgcgaacggactgatcagggcgagtgtgtgtgtgtgtgtgtgtgtgtgtctgtctgtctgtctgtctgtctgtctgtctgtctgtctgcctggatcagtccgttcgcatg

SEQ ID NO: 661512 - DNA, 249 bp, Homo sapiens
aagtctctagataagctcagtcatagctatcaggatagggatgtgtggtagtttgagtgtggtttgtgtattgtgtatatggtttgtgtgcatgtaatgttggtggcatgtggtataaatggcatgtggggtgtgtgtgtgcgagggtgtgtgatgtgtatgtgtctctgtgtgtggcaggcatatggtgcatgtgtggtgtgagtgatgtgtgtgtgatatggtgtgtaaggactttcggcgtgtgca

SEQ ID NO: 661513 - DNA, 1885 bp, Homo sapiens
ggcgctccaggcaggtggctttggcactatcgctcgacccacgcgctccgtatacccacacccacccaagaacacgggctcgctcaagatggcagagcccggctaatcgcatacaaacttaaaactttacagtcagagcgttcaatatcctcctatctataacaacatacccactggccaacccatcctactcctcattgctacccacttctaatcgcaactgcgccaattcctaactgcttaccgaaccgacaaacattcctagcgctactaactacaacatacgcccaccaggccaccaaaacggataggcaacgcccccttacggcctctactctaccacaccctatcgcctgacagccactaacaaactcttcacccacaaagcagccaccatacaaaccccagacacaactcataccactcaaccactcatacaataacacgacaccccgcaccactatagcctcttcaacacaatatcgccctacatttcataacctacctgcaaacgcaccaccacttaacccaaccttacatcgctacatcccccccaccctgcgcatcacaaacatcctcccacacgcctatcaaagataccatcacctaaacctctcacttgaacactaacgacaaaagcccctaccccaacgacaacactaagtaaccagcctacttcaccctccgacagtaacgcacacacagacaaacacacacggcggctcggccggcaccccttcccacacaaccctccgacagaccggcacagacaacacagggacgacacggacccgacaacacctgcgacaaagacaccgaacgacagcccaagacagacaaacaccactccactgaccaatcaccgcaaaaccgaccccaacaccactgaagacgaaccatacaaagaaccgtgaccagacaaatcaagcacgcaaccaaccatacagccacaaccgcacaggcgcacgtcacacgtcagcacaacccatccagtacaccgcacaccccacccgaaaacacacacacacaccaccgaccagccaacagcaagcgcagcacccagcgcaagacacacacaatgctgaacacacaaccagagagggacacacccaagtcggggccgacaacccgacactaactgcgacagccccaccagccccacccgcccacaacacgccgaaacgacgcacaccccacacacaccgagcaacccgccacccaatgcccagcacccactcgacccgcagcacaggtagcgcgacccctaagcgaaacgagcgaggtaaacgcgcgcgacgcgatgacacgcccacgacgacgaaagcaagcaacacgctccacggcacaccctagcgcaccacaccaacccgcgccaacacgaccgcgaccatccaaggcaccagcagaacaaagacagagagaccgaggcagactcactcacaaccaccgagaacacacccaacacacgagcacaaccgcaccgccgaacgccaccacgccacgccacgcactaggaacccaaatccgagaaccagccagagacagcgacgtaacaacacaagagcgcgccaggcgaggctgcaccggcagacaaacacctcagcagcacgaccgagcgcgacgacccacgacgcgcgagagcatcacacagcagaagaacacccacctactcactgcccacgacgacacaaccgagcacaccccacggaaggacacacagacctacagccaccactaccaccccctcaacgcacaacagccgactacacaccgacagccggacgcgcgggcagagcaaagcagacacggacgcaacacccgacaagcacagaaccacacgacctagacaagccccagacagaagcacgaaaaccaacacccccaa

SEQ ID NO: 661514 - DNA, 106 bp, Homo sapiens
aatcacgcatggctaccccagctggtgagcggcgccccttgccaggcagtgggcacagaacttctcgcttggccgcagggaaggggctgcggagctgtgggaaagt

SEQ ID NO: 661515 - DNA, 118 bp, Homo sapiens
tgcactgttgttcataccacataaacctttttaaaaatagacaccccccgatacagcgaccaggtatgaacaacagtgcaggtatgtaacaacagtgcaggtatgtaacaacagtgca

SEQ ID NO: 661516 - DNA, 330 bp, Homo sapiens
gtgagatggtcagtacatgtggtgcttataatcacctggtgtggttatgctcggtcatagagtgagcccgaaggcgtaatgcagtcgacatgttcattgccgtctcccaataggggcagaggtgagcacccctggtgaaaagttaagactcagtgagtataaatacgccaagaagagctgtggcttctttcactggtgtcctcagaaaggctgtgagcagtgttggtggcatacctgtcacagcatctagcaaagcacctgaattctagtatgaattcaaatacatcttttgatggaaggagtgaagttcgatgaaagtgagaaaactaa

SEQ ID NO: 661517 - DNA, 477 bp, Homo sapiens
  misc_feature (45)..(45): n is a, c, g, or t
tctgctgcacaaataaacaacatagagagtgaaaatataccctanaatttattccagaacactgaagtataaaacatacctgtgtgtcctattaaagtggcgtaagtttgtattgtgaacagcaagccatgtgggtggtttcagtggctgggaaaggctcagataatgaaaaggcattgcatttacagttcccagggactcactgaatttcacttgctcagtcaacttcacagtgaagtattctgctgccctaaactaagtgaagaaacaatgtgcaaaagacaaagggaattagccaagttatatgaataatatcatggtggaagtctattaggaactaatatcccaataataggaaagatcaaaataaaagtcaatgtgaagctacagttttctggtacaaatctctcaggattccttctttgtgtgtgtgcgcgtgtgcgtttcaataaagtttgtacactttcttaacagtga

SEQ ID NO: 661518 - DNA, 622 bp, Homo sapiens
ctgggaggaccaactgatacctcgctatgtagctttactcctttatcctctaggtggcgtattagaatggtgccgtgctcacagggtgtgactggcccactatctagggtagtgagcctattttgtggcccctgtgtgcagtcaagccccaacctcctggcttggtctccgcttgttgttggctacctagttccaggttgagggcccactcctgtagttacagccccgtcaagtacacagtcaaccctgccacctgtccagagtgttatttatcaagaggatttatcgcagcactgagatagtatataagaatatgctgccaatttctgtcattgtctttgacctatctgtttgtgtatcctaatactccgcagcagcggaggcaatcgtgagcgccctcccaccacaaacgtgggatccgtgcacgtcagcgatcacgaggactatgcagcaaccctcgcccgtgatgaagggtaacctggctcgagcctcatagccaggcattattgagatataatgatgtgtcggggcactcctagaaggccatgccactgaggacagttccccaggcactgagtaccaccagccaggcacccttaagcagggtaacggagatcctcag

SEQ ID NO: 661519 - DNA, 169 bp, Homo sapiens
ccgctagagttaaccttactcctgtggaatttcaaggcctgggtctctttccaggaaaatgtaagctcaggaggtgggtgcaggccaggtgcttttccctatccacaggggtgtttgtgtgtgtgcgcgtgtgcgtttcaataaagtttgtacactttcttaacagtga

SEQ ID NO: 661520 - DNA, 136 bp, Homo sapiens
aaggagaattatggcaggtcaagattaaagcgcgatacagatcaaaaaggccgatctgtgttgcagatgctagggtaatataatgtatcctcatgatgctaggggtctatgttggtcccttatgcttaattgaaat

SEQ ID NO: 661521 - DNA, 269 bp, Homo sapiens
acccatgttgttactcatacactaccgattcacaccatctaaagggttagtaaggccactgctcctcctccgaggactcctgcgagatgccctcctcttcctcctttctccagttttttttagggtctagccccttgtgtttcctatccctggagttataggtaggttagacccgtgtgcttagcgagcaaatattcggtaccccctactgacgggtactagggggctctctatctttattagttaggcatacaaggggcggagagggg

SEQ ID NO: 661522 - DNA, 1535 bp, Homo sapiens
  misc_feature (229)..(229): n is a, c, g, or t
  misc_feature (442)..(442): n is a, c, g, or t
  misc_feature (465)..(465): n is a, c, g, or t
  misc_feature (501)..(501): n is a, c, g, or t
  misc_feature (505)..(505): n is a, c, g, or t
  misc_feature (532)..(532): n is a, c, g, or t
  misc_feature (580)..(580): n is a, c, g, or t
  misc_feature (654)..(654): n is a, c, g, or t
  misc_feature (656)..(656): n is a, c, g, or t
  misc_feature (658)..(658): n is a, c, g, or t
  misc_feature (696)..(696): n is a, c, g, or t
  misc_feature (731)..(732): n is a, c, g, or t
  misc_feature (749)..(749): n is a, c, g, or t
  misc_feature (962)..(962): n is a, c, g, or t
  misc_feature (1032)..(1032): n is a, c, g, or t
  misc_feature (1130)..(1130): n is a, c, g, or t
  misc_feature (1251)..(1251): n is a, c, g, or t
  misc_feature (1281)..(1281): n is a, c, g, or t
  misc_feature (1371)..(1371): n is a, c, g, or t
ggtgcgcactcgtgtctcttgccgtcgatctgccgtcgagtaactctgaccgggatgcaacttgtaagcacagcgagttcagtccgtctgctgcatcatttgagcttgttggatccgcggtctgtgttgcccttggctgtgtctatgctgctggtactgacgtcatccccggagccgatgctaccgttccagttcggtcgtaggtcgccccagaaccaacgctagtggncgttcgatgatgtgtgagcatttgtggcctcctggtacacgtggacatccgtgatccggatgggttgcctgagctggaggaggcaccgcacgaaggcgagagcagatagagtactctctagcactccctgtatatgttacgcaccgattgtgaaggccacactgtggccggaggttcgatccatttcacagagcagtcgtgggtaagcgcacncagtggcggagtacagggaatcntggtgcgactctacaaatcatgtcgtagctaagcgnacgntatggctgcctgttgaggcactcgcgnacgtgaagagacaacacccatgctgtcttggcttggtaagacagtagngggctccactcttagagaaaccactccgaaatgaggccaaacttagtaaggtaagtataagtaatagtaccatncngngcactgttactttggtttcatcggaaaagaacgctctncgagagcagtcccgctgtgcgccaatgtttaccgnntgtgtcactagttaccnactcgtgccaccgtttggctgtgggtacacgcatccgtaactggctcgtcatcggagactgacaggcgcaacgtgagacgagtttgctacactgtggacccgtcgtgtgaagcacagtgaggctacagcgcccgatcaactggatgacgcccactctttacagatgtgggcttacggcgccgtactcgcccgacagcgcaataccatggcgcntctgggatccctgtggcttggaccgtgggacacgtggagcctgactaagctgcgatagaaggactccctncaacttgtaggccgattggcttacggagctttcaccgaccccacgtggggctgaatgcggggcaaagtcctgttgccgcggaactaagttccagaggngaggaaaagcgcttggtggctaaacgttcaggcacctgagagctcttccgacagcattgcgaatgattgtggcccaccctggtcgcgatttcccttcccttcctgtcatcatgggacgaanagaagctaacaaaagcgttggcgcccgagntgtgacccggggtacttcacccgttatgccaatgaccggtacccgaggatcacgaaagggcaggtcccacgcctccttcctgggcgttgngatctctcagcggtcccgcgacccacgttcatcctctagagcgttggtgggctctcgcaaactcgttccacccggtttgggtgcgcacatctctccgcttgtcttcagagacaccctgcacagatatatatcccagaaagggggggccctcccccatagagagc

SEQ ID NO: 661523 - DNA, 311 bp, Homo sapiens
gactgaaactgaatagaggcaggtcaagtagctacggtcaattttaaagatgtatatacatttgaccggtgtgccatgttacagaggtaattctgcagcatggtagaagttgcaaagggaacaaaaggtatacattaaaaaaataagttactggccgggctttctgaatcttatactgtactatgtataagtattttcttttctttctttcttttttttggagacgcagtctcactctgtcgcccaggctggagtgcagtggcgcaatctcggctcattgcaagctccgcctcctgggttcacgccattct

SEQ ID NO: 661524 - DNA, 1271 bp, Homo sapiens
actcatgctttgtgatgatcaaggacggcggagtatgacaaggacgggaacctccggccatggtggaagaactcatccgtggaggccttcaagctgtcagatcctgatgtgcactggtacgaggtcacgtatcaagtcaaactacaggcggtgaagcggggaagccgagctgaatcgggacggtatcaccctgggtggagaacattctgcgcgaccaacggtgggtctcaaggacgcgctctactccgcgtgcttaccatagacctcgggtggaagcaagaacggtggctgcagtccactcgactccaccaccctggggctcaacacaaatcatagcagattcttcattaccgtgggctttgctctaggtctggtgctccgtaccggtagacctgagcagctcaccgatgcatacgggctgcagtcgaccgcatcgcacacaacaaggcgcactcatcgctttacccggcgtcatccgcgttcacgctcttccaaaattcgctaagggaacgttactcaaggatacactttacctgcttaggccaacacttggggactgcacgcactaatgaaatcccgtcacatcagcaacgctggccgaaagcctactgggagtgaaggtgatacggaacgtgcggtagcaagtgaagccctataaggaatctgcgccacgtgaaagggcgcgtaaacgcgaggtctgcagcgccaccgtagaaatcccccctaattccaggacccttccaaggggggcccaatttctgtcatccaatatggcgcccgtctttggagaccgatttccctgggggggcccgcctggggcgttttcgctcagcaacggtcgcggttggcgcgattgtatcaccgcccgtgaaaaacctggatgccccagttggggtgttatggggcgtcgtccatagacggtttggagcccggcaatctccttggagttcccccgtggtttaaacgaagaccggggaatatgttccccgaaggccgagcgatcggttttgtttggtggccccatacgttttccagtcatagtggcaattgctcggaggtttggcattgggctcggtgtggagtacaaatcacagagggccgtggggcgcccccgagaccttgtgaacaagagacgcgccgaaggaatactgtggccacccaatgttcccacttgtgtcggtcacccgttggctgtttccacagaagtatgtaacttttgtgggcgggaacacactcttttgtgttacacacccctcgtgctgtagatacaa

SEQ ID NO: 661525 - DNA, 90 bp, Homo sapiens
ggatttgctggtgcagtacaactaggcttaatagggacatgtatctttccttaacactcagatccctggttaatagaaaagaccacaaga

SEQ ID NO: 661526 - DNA, 284 bp, Homo sapiens
  misc_feature (224)..(224): n is a, c, g, or t
  misc_feature (227)..(229): n is a, c, g, or t
gagacagtgtctctcacccagtctggaatgcaacagcgtggtctcggctcactgcaacttccccctcccaggttcgaaggattcttgtgcctcagcctcctgagtagctgggactacaggcatgtgacactatgcctggctaatttttttgttatttttagtaaaggcggggttttgccatgttggcccaggcaggcggatcacttgaggccagaatttgaggncannnggccaaacatggcgaaaacctgtatcactcttttagacccttctgtcgtcttctc

SEQ ID NO: 661527 - DNA, 361 bp, Homo sapiens
ccttgactgaccttgatgtcctcaaaatttcctcaggtatattctgattataaaataacacactttcaaagatggctgaataggaacagctacagtctacagctcccagcgtgagcaatgcagaagatgggtgatttctgcatttccaactgaggttcatctcactgggacttgttggacagtgggtgcagcccatgcgagcatgagctgaagcagggcagggtatcgcctcactcaggaagcacaaggggtcggggaactccctgtcctagccaagggaagccgtgacacatggtacctggaaaatcgggacactcccaccctaatactgcacttttccaacagtcttagcaaacggcac

SEQ ID NO: 661528 - DNA, 949 bp, Homo sapiens
gacggtcgcagcggtctgagatgcttgacgagataggcgcccgctccggccggcaccatggactagcgaggcgattccatggagcgcgcgggactttctggacatgaacttccagtcaggctggccatgaaatcacatggcatcatgaagcagatggagctggactacggtctggcgggtgcgaaggttggatgaacgtgacacaagcaagcttggagatcgactgtggtcagacttcttcccgtcgcctccgtggtcccgcaggcctggaagcgccccttcttaggcactgacccgagtacagctcctaggcttcgagtaccttgagacccttcggcagactcgagggttccccctcggtaaggcggtcccacacgaacgtgcgcatgaacacgcaccgtttcggtacgaagtcagaagtagtgcagcccaaaccctactactccctacaagacgccgcgtgatcgcccatggggcacggcccgtccagtggcccggctgacaacccacaggcttctatccctggcaatgcacgggaacctgcctttaatggggccagcactgggaactcggaggaccggagccttcggtacctctcggtggaacgctccgtcggaccctccccggagtggagcggtcgatgggctagtctgtccccctttcgagcccgtgactgcgcctgtcccccaggtgaagtcacacggcgtaccaacagcgcccgcatacgcgacaccagtcagagtgggataaccaagccgcaatatgtactttgtcccgaacattgtccactggggatacggcctcgcagcgacattacataccacagatgtgaaggaactcagtgtgtgaagcgcagggagaggtagacctactatgcacttcagtacatctccaaagcatcgctgtcgtgcgcgtgcgaagaccccgagcccacctaagtttgaaaatg

SEQ ID NO: 661529 - DNA, 1865 bp, Homo sapiens
gccccaaggctcccggccctgccgtctgccatggcgtccgacgacatgtctaccgcctgtcgctcggcgtctctccattattcgtcgtcagtgagcgatccgagttacactcttcgccacgagtgccgcacatgaagctagcaccatggatctcatgagggcggccattcacagtcgccatgatcatagctctgagagtcttctactgtctctccattagcaggttatagcctgtctcatgattcgttacgtatcattctgagccagcggagtagactgatggcgatttcgatacgacactttgcgcaataggtaccttctcattcacgctagagtctctccaatcgacgcagatgacgggacacaatcgctagaacgataaacttgagtgagaggcttgctatgaaaacccacacagtaaggtgtggccggaacatctgtgccttgtcgaggggatttatcacaacgcatagctcaaatgcactggatggcaattgtacttgggggaaagcacgcgggggcctaggacatgggcatcatcgtgctagtaggtgtgcaattttgcacgtattctcgggacaacagaaaccttggttgcacatattccaggtgtcaatgctaccatgcgacagactgtgtcatgcaccattactgggacctccaccatggcagccataaacacaactgtgagcactgcctcaaaatgttgtgcagtgcttgtaccctttccacttgtgatacgccacccgaccatttttatccacggtgacaaaatgtggcacgaccagcgtgcattgtacaacgcagccccctaccgttccaatatagcgaaaaaccttttcggggggagttggacacgccaaacccgggttagtaaatccccacaggatgccgattattggtccgggagccccacaaacagcgtactggtgtgggagcaaaagactgtggcactacaaggtttaaaacattacggtagcggcgcatccttgtggtggcgcgggggccaacacatttactcttcctgtaccattctctttgcaagccacaactggccaatcacatatcactaccgatgggagaggagcacactaaccccatcgttcgaattttatactctagcaagagaaagggcgtatcaaaacgggccactcttcctggcggcagccattatagatggtgtgtccgccacccaagatttatcggcgcccaaagtggtagagccgctatgaaccttatccccgccatggagatgtgcaacacccaataatctgaggctccacgttggcaacttggcaacgtgagctactaggcagaggatataaccccattctaatatagtaccctgtgagtatggcctaagatacacatgctttggtattccgccgacaagaagcatattcccgagactgttacaggatgtcacttgtgggaaatttcgagtaacccccttgttgcgctttttcaaaaaatgttaccgacgaaaagtgccgcgttcacaccccaaaagcaacacacatcacaccatctcaagctgtgggcgggagggcggactgtctgaaaagcagagtacccgcgcacagcaggtgggccacccagactccgggaagccggtatgaaccacaaggtatgcacctgctgtgtcaacaagcgtgggtaccacctaacaagtgagaacgccgcaatgatcagggcaaaacacacacaggaccaggccgacataacaagacacgcgcaaacgcgacaacaccggcacgactgaggagacatcgaagacacagacaacccaacaaagctcgcgcagtacacacaaaaccgcagcagacgcccacaggcaatacagcagctgcgcagcaaacacaacc

SEQ ID NO: 661530 - DNA, 181 bp, Homo sapiens
ccagaggaggttgatgagtcgtcgtcaccacagcagggacccgagcagcttccattgagaatgtctgcaggacagcagccccgagcactgaggccgaggcccacctgctgacatctacctgccaggacggcccacctccatggagacggcccacggcctcgccaccaccagccccacctgg

SEQ ID NO: 661531 - DNA, 195 bp, Homo sapiens
acatgtcaccgtcgctagaggcggagcgccgcagacgatctatctccaggtggaccgcttcagacactgatgaccacggagcagccccggctacgggtgcctggttgcaaaccagacttagatgttcagacaaagctctatgactgccttgaggagcacctttcagagtccaactcgtccaatcttaaccctctt

SEQ ID NO: 661532 - DNA, 465 bp, Homo sapiens
ggctgctctagcaggatccccaggcacaagctcctacggtagagcgcgtggcatgatcatggctcaccacagccttgaccttcctgagcttaggtgatcttctcacctcagcttcttgagtagctggtacaggtgcacatcaccatgccctgctaatttttgtctttttagtagagacagggtcttgccatgttgcccaggctggtctcaaactcctgcgtttaagcgatcctcctgcctcagcctcccaaaatgccaggattacaggcttcagccaccacgcccaaactcggtgagttttataaagaaagcaacaccaacagagactaacatgctttaaaaaaaacgaaagaaagaaggaaatcccatagtctagtcacataaaatactagaattattttaaaatattattttaccccattcctactttacttagtctcctaccaaggtaggagcttatgcctg

SEQ ID NO: 661533 - DNA, 856 bp, Homo sapiens
gacagccggaacaagaaagcaaggaaggacggaggtccgatgcctcgaggggctcctagcaaaggggccgggcgggagtccatggagactgggagcgcgcccgttcatcctcatccttgtgctccagcttctccttcgcatccgacgcaaccggcagcagcgcgtgccgccgtgtcctcagccaccgtccctcttcccaggatgtgatctcgtggtggaaaggctaagttttaaaaccaccccaatggatgcagacaggttgatgtttgcttgggaccattctattaccacgtgtacggtcgtggtttagaacaaggagtgtcattttaacaccttaacgggacacgatgcttgggagggagcaaatgtcacttgataccccgtgattgtcggaacgcgtatgagtgaggctaagaaaccctagagttacggctacacattgtcctcaggaacacttatggcctgacgcacacaagtgaggagagaccgctaaatcgttgccagacgcttagcccggtagtcttgcagaagctacggtccaggtacatatcacagatggacgggatgtaacgtctggccgtgtgtaaccacgccattggaaatcggtgtgcagcaatccacaaagcacgaatagatcttgtggcagttagaagctgaattcatccggggagatgctatgggtacacttttaaaacttcctacgatttccccgcggagtttcaccgtcacgggcaaggcaaggctggttgctgtgcgacgattaccatgggttgaaccgggaaattcacccctatgggaaaactagaagatagcgggactggtcggacggtacatgtggaccatacacgcgaagcgc

SEQ ID NO: 661534 - DNA, 443 bp, Homo sapiens
taggagtctagagatccggcgacatttaattcccatataatgtacaaaggtctgtataagtctgttctcatgctgtaataaagacatagcatgatgggtaatttataaaggaaagaggttaatggatcacagttccacatgatagggaggctcacgatcatggtagaaggcaaagtagaagcaattttactgtgttacatggcagtaagcaagagggcgtgtgcaggggaactcccctttataaatctgatctcacatcagatcttgtgagacttattcactatcacaagaacagcacaggaaagacctgctcccatgattcaattacctcccactgggtccctcccatgacacgtggaattatgggagctacaattcaagatgagatttgggtggggacacagccaaacggtatcaggttccaattgctctgtatcctcaac

SEQ ID NO: 661535 - DNA, 126 bp, Homo sapiens
tcccgttcctcatcctttggtaggtggttagatattttaccagcaactccctaggattatctgtaaccccaaatacctcctcgagagcctgcatacattcatcgacagttattcaagtattgttta

SEQ ID NO: 661536 - DNA, 147 bp, Homo sapiens
catcttctggtcgatctctgcaggatccccatcctgccttggttgactctgatacctcgggccgatcgcgacgccccccgattccggcgaccacccagtgtccaccgtcgggtacccgagctcgatttccgttatctttgttcctag

SEQ ID NO: 661537 - DNA, 150 bp, Homo sapiens
agaataataatcaaatccattaactcggtcaaataacttaataacgccagcatttttccaatcgccagattgtacttcaacttgacaccaattattccccttcaattggagagtttaatatttgttttccgtctactctccataaggcca

SEQ ID NO: 661538 - DNA, 125 bp, Homo sapiens
tgggacacgggcccatctcgcccaatccctgcttgcccgatcccagaggttcctgaggggctaattctgggaagggagagttcttggctgcccctgtcgggctagtcggggggggatcgtctaga

SEQ ID NO: 661539 - DNA, 218 bp, Homo sapiens
ccaggctgaggctagtggatggacctgtgcagggattgagggcatcaagaacccctttactgactgcttgtcatgaagcctggtgttaggagggctgcatgcagccaggtggtcacagaactggagctggtggcttgccaagggactgtgccctctctgtgcacactggtatgttagtttgctaggtctcccacaacaaaatacctaagcctgcgtct

SEQ ID NO: 661540 - DNA, 302 bp, Homo sapiens
  misc_feature (130)..(130): n is a, c, g, or t
ttaaaagcccccccctttttttttaaggagaagggcccgttttttttccaagtccccccagggggggggaaagccttgtttttgtgtaaattatgaaaaggaaaattttttttattttccccctaaactnttttttttttgtttttttttgaaaaaagggcctttgggccccccctttccctttttttttccccccacttaaaaggtaaaaggggtttttttttccttgggggggggggggggcacccggggttttctttttccttttttttggccccgtttattaaaaggggcccctttta

SEQ ID NO: 661541 - DNA, 171 bp, Homo sapiens
ttaagcggaggacaccatcaagtacgccaccaactcctcatccagcaggaagagctataaacactaaagtgcgtctgctagctctcggtcgcacagatcctcagagccgggggatccatctgaaagtcagaccatgcattgcaatgcaatgccttgtgcacttggcctgtc

SEQ ID NO: 661542 - DNA, 309 bp, Homo sapiens
aatcaaacgcgatgtctcacgctccgttatgcctgctgtcggcgatttgaccgttcgtgacagttcttcacaattgcctttcatcagttttttaagatatttttgtttagtgcctatgggctgtgatgtatatagaagttgtacattagacataccctcatttttgtcttttctttttgtattttttgttttttggtttttgtctttttggttttttcccccttgtgagggtcgtaaggcgcctttttacaacactcgcgccccaggggggagccccgggcacaaaatctcgcaacaccgggggccaca

SEQ ID NO: 661543 - DNA, 709 bp, Homo sapiens
agcttttaaattaaaaaggaagctattcaccattgagcgactgcattttgcctccaggacttgtcagacacagtgagccgctcaagcaaaatggatctggcagaatccgccaagcggttggcgccaggctgtggcatgatggccggagaaagaagcacctgacttctagggatcctcccttagtcgctgcatgagaattctatgacactctaattatgatggctaatagtttatgtaaatatttttcttaaccaattggaccctccactctttgaaaaacacaggattataaaaatgtggccgccatttctcattttttacttttttacagaatctagcacagcagaatactttaaaattcttcccttaatgctctagagaaaatacttttattttaaataagcggcaaaaaatggtcaaattcacaaaaaaaaacatacagcaaaaaaaaaaccattgtgtggggcgccgcggggccatagagaaaaaggtttttaaaacccaactcctgttggggggggcgcgccccaagttgtgtagagtgcacaaagtggccacagcgctggtcccaagagaactccgggcaagagacatagtgcgtgcttttctaccaataaaaaaacgcgcgggggccacgggctcttgaccaacccaggcgggccgaggcagccgctcaaaggggccaggggcaatatcgcgccgggcagga

SEQ ID NO: 661544 - DNA, 545 bp, Homo sapiens
  misc_feature (525)..(525): n is a, c, g, or t
gtgagtattttgggtagctgggggggatgggtaataactggtgacagcaacaagtatcttattcccatttcacagatgaagacataggctcggggaaaaaaaaatcttcaacggtcacggattacctggcccaccccacgacatatcctaagaccgggcacgtgataatttaaatgaaatatcggggggaagtggattatggaaaggagaaagcagagccaggggggtggggggtggtgtgaatgcccactgaaatctgaagtagggtgcagattggtccatcagtgtgaaagttattcgggtcacatcggagggcggctctaggtcaccctaaaggcctaggcgggctggtctacgggtcagggggctgagtggccattcagagactcaagggagtgaatcgtacacatcaatcagggggtgggctgggccaccaccctggtggaacactaccgggccttctaacctcagggagagcctgaccaggcctggcacagagacctcagagtgccagagaatctccantgtgtccttagctctgcaca

SEQ ID NO: 661545 - DNA, 317 bp, Homo sapiens
cagttttctctcttataccccgccacggtagaatatgttaaagtagagtttgttccaatggaaattttgagggagacgcccccttctgcgctttctgagacgccgagaataggtctcctataatatagtatagagagagacccctccacattaaccctggagagtgaactaatattggaatgcccccacaccccgtgccaccaccacattcgagagagaccccgtgatatacattaaatttagaccaaaataggaaggaatcgaacccccccaagactggtttcaaaccaaccccatggcctccatgactttttcca

SEQ ID NO: 661546 - DNA, 828 bp, Homo sapiens
taacagttaagcttcctttattgtcaacgaaatatacaaactaattttcaagaggatacctttttgttctaagatatattcacactagcaagattttatttattttaaagataaacatcagcagataagccattttattttccaggttcagttttataatgtcactaaagtcattatcaaattttaaaggatcacatctataatcaaaggctgatgctgttaatattatacacaggattaacaactgtgttacaagagatgttagaacaaagcttatttctgtctacacatatgatgacatgtatttgtaatgctgttcagaattttgtgttgccatattactttagagtatggggaaattattttttgaaatgaatagcaagttgaagggacgcgtgttttttatcctagatacggaggtgagatttatgtatctatagtcgaccttactatgttggagatagtgtctaactaggggagttatgagtgactagactatgcttaagagatagagaacaacttggatggtgttcgaggtcgtgtttgagatgagtatgcgatctgtggtcggatatacataatgctggatgtgtgagttgatgagagagcttgttaacttattagatgcttgatcaaagtgactatcttagtttgtttgtctctggtttttgatgtgataatctgtttttgtatgctgataagagattgtatccgatggagagggacgattgtattactggttcttgtcgtataaatgaagtagaacaaagatcgaggaccgtgaatatactgctccgatgagatatgtgtagctcatggatgagtaag

SEQ ID NO: 661547 - DNA, 1206 bp, Homo sapiens
  misc_feature (897)..(897): n is a, c, g, or t
  misc_feature (1086)..(1086): n is a, c, g, or t
gatgctgaatttctaaatttcttttgtgatatccctgcaagggacaaactcgttgtttagagagaaagagcagaagtcacctgattgtatctcccaggtcaatgataatgatataggcggcttttctgagtgtagatatttgtctttttctttttggtctttttttttttttatgttttgtttttttagagctcaagagggttgggggcggaagaggcgccgaggtgggggtatccttgtaacagagaaaatttgtggtgggcgaaccaaggggtgttgagggtgtatttcttccaaatttttggcagaattttgtggaatggggaggcagggtggacaaatcagggtctctttccacctccctctctgtataaaggtctttccaaagatttgtggggaatattctctggggggagacctccgaccgatgtggggtctccctctgtgtgtgggtggtgaaaaagagtggggggccgcatagcgaaaaatacgtgggggggccagttgtggggtcaatacctagaaggggggagaagaacaaggtgggtggggactggggggcggagagaagctcataatggcagttatttggaatttaggggagctttcgattctttgtggaacacaagagagcgtaaaaaatgggtgggggggggagtatttttcccgcggggtgttttaaagaagtgtaaagccccatttttcgtggggtggtgcaaatcttcatgggaggagataacacagaaagggggaaggattcctccttggtaaaaacaggggggggcgccctcttatagaatatgtgttgcgcccggggttttgtaaaacgaaattcttctctaaaattacggggagggagggggagaaagaattagggcattttaaagaggagacccncttttcttgacggtccaccgggggaataatcttctattttggggggaaacgctcgtcttttttacgcgtcaaagaaatattggggggggggggaattttttaatggggtgcccaatatgtgtagtgtgttccacaacaaaattaatcgtatagttgcgagaaaggactgttctacagagatttgtttcncaaaatagacgagtgtcgaacagaaagagatgcccaattgttggggagcggggagcgagatcaggtgcgtcacaaaatcggcacaaaaggaggaggggggcggtgaacaaaagaggtcgg

SEQ ID NO: 661548 - DNA, 1010 bp, Homo sapiens
  misc_feature (66)..(66): n is a, c, g, or t
  misc_feature (74)..(74): n is a, c, g, or t
  misc_feature (97)..(97): n is a, c, g, or t
  misc_feature (106)..(106): n is a, c, g, or t
  misc_feature (123)..(125): n is a, c, g, or t
  misc_feature (127)..(127): n is a, c, g, or t
  misc_feature (134)..(134): n is a, c, g, or t
  misc_feature (139)..(139): n is a, c, g, or t
  misc_feature (142)..(143): n is a, c, g, or t
  misc_feature (160)..(160): n is a, c, g, or t
  misc_feature (162)..(162): n is a, c, g, or t
  misc_feature (164)..(165): n is a, c, g, or t
  misc_feature (177)..(177): n is a, c, g, or t
  misc_feature (181)..(181): n is a, c, g, or t
  misc_feature (186)..(186): n is a, c, g, or t
  misc_feature (206)..(209): n is a, c, g, or t
  misc_feature (237)..(237): n is a, c, g, or t
  misc_feature (266)..(266): n is a, c, g, or t
  misc_feature (274)..(274): n is a, c, g, or t
  misc_feature (283)..(283): n is a, c, g, or t
  misc_feature (287)..(289): n is a, c, g, or t
  misc_feature (297)..(297): n is a, c, g, or t
  misc_feature (312)..(313): n is a, c, g, or t
  misc_feature (325)..(325): n is a, c, g, or t
  misc_feature (337)..(337): n is a, c, g, or t
  misc_feature (352)..(352): n is a, c, g, or t
  misc_feature (355)..(355): n is a, c, g, or t
  misc_feature (371)..(371): n is a, c, g, or t
  misc_feature (400)..(400): n is a, c, g, or t
  misc_feature (405)..(405): n is a, c, g, or t
  misc_feature (409)..(410): n is a, c, g, or t
  misc_feature (415)..(415): n is a, c, g, or t
  misc_feature (418)..(418): n is a, c, g, or t
  misc_feature (422)..(422): n is a, c, g, or t
  misc_feature (428)..(428): n is a, c, g, or t
  misc_feature (430)..(430): n is a, c, g, or t
  misc_feature (452)..(452): n is a, c, g, or t
  misc_feature (455)..(455): n is a, c, g, or t
  misc_feature (459)..(459): n is a, c, g, or t
  misc_feature (476)..(478): n is a, c, g, or t
  misc_feature (484)..(484): n is a, c, g, or t
  misc_feature (889)..(889): n is a, c, g, or t
  misc_feature (946)..(946): n is a, c, g, or t
  misc_feature (974)..(974): n is a, c, g, or t
tttattttaaaaattcaaatatgcttcaaatgaaaactcctatccatttattgagcacccacagantgccaggnactgtacaaaacattagaaaganttgttcaanctcttttagagcaaaannnantattccnttgcnctnnccatgatgctgacattncncnnccattgccatanaccncccangatcttcaccccttgttcannnnacatgtttccaatccatagttgaaactnttcatgcgggtttttgttgatgtttactngtgatgtntgttaactntttnnnttattgtnctctccctctggganngccacctcttcntcctctggggcncccatcctccacctnctnttccacctctgagggnaccgcctctgcgaccacctctgcgacctnctccngtgnntcctnctngggntccggngngaccggctgtgggggggggttngtnaccngggggtggaggtaaaannntctgcngtggcagcagcttatatgggtctatataaaagttctgtagttttttaaaggatgaagccttcatgttttctgacaacttaactgaaaaataaaaatctctgagttgtccaaatatttcatccacttttccaatttgttctttgttttctaagtaaacaggagcattgaaataaggcaccttattttcatctgtggtacatttacaaactatgtcatcttcacagggatgcaggaactctcctaataagactacacgttctggaggtccttggtcttggcctttgttaaagcctccgcggccaccccctcgtccaaatcctcccctgccgccgcctctgaaattgccgccgcctccaccgccgcctccacctcggaagtggttgctgctgccacctcggttgaaancgccacctccaccacctcgatttaagcctccacgacctccgcctcgaaaagacattntctctcctcccggcgccacgtgcccctntggccctggccttgcgcacataccggggattccgga

SEQ ID NO: 661549 - DNA, 155 bp, Homo sapiens
  misc_feature (13)..(13): n is a, c, g, or t
gtcgaccagaggnccccgtgaggtttaggaagattttggaaccgtcatatttcatgtcaaaggaaatcagcagtgattgatgaagggttcgcggcgagcagtcccggacttgtctaaaaatgagcaggtttacaagttactgttctaaatgttaa

SEQ ID NO: 661550 - DNA, 1654 bp, Homo sapiens
agcggggagtcggcggcggcggcagaagcggcggcggcggtggcggctgggagccaacgcaggaggttccggacgcgtgcgttaggaaccggggactcaggacgtgccctgcgccctgagccgctcagctccagaggccgctcatggctgacgtaccgggacccttccctggcaaggaacctgaaccaagcaaaccgattcacgcccttgaaccgaatcttagcaaaccaaggctccaacgctcggcccctgccaacggccacagacgactccaccgaggctgaccccagcaagctgcacgcgaccaatccaccgttatccttgcgccaacttggcccctggcgcctctcaggcctctccctgcggaccgaaggcccaacaagcataccccctcggagcctacacgcacctaatcccttccttcgccttaccacttctgccaagcccacccagtcccactcttgcaaggcactcgtaccccctacccccgctcccccttgcaaccccttcaccttccacccttaactgccgctcaggcctttgcacacatatgccccgacagacagcccacccggttggacttgcacccctccgcacaccaccctttcgttccttggccacccggcaccccggcactctgacgcccctgccagcaacgcccataccccaacgctcctttacaactcccccgcgtttatatttccccattctcattaccactactcaccccccatacacccacaccattttcccccaacatcccctcaacctccatcttgcattccccctgccgacacatacacacccacatcccgttttgcaacctcgcacaccgccacgtaaattccacacatccaacccaccaccctcccggggccccctctcaccagctcccccatactccccaggcctcagcctaacatcgccggccccccctttgcagtcccccccaatcatgctcctgcggcaccggcggcacaaaagcccaacggcaacgcggaaacaccccgggctccaagcggaccccccatagttgcgccaagttcccggtgacagacccccacgcgtcttccgcgcccattgttagaccacggcacccccagactatgctcgcccttctctcaataggtcgtcacagcgacaggcgggcggtactgtgccaatacccggggttgtgccacacaacggccaccgtagggtcgccatcattctgattacagcacctcatagcagtttcacacccttgaactacgcccctatgtggcgcattcccgctttaaaaacgcctgctctcccacgttcttaacacccatttgagttgtgcacgagccatgctttggcacttggccattggcgtctgaccccggtatttggatatagcccacgtgcatctactacatgtggtaccaagcccatgtggagagcccttagagacgatacgaaggcgacaccatattgcagtttgatgcggacctcgacgttaacagtccacgcttcccactatgcccttaagaggcaattatgccccccactacgagaaacagactacaacaaagctggacgagggaaaaaaaatcggcggacgcgggactcccaacaacggagcctgtcgacacctagaccgacgcgaggccaaaaacggaccagagtagcc

SEQ ID NO: 661551 - DNA, 173 bp, Homo sapiens
atgtctgcaactattattgcatggatgaatagcgtgtgggttatggcattcagcacaagactagtactgcagtgcttgtacattctctgagatctcagccctccggtgccggggcagagagcaaaggctacaggttcattttcctgcacgacagcagtcacaaacagcgctcg

SEQ ID NO: 661552 - DNA, 1388 bp, Homo sapiens
cgcggacgcgcggtgcgagctggaactgctgcagcttgctggcgtcgccgggaggaaccttgatccctgtgctccggacaccgcgggactcgccatggacttgaaccagcctgatcttgatcgagcagaattgcagagttcaaggaggccttctccctcttctgacaaggatgtgagatggcacttatcaggcactcaaggagttggtggacatgtgactgatgattccctgaggatcacgaatccccaccctgaacgctatgaggctgactgcgatatagatcgatatagcaggttggattgcccgatcggggcaaccgtggagccattagcactttcctcagtgaagtatctctgagcaattggataggcgcgagaaaagcataaacgtgaccatcagtagcaggtagaaggcagtgagatcctgaagagggtcgattccagtgtcttttgagcaaagggatgtgtgacattggcttaacattctatggcgctcggtcaacgtaggcttagctggtccaaacgtgtaaaatcgatcgatagcacattgagcggcgccgaaagggtcttagtacccgactgaaccggaggtgtggaggactagaaggaatcgactacaacgggtgcatgggctagatattcctgattgggacgagtttgggggcaaggtgttgccaaacttgagtagacgacgcacagtttgtaaccaggtattcgcattggaacttggctaaaagttgaaaagggctcacacactcgggggttcgaagactaagagtctggacttgtcccacagttatgcttccttgtggagtccttcttactacctctccttgcggcgggcgcttggcaacttcgtcgtacatttcgaaataaccttccttcccttgtgagattcaacgcgcccggtgttttcctaatgccaaataacaaccctacatttggcatttggcacttgcgacagtaaacttacctgtaatttgaccaggttccaactctacacccacgggacattatggattccgccgaaaggtgactggttccagttgaacattgtgggtctaccatttttaccttcccgtttacacataccccgattggaggattccgtccttcggttcccaatttggccacccccgtttccaagtcattcttgttcccttttttattgtcacgtttcgggccagtccttgtgcccagattccccagtttgctcggtatgcccggagaggggccctgtgaattcgcagtttccgttacacggtgttggacagggcccgtatcccgccagagagattcccccctttgggtgggaagaggcgcgttcttaggccccgtatccggtttccacagggtccacgggaattggtgagtccttaccattccaa

SEQ ID NO: 661553 - DNA, 171 bp, Homo sapiens
tcgataagggccagaacacctctggacttaatcttcaggttcgttagtgctaagaaactagacatccgtggagtattagtctcaaggtgtctctcacctggttgttggagtcccaccgagaaattcccaattccttcccaaccgatctgctctgtccttggccttatcgag

SEQ ID NO: 661554 - DNA, 862 bp, Homo sapiens
tgtcatcccatcatcgcactgtccacaggcaccgccccaccgcgtgttccatgcttccacaggactggcacgcacagactgcgcagtcactcgtcctgcgccagggaccactggcacacacccactgctgcccctcgcatgcgccactcctcaccacgcgaccccccaggctccgagacggcgaccccaatgcccacaccgcaagacgcccccccccctacacgcgcccctccatgccagcccctcaacaacagcgcgcctcgcacctgccccccaaccggctgcccgccccccaccagcccccacgcgcaacagccaaccccaaagccccctaacgccagccacgcctcccccgccgcccccaccggaaacccgctcccacctgcccccaagccccccggcgcccccaccccccaacgcccccgcccaccccgcccccccaccccccacccccccccaacaccccaccgccccctccccccgccccgcccccccacccccgcaaacaccgacccccgtcccccccccccccccaccacacaccgccgacacccccccccacccacgcgccaacgacccgcgccaccccgccccccccgcacccaaacaacggccaccaccccgccccctcgcctcccccacccgcgcccccccacgcgcccccccccccccccgacccacacgccacatccattcaaccatcactccactctaaccccacgacacctctcactccccctcaccctctcccccccctcctcacaaccccctttcaccacatcaatccccacacctccaccaccacaccctctcctcccctccctccacccccccacctccccccccccccaccccaccccaa

SEQ ID NO: 661555 - DNA, 899 bp, Homo sapiens
aaggagcctttgggtcaactgcgcggtgtactctatcgtcttggaggcgtggaggatatcacctcttcgagagtcggatggctccctcagttgagttggactccataaaagttgtgtgaggaaaatccagcgccataatcacactacgctctgtcttcgggcccaatttgagagataggtctgcgaccgtatgcttctccaagtatatgctgcaatgatgcgtgtcctcttttctaccttagctatcactttgttcaataaatatactgctacggggtataccttgagacaccactacggccagatgtagcatatctatcatgaggaaaactgcattcgctagatagtgaggtcactaaagtggtggtatttgtaccaaaggttagctagaagaaataggttggggccttggcatgtgctgaagattccctatgcagggatatatccacatatgcgcaaattccctaagggatcattcgtgggcacatgtctttattcctacaattatgtaccaaatacatctaaggcccactcgattttgcagtgtcctttagtaaccgaggaatctactacgggatcaaactcaaagtcgaaagggtcatttttcctacacaattcgttagtattattctaggtttcccattcaataggcgggtggcagtcaggatgatgttggtcacacattctatataccggcagagtaacggttacctatccaaagataattcttctttaaagttgaacccgttatagtcatgtcgtaaaaggggttaactaccgcttcgtgtcggaaaccgtgaacaattttcatttctaccgtattttaatgttccgagcagggggggaaacttgatagtctccgtaggcacaagtttggggttcctccatatagaaagtgt

SEQ ID NO: 661556 - DNA, 320 bp, Homo sapiens
tctctacagtaagaaaatactccaaactattttcttaattctcttttttaggtcttttccagatatgcggcttttaatctacagggggcttggaaacaatataaccaaccttattatatgatgtataaaatagaagcaagcaacccctgagtcaaagtatatggaatgttctagtgctaggggtgggataggaacattgttggctggactctgggcactgtttggataggtaaggactttgttttagtttggggaatatttatattgatgctctgtttggattaaaattatttctattacagagcagccatttattgatg

SEQ ID NO: 661557 - DNA, 669 bp, Homo sapiens
ggggaatcataatcttgaaaatctttagtactaaagtctgggaatatatcaacaactgattaacatatgcagatgctattggataccaagggctttttaaaggtcatgggggggaaaaacccaacttggggaactcccagttaaacaaccaagacttcactgaagattaattccaattctagaatggtcctttttaattttaattttttcaactgactaacttcattaccttaaagcctagaacattattcggctttattaatatggctttctcactttaattttgtagcatgggttgcatcgacttttttactagagaattttactagatattggccattcaggttttcatctgctttataatggatacaccttgagggtcacttttctaatactttaactataaggtgcgaccacctcagccctaataaataatattttaacctaaggtcaaatctttttccagctaactaaaaactgtgtccaaaaggattgtttcgaaatatgcatgcaaatagttctgttaataacccactgttttacatctgttcacatctgcgactgctaatacggttaggtttctaactttttcggtcgtttgttcagtctgattcaaaattagcaatttgaacttaaggttttagggggtttctggtaatacacatcccc

SEQ ID NO: 661558 - DNA, 783 bp, Homo sapiens
  misc_feature (52)..(52): n is a, c, g, or t
  misc_feature (141)..(141): n is a, c, g, or t
  misc_feature (183)..(183): n is a, c, g, or t
  misc_feature (258)..(258): n is a, c, g, or t
  misc_feature (260)..(260): n is a, c, g, or t
  misc_feature (271)..(271): n is a, c, g, or t
  misc_feature (276)..(277): n is a, c, g, or t
  misc_feature (308)..(308): n is a, c, g, or t
  misc_feature (317)..(317): n is a, c, g, or t
  misc_feature (322)..(323): n is a, c, g, or t
  misc_feature (330)..(330): n is a, c, g, or t
  misc_feature (346)..(346): n is a, c, g, or t
  misc_feature (348)..(348): n is a, c, g, or t
  misc_feature (388)..(388): n is a, c, g, or t
  misc_feature (429)..(429): n is a, c, g, or t
  misc_feature (732)..(732): n is a, c, g, or t
taaaacctccacctccaggggttgtgatgggccccagtgattatacgttatnggttgctgtgggtctgggcgggcctggagccagaaggcgacttattttttctctcctatgccaccccaggtggggagggagggaggttncagactccagtttctcccttgcccttttattcccaagcctcnttggccccagtataagtgtggggaactctctgccagcttcctgagttctgcctaaagagggccccccagcacggntnggggacagggncaatnnggtgaccaccagtcatgcctaggaccggggncccaaaagncgggnnaacctcnggctacaggggccatngngtgcctcccagtgagaggggccgtgttcgcctgtgtccgncagtgccagtgcctgtgccagaggtgcgaggtgagtcctcnagagcttcctggccgggcccttcctcctgcctgttctggctcctctgctccccacgctagctgtcccttttctgattcttggtggatcctccctcccctaatttaaaagtctcttttttgccccacttggggggctgccgtgcaaaaacacacacaaacacacacaaaacaacagttgttgcgcgcctggcgcccagaaaagtttcaaccaactcggggggccgcgggccagtgagaactgaaagggtgccagcgtccccagggacaccggcagagcagggctgcttcccctaaaaaacgcgncgccgggctcgaccaccatgctgggtcgggcacaggcacagcaacgcccgg

SEQ ID NO: 661559 - DNA, 382 bp, Homo sapiens
tgtacttttagacggaatgtactgtgcatccagtagggcaaaaatcattcagattgctagacttgagggttcttgggtctggttttttgtaaattttttgtcttcttttttaggtcttttccagatatgcggcttttaatctacagggggcttggaaacaatataaccaaccttattatatgatgtataaaatagaagcaagcaacccctgagtcaaagtatatggaatgttctagtgctaggggtgggataggaacattgttggctggactctgggcactgtttggataggtaaggactttgttttagtttggggaatatttatattgatgctctgtttggattaaaattatttctattacagagcagccatttattgatg

SEQ ID NO: 661560 - DNA, 187 bp, Homo sapiens
gtcgcatctcagcaggctcccccatccaggcgcatagcagtgtggcagcaaatcaagggctttggccaattcatggcctgcatccccaattcttgctcacaagccttgcacgacatgggcccaatcaatcccctcatggtgcctcaccttcccagcaatttcatgttcccatgcaatgggcttttgc

SEQ ID NO: 661561 - DNA, 819 bp, Homo sapiens
  misc_feature (152)..(152): n is a, c, g, or t
  misc_feature (184)..(184): n is a, c, g, or t
  misc_feature (205)..(205): n is a, c, g, or t
  misc_feature (209)..(209): n is a, c, g, or t
  misc_feature (224)..(224): n is a, c, g, or t
  misc_feature (232)..(232): n is a, c, g, or t
  misc_feature (243)..(243): n is a, c, g, or t
  misc_feature (250)..(250): n is a, c, g, or t
  misc_feature (646)..(647): n is a, c, g, or t
  misc_feature (667)..(668): n is a, c, g, or t
  misc_feature (670)..(670): n is a, c, g, or t
  misc_feature (675)..(675): n is a, c, g, or t
  misc_feature (677)..(677): n is a, c, g, or t
  misc_feature (682)..(682): n is a, c, g, or t
  misc_feature (696)..(696): n is a, c, g, or t
  misc_feature (699)..(699): n is a, c, g, or t
  misc_feature (703)..(703): n is a, c, g, or t
  misc_feature (714)..(714): n is a, c, g, or t
  misc_feature (717)..(717): n is a, c, g, or t
  misc_feature (719)..(719): n is a, c, g, or t
  misc_feature (730)..(731): n is a, c, g, or t
  misc_feature (740)..(740): n is a, c, g, or t
  misc_feature (749)..(749): n is a, c, g, or t
  misc_feature (763)..(763): n is a, c, g, or t
tactaccggtggacccgcgcccacgacctgcgcggcttcctcaacttcacgctggcgcgagcccgtcctccttcgccgccgcgcacaaccgcacgtgcaggtatcgggctttccgggatgacgatggacattattcccagacctactggaantcttctttgccaatccgccttggcccttccgncaattgttgttttgaaggaangccnaaggcaaccctgtcntggtttcntcccactccantggtcantgagcgccccgaccctgtgctttgcctaattcgagcacgtggtgaggggtcggtgccgtcacttcctgctgtgtcatcttggtcaaatcagagctcttctctgcacctgcgttttccctgcctggcctcatccctgggttgtggtgtggacattgtgggtgtctccaggagccccagggccacgaaagctggggtggcctctgccccttctggggttccttttcctgcacagctgctttctgactccacccacagctgggagcaggtgccggagccccggcctgcctggccctgtgaaggccactctgggcgtttgggtgggcgtgagtgccttcctctgctcccagcatgtggttttctccgttggccgcctcctggacctcctggtgcctgacnncccacacgtctgtggagatnnangtgangngcgantactacctgggtancgncggnctgggtgacanctncngttgttttttnnccgaccgangccaccctncttcggcgggaccnttgtgcaccgtgctgagggcgttacgcgggttgcgttttgggccttggctggctgg

SEQ ID NO: 661562 - DNA, 287 bp, Homo sapiens
  misc_feature (44)..(45): n is a, c, g, or t
  misc_feature (51)..(51): n is a, c, g, or t
  misc_feature (162)..(162): n is a, c, g, or t
  misc_feature (214)..(214): n is a, c, g, or t
  misc_feature (251)..(251): n is a, c, g, or t
  misc_feature (272)..(272): n is a, c, g, or t
tctggggctggtggatctcagtcgagccaccgtatttcattatnnagaaantggtggttcatgctactgtatccacactccctcacaatcttaagggaaatacaataaacccactttcttctcctaaaatgatttttagcacatttggcaagaagaggtagnccctttaactcctcctcctttccttttttcctctcccttccttttttcctangaataactcaccgccacaaaactaagacaaacttttncaaagctcagctggagttggntggaactacacagag

SEQ ID NO: 661563 - DNA, 385 bp, Homo sapiens
ccaagttgccagagagctttttcattctaaaatattaatcccacatactggagttgttctggagccaagagccattttgaataaatacatggctctttaagatatggacctaaccatgtgtccctgttaactgtctcttaacccttttctggacgaagcttgtattccaagttgagagaaggatgtaatggagatatatctccatgagtgctacagtagaagtatataccatgagagcatagtgaagcaggatgaataaaggcagctcagtttcagtgacactgtcttatcctgtttttattactaatagaatttctagaagtggatgaatacccagaacatattaaaaacttggtgcagaaagagagagagttggaagaacaag

SEQ ID NO: 661564 - DNA, 318 bp, Homo sapiens
ttctcgccactctcacagaagctttagagacatcaagtaataagaataaattacctggcgatcggggcatgcagttcggtcttctgggaactggcttccagcatgtcaggctatgaggaaaaactgcagtccaatcctctacagcatctcttagaagattatgtacaagttactaaagaagcagcagatgataaaagtgtagccaaagcagcacaggagttcttccaacgactggcactgggcgatgtgcaagcactttcactgtggcaaaaatatcgggactagagcatcgaagagtacacttcgggtttacaagcg

SEQ ID NO: 661565 - DNA, 501 bp, Homo sapiens
  misc_feature (9)..(9): n is a, c, g, or t
  misc_feature (67)..(67): n is a, c, g, or t
  misc_feature (78)..(78): n is a, c, g, or t
  misc_feature (114)..(114): n is a, c, g, or t
  misc_feature (159)..(159): n is a, c, g, or t
  misc_feature (166)..(166): n is a, c, g, or t
  misc_feature (189)..(189): n is a, c, g, or t
  misc_feature (363)..(363): n is a, c, g, or t
  misc_feature (416)..(416): n is a, c, g, or t
  misc_feature (483)..(483): n is a, c, g, or t
gagggtgtncaagcactgcaagcgcccagttcctcggaggacggcgcgtggctcagtccaggctcangtccccctctncgtccttcttgtccttcgtgtcgccctctttctgcncgggcttggcgtcgtcctccatggctttggcaaacgcttccacancgccctngtcggcggcctccacagcctctncaggcagaccgaactggcacaagagggggcccagctgccccgaggccaaggctgccctgaacaggcccagggcctgctggaactggggcgaggccagggtattctggatctcatccgcggcctgcggcagcgactccccagaaggcaagtagggaagcaggcgcccctggacanccgcgtgggcgaggatgggagctattatctccggcgtcactcactggccaggnccacttgctggccgcctgccggcccggctggcacgtccatcgtggccaggatgctctggagggcgcncagctggatgggctgggt

SEQ ID NO: 661566 - DNA, 81 bp, Homo sapiens
cctgacgacacggctgtgtattactgcctgactgggagtcgttatctctcacagggtggtttcgatatctggggccaaggg

SEQ ID NO: 661567 - DNA, 370 bp, Homo sapiens
acttcatctttctgtgttacattctggtattggtagttcttgcgatttgtcaaactttcccattctttgtttgtatctctgttatgctgatctgtgatcagtgctctttgatgttacttttgtaattgtctaaaggtgccactaaccacacccatgttagaaacgtgaagttaataacgtgtcgtgactgcgcgattgctgacgtcttttctgtttctcttcctctccttgggcctccctattccctgaagcacagcaatgttaaaattaaggaagttaataaccctacaatgacttctaagtgttcaataaaaggaagaatcccaagtctctcattttaaatcacaagctaaaaatgattaagcttagt

SEQ ID NO: 661568 - DNA, 418 bp, Homo sapiens
tgagcaagatccaaatggttgtacgatgggctgctcattctaaattcccttattttgttctgctggtcgtagtcgtgtatttgtaccagcaccatgctgtttaggttactgtagccttgtagtatagttggaagtccgtgtagcatgatgcctccagctttgttctctttacttaggattgtcttggctgtatgatctctcttttggtttcacatcaattttaaagtagattcttctaattctgaaaagaatgtcaatggtagtttaatgggaatagcattgactctataaattattttatagcattgaatctataaattattattccatgagcatagaatatttttctatttgtttgtgtcctgccatgtagtaagtactcagtaaatgttagcatggtagcagataaagtagaaaa

SEQ ID NO: 661569 - DNA, 443 bp, Homo sapiens
tcccctgggtggacacagtcttggaggttggggaggcccgacaagcagagtatagactgggtgccgacgtgcagtgaacaacctgcccaactgtactggcccatctttccttctacccagggaaatggaagtccttagctctgaagtatacgattgcagccagtccctgaggacagcatctgccacccccaccatgaccactggcaaatgatgagcacggggagggagtggccaaagaaacaggccctgagccacctcaaggctacttcacagagccccatcctcacggaaccacccactgccttccaccacgctctgtccagcccccagcatgtagcaggtcagctccatcagagaacgaggctggctcatggggttcagttgagaggcctgggaccttaaagccacttggagacaggcttgacctggaagcggctggtctc

SEQ ID NO: 661570 - DNA, 549 bp, Homo sapiens
  misc_feature (241)..(241): n is a, c, g, or t
  misc_feature (245)..(245): n is a, c, g, or t
  misc_feature (261)..(261): n is a, c, g, or t
  misc_feature (263)..(263): n is a, c, g, or t
  misc_feature (274)..(274): n is a, c, g, or t
  misc_feature (301)..(301): n is a, c, g, or t
  misc_feature (383)..(383): n is a, c, g, or t
  misc_feature (392)..(392): n is a, c, g, or t
  misc_feature (394)..(394): n is a, c, g, or t
  misc_feature (448)..(448): n is a, c, g, or t
  misc_feature (468)..(468): n is a, c, g, or t
  misc_feature (495)..(495): n is a, c, g, or t
  misc_feature (523)..(523): n is a, c, g, or t
  misc_feature (526)..(526): n is a, c, g, or t
ggattagttaccacgctctcccatttctgtgtataccaaaatccacgcactactcaagttttcgaagtcagtcctgtggaatccacatataacacaaatgggaaaattagtgaggtgtggtgactaggcacctgtcacgtgtagctcattttttttttttaatttttagtagagacaaagtgtcactatgttgaccaggttggtggtgatctcctacactcaggcagttctctcacctcancctnccaaaatgctgggatnanaggtgtgagcngccacacctggctgagggggttaattnttaattatataaagagctcaaagcaaatattagaaggagcctaaatgcctccagcagttgactggtactggtaaattgtganacatccatntnataaaatattatgcaaccatgaaaaggattaagatagatcaataggtattggcncaaatgtccacgaaatatgnaaatatgaagtgatgttcaatcaccangtacgtatcttgaaggatatggcccatnttntcaactgcaattatttcctgaga

SEQ ID NO: 661571 - DNA, 489 bp, Homo sapiens
gtccgcgtgctcatcaggaacagtgatattcgaggtaactgaaaaactcgaaggataagatatagccgtggaacaattgaacactagtttaattgttcataacgctacctcccaccttttccacccacagccacccaatcccatccaggctgagtaaccagttagctcccttcaccaacaccactaccgacctgaccctcaaatgtaacacgtgaaactgccacagagttaagcattcatctcctattaactttatgcctcctgttttttaattcttacaaacagttgttattcatcatttatcatatttctgtgtactcaaagtacatgaatgtgccttctgtcttcgtaggtccaagggggcgccttcttgatatcgtcatgtatagagctatggccaaatgctgtgacatagggtatgcccctccagactcttgacgaggctgttctttctatgtaaacagtaccagtctctgagctaaaacactt

SEQ ID NO: 661572 - DNA, 261 bp, Homo sapiens
tacataagcctgaatatgttacgtgcaccccacaaactccaccaaaaaactcttataattactaaacaaactcagtaaagtcacaggatacaaaatcaacatacaaaaatcagtagcatttacatacagcaataacaaactagctgaaaaagaaatcaacaccagcactttgggaggccaaggcgggtggctcacgaggtcaggagatcaagaccatcctggctagcacggtgaaaccccatctctgcgtcagtatagata

SEQ ID NO: 661573 - DNA, 1058 bp, Homo sapiens
ggggtgacatgagccctgggaggccgggccgggctcggtggccactccggtgtgccctggtcatggatgtgctgccgtctgacaggtgaactaatttcgcgaggagctgcagcgccgcgtcctggacacttcgagtgcctcatagggtccgagcttgcgtgatacggctgcagtgctggcgttggatggcctgagtgatgcctgactgatcgagcgggagctcgacgcctgacgaccgaaccggggtcgacctcgggctactattcaatcgaacggcaggtcgagcaccgtaagcggtgggtctctctgatacttggacgtgggtgcactcgtctccaaggcacatactacctgcctcccggggaccttgacctagaacgcaatagaccggaaagtcacctgtgccgtgctttaacatcaggggcgactcgagtaccgggaaccactttatggactaggtggtaccaaagttagtatacgccaagcgtcacgaaagctcagaccttcttatcggactagtcccaatagggtctactccaagaccaatgaaaaacaccggaggttacaaggcggcttaacctggaagcacgtgcacggagcccatcgtgggacatcttcgtgcagcaattgaacgacaaggggtaccccttaagatcccggctcccccaagttaatatcatggaccatgctagcttggcaccgaacttgcatccgtcccatcgcggcgattgggcccattccacaagcgccgatggacgtttattactctttttcccccggtgaccctttgagaaagtgcctggtttgtcgtttcaaataaccctttccaataatgggcgccaaatgtaacacacaaggtggtccacaggcatattacgacgctttaccgcgaatggaaaggatatctggaggagcacggcaatgtggccccgatttgagtctggtaaacgggtacaccgtataaaccccgtgtgggtgcacatccgcggagggcggttgtatcaaccaattttgcgtgctaaggagctaaacccgtggcagtgtaaccggggcacatt

SEQ ID NO: 661574 - DNA, 138 bp, Homo sapiens
cagagagtgacaagagttacataacctaggtgatctgtgcagagctatgtcaaaacgccccagtaggcagagcctagataaatgttacatcacctgggtgaccagtgcagagatacgtcacaataccgtctgtaggcg

SEQ ID NO: 661575 - DNA, 149 bp, Homo sapiens
aatatagttctaaaactactgtatagcagtctttgccaagaacctgatgacggaaaccacgagataactggaaatacccaaattgcgcttaagaaaaatactacgagaatagagaatttcttaacgtaacttcctaagtgtaagatgac

SEQ ID NO: 661576 - DNA, 301 bp, Homo sapiens
  misc_feature (38)..(38): n is a, c, g, or t
  misc_feature (89)..(89): n is a, c, g, or t
  misc_feature (287)..(287): n is a, c, g, or t
ctgctcccgcatgttaagatatgcctgctcctgctttncttccacgtgattgtaagtttcctgaggcctcccaagaagccgagcagatnccagcatcgtgcttcctgtactgcctacagaactgtgagccaattatccctcttttcattataaattacccagtctcaggtatttctttacagcagtgcgagaaaaaactaatacagtgctctaggaccaaatacggattaggaagtgtcataaacttttttaaagtctatttttttcaacttttttttaatgggatngcctgttatgtgca

SEQ ID NO: 661577 - DNA, 382 bp, Homo sapiens
acatgatccgagatcattggtcggtcgtatcaactcaggaacctgatttaacactgctgctgttatcctgaccgtctttctgcatacggtacacatcagcttttcactgcctactgaattgagcctctgtcaggcattcgagactttccacaatatgacgccgagcaatccttccagctctgtattatattatatctccaaatgtacagatgcagaccaatgggatactgttctcttgcctgctaggccccttaatatccttgccagctgtgagcttcacctgcctggtgtccttctctgtcaaccttgcctgttgaacttgtgcatggaataaatgtcacaagaaggctgggcatggtagctcacacctgcaatcccagca

SEQ ID NO: 661578 - DNA, 784 bp, Homo sapiens
cacgcgtcgggagaagaaggaatgttgtggaacgaggcaggaaaatggaagagacgcccctgctaacgggaatgctaatgaggaaacatggggagcagtgagtgcgtgacaactgaggtagacgaagaagaggaagaaggtggggaggaagaggaggaggaagaagaaggtgatggtgaggaagaggatggagatgaagatgaggaagctgagtctagttacgggcaagcgggcagctgaatgatgatgaggatgacgatgtcgataccaagaagcagaataccgacgaggatgactagacagcaaataaggaaagagttaaacgtaaaagaaaaaataggccgccgtgatctattcacccttccatttcccggtctcagaatctaaatcgtggtccacctttccgagtagagaggtccgccggcccacctgtggtcgagtgcctagctcggtagatgacatcgcggctcttgctagcagccataggtgagaacgcagtgaggaattgtggaaccaggggggaggaagaatgagaatcagaaagttctcaagggtcctgtggttggaattctctctatacaagtaggttgtacagaggggaaaaattcggtacgagcaatctgtataaattgtaccgattcaataattccttggtgacatattgggtaacggcgccaaggccgatcttttaaagtgatcctcgggattgacccaatgccagtgcctttcgggaagagtatctctgatccttactttctggacctttacttgttgggtggtggac

SEQ ID NO: 661579 - DNA, 316 bp, Homo sapiens
tcttttttttgacacagagtctcgctctgccgcccaggctggagtgcagtggcagctgtagtacagtacggctatctcagctcactacacacaacatgcatgcgccacaacacctggctaatttttgtatattttagtagaaaccccatctctactaaaaacacaaaaaattagccaggcttggtgcagacgcctataatcccagctactcgggaggctgaggcaggagaatcacttgaactcagggcggaggttgcagtgagccgagatcgtgccactgtactccagcctgggcgacatagtgagatccgtctca

SEQ ID NO: 661580 - DNA, 268 bp, Homo sapiens
ccggtacccgcttcacgctaacaaaaatgttggtagtcagtgggaaagctgttgcctattggcatctttcacgtgaaccacgtctaaaagatccaggtgcctctctctgttggtgatcacaccaattcttcctaggttatgcacctccagtcaccatacacaggttaccagtgtcgaacttgatgaaatcagtaatcttgccagtctccaaatcaatctgaatggtatcattcaccttgatgaggggatcggaatagcggtgagggcg

SEQ ID NO: 661581 - DNA, 812 bp, Homo sapiens
  misc_feature (312)..(312): n is a, c, g, or t
gggctgggcgggggaaaggagctcttctgaagggggtcctgccgcagtgagtttagggagctcagtttttgctggggcgcgttctgtctttaaaatctcatatggtaaaattgtcagcttttaaaaaagttaacctgcttcagggtttgcgtgcagaatccaagccacgctctgtaattcgatcctgttgtcatagcaggaaccttaggaaattcccaacgacttgattttagggattagggaagtcataagcgaaccaaaggaggacgaagagttctcattaaaaatgtatatgtattgaagatggtggtnttatgttttagaacaggaatgaggaaccttcagacctcgggcaagctctctccccctttttagtttaatttcatcaaatgcaaagaggtgatcccccttgtactgacagttgtacaaaatgtgtcacggctttaaaaatcatccgtggtattttaacacgaattagaaaatccgtggtattttaagtgttaatgttgcttcgaccaagtgtaggccgggcgcggtggctcatgcctgtattcccagcactttgggaggccgaggcgggtggataaccagaggtcaggagtttgagaccagcctggcaaacatggtgaaaccccgtctctactaaaaatacaaaaattcagcggggcctggttgcccgcgcctgtaatcccagctactcgggaagctgaggcaggagaatcgcttgaacctgggaggtggaggttgcagtgagccgagatcgcgcccctgcactccagcctgggccacagagggaggccctggccccaatt

SEQ ID NO: 661582 - DNA, 347 bp, Homo sapiens
  misc_feature (52)..(52): n is a, c, g, or t
  misc_feature (179)..(179): n is a, c, g, or t
  misc_feature (199)..(199): n is a, c, g, or t
  misc_feature (241)..(241): n is a, c, g, or t
  misc_feature (245)..(245): n is a, c, g, or t
  misc_feature (252)..(252): n is a, c, g, or t
  misc_feature (263)..(263): n is a, c, g, or t
  misc_feature (277)..(277): n is a, c, g, or t
  misc_feature (337)..(337): n is a, c, g, or t
ggacattcgtagtgatgtagaagaatcagactccagtgaggaggcggcggcngccaggaacctctgcagctaaagaacgggacagctggagggcccaggcagcccccactgatggccctcggagccgggtggccgggcgttctgaccaacaggcacacaacagccacatagccgggcgnggctggctgtaaggggttgnccccccgacagtgccttggatatttctggggtgactggactngcgnccctggncaacctttctngagacagggagggncccaccccggttgttgggaaaggctgatgatctgtctccagccccttccttcttgcccanccaccttttt

SEQ ID NO: 661583 - DNA, 772 bp, Homo sapiens
tcgatatgtgaccaggcgtcgcgcgcaacagagacacaaacgtgcgacacgcgtctcatgtgacccctttgcttccagagatgaactgtggcactccctccttccattcctaagctctagccagcggcccttgatctctcatactttctccctgtctacacagtcgccatcttggtgacgtttgaagtttagtctggctcctgggcaggtcttctcctcgctctccagtccctattccctcctctgagaatggacccctttgtaattgaggagccaggtggttctgtggccttttcccgtctttgctggcgacgttcctgtttctcacgcctcatggtgactctgattgatctgggtaacatgagggactggcaagtcgcaggcctgtgttgaccctttcctggaaaatcgctcgtagctaagcgccccgtaccttcaggccagatttctggtctttgtgttgttcacatggaaggatcggcagtattccgcggtcctatgtgtgcaccaacggcgtgggagctggcaacatgcgtggacaaaatcgtctagtactcaatctggtcacacctaatcgcgcaattccgcgagtgcttcgacagcgcgacttcctccaccgagcttcaagggttcacccagaaggtacgcttgtggaacttacctgggcatgttgcctagccgattgtccgcggcttagattttgcttttctatctccttgtcttcctcttagtgtgcactaggggcgacttgttcttcacagtacaccatgtg

SEQ ID NO: 661584 - DNA, 1099 bp, Homo sapiens
ggtgaccgtcccgcggtgtggtcgtgggcgtgacagcggttcctcgaccgggtcaccttccgtggctcctcccgacagcaggtgagcagtacaaatgtaccagttgttccaggaattcggtggcccagagacgtgcaagttcgttagtctctactatatatccgagcaaagaaccagcgagccgggcgacgcgatagtgtcaccgactccctaccttggccaaagcgatactagcgttgcaagaggtcaattgccttttgattcccccagctagtgttataccagtcgcacattcgggtgttcatagaggggatgagaaactgataccaaactcggataaaagcggagtgcgttgatggcactaggtaaggaaacacagttcgtgacaattgcaaggcttcggggatgcgtgattccggaagcgaaactcacacctctattccacagcggggtcgacagtgccctgttgttgtcctgtgacatggtccaacgagtagtgtatcctcatgggaatgtcgggctgggctttctgggtctacactgaatggccagaagttgggcctgagtagtggtgggaactgtcctggctagcattataaatatcaagcttatccgtagagtcaccccctgtagactgtctcgagagtatgccgtggatcaaacgcggacttaccccaaatgcggggtcgggaaaattgggcggcaccaatgagaacataaggttggacgtatccgctcctggcacagtgacggggagaccacattgaatggggcatttgccaaagtagctcacactacgaactttgtcgtgcggtgggccacatccgggagatcggttccgttcccgtgacgaccaagacacgctgggacctggactgattccaaagggaagaaagactagagaacgcaaaccagaaaattagggaagaagggccagctaggacttctaccaaacttgagacttcgaaaggttgagatgggggtaccctggaagaaccaatgcgcacgagacgcggattaagacacgcccgggttttgtttgaccccttagtaatttggggttatggcaacacctggttcaaacgattggcggttacgg

SEQ ID NO: 661585 - DNA, 316 bp, Homo sapiens
gagtgatgagtttggtaagtacaatgccagtcagggcacctacggtgaaaagaaagatgaatcctagggctcagagcacttgaggaggatcatttcatatgggcttccggggagatgtggcgacgtcagctaaaataacttggaccggccggagggggactcgcgactgacttactggtacgcggacggtcgacaaatactgctcggtggtgtctaccggtctacttcctaccgtgtaaaatactactggtggtgctcaccacgactaaaccccctacggacagccaatttgactactcactcggcttcagaccca

SEQ ID NO: 661586 - DNA, 1004 bp, Homo sapiens
  misc_feature (228)..(228): n is a, c, g, or t
  misc_feature (642)..(643): n is a, c, g, or t
  misc_feature (828)..(828): n is a, c, g, or t
  misc_feature (901)..(901): n is a, c, g, or t
gggagaaccaggagagaaaggagtcccaggcaaggagggggtccctgggaagcctggagagcctggattcaaaggagaaaggggagatcctgggatcaaaggtgacaaaggacctcctggtggaaaaggccagcctggggaccctggaatcccaggccacaaaggccacacaggcctgatgggtccccaaggactacctggggagaatggaccagttggacccccagngcctccaggccagccgggatttccaggactgaggggggagtctccatccatggaaaccctgcgtcggcttattcaagaagagctggggaagcagcttgaaaccagactcgcctacctcctggcccagatgcccccggcgtacatgaagtcatctcaaggcagacctgggcccccagggccccctggaaaagatgggcttccaggccgggccggccccatgggggagccaggtcgtcctgggcaggggggtctggaaggaccctctggacccataggtcccaaaggtgagcgaggagccaaaggtgacccaggtgcacctggagttggcctccgaggcgagatgggaccccctggaatcccaggtcaacccggggaacctggctatgctaaagatggacttcctgggatccctgnncctcaaggggagacaggaccagctggacatcctggcctcccaggacctcccggtcccccaggccaatgtgacccttcccagtgtgcctacttcgccagccttgctgcccggccgggtaatgtgaagggtccctaaaggactctggaaagccagaagactgcagtggatttctgaaacttgaactnagagcccagtgggaagccagaggtcttgaaagacttcagccatgtgttcctttttttttctttcttttatcgnttgctttttggtttattttcttgagagacctttttttcttaaatccaccagacgctgcggtcggtcagattatcctcactatacttgtgtcgtaaatatataa

SEQ ID NO: 661587 - DNA, 608 bp, Homo sapiens
ggtatgaatggctccacgagggttcagctgtctcgttacggtgttaaccctagtgaaattgaccgtgcccgtagaagaaggcgggcataacacagtcaagactgagatagatccctagtggagctgtgtaatctctattaaagtgcaacacagtacataactgatcccacaggtcctggaactacgcaaatccaggcatgtagaaaattatcggattggggcgacctcggagcagtaactccaactctctcgagcaagtacatgctagagacttcaccagtcggaagcgaactactaatactcaagttgatccgaatcaacttgacacaacggaacaagtgtactcctagggataacagcgcaagtctcgtattctagagtccatatcaacaactatgggtttacgacctcgactgttaggatcaggacatcccgatggtgcagccgctattaaaggttcgtattgttcaacgattaaagtcttacgtgatctgagttcagaccggagtaatccaggtcggtttctatctacttcaaattcctccctgtacgaaaggacaagagaaactaaggcgatacttcacaagacgccgtccgccgtaaatata

SEQ ID NO: 661588 - DNA, 455 bp, Homo sapiens
  misc_feature (279)..(279): n is a, c, g, or t
  misc_feature (352)..(352): n is a, c, g, or t
gtgaactgggacttccaggactgaaaggtgaccgaggtgaaaagggtgaagctggtcctgcaggccctcccgggttacctggaactcatccctgttcacaccacatccacggatgcccggagaacaagggcccaaaggagagaagggcgatccaggccaatgtgacccttcccagtgtgcctacttcgccagccttgctgcccggccgggtaatgtgaagggtccctaaaggactctggaaagccagaagactgcagtggatttctgaaacttgaactnagagcccagtgggaagccagaggtcttgaaagacttcagccatgtgttcctttttttttctttcttttatcgnttgctttttggtttattttcttgagagacctttttttcttaaatccaccagacgctgcggtcggtcagattatcctcactatacttgtgtcgtaaatatataa

SEQ ID NO: 661589 - DNA, 198 bp, Homo sapiens
cccggttttattgtctatgaagattattcttttcaaagcctcagtggtccagcagggacccttccctggagacaccggcacacaatcccttgctgattcttttataaatcccgtgcttgcaaaagtttatattgcagtaggttcgggttgaattacacaggcattgaagtgtccccgtaattagggggggatcctcta

SEQ ID NO: 661590 - DNA, 330 bp, Homo sapiens
  misc_feature (173)..(173): n is a, c, g, or t
agaggatcccggctatcacataatcgggggaaggcgcttgtgaagtaggcttatttctcttgtcctttcgtacaggaaggaatatgaagtagatagaaaccgacctggattactccggtctgaactcagatcacgtaggactttaattcgttgaaccaaacgaacctttaatnagcggctgcacccatcgggaatgtccttgatcccaacatccgaggtcgtaaacctctattgtttgatattggactctaagaatagggattgcgcttgttatcccctaggggtaacttgttcccgttgggtcaaggttattgggataactgttgatag

SEQ ID NO: 661591 - DNA, 691 bp, Homo sapiens
  misc_feature (1)..(1): n is a, c, g, or t
  misc_feature (678)..(678): n is a, c, g, or t
ntggtcaaataatggcactggattaatttttaccaagtaaattattaaaggaaatctaaacggacaatttgcattatctttgagtatttgtgattattagctggtagtgacgaatttaacttgatgaatgcccatattgtctgtaaataaattaactcacttgagtgttctcatatttttcccgattttttagttgaatgcagctttagaacattaaattgtgccatatattaaataaaataattaaacaataccaacaagcactcttaatttgctcttctaaattttatatccttatgtagtttattattttattcaacaaatacttgtggagtggctactttgtaccaggtactcttttcatcactggaaatataacactgaacaaataggctgaaatctctgccctgatagagctttcattctggtacattctagaatgaggcattttaagaaaaaaaaaagtatgatatgtgggtgaaatagacagtttaaacaagaagtaaaatgactattaagccagttaataccaaggatatggaccaaattgaagccaataaggagcattgataatatgagaaaggaagggtttgggtctggagggggttttaacttaaaataaggtcatttgggaaagacctctttgattaagagttaagggatgggagttacaaagtnctaaggaaggaga

SEQ ID NO: 661592 - DNA, 154 bp, Homo sapiens
cacgaggggaaacggtagcttaggacagttggctgttaagtgacactgattctccccgccccgcctgacccccgagaaggaggcttgtcccccgctgcgtaaagtggtgcggaagtgggtactccattctgatacacctgggaggggggagtgg

SEQ ID NO: 661593 - DNA, 667 bp, Homo sapiens
  misc_feature (18)..(18): n is a, c, g, or t
  misc_feature (263)..(263): n is a, c, g, or t
  misc_feature (268)..(270): n is a, c, g, or t
  misc_feature (272)..(275): n is a, c, g, or t
  misc_feature (277)..(278): n is a, c, g, or t
  misc_feature (303)..(304): n is a, c, g, or t
  misc_feature (308)..(308): n is a, c, g, or t
  misc_feature (313)..(313): n is a, c, g, or t
  misc_feature (319)..(319): n is a, c, g, or t
  misc_feature (587)..(587): n is a, c, g, or t
  misc_feature (641)..(641): n is a, c, g, or t
agtgcctgtccacaatanaaaaaaagtcacaaaaacaaaaacaacaaccaaaacataaaaaagaaacaatttgccaaataagctaatttgttcctaagagtataaaaagtacaaaatattcaccttcttttcagatctctcccaagcataattatcctccttgacaaactgaacagaaagattcagcagccgccacactgcactggtctttcaggggacaatgtaagaaaggtggatgtgaaccacagtccctctgtaaagangtaannnannnncnnccaaagaattctagtcaacaaaacnngccncagtntgtccntccaatctctatccccaaacaaaggaaatcactaaaaaaacagatcacacttctttttataacagaaaaatatttatgtaatgatggcagcgcgcaaattgattgggatgttaataaataaaaaggaacaagtatcaacaagctgcaaatgaggaagaaaccaacctacctgaaaactacaaccaaattctcatggctaataagtgatggcagtcagaccatggcccctaatggaagtcagggcagcctcacccactgaaatgttgtntagttggagctgatagcctcagtgttagataaaaattgtgcaacacctgtagcnacaaatttttttttttttttggaaat

SEQ ID NO: 661594 - DNA, 148 bp, Homo sapiens
gtcccagtaacgaacatgtgtacacctttgcattctatacagtcccctagaaccagtaagttccttttcctgacaaagctgttgctgaaccatttcagggttccaccacattgaccactttaaggggtaggtggtaaggcaaagcaag

SEQ ID NO: 661595 - DNA, 327 bp, Homo sapiens
tggtgatatggcactataccgctagcacttcctttgttttgccacgggagcccccactgcatctctgcgctcgcctttctgcgctgccacccttatttcctttcatccgctcccacctcttcagttttctggcatattcttgagcatcttttaatccaagatctgtgcagagacgaactaagaaacgcagacgaatagtatttttctcctgaaaaataattacactttgcaatctctggaccagggagaactgacttccttggaaggaggtttaaagggtctctctccatgtgtcctgtcctcacgctgccagaaccacaaatatcg

SEQ ID NO: 661596 - DNA, 116 bp, Homo sapiens
ctgtgcactaggcccttgtttatatcctgctgcagaacttttccttactgatgtgtaagacatagttctatttactaaagaggcttgcaatcatatgggtgtgtgtgtgtgtgtgt

SEQ ID NO: 661597 - DNA, 934 bp, Homo sapiens
  misc_feature (1)..(1): n is a, c, g, or t
  misc_feature (19)..(20): n is a, c, g, or t
ngaatgcagagaaggcacnncgaaactcacgacggccccagtgatgccgctgacggtcgcccacctgtgaacaccaacacttgggctcgggaagaacgtcctgccccacggcggtaacgcgaccccggtggtgcggaaaaatgcgtcgccgaccacaaatgggggcccccccctctcatgtgagtgtcccctgcagcgtggttccaaaaccgcgtttcgccccccataacatccgggctgcgaaaatgaaggatgaaggccggcagaaattaaagacctggggcatgaaaaattcagggccccccctccacgcaacgcctgttgggagcgcctccccccatctctctgtgaggaacccgtccgcgatgagcaagcaggttgtcgcagcagtcccccccccgccatgggttatcagtagctccccccccgactccggccgaaatttgtccgtaaccctgcccccggaacacataatgggcgccaacgtagccaagaaaggtgagaaccaggggggcgcccctaaagaaacagagacaatgtcccccagaataaatcgcggggtgacccccaagataactcaccacagggccccagacgagaggaaaaagaggagcggtccaacacaagggcacaagagcaaacacaaacgggagcgtgacaacttcctcgcccctccccgccgcaccatggatacaactcaagagacgctatcccaaccgccctcggatggaaccacacccagcagttctcggcgcccacgcaacataccacaacagaacgggacatgtcagaccccggggagaccccctcacagacgagggagccgcgctccgcccagccccctgccgacagcgagcccgccgctccaagcagatgctcattccccggctcgacagcaaaaaatcttattactattacacaacaacaaagcaaa

SEQ ID NO: 661598 - DNA, 557 bp, Homo sapiens
caacgatggtcctcagctactcagtgaggtgaggcaggagaatggcgtgaacccggaaggcggagcttgtagtgagcagagatcgcaccactgcactccagccggggcgacagagcaagactccatctcaaaaaaaaaaaaagaaaatattaatctagtacgtcaaaactacagacaaaatatgtctgagaaagggaaaattaaggtaagataacatttcaattggaggacaacaatccaagagccatggtcaaatattcttatagggtatgactattgggtctcattcagaaggacctcaggtccacagtaataaagctttcaacacttcctttaacaaccatctcggcaaatattagttatataattaataagcaagagaggtaataggggagggtaatcaaggagggcttccagtaagtcaagactgggattcagcctctatcactggtaattatgtgaccttggttaagtcacattctagagttcctcatctaaaaattgggaatattaagtcacctcaaaggtactgaggccatatgtgagcaaaattaaac

SEQ ID NO: 661599 - DNA, 471 bp, Homo sapiens
tttttgaacaattccaactccgttctagtggcatcatctgttcgccatgcaatgggaaggggcattagctgacagagtggccttaaccaagcaaattgttttgaagaaatgtataggaatcttcacatgcaaaatgatcatcctcatgagatgctagaaggatggaagattcatgtatcttttatatgtatttttttgaagaagggttctcactgagtggcccaagctagagtgcagtggcgcagactcagcctcctgagtagctgggtctacaggcacagaccaccatgcctggttattttttttttttcttttggtagagaaagggtctcactatgttgcccaggctgcttgaactcctggcctcaagggatcatcccacctcagcccctcaaagtgctgggattatggatgtgaaccattgctcccaactctatcttttttttctttttaagaaggagagtgtttatt

SEQ ID NO: 661600 - DNA, 143 bp, Homo sapiens
  misc_feature (138)..(138): n is a, c, g, or t
gccgggcgggccgcgaggctaggaggcggcgggagctgggcagagcgcggggcggccggggctctcgctccgacccgcgcccgcgacccttcctgggacccgagcccgagacccccgccggcccccccggggccgctngcggg

SEQ ID NO: 661601 - DNA, 759 bp, Homo sapiens
ccacgcgtgcggttacattggaccggctatggagtcgcgcggtaagaagcgaacaacctctcgtcttcggctcgcgtcatcagtgtcggcagtcgcgaagcaggggtcatgcgtgagtgcgatctcgcatccactgtggctctgggtggtgtcctaggtattggcaatgccttgcttgggagctctagtgcctggaacatcgggtatccagccacgattgggcagatgccaagtgagcaagaccacttggaggcgaggtagatgattcgcttcaacatgcttcttcagtgacgacgggggctggctagcatgtgccccggcgtcgagagtaatgtaagactgtggatacccacagtactagttgatgaaagttcagcgagcatggcacctaccgccatgactcttctcgaccctgagcaaattatcaacacggcaccagaagatgctgccaataactatgcccgaggagcactggcatcgcaatgtggcaagggaggagtcacttgaccctcgatgtcggaccctgacatttcagcaacgcgtggctcgatcgaggtgcccgggtctccgaggggctttcgtgtggttttcctagcagcttcggtgggggaactggttctggggttcagctcgctgctcatggaacgtcgtcgtcagttgattatggcaagaagtccaagctggagttctcgtatttacccggagccccaggtgttccacagctgtagttgagccctaaaaattccatcctcaccaact

SEQ ID NO: 661602 - DNA, 155 bp, Homo sapiens
ggccgacgatgctcggaatacgcggaatgagatttcagagataagcgggtcatccagaggtctgcaggctgacgatcgacaacatcaagaaccagcgttgccaagttggatggccgctcattggcgaggctgaggagcgtggggagctggcgctc

SEQ ID NO: 661603 - DNA, 124 bp, Homo sapiens
tgcttaccttcttgctttaatggaattgttaagggctaagcacatagaaggccaaaaaaggagtttcccaaccccagcaaatcaagtgcttggattctagaactgccaaaagaaacctgcactt

SEQ ID NO: 661604 - DNA, 336 bp, Homo sapiens
agtgtgatgctagtcctgcatatgtcgtcaatacacatatatggtttccctgaaagggattatctcatccctctacctatgccctgctcgttccatctggacttgtccacatatccctctggttcccacaactgccccactgtccacagtccccacgattaagcacccctcttctgccatctctcaacagcccctgactaacaacattctccaagcctacattgccccctcgcttctaccactgccaccacttatgggccatccagcttggggcatacctctagcacgtcgacctgacaggcctgctagccttggccctcgaccgtacgttactac

SEQ ID NO: 661605 - DNA, 906 bp, Homo sapiens
ggaggcgtgggcacgggacgcctgaggggttcagctcggacgaggtcgtggggccaagagaggagtgggtgacagtcccaagttgggctgcggagaatcgctgtttctccacgcccactcactaactctgcactggaagtgtctgacggatgacaggctgttcgtactgcttgcgctctcttcatcatcgcgagctccggggagaagccggtccccagctctccccgcagtgtcaccagtgggccccaatgtgaagatcaacgtgctggaagacttgagggagagaaccctcaggtgcccaaggttgagaagagcatcagcgggaccagcccctaaacgggaacaactgccctgtggcgtgggcgtcgccttcttcctcatgacgtgtcttggcctcctagctctgcgccctcccctgggggggggcagcagatggggcgggggcttggaaggagcagggagcctttggctctccaggggaagcctagtgggcctagaacccgtcgtgccatggtagaagggggcctgcaccatacatctgtgtccgcccctctacccttgcccccacgtagggacttgtgtggaccaatggcacgaggacgtcgtgggtccaggcggcttgtggtcctggtaggtgggtagcaactggggccagaagggaggctaaggtgctggcctggtactttcctgatctgtgcgtctcgttggcccagaagatatgcccagagaggaactgacgtgggggcccatggccctcaggcagaacgggcgggcatagggggggacatgcaggcgtcccgtagaaaaggcccagcatcagggggtgggtacaagatacacgggggaggcaagaaggaggcaggcaaactaataaaagacaccatgagacaaagagcagaagcatca

SEQ ID NO: 661606 - DNA, 334 bp, Homo sapiens
  misc_feature (13)..(13): n is a, c, g, or t
  misc_feature (19)..(19): n is a, c, g, or t
  misc_feature (81)..(81): n is a, c, g, or t
  misc_feature (145)..(145): n is a, c, g, or t
  misc_feature (152)..(152): n is a, c, g, or t
  misc_feature (212)..(212): n is a, c, g, or t
  misc_feature (222)..(222): n is a, c, g, or t
  misc_feature (263)..(263): n is a, c, g, or t
gtctcactgtttnccaggntggagtgcagtggcatgatcttggctcactgcatcctccagccccccgggttcaagcaattntcctccctcaacgtcccgagtagctgggactacaggcgtgtgccaccataccttgccaattttngtatttncagtagagatagggtttcaccgtgttggccaggctggtcttgaactcccgacctcatgtnatccacccanctctgcctcccaaagcattggggattatagacatgagccancatgcccagttcatcaccctaaaaataatccccacgggccggggggcagtggcctgggccaaatatgggtg

SEQ ID NO: 661607 - DNA, 245 bp, Homo sapiens
ctgccacgccgtaaaacagactgagcaatcgggatggacgaagtgttgctgcacacgccgaggaaccatacacttcttaaaatcatatcagaatggacgaagttgttgctgcacacgccgaggcaacaacttcgtccattacgacctctcgtgtgttgctcggcgtgtgcagcaacaacttcgtccacaaagaccttactgcgaatacagggtactcggcgtgtgcaattaggtcactcggcgta

SEQ ID NO: 661608 - DNA, 188 bp, Homo sapiens
aaaaaaaaagaaaaaaaaacagaaggcagtgagctcactgtgctggaccgactatatgcaccatagacataacgactactgaatagcaaataatagtgaacaataagccccacaaagtccctttaggtattgatttagaaggttttcgaagctcacttgacatacctgcattaatgaatcggcacacg

SEQ ID NO: 661609 - DNA, 100 bp, Homo sapiens
  misc_feature (23)..(23): n is a, c, g, or t
  misc_feature (28)..(28): n is a, c, g, or t
ccgcggcgcaacgtaggcatccnggacnatccatctccaagttaaccagcccgtgctgcccaagttctggggcaggtaggagagggccgtcacacacctg

SEQ ID NO: 661610 - DNA, 197 bp, Homo sapiens
  misc_feature (113)..(113): n is a, c, g, or t
ggggggtgcttctttattatatgccagagggtgctttcaaaggaattatcaaaacaatggcatggactaatgtggccaccgtatcttttatccttctgttttaaaaaataaancgagcaaatcattactcctctcctgtttgaactagaaatgttgggaaacccctagagtgcttatcacggtgaagtttagcagtg

SEQ ID NO: 661611 - DNA, 224 bp, Homo sapiens
  misc_feature (38)..(38): n is a, c, g, or t
ggttttttttcccccccctttggggggttgggcccccngggccaaaaatttgggcagggggcccccccaatttttgggggtttcccttttttttgttttccccccccctttttttttttttaaaggtggggccccccccttcccccccagggggggggccctttcacaccctttggtttttttccccaaaaaaaaaaactaccaaaaaaaaggtttaaacctta

SEQ ID NO: 661612 - DNA, 305 bp, Homo sapiens
ggttttggccggttttccccccccccagccccttttttgggcccggcccaggggatttgggccctgggttttttttccaaatggggggtttccaaaggccccccccccggggaagaaaccaagggggttcccttggggggagggggaggccccatccctttccccccttttggggggggccccttttggggaaagggggccggggggggggcccaaagcccccccgcccaggggcccctttcccggtttgttttcaaaaaattggccccccccccttttggggggggggaggttttaccccccca

SEQ ID NO: 661613 - DNA, 166 bp, Homo sapiens
tcgcctagatcactgtagtaggctcacccaggcccagaagtgagcttattcactaggctaaaactggactagacagcaaaagatctcgcaggaagccaaaatctcgcaagtaggtaaggaaaagggcaaatacaaggaagttgctaggggggtacgagctcgaatc

SEQ ID NO: 661614 - DNA, 619 bp, Homo sapiens
cggtctgagcagatagcggacgtggagcacatcctccacagcccagatctttcatttttttgcgacaggatctcgctctctcacccaggctcgagtgcagggcatgatctcggcccactacagctttgaactcctgtgctcaagtgatcctcctgcctcagcttcctgaatagctggggctacagacacatgctactgtacctggctaatttttgtattttttgtagagatggggtctccctatgttgcccatgctggtctcaaatgcctgagctcaagcaatcctcctgcctcaatctcccaaaatgctggaggagataagcgggacgtgtgagccatatcctccagagcccagattctatcatttttttgagacaggatctcgctctctcacccaggctcgagtgcagtggcatgatctcggcccactacagctttgaactcctgtgctcaagtgatcctcctgcctcagcttcctgaatagctggggctacagacacatgctactgtacctggctaattttggtcttttttgtagagatggggtctccctatgttgcccatgctggtctcaaatgcctgagctcaagcaatcctcctgcttatctcctcggggatc

SEQ ID NO: 661615 - DNA, 957 bp, Homo sapiens
gggctccccgaagcggcagaaagttcctggccactctctgccgcttgtggttgggcgaagccaggaccgtgccgcgccaccgccaggatatggagctactgtcgccaccgctccgcgacgtagacctgacggcccctgcatggctctctctgctcctttgccacaacgtgacgacttctatgacgacccgtgtttcgactccccggacctgctgcttcttcggaaggacctggaccctgctgcctgatgcacggttggggctgctgctcctgaaaccctgaatgagcactctgcacttccccgcatgtgcgtgtgcaccctggcccctggtgctgcactgtgatgtgactgatgcatgtgctgctgcagcccagctgggcaccaccatggccgtgggccgctgcctactgtgtggcctgcaagggcggtgcaaggccgcaatgaacaccaactgcccgacccgcctgcaatggcccgccgccatgctgctgaggctgtgagccgccatgagcaaatgtaaattgatgtgcctttgagacactcaatgctgctgcactgtctgaggcaatccaaaccaatacggttgcccaaggtggatgatcctgcgcaactgccatccgcataatatcgatggggcctgcagtgctctgcttgcagcgacacatgtgacgccgcgcccctggctgccgcatgcctgccttctatgcgctgtggcccgtgcccccgggcctgctgtggctgagcactacagttggcaactccgacgcgtccagcgctgcgctcaatgctctgacggcatgatggatacagtggccccccgggtggagcctgtggtgaattgtaaaagggcctctaaacgatggccaggacatgcctggaagagtgtggttaagctaatgctgcccattgaggttccacgaagcttggccacctgtggaggcatgggccgcgaattgc

SEQ ID NO: 661616 - DNA, 323 bp, Homo sapiens
tagtcaaaacttgtaagctgatcatactaagtccagatgcacctcaattaacgatgggagtaacatcctgataaatacacagtgaagtcaaaaaaatattaagttgaaccatcgttaagtcacatggctagagtacaataaaactaagggaatgataggggagtcatgaggatgcacaagtcagaccccagtctaacgaaaagaggtacatggttagagtaatgccgataacctttacatttcatattactggcactcatacttacctagaagaggaatggacatccgtggcctctaataaattgggtaccgaagctcaactt

SEQ ID NO: 661617 - DNA, 107 bp, Homo sapiens
catttacgatttcgaaaacattaaagcaaacccccaaacaccccacaccgtacacaaaggcgtggtttggaaatcaccactgagatgctggttctccctcgcatgtc

SEQ ID NO: 661618 - DNA, 369 bp, Homo sapiens
agacagagccctggtctcgccaggctggagtacagtggtgcaattatggctcactgcagcctcgacctcctgggctcaagtgatcctcccacctcagcctcctgagtagctaggactatagacatgcactaccatgcccggctaatttttgtattttttgtggagacagggtttttccatgttgcccaggctggtcttgaacttctggactcaagggatccacccacctcggcctcccaaagtgctgggattataggcatgagcactgcacctggcccttgttaagttttaattaacttttttgtttgtttcttttttttttttgcgacagagtctcactctgtcaccctggctggagtgcgtcgacgc

SEQ ID NO: 661619 - DNA, 403 bp, Homo sapiens
  misc_feature (53)..(53): n is a, c, g, or t
  misc_feature (215)..(215): n is a, c, g, or t
  misc_feature (286)..(286): n is a, c, g, or t
  misc_feature (343)..(343): n is a, c, g, or t
  misc_feature (349)..(349): n is a, c, g, or t
cgggagtgcagtgagctgagatcatgcccctgcactccagcctgggcaacagngcaagatcctacctcaaaagaaataatctcgggcgggtgctgtgggtcatgcctgtaatcctgggcttcccaaagtgctgggattacaggcgtgacaacttgcgcccggctggtttgtgcttgttgtatcaaatttggggaaatccttctttgctgccaggnatgttgttttaataaatacagtagtatacctatctataaatgtgggtatatctcatcttgacatttatttnccaatatttgctttgattacaaagggcagacttcttaggaagtttgctttcttaatnaccttnggggttataggggccacagggtttttaaaagggaggttgggattttgcccttac

SEQ ID NO: 661620 - DNA, 318 bp, Homo sapiens
aaatcccaatcacaacccttggtgggaaggctttccactttccacagaccagaacctaacatcaccggtaatacaattagtcacaaatacagtcctcgagttttaggcccatacacatgagtattggtctaaaacatgtcttcttggtagcagctaggcccggccaccacggtgctgggctgagttcacaaatctgtggtaaccggtagcttcccggtcacttctcgggctctcctctccggctaagcttggtttcctaattaacatcttctggccacggccatagctacggcggctatggaaacttctacaactagg

SEQ ID NO: 661621 - DNA, 185 bp, Homo sapiens
gtactattggtgggcacctgtgcaaagaagcaccttgatatgtaacttcgtgtaatatggccagagatggccaatagatgtctctcaagtgtatctgatcaccagtgtcagtgctatagggagtgatataatatggtggttcctaaagttatttttggtctctttttttttttttacgctgctat

SEQ ID NO: 661622 - DNA, 357 bp, Homo sapiens
  misc_feature (351)..(351): n is a, c, g, or t
ataacgctgggcggtggcggcatcgggtttctcgacgaagcggctgacctggaagctttccttgttcaggccctggcctttctcgatatagccaaagccggtctcggcgtgggtgggcaccaggccgaaggtcaccagccagccttgctcggccaattgccgggcgctgtccacggcgttggcgaaagcctgcacatcgttgatcaggtggtcggcgggcagcaccagcagctgtgcatcatcaccgtacaggcggctcacgtgcagggcggcggcggcaatggccggtgcggtgttgcgcccgaatggctcaaggatgaagtccagttcgacccgggccttgttcagcangcgcta

SEQ ID NO: 661623 - DNA, 544 bp, Homo sapiens
acacgttcttttgtggtggcatgtcaactgtataggcattatttatgggtaccgtgttgaatcgtaaatccatagggttatataattattaacactattaatgttgccaaactatcaatatgggttgtatctctatgtatgttggtaatcattttgatcaatatttatagatttctaggtatatactgctcaggtttgtacgtggattcctaagtatttcttgatttaagttctctagcatatggaagtgtttttaaattttcttttaaaattgtttattgttaatgtgtggaaattcaagtaatgtctggtgcggatattgtattgtgcgaatccactgaatttattgcgtagtatggagggaagagataggcctctcatattgttttatattgttttatactcagtagctgttttaggacaaagacgaggaagtgaactccgcgacaggcagaccggcgccaggtctgaaagcagggctgggcctgcctggcctctctccagtagttcagaatccctgtggaaaggtagggatcctctagaa

SEQ ID NO: 661624 - DNA, 439 bp, Homo sapiens
  misc_feature (44)..(44): n is a, c, g, or t
ccggggggtagtgcccacctcaaaaacctcggggctggtggcancagcgtcgtcataggtaatattggtgccctgatgggttacgccacccacaagtatttcgatagtgaggaggatgaggagtagccagcagctcccagaacctttttttccttttgggcctaactcttccagttaggatctagaacttggcccttttttttttttttttttttttttgagaggggttcccacaatattgtccagggtagagtgcagtggctattcccagatgcgaacatagtaccctgcagcctccaactcctagcctcaagtgttcctcctgtttcaccctcccaagtaggattacaagcatgggccggcgatgcccagaatccagaactttgtttatccctctccccaacaacctagatgtgaaaacagaataaacttcccccca

SEQ ID NO: 661625 - DNA, 360 bp, Homo sapiens
aggggctttagggactgccaggctgtttcaaccaggaaggccaaaatcaagagtgaaatgtagaaagttgtaaaataaaaaaagtggagttggtgaatcggttgttctttccccacaattggatgattgtcataaggtttttagcatgttcctcctttttttcccccccccctttttttttttattaatcaaaaaaaacttcaaagttaatgggatggtcggatctcccaggctgaaaactcgttcccctccaagcatttcatgaaaaagatgctttttattaatcatacaaactctccccatgatgtgaaaagtttcccaaatctttcaaaataaaaagtaatggcttaaaaactgcca

SEQ ID NO: 661626 - DNA, 188 bp, Homo sapiens
ctggtcactctaaggaccagctccacagagcatacttattatgatagaacagtacaacttcaacagctgcgtactcttgagacacaaaaaagtgctccatatagttacttgttaattccctaatcgcattacaatatcattactgttgttcttccagggctcggactagcctttagctctcgacacat

SEQ ID NO: 661627 - DNA, 237 bp, Homo sapiens
gacctgttgttcgaaaacgtgttgatgctgctgctcaagcccgttctgcctgctgcactaccgccagccagcctctggtcgtggctgtgggcgcttggcaccatgacggtcatctcgctgctggtggggctacgaccatatcgcttgttgctggcacgcagcctttacgcgtattacgtaatgatgtggtagcgaacgtctggccgctgaagttttatctgccgattgtcagtgtgg

SEQ ID NO: 661628 - DNA, 308 bp, Homo sapiens
  misc_feature (1)..(1): n is a, c, g, or t
  misc_feature (17)..(17): n is a, c, g, or t
  misc_feature (25)..(25): n is a, c, g, or t
  misc_feature (75)..(75): n is a, c, g, or t
  misc_feature (84)..(84): n is a, c, g, or t
  misc_feature (130)..(130): n is a, c, g, or t
  misc_feature (151)..(151): n is a, c, g, or t
ncggccgccgacacggntgcgagangacgacagaagggggaaaagaaaatgtaaaaacctctagaaaactgaaanaccttccanagcttaaatcagccgtcccattgccctgccatccccccacagcaanctacacttccagacagccacnttcacagcagcgagcccaggctcttcctcaggcttgaccgccacagtggcacaagccatgcccaacagtccccaactcaagcccattcagcccaagcccactgttatgggagaacctttcacagtcaaccctgccttgactccagccaaggacaagg

SEQ ID NO: 661629 - DNA, 265 bp, Homo sapiens
  misc_feature (132)..(132): n is a, c, g, or t
  misc_feature (200)..(200): n is a, c, g, or t
caatgatattgatggtcttgacccagtgtaggtctaggctaattttctttgtttgtgtctaagtttttaaccaaaagtttaaaaagtaaaaaaaaaaaaaaaaaaaaaagtagaaaaaagtttttacaatangaatataaaaaataaaatgctttaatatttttaattgagggaaagaaattaaaaataaatttaatgtngccaaagtatacagtgtttataaagcctacaatagtgtataggtaatgtcctagggccttcacat

SEQ ID NO: 661630 - DNA, 354 bp, Homo sapiens
ttatatacaatacgagctcgtgtacctgtgtgtatcatcaatcaggaagggtccccagcgtggggagagccccacagttgagaacaataagtgaacaattgttgtactgaacactagtcacgatgactgctgatcataaacaacctgtgtgtactatgtattcccctacacacgtagcacccttcagcaggaccctataaaactttcctccagcccttgcctctttgcaggttgccccttctctgctgagctgcccactgcaacatattttcacaatttctctaataaatctgcccttctttacctacaactatcttggtaaatggctttaccacctgcaaaactgaccctagg

SEQ ID NO: 661631 - DNA, 1755 bp, Homo sapiens
  misc_feature (1084)..(1084): n is a, c, g, or t
  misc_feature (1429)..(1429): n is a, c, g, or t
tttttggatagtatcgtggtctcaatatagagaatctatccactcctctgtgtggagtaatagaggtatctcttctctcgactcctgcgctgctctttgttgtagatgatgatgtttgcctcctgcgccgacgaaaggtatacatcatcccgccggtgggttccgaatatctgggctcccgctgctactcaaaacccccccctacaggatgttgtcccgctgacctttgggtttctgtgctccatttcttctggggtcgctccgcccgacgaagcaagaatgtgtataggggtccccccaacccccctgctgatattggtgcgaagggagattccctcccaacagggggttggttgaacacctcggggtgatgggcgctgacaaccatttttttgtgtgctccctccggcaaggaaaaaatctgtgtgtggcaaccattttgtgggggcgtccctccccttcctgctgatgagtaatgtggctcttttttttgtagctgcccctcactcccacgacgagggtgttgaaaccacccctccgttgtgtgggtgaaacacacacccacaagatggtattctttttagttggtgcacccacgagcggtaatattatttgtaggaagatttggtagtgttccgttgaagaccgcttttcatactattaccgcggggggttttggtacaaccaccaccaagaggaggctcactaaagaggggcttttacaccaccaacaaagagggggggttttccaccaccacacgcatatctcggtgtgggccaccacgcccctccccacgaggagatagccttgtccctccgcccgcgacacagagcgcccccccccgagtagtgccctctggcgtgccaacacagagttggcgcgccctcggtaattttggggcgcactattgcgcacatctcctggtcgttcctcggtgtgtatagcgccctctgtctctctctttgggacaacacgccccgccacttggggggcacacagagaaagagggtgctatcaccagctggctccccgcgcaccctcgagggagattctcaccccacagagagcagagattgctatatnataacagagatttgtggcccacaccagcggggcttatcaccccgcttatggtctcaacacagggatgctgtgcaacacagtcttctgagtctcacacagagacacacactagcgcgctctcgcacctcgggagactctatatgagacttctattgtctctgacacacacagagagcgactctcctacacccttctctctggagagtgtgcgtctctctgtgtggcccacactcacttggtgtgtatagatgtgacactcacatgtgacactgttgtgtctcactgtcttgtgataagagccgtgtgtgtgtgtgttgtggggacacaccacagagatacaccggngtgtctctctacaccctctccgccacagatcctcttgtcttgtggtgtccagacacaggaaacgcgccggcgtcttgtggagaaagaattgcacccttaagagtctcattgaccacccaccctccccagatttggccctaggcccgcttcccaggaccctagggagagagaaagaaaagccattccatggggcacccctgaagaaaagaacccgaattgccaaggaagaaagagagacttaatagcccgggcaccagattttcccacttggtggggtcctccacattaaaggttattttcccccgttaaaaaaaagaaaaaataaa

SEQ ID NO: 661632 - DNA, 247 bp, Homo sapiens
  misc_feature (72)..(73): n is a, c, g, or t
cgcagacttcgggaggcgagggggtgggtgtagcaggccgagccgccgctcgctccgccgcctaggactagnngttgagttttgtacaagtccgatgccgggggagacggaagagccgagacccccggagcagcaggaccagtaaggggtagaggcggccaaggccgtcggaggagccccaatatcggccccctgaggcggtcgcgcggcgctgcaggaccactagcagccgcgtgctgaggggagg

SEQ ID NO: 661633 - DNA, 326 bp, Homo sapiens
gctctgcttatgaggtcatagaggatcccatcaggcgaagacatgttgtcagagaaagtgtgcaatcatatggactaccatggatgggcaggggtggtcatagcgagagtgatcgtcatcacctatggtgatgctgaagcaagaaacagtacagatccattcatcatggtgtggtgagaggtagatgccgctgtcacccgagaggagcgccacctgtccacagatgcagtagaagggatacgaatatggaaggctacaagttctttgcaggcaggagtggagaactagaacacgccgtgtccacagtgtctacgcctgatgggtac

SEQ ID NO: 661634 - DNA, 452 bp, Homo sapiens
agggaactgggaagtgcctcccaccccagcttcccatgaagcttacctgtcaccttaaagttaaaaagctatgtagctttcctttttcaccgttgaatggagaacttggtcgagtcttagaagtttgattaatatttcagattcagagtcatagtgacttttttgttgttgttcatacatcttactgaacattgtaaacctttaaccttttcttaaaaatgattggtgtttgaccaaatacaccttccctgcctcaagttactaaaagccccttgtcagacgtcctgttcacttccctccatctcggcccccccaaccccgtgaacttttactccctcttccctaccctgtacctctccctggcagtgtctggtttggcacatgacccctgaggacatctggagattctgcgccccctgggacaaacagggcctaggttattaagcaggtga

SEQ ID NO: 661635 - DNA, 346 bp, Homo sapiens
gcttacccatgagaagttgctattctaggctctggggaggtggcggtatctagctgaacataatgggggctaggaccctagaatcaattcttttagaagaaaagccattccaaacatccttgccaatacaataactaaccgctagctcactattcattaaattcaacaaacgcttctccatcacctactaccgtgtaaggggactagggagtgtagatatagagtaacacctagtagacccaacctaactaagacagtaccgctagagggctggtacttaggtataacgcccccaaagctactgctacccatagccctagacccatacagaggccccctacctaca

SEQ ID NO: 661636 - DNA, 104 bp, Homo sapiens
ctgtggaagatggggaccacgtgtgtgcaggagtggcctggtgggactaacaggaccagcatcaccagttgcgaccgcgacggaccagcgtggccctgattggg

SEQ ID NO: 661637 - DNA, 151 bp, Homo sapiens
agctcagctgtaacattgacagatgggaaggccatggtttaacggcagctatctcgctcacagagagctgggctactgtttcctatgtcgccgcctccacagacacttgaagactcgcaccatgaagccatgtccagggtgggtgccactg

SEQ ID NO: 661638 - DNA, 686 bp, Homo sapiens
aagcactgtattttggttgagctggttcacgaacggcttaggagtcaggaccggtaactgcatccacgtgtctgagacctgtgtggagtgtgaccgtggggacagtactgatatcctaacattcaaggataaaagcctgcctacataggggaacttgtatacaaacactaaactatgggcttcagagagcttctgggctgttgaacacattgaggtgctgggagggtgtaatggcgtgagagggcatgaaagttccatgctgtccacctcccatttactttgtacaatgcacgacttacatctgactgtacctgagtcatatgtacaaggaaggaaaaaactatttgttccctatactctaataccactcaacagaatatttctgacaccagatgtatgggggtatttccttacacaccaagcaattctacaagagacaacggttgtgtgtcttctaaattaatacagttctgacactatttacctggaggtagcatcaggtcccacaggttaagggctcattcccacaaggagtgaagtgcctccatttccgataccagacataagtcatagttggtcgcctatactttttgcccaggttgtaatcaagagttccacaaccgccttgcaggttcaatacattgtgtagtagctttcgagcgcaggcatttttctgtgcaggaggc

SEQ ID NO: 661639 - DNA, 1042 bp, Homo sapiens
tggccgaataggaacagctccggtctacagctcccagctgtgagcgacgcagaagacgggtgatttctgcatttccatctgagaccagtgaccttttctatttcatagtaaacaaacttcatgagtacttgccggagtctagggatcgagaatgcactacaaaatcaaagccaaaggggtcgactgacgctggtggcactgcattgacactcttatacagaccctaagtaatcgatgttacagagaaacagaaaccgcagtcatcacgcctgcaacaccattgggcagctacagcaacgggagccactattttaatctctgtggtaaattcttaacttagttgagcctcagattccaaaatcttgtcctgtgttgagatatccagttaggatggctgattcagctttagctcagaagtgtcttcttgacgctgagttacagaagcttattctggaggtatacaaatactggctacagcacctttactatgagatacttctggtcttttcagccagggcacactctcgcgatcggggatccaccaaagcgtggctatatagctggataatgtcctttctaccaagcctgtcctcgcatcactacttttgctggccaggtattgtgaaccaggtggttgcagggctccttcagcttcattcagctggctagtcctgccaaccactctgttgcccagccaattcatctcagtactgtcttggcccagcagcacctagcggagccttcccgcacaaccacgggaacaatcaggcaccatcccagccgcctgcgcaaaaggcccccgggtgaccccaccacacctcccctctgcagaattcccctgcttcgttatccccacattccgcgtcttccacaccttatatcccacaccctatttcacacgatttgtatatcgcatcacccacaaatatgctccctgtccatacctttaaaaaccactcgcatcatcctctactcactcccaactcaacacactccacactacccccctcatactcctctcactcctccactccaccccccc

SEQ ID NO: 661640 - DNA, 235 bp, Homo sapiens
gtacgttgctatccaggctgtgctatccctgtacggctctggccgtaccactggcatcgtgatggacttcggtgacggggtcacccacactgtgcccatctacgagggggtattcccttcccccattgccattcttgcgtcttgaacctgcttggccgggacctgacttactaacctaagaaggttctcaacgagcgcgggctacagagttcaacacacacgggccgcgcgggga

SEQ ID NO: 661641 - DNA, 367 bp, Homo sapiens
  misc_feature (194)..(194): n is a, c, g, or t
  misc_feature (349)..(350): n is a, c, g, or t
taatttccttggttggaacgtgtagttattttatttattcctatattaaccatctaaaccaagtgtaagtgacatggtacactaaatacaggaatggaacattggtagttgtgggcaggtgaacccagtgtgtgtggtgcaatttcaaagctttagaaatatgcggaatggattgtgctgggctattatttccnttgtgcagcagcagcaaaggcaggcaagcaacatgagaacccttaataggtgcatcagtgaactttcaggggaacagttaccggaagaacccatgggtgtccccctcgtgcgtttactgggtgtggacatgcaggcaaggggttaattcatctgnngattccagagctggcag

SEQ ID NO: 661642 - DNA, 644 bp, Homo sapiens
agcggactagcgctgctggcggccccgtgcggccgggcagctgctgcctgcaatgatgtcctgtgctgacctgcgggcgcggggcgggccgtggcgctgtgccggggtgacctcgcgctcgtccctgtgcatggcgtgtgtcatgtcagcgccctgctgtcccggccgcgggctacgtgatcgtgagctccgtagtcttggtgccgtcaccatcgaggtgtgacgagtgagctggacgcgcctccactgaggaggctatgcccgcgctgctgaggattcgggcacatctggcgaagcttccccgcctctgcccacaaggaggacgcgcacctgcggccccgggcgggcgccgcccgggccaggcagccccccgcgccacccgggatgttctcctaccggcgcgagggcggccagacggccagtgcgcccccgggccctagactgcgcgcttgccaccgcccgctccctggcccatgccagcgtctggggctgcctggccaccgtgtccacccatcaagaagatccaaggactgccatttgggaactgcctcccgtcagtgatggcccttcatcaatagcactgggattcctttcttctacatgacatgcaaggagccctgtggtggctgactctgatgacgaaa

SEQ ID NO: 661643 - DNA, 241 bp, Homo sapiens
ccagaggcaccaaggagtgccagaggcaccaaggaggccagaggcaccaaggaggcagggacccttgcctccttgcagcctctgggccccaggctgagcctcagtctccctccctcgaggcccatgcagaggctcacaacacacagaacagagctcagccctgcggccagagagagagggatgtagctgtgcagatagagaggcatggcaacgtaagactcggtagtagtacacacttgat

SEQ ID NO: 661644 - DNA, 300 bp, Homo sapiens
cggctagttcgagcctggtgttaatcggccgagggcgagaggtatactgcgttccatcccgacccggggcacggtactgggccctgtttcccccctcctcggccccgagaagccaggtccgccttctgcagggttccccagtggcccccgctccaggccgggctggaccgactcgctggcgcttcatggagaacttccaaaaggtggaaaagatcggagagggcacgtccggagtgtgtacaagccagaaacaagttgacgggagagggtggcgcttagaaatcgcctacccccccgggg

SEQ ID NO: 661645 - DNA, 157 bp, Homo sapiens
ctctagaggaccgtcttacacaggcgtacatattattatacttatacagttataacttcattcatggtcctgatcctgggcatccggtgaaagttgcagttttactcctcagacgatgagaacaacttccccaaacaagtttgccagggcaggagaa

SEQ ID NO: 661646 - DNA, 131 bp, Homo sapiens
taggggcttactgtgagcggcactaacccaggaggaactgctccgggaggacacgatcacagaagagcttactttacggtcactggagacatactgagcggctcgaggctgactaaccacagaagcaggtt

SEQ ID NO: 661647 - DNA, 912 bp, Homo sapiens
gcttcggaataagctcccatatggtaacttactactccggaagaaaggaaccatgtggatagcataggtatggtactgagctatgatatcaattggcttccatagaggttcatcggtgtgagcacatcgcatatatttacacgtaggaatagaggtagacgcgagcgaggcatattgtcacctccgactaccatgaatcatcgcatatgccctcagccggcgtcaagagtattgagctgagtcgccacactccaacggaggcaaaatgagatgatctgctgcagtgttctgagccctaggattcgatcttctcttgtgtcaggcgtaggtggatctgatctggcattgtattagctaaactcgatcaactagacactcgtatcctacacgtagcgtagtacggtgtagctcacttccagtatgtgctatcaataggagctggatgggccatcataggaggcttcaattcactggatttcccctatgctcaggctacggcgctagagcaaacctatgccaaaatccatttcagtatgcatatgcatcggtgtaatctaacctttttcccaagaacttgctcgtgagtatccggaatggcccgaggttaactttggatagccgatgcgtacagcgtatgaaaatctattatctgtggggtcattcatctctttaacagtagtgatattagtattggccatgatttgggagcgttaggttggaggaaagtctgttagttgaagaagcctcaattagggtgagtgatattttggtgccggacttgcaattggggacgtttgtaatagaaaggggggtggacccagtggtgagggcccggcccgttcaaaaaaaaaaaagggggggggaaaaaaggggggaaaaggaagaaggagtgaagggggaggtgaagagcgg

SEQ ID NO: 661648 - DNA, 907 bp, Homo sapiens
  misc_feature (764)..(764): n is a, c, g, or t
  misc_feature (775)..(775): n is a, c, g, or t
  misc_feature (781)..(781): n is a, c, g, or t
  misc_feature (784)..(784): n is a, c, g, or t
  misc_feature (793)..(793): n is a, c, g, or t
  misc_feature (802)..(802): n is a, c, g, or t
  misc_feature (817)..(817): n is a, c, g, or t
  misc_feature (819)..(819): n is a, c, g, or t
  misc_feature (831)..(831): n is a, c, g, or t
  misc_feature (835)..(835): n is a, c, g, or t
  misc_feature (839)..(839): n is a, c, g, or t
  misc_feature (841)..(841): n is a, c, g, or t
  misc_feature (844)..(845): n is a, c, g, or t
  misc_feature (851)..(851): n is a, c, g, or t
  misc_feature (860)..(862): n is a, c, g, or t
  misc_feature (865)..(865): n is a, c, g, or t
  misc_feature (868)..(868): n is a, c, g, or t
  misc_feature (876)..(876): n is a, c, g, or t
  misc_feature (880)..(880): n is a, c, g, or t
  misc_feature (890)..(891): n is a, c, g, or t
  misc_feature (894)..(894): n is a, c, g, or t
  misc_feature (897)..(897): n is a, c, g, or t
  misc_feature (899)..(899): n is a, c, g, or t
gtggcctgctcttcctgcgggctagctgggcggtgggggctgccagcagcagcggaagtgcggtgcacgcgtggccatggctccctgttgcggagtgccgagcactcggcgctgaaccctgctgctgcgctggtgtggctcacgctgaccgcctgccttcctgctgaccctactgctgcagctcctgcctgccctggcctgctccctgggctgcgctgatcttccaggacctgatccgctatgggaaaaccaagtgtggggagccgtcagcgccccgccgcctgccgagcctttgatgtccccaagagatatttttcccacttttatttcatctcagtgctgtggaatggcttcctgctttggtgccttactcaatctctgttcctgggagcaccttttccaagctggcttcatggtttgctcagaattctcggggcggcacagttccagggaggggagctggcactgtctgcattcttagtgctagtatttctgtggctgcacagcttacgaagactcttcgagtgcctctacgtcagtgtcttctccaatgtcatgattcacgtcgtgcagtactgttttggacttgtctattatgtccttgttggcctaactgtgctgagccaagtgccaatggatggcaggaatgcctacataacagggaaaaatctattgatgcaagcacggtggttccatattcttgggatgatgatgttcatctggtcatctgcccatcagtataagtgccatgttattctcggcantctcaggaaanataaancangagtggtcnttcactgtnaccacaggatcccantnggaaactggttngaanatgntnctnnccctanctacttagnnnagntgntgatctangttntcctggccgnnacnttngngttccaca

SEQ ID NO: 661649 - DNA, 437 bp, Homo sapiens
aaagacatacttgagactggttcatttatacttgagactggttaatttataaagaaaaagaggttttattgacccacaattccacgtggctggggaggcctcacaatcatggtggaaggtgaaagtttatatcttacgtagtggcagacaagagagaacttgtgcagggaaacttctctttataaaaccatcagatctcatgagacttattcactatcatgagaacagcacaggaaagacccacccccatgattcgatcacttcccaccaggtccctctcatgacacatgggaattgtgggagctacaattcaagatgagatttgggtggggacacagccaaaccatatcaccttactttgaaactttaaaatgttttgtatatagttgataactttggagagatttgggttaaatgttggtcgacgcggccgcgaa

SEQ ID NO: 661650 - DNA, 655 bp, Homo sapiens
  misc_feature (30)..(32): n is a, c, g, or t
  misc_feature (512)..(512): n is a, c, g, or t
  misc_feature (523)..(523): n is a, c, g, or t
  misc_feature (529)..(529): n is a, c, g, or t
  misc_feature (532)..(532): n is a, c, g, or t
  misc_feature (541)..(541): n is a, c, g, or t
  misc_feature (550)..(550): n is a, c, g, or t
  misc_feature (565)..(565): n is a, c, g, or t
  misc_feature (567)..(567): n is a, c, g, or t
  misc_feature (579)..(579): n is a, c, g, or t
  misc_feature (583)..(583): n is a, c, g, or t
  misc_feature (587)..(587): n is a, c, g, or t
  misc_feature (589)..(589): n is a, c, g, or t
  misc_feature (592)..(593): n is a, c, g, or t
  misc_feature (599)..(599): n is a, c, g, or t
  misc_feature (608)..(610): n is a, c, g, or t
  misc_feature (613)..(613): n is a, c, g, or t
  misc_feature (616)..(616): n is a, c, g, or t
  misc_feature (624)..(624): n is a, c, g, or t
  misc_feature (628)..(628): n is a, c, g, or t
  misc_feature (638)..(639): n is a, c, g, or t
  misc_feature (642)..(642): n is a, c, g, or t
  misc_feature (645)..(645): n is a, c, g, or t
  misc_feature (647)..(647): n is a, c, g, or t
gcgcccgctccgatctcctaagagaaaaannnaaaaaaaacagatcgcaactttactaataactaccacttttatttcatctcagtgctgtggaatggcttcctgctttggtgccttactcaatctctgttcctgggagcaccttttccaagctggcttcatggtttgctcagaattctcggggcggcacagttccagggaggggagctggcactgtctgcattcttagtgctagtatttctgtggctgcacagcttacgaagactcttcgagtgcctctacgtcagtgtcttctccaatgtcatgattcacgtcgtgcagtactgttttggacttgtctattatgtccttgttggcctaactgtgctgagccaagtgccaatggatggcaggaatgcctacataacagggaaaaatctattgatgcaagcacggtggttccatattcttgggatgatgatgttcatctggtcatctgcccatcagtataagtgccatgttattctcggcantctcaggaaanataaancangagtggtcnttcactgtnaccacaggatcccantnggaaactggttngaanatgntnctnnccctanctacttagnnnagntgntgatctangttntcctggccgnnacnttngngttccaca

SEQ ID NO: 661651 - DNA, 305 bp, Homo sapiens
tttttgggaattttgccccaaaaaaaagccaggccgtccaaaccaattgttttcaaaggggggggcccagggtccctggccggcttatttttagggaggaaaagggggggcccccccttttatgaacaaatggcccttttttaaaactggggggccctaaaaagggggcccggtttttcccccgggagcctttgtttttcctttgaaaaggccgtttttcgggccggttttttgtttaggggggggcccaaaggtacatgtttgcccccttttagttggaaaaaaagggggttttttttttttta

SEQ ID NO: 661652 - DNA, 642 bp, Homo sapiens
  misc_feature (499)..(499): n is a, c, g, or t
  misc_feature (510)..(510): n is a, c, g, or t
  misc_feature (516)..(516): n is a, c, g, or t
  misc_feature (519)..(519): n is a, c, g, or t
  misc_feature (528)..(528): n is a, c, g, or t
  misc_feature (537)..(537): n is a, c, g, or t
  misc_feature (552)..(552): n is a, c, g, or t
  misc_feature (554)..(554): n is a, c, g, or t
  misc_feature (566)..(566): n is a, c, g, or t
  misc_feature (570)..(570): n is a, c, g, or t
  misc_feature (574)..(574): n is a, c, g, or t
  misc_feature (576)..(576): n is a, c, g, or t
  misc_feature (579)..(580): n is a, c, g, or t
  misc_feature (586)..(586): n is a, c, g, or t
  misc_feature (595)..(597): n is a, c, g, or t
  misc_feature (600)..(600): n is a, c, g, or t
  misc_feature (603)..(603): n is a, c, g, or t
  misc_feature (611)..(611): n is a, c, g, or t
  misc_feature (615)..(615): n is a, c, g, or t
  misc_feature (625)..(626): n is a, c, g, or t
  misc_feature (629)..(629): n is a, c, g, or t
  misc_feature (632)..(632): n is a, c, g, or t
  misc_feature (634)..(634): n is a, c, g, or t
ccccagcccgcctagggacggcagccgggaagccaggggaggtaatatttctccacttttatttcatctcagtgctgtggaatggcttcctgctttggtgccttactcaatctctgttcctgggagcaccttttccaagctggcttcatggtttgctcagaattctcggggcggcacagttccagggaggggagctggcactgtctgcattcttagtgctagtatttctgtggctgcacagcttacgaagactcttcgagtgcctctacgtcagtgtcttctccaatgtcatgattcacgtcgtgcagtactgttttggacttgtctattatgtccttgttggcctaactgtgctgagccaagtgccaatggatggcaggaatgcctacataacagggaaaaatctattgatgcaagcacggtggttccatattcttgggatgatgatgttcatctggtcatctgcccatcagtataagtgccatgttattctcggcantctcaggaaanataaancangagtggtcnttcactgtnaccacaggatcccantnggaaactggttngaanatgntnctnnccctanctacttagnnnagntgntgatctangttntcctggccgnnacnttngngttccaca

SEQ ID NO: 661653 - DNA, 402 bp, Homo sapiens
ttggggctccattcaggtatagacgtcgaggaggcagccgttctcgctctcgtccccgtccaaatctgcagaaagggagggagggcacaaagaacgagaacgagatagggagcgggatcggaataagagggaccgagatcgagacagggatgggcacagaggggacagggaccgtaaacgatccagcttatctccgggtcgaggaaaagactttaaatctcgggaggagagagactctaagagggatgacgaggatgaccatggtgataagaagcctaaggcccagccattatcccgtggaggagcttcgggccaagaaaagggctgaggaagaagctgaggctaagcccaagtttcctctctaaagcagaaggagaggctgaagctctaaagcgacggcag

SEQ ID NO: 661654 - DNA, 439 bp, Homo sapiens
  misc_feature (30)..(32): n is a, c, g, or t
gcgcccgctccgatctcctaagagaaaaannnaaaaaaaacagatcgcaactttactaataactaccacttttatttcatctcagtgctgtggaatggcttcctgctttggtgccttactcaatctctgttcctgggagcaccttttccaagctggcttcatggtttgctcagaattctcggggcggcacagttccagggaggggagctggcactgtctgcattcttagtgctagtatttctgtggctgcacagcttacgaagactcttcgagtgcctctacgtcagtgtcttctccaatgtcatgattcacgtcgtgcagtactgttttggacttgtctattatgtccttgttggtgccttactcaatctctgttcctgggagcaccttttccaagctggcttcatggtttgctcagaattctcggggcggcacagtt

SEQ ID NO: 661655 - DNA, 487 bp, Homo sapiens
acagccatgtgacgtgggcactgagatgatttgggagattgaatgctcctcagtggggctagaggccacaggagtgataggttactgtaaagaaagcaaaaaagatgcaaaagcctacatgacaaaccaggcacgacacaaaggagaggcttgagaagaggaagtgaaggagggagaggattccacaagaccgaagtgcccaaggagacatggagggaagagagggctcttcacagagctgagtttagagaccaccctccatggttctggaaggaaaccagccagctttcatatgtggtgacaggctgttcattaatttgtagtgtacagcattaaataaatgaagtatgtagagaacattaggaaacaatataaaaaggtaggggaattcgtggataaagggaataacctgggtaccatatttcatcacattattccatgggaataagtcatcagtgcaaaggactgtaaggagtgcacagcagca

SEQ ID NO: 661656 - DNA, 359 bp, Homo sapiens
tagaacattttcctcctatctagctgtaattttgtagcctttaacaaatctctgtctctcccttcaccctacccttcccagcctctagcattctctgtcctactttttacttctgagatcaacttttttttttctttttagcttgcttccacatataactgagaacatatggtggttaactttctgttcctggattatttcacttaacataatgttttccagttccatacatgttgccttgaatgacaagattttattttttttcatggctgaatagtattttattatttatatataccccattttccttatgcataaatttgtttgtgtactcaagcaataaaatgattgtttaacta

SEQ ID NO: 661657 - DNA, 183 bp, Homo sapiens
gatggtgtcagcatcagtagtcccagcatgcattaagaggctgaggtgggagaatcacctgtagcctgggaggttgaggctgcagtgagctatgaccacaccactgcactctaacctgggtgacggagtgaggccctgtctcaaaagaataaaatgttttttaactcagaggggcagctcccc

SEQ ID NO: 661658 - DNA, 626 bp, Homo sapiens
  misc_feature (598)..(598): n is a, c, g, or t
cttaccaggaatggagcttagaggttggaagttgctctgtatgagtcagtgagtgagtggtgagtgaatgtggaggcctaggaaattattctacactactgtagaatttatgaacatttgggctacactaaatttataaaaaacattttcttcttcaataatgagttagctcactgtaacttactttttaaactttttaaatgttttttaagtttttaactcttgtaataacacttagcttaaaacacacattgtacagctgtacaaaaatattttctttatgtcattctataagctttttaaaatattttcaaatgtatttttttttttaaagcttaaaaaaaacatgtaagaggccgggcgcggtggctcacgcctgtaatcccagcattttgggaggccgaggcgggtggatcacgaggtcaggagatcgagaccatcccggctaaaacggtgaaaccccgtctctactaaaaaaatacaaaaaattagccgggcgtagtggcgggcgcctgtagtcccagctacttgggaggctgaggcaggagaatggcgtgaacccgggaggcggagcttgcagtgagccgagattgcgccnctgcactccagcctgggcgacagggcga

SEQ ID NO: 661659 - DNA, 934 bp, Homo sapiens
cggagctggcgtgccgggccttgccccccggcgcacaggagcggtacgccgagccgcgtccgacgcacggggagctgctgtacctggggccgatccgacacatcctccgctgcgggtcaggaaggacgaactgcgacgggcaccaggaacccatgtcggtattcggcatgcagtgcgctgctacagcgctgacgagatgaattcccgtctgcgtgacaacgccaaacgtgtgttctggaagggtgtgtcgggaggagttgctgtggtttatcaagggatcctagcaaatgctacaggagctgtctctccaatgggagtgaagaactctgggatgccaatggatcccgagactatattcgggactagcctgggattctccaccagtaggaagacggggacttgggcccaggtttatggcgttccacgtggaggcagtttggtgcagaagtaagtagatctggaatcagacttagttcaggataggcacgttgatcaagtgaggatgagtgacttgaaacaatcaagatcagaccctgagtagcatgacgtaatcagtcgtgtgcgcttatgcgaaatccccaacattaatcttcctccttggattggcgagctgccttccaatggccagtgaccatctgaccagtgtctagtgtgggtgaacacgtgagcttgtccctgaccaggcctgtagcaagaagactcgggagagaccactggggcctccggctgtcggcttccacgcaatcgctcaggtacgcactggttcactgtccctcattgccgccaatcacgggcgcctgacgacaggcgagcttaatagaccacttggggcatgcccatattttcctgacctccaatcgaagccggaaatcacgatcaggtagaccaaaccttcaaggccaagattcaagatggaaaggcgctaacgagcgta

SEQ ID NO: 661660 - DNA, 232 bp, Homo sapiens
ttatgtctaccggtcttcgcatgtgtggtcggtggggggctccatattgtcactccaggtttatggagggtacttctactattaggacttttcgcttcgaagcgaaggcttctcaaatcatgaaaattattcatattcactgctgttcgagaaatgaatgagcctacagattataggatgtttcatgtggtgtatgcatcgggatcaatccgagtaacgtcagggcatacca

SEQ ID NO: 661661 - DNA, 230 bp, Homo sapiens
ctgatcaccccacagcatgcctgcatgggcactcttgttctggttttgacttgacttgaattgctggatactttggttttggttttgacttggcttgaattttttggtactcggattttgaatttcgtgattttggtttggtataaacggtaaaagtgtgtgtgccctctttacctgttctttgtcttgtggtatgtgtggtgtgagcgtggtattttgtctggaaaaaa

SEQ ID NO: 661662 - DNA, 120 bp, Homo sapiens
agcagctcgcacctcagcttcagagtagctagcactacagaggcacacacatccggttaatttttgtattttttgtagagccaggttttcgccatgttgcccaggctggcctcaaactcc

SEQ ID NO: 661663 - DNA, 317 bp, Homo sapiens
aatggcctgtggtatcaaattggaatcgtaaactgggaaatgggctgtggtcggcccaatcggcccggtgtttacaccaaaatcagccccccctttggtggatccaaaagttgatggcccaaagtggcatgtcccagccaaacccctcctggccactattttttttcccttttttttggggtttcccactcctggggccggtttaagcccacctgagcccatgcagcctggggcccctgccaagtcaggccctggttttttttttttttgtttggtaaaaaacacattccagttgatcccctgcagggcatttttca

SEQ ID NO: 661664 - DNA, 748 bp, Homo sapiens
ggcggtgccgaacagtgtatacttatttatatagaatatagtatattatatttattatctatcctatatttatattatatatatgataatattattattatatatatataatatattataataatatatatatttatatatattaaatatatcatatattaatattattatatatattattatgtagtatgatgtatcagaatggaggaagagagaggaagagagtgagtgagagagaggagaagagagaagacgagagagtggagaagtgagatgagagagataagaggagagaagagaggaaagagagagagaagaagggaggaaagggagcggagcgaaggtgcaggagagggagagaggaggaggcgaagggacaaggaagggagagaggagcagaagagagacgggcgagcgagggagacaggaggaggagagaggaagggggggaggacacgaagaggagacgaacaaaagaggcggagacgagagagcgggaaacgggaggagacagaacaaaggaagaagagaggcgaggacgggcgagggaacgcgaggaggagagaaggacaaggcagaacgagcacacgcggagaggggcgagagggaggaacggagagagagcgagggagggggcaggcggcgacagcaggcgacggagagagagagacagagaacaggcggaggagaagacaggaggcggaggcgccacggaaggaggggggagcggagagaggcgggggggcgc

SEQ ID NO: 661665 - DNA, 111 bp, Homo sapiens
atgtgtatcaatctatcgataccagacatcatgagcagcttcttagtgcacgggtgcggagactatgccagatgccccgtggggtgcagcgcatgacggcgtaccatgcac

SEQ ID NO: 661666 - DNA, 374 bp, Homo sapiens
accatacccagctaatttttgtatttttagtagagacaggtttcaccatgttggccaggctgttctcgaactcctgacctcaagtgatccgtccaccttggcctcccaaaatgttgggattacaggcgtgagccaccgcacccggcctcaatatttgaagcgctggttatgcgatgtgtggttgtcgtcatggagaataactgggccctttctgttgagcagtgccacagcaggccttgcagtttttggtgcatctcatcgatttgctgagcacacttctcagatgtaatggtttcactgggattcggaaagttgcagtggatcagaccagcagcgtcgacgcggccgcgaatttagtagtagtaggcggccgc

SEQ ID NO: 661667 - DNA, 126 bp, Homo sapiens
tcactctagcaggatcccgtgtcgccagcaacaggataacaggatcagaaataggtcagctcatcatgcttggctttgttggtctggtagttaggtcagctcatcatgcttggctttgttggctgg

SEQ ID NO: 661668 - DNA, 461 bp, Homo sapiens
  misc_feature (194)..(194): n is a, c, g, or t
ctgggatcatagaaggtcatcaaatatgagggaaaagaagttatgtaactgatggcagtggagattttaacaagtaatagagatgatgagataatgtgtgaaaaaaacaagcacaatggtacatcataagtacccaaaatttggtggatattattagtagtattttatccacttagcagaaaatacaaaatganaatggaaatgataataagaaaaggaaaagtggcaagcattagaaatgtttacaactgattaatgttttttatgatcatgaaatcaatcactagtgttatttggtagaactcaaatatggtctggagtaaaccacttgcgagcttccaagtgtttgctctcggtgtaatcacaaaggataggctcaattccgtaattaacaagttataactgtatatgtgagcagtcatttatctgtgtctttacattttggattatgtctacctata

SEQ ID NO: 661669 - DNA, 434 bp, Homo sapiens
tgttatacaagaacctggaagtagatacatcacactgtggaagacaagcagtcatgtaagctttaagcacttgcagtgctaccagaagggctggcatcctcaggagcctgactatgctagactagctatctgaaaaaaaaaaaaaaaaggtaaaaaaaggtttttacttctatacagatggccaaaggggtatcaggcctagtttttaataaaaaatggttctagcaggttcttccagggaacaactaaataatttgtaggttcaaaagaataatgtaataattgggcaaattagatttatttatttccccccctgggaggcccctttaaattccgattttggaaaaaatttctaacttccaaggccggaaaacttaatgatcttccaaagggctgaaattcaacatattcatttataaaaaagaactttcttg

SEQ ID NO: 661670 - DNA, 1271 bp, Homo sapiens
gccgacatggtagagcggggccatacggtcgcggccaaggacgggcggcatccttcgacctgcggcgcttcctgacgcagaccgcaggatggatggcgcgcgccgatgtgcattgggtctgtcgactgtggcatcgtgattcgtcctagcatcatactggatgcagggctacacgcaaatgccacacgaagatctaagacagactgtactgcgtgatatcaacacgcgaacgcaggatgccatgccgcatatgagccagtgccatcaggggatgctggccttccatggaccatcggccctatcttcatatggtggtcgacgcgatcatttccccacagatcagacaacgaccactcgcaccgcaaagtacctaggtccatatagagtagacctagctctatctcaagctctctagggaccttcctagtaggtataagtcgggttctctaggctatccctccaccaaacccagtaggcgcacgtcacacgaacccccgacaggcacgtgcatgcgatgcgtgaggccgcactcatgctagaggggcaacgccaatacaccatatcaggcatatctctgttcacatccttactccatgagaggtggtgcttggccttaccctgagcctcaccgagacgactcacacaggactcgggcagctggacagactaacaatacacagaactaccgctaggacccccacatcccgagaccccaacacactgcctcacgccctcccataccccaggtgcacatcaggtgcgcaccacaactaccaaacagacccaaccccgtaccaccccagcaacagcggaagacaccaccgcaggggcgtacccaagcccgcgcccccctggcggtaccatggacgcaggacggacaaagcgacgacgcacaggcgcggcaccagaacagcggcacacacacacagctggacccggggcccgcaccaccaaagaaagccccctcccggcaaaccaggcacagagccaagcacacaagcacacccgggaccacccccctgcgacccgaagcgcgcaccacacagctaaaacgcgggcgcccacaacccacgggccagagcgacatcacagagcaccccccaaccaggcgcacgggaacccacgcgacaccagctacggccggccgacaacgcccgggacccactaccaccaacggcacaaccacgaacatgcaccacaagcgcacacacaacagaccaacaaaaccatacgaacaccacagcgaacacaccaagcacgaccaagacacg

SEQ ID NO: 661671 - DNA, 458 bp, Homo sapiens
ggttattaacattatcagtaatcaaagaaaggtggcccatcatctgggcacccctgttcctctcctaagagagacagacacatttgacacaggcatttaaaacttggtttagataaaaatctaggttctgggttacagtgtaaagtaaaaattgaatgtaaagtaaaagcacaatttggccaggcatggtgactcacacctataatcccagcactgtgggaggccgtggcaggtggatcacctcaggtcaggagttcgagaccagcctggccaacgtggcgaaattccgtttctactaaaaatacaaaaattagctggatgtggtggcgggcgtctgtaatcccagccacttgggagattgaaacatgagaatcacttaaacccaggaggcagaggttgcagtgagtcaggatcatgccactgcaccccagcctgggtgacagagtgagactgtctca

SEQ ID NO: 661672 - DNA, 366 bp, Homo sapiens
cctaggatccactagcagctatcagcactattcagctgatataggatatgtgtaaaagaacatctagagaatgcacagacaggctagtatggtacagtaccgatataaagacaattgcccatgatagcctgaagcactgaaatcaagtacttctgaatcgaatcaatgatactaggtagttttatatcctcatatatatcaaagttttactactgctgataattttgtaaaccaggtaaccagaacatccagtcatacagcttttggtgatatataacttggcaataacccagtctggtgatacataaaactactcactgtactcatctggtatatacccgcacgaacattttgaaattccaattt

SEQ ID NO: 661673 - DNA, 1121 bp, Homo sapiens
  misc_feature (1121)..(1121): n is a, c, g, or t
catgttttatctgcaatgttggaaagtccgaggcccagaggccaggagagagggcggctgggatcagaggccaagcctccctccctggctcctggagccccgcagaggtcagggcgataaggaacaatgactctcccattcaggaggaggaaggaagtccctgctgccacctaatctctgctcctctgcttctcccctgctcccgagccttttctctagagaagactttcaaggcgacttttgtgctgagggccagccgccatcagcttgagaaggtgaatttggcaaatgacatgaagattcttcaaggcagaatccttgcagggaagcttcaaaggactccatctgcagatgttctgaaaacctctgagtctagaaattgattattcacccaggatacctaattcaagctcccagaactcagccgaccaaggagcttggaagactttgcaactttggaccaagcacaatgaagtattccctctgggctctgctgcttgccgtgctgggcacacagctgctgggaagcctgtgttccaccgttcggtcccagaggttccgaggaaggatacagcaggaacgaaaaaacatcagacccaatattatccttgtgctcactgacgaccaggatgtggagctgggttccctgcaagtcatgaacaagacgagaaaagatcattgggaacagggtggggccacctttcaacaatggctttgtgaccaccgcccatgtgctgtccaatcaggctcaatccatggtcaactgggaagatacgtgtgatatacccaaggtttacaccaaaatgggaaatgcgctcatccctcgtgggagcaaatgaacgagacttcggacacttgtgggtatacacgaaaccggggtaaagaacgtctggcacgaccccctgatggaaacaaggggagcaaaaacaccggacaggaggaaagccggaataaaaaaaaacaggtaagaccaggcgagaagcggcagcaccacacctgacacaagcagcaccagacaaagacaacaaagagaagcaccagaccaagagagacccagtggacacgcccgagcacacgcagaaagacagagacacccgaccgacgtcgcatccacactactn

SEQ ID NO: 661674 - DNA, 630 bp, Homo sapiens
ccactatgctcgtttcattgtgtgtctcagccttccgtcctacgtttgcatttgtgcgttcgctttttatgaacgagtttttgataattctgccttataacgatgagtagatgtctcattaagaagactcttggaggcagcatggtctgactagcttaaggtacagtctttcctctgagagtttcctgtggttttactaactcttagcttgccctctgacatataaactagaagccgtaaattacgcataaattccactacgtgccataagagatctttaaaactctgcatggcaaagccactatgagacacgtcatgaactaaactgtgagataggtgcagcttatatctcagacgtggcctgctgactgaaattatgaatcaagtattattagaacacagtcacactcacttgcatgcatattgtaagcggctgctaataccctatggtggcagaatttgatagctgcatcagggaccatatggtccacagaacgcaacaggtttattatactgcgcttgacagaacagtttgccaactctcgctctgatgaataaggagttgctacgactacacatcaatatgacacgaccctgaccagtttattaggcatgagatatgattgtgtg

SEQ ID NO: 661675 - DNA, 847 bp, Homo sapiens
  misc_feature (24)..(24): n is a, c, g, or t
  misc_feature (27)..(27): n is a, c, g, or t
  misc_feature (34)..(34): n is a, c, g, or t
  misc_feature (51)..(51): n is a, c, g, or t
  misc_feature (72)..(72): n is a, c, g, or t
  misc_feature (88)..(89): n is a, c, g, or t
  misc_feature (95)..(95): n is a, c, g, or t
  misc_feature (102)..(102): n is a, c, g, or t
  misc_feature (108)..(108): n is a, c, g, or t
  misc_feature (119)..(119): n is a, c, g, or t
  misc_feature (130)..(130): n is a, c, g, or t
  misc_feature (133)..(133): n is a, c, g, or t
  misc_feature (137)..(137): n is a, c, g, or t
  misc_feature (142)..(142): n is a, c, g, or t
  misc_feature (146)..(146): n is a, c, g, or t
  misc_feature (164)..(164): n is a, c, g, or t
  misc_feature (172)..(172): n is a, c, g, or t
  misc_feature (178)..(178): n is a, c, g, or t
  misc_feature (183)..(183): n is a, c, g, or t
  misc_feature (204)..(204): n is a, c, g, or t
  misc_feature (217)..(217): n is a, c, g, or t
  misc_feature (245)..(245): n is a, c, g, or t
  misc_feature (267)..(267): n is a, c, g, or t
  misc_feature (276)..(276): n is a, c, g, or t
  misc_feature (287)..(287): n is a, c, g, or t
  misc_feature (291)..(291): n is a, c, g, or t
  misc_feature (321)..(321): n is a, c, g, or t
  misc_feature (331)..(331): n is a, c, g, or t
  misc_feature (401)..(401): n is a, c, g, or t
  misc_feature (429)..(429): n is a, c, g, or t
  misc_feature (434)..(434): n is a, c, g, or t
  misc_feature (468)..(468): n is a, c, g, or t
  misc_feature (545)..(545): n is a, c, g, or t
  misc_feature (554)..(554): n is a, c, g, or t
  misc_feature (562)..(562): n is a, c, g, or t
  misc_feature (588)..(588): n is a, c, g, or t
  misc_feature (590)..(590): n is a, c, g, or t
  misc_feature (599)..(599): n is a, c, g, or t
  misc_feature (605)..(605): n is a, c, g, or t
  misc_feature (620)..(620): n is a, c, g, or t
  misc_feature (660)..(660): n is a, c, g, or t
  misc_feature (663)..(663): n is a, c, g, or t
  misc_feature (684)..(684): n is a, c, g, or t
  misc_feature (688)..(688): n is a, c, g, or t
  misc_feature (708)..(708): n is a, c, g, or t
  misc_feature (732)..(732): n is a, c, g, or t
  misc_feature (738)..(738): n is a, c, g, or t
  misc_feature (744)..(744): n is a, c, g, or t
  misc_feature (749)..(749): n is a, c, g, or t
  misc_feature (753)..(753): n is a, c, g, or t
  misc_feature (774)..(774): n is a, c, g, or t
  misc_feature (786)..(786): n is a, c, g, or t
  misc_feature (836)..(836): n is a, c, g, or t
tctcatttaacttttttaatgggnctnaaaattntgtgaaaaatttttggncaagttgtttccattaaaaantactgattttaaaaannaaaaanttaaaantgccanacgcaaaaaanaaaaccaaagnggnccanaaaanattntcctttccttctgaaggntttacgangcattnttatnattaaccagttttttactacnaaacttaaatggncaattgaaaaaaaaagttctgagaccgntcttccaccactgattaagagnggggggggngggattagggntaanattcatttagccttctgagctttctggggngagttggggnccttgccagccccagcagccttcttgtccactgctttgatgaaacccaccgcaactgtttgttttatatnacgaacagcaaagcgacccaaagggggntagtntgagaagctctcaacacaaatgggcttgccaggnaccatataaacaatggcagcctcaccagacttcaagaatttagggccatcttccagctttttaccagaacggcgatnaatcttttncttcagcncagcaaacttgcatgcaatgtgagcngngtgggaatncaatanaggggcatagccggngcttatttggcctggatggttcaggataatcacctgagcngtnaagccagccgcttccattggngggntatttttgctgttaccagcnacgttgccacgacgaacatccttnaaaganacattnttganattnaagcccacattgtccccaggnagagctttactnaaagcttcatggtgcatttcgacagaatttacttccgttgttacgttgantggggcaaagg

SEQ ID NO: 661676 - DNA, 1949 bp, Homo sapiens
  misc_feature (1647)..(1647): n is a, c, g, or t
ggcagccgcacgcctatgactcacccaacagctacatcccctgtaatcaacccaagacagctcaatcgagcgctgacttagtcagtctacggcccctcaatctccatgtccagtggtgccatgtaactctgcgtctcctctagcttcctgtgtactactggcctgtcttgccgtggacaccactcgaccacctccacagagccctatggcctccatctcactctgacatgcgagtcagtctcagacgagcctccagtgtcacaactgagcagacaatcgacgcgtgccaacaacgtacatgcccctggcacgcgtgcccctgtcgatgcgcatagctgcgctgcgagtccgatcccatcgcccaatgcccgtaccacgagtcgcctatatgactcactgaagcctgagactcgcaagggtcctgatgtaactcgcgcctgcccgtgtaaaccgactgcgaaccgtgcgacacgtcggtccacgaccctgaccgtgtgctgaccggtgcatgagcgcaatacccgcgagacatcactccctccgcccacgatatccgtaggcagagcacagcgtaaatctccgtacagcatgactatgcacaatacccattaatgcccttgcggctccccgagtgatatgatcggccctaggtgacacccccaagggcagacccggtgcacggcattcctacgcgtgtagcaccgcctctgggcagccgagtcccgaccgactaacgcttagcctgccgcctgcactgcgcgggagcaggtcgcgcgcccgactctttccgctccttcgtattctcccttggtgagcccctccggctcgaccatgcacccggttccatgtgtcctccggtgccactttgcaagtcctccgttccctccccgacgtcagtctccacggcgggcgtactccgatgctcggctaccgcgctaccgtagccagccggtcttctccccagcgtggcatcagcatttcgtttcccctccaccgggtgcggacccccaaagcgtattaaacgcaagcaaggagtcgtcaaagcacgcgagaactgtctgtcgcgcgaggtgggctcccttactccctctcatcgctcgccgcttcgccaccccatagcccatctctccctcttgcctctctcagccgcctcgaacagggctgagctcaccgcccgccacatcgtgccctcgccgccgcgcgcgtcctccctgtctgagctcctccaccgctcgcggactcatcccccttagagcgcacccgttcacacagcattctctcagtccggccgttcagcgcattcacgtgtctctctgcctagagctacctcggggtccccgactgcgttatcaccgccggtcatttaccgctatccccccgcggccgttatcgcggccccgtccttagtcagcgcgcgaatagcttctaggaacccatagtgaagcggtgctggacgaatccacgtctccactcgctacctttcggcgcgccgtccgcgcgtgcacacccccgccgccgcccgccacctctcctttgtggtgtggtgtagatccctcaccgccagaccatcgcatcgggccattcctctccgcggcgcgccctgcgggcattcgctttcctcacggcgcccacgcctctatcggacgntcgtggggcgttctcccttctcgtccgttccatcgtgcccgagtactcgctcccgctagggtccctgcgtcctgcctcgcaggttctttcacctacacgcgcagcagtcaacactcgatcatatcggaccaggagcatcgcttcatgtacaatcgttcaagacttctcaatcaggcgtatgggagttcgtgcgtccccgtagtactggtgacctcgccgcctgccgctcctggcgtctagttgatcgggtggcggtctttaaaaacgggtgttgtcgcttccttcttcagctgcgcactaca

SEQ ID NO: 661677 - DNA, 398 bp, Homo sapiens
  misc_feature (95)..(95): n is a, c, g, or t
atttgaatgtaatagttaatttatgtgaatttctgagaaagaatatagctactgaatgtcatttagttattttcttatgccacattgtcaaatgntctgtgtaaaagactatttaaatgttttcctgctttgtaagcattaagattttaagaaaatattcaaactatttttataaaatgaagttatgatttttaacttattgattcctctttgcccctacccccccttttggaagaatattttgattccttataacttttaccctaaggctaaaaaatgttttttttcccaagtgcttcctggcccccagccacccaatgaaggggttcaaattcagtgttgtatgtatgtttatggcaacatttttgaaaataaaaaattaaatgtttttcttcaaa

SEQ ID NO: 661678 - DNA, 819 bp, Homo sapiens
  misc_feature (594)..(594): n is a, c, g, or t
ttccccaaagtcaaggcccgcccattcccggagggctttaagggtccaaattttcctgctcccccaccaacaagtggcggccaaggggccccaattggaacagccctttcccatgccccccgccggggagtctcccccccggtgagaaattcaacttaaaggatggtttttaaggttgctcgtttaatctttgccctccaccccgtttaatttttatagcttttcccaggtgttctagatcccaatctatttatatacaagttatatgttatgtgtgtgctcctttgtgtgatctggcagccccagccctcgagtgctttttccttctggccctgactctcctgactccccgatgtaatgtgcaggccacttcttaccccagatagcctcgggcgctgcctgtagtcatgctgacagctgtccagtaccccccaaaactgctcccagctggagacggttctggtttcaactacggtatattgatatcggaagtattctagccagacccccggttgggttttctagcaacatgtttgtattgcccagatcccccccccccctcctatagtgttgtcttcctgtgtgttccggggnttttgggcaactgggcctgcccggggaagtccttccaggtgggaggccatacaaaaaccccctgtgtgcccctgagcgtccccctgctgctgggcaactggaggactccagggggcccccggtgcctctccccttttttatcccaccagctcctgtgctgccctcccagttccgttttggacctgtaatactaaaggaaaaaataacctcctattttgtttaata

SEQ ID NO: 661679 - DNA, 585 bp, Homo sapiens
  misc_feature (1)..(1): n is a, c, g, or t
ngtaacagtttctaaaatgctaagaatcgcctctagagaagggattatctccgtcatctgttaaatgagatatgggttggactggtgattgatagatgaaatctgtcaacactgtgtatcaggttagactacctgataccaaataagggttggccaaggcgaatttctttgcaattgattaatacttcttgaaaaaatgaagcaccaaagctggtatactatgagacaagcctgtagtcccttgaagtatggtagactttttagtcaatcagcagccataatctccccttttaagaaaatcttctaaacccaaggcattgtcttccataaagatgttgactggtagaatcttgaacactctaaaaatgcagacacaccaaaaaactgccaacaaatggcctttttcaaaatgtcaaaggttcttcataccaactgctggtcattgtgtggggttttgaacactgtatgccaatacttaacctcacaaaatttatttgacaaagacagtttcatcagaacttgggacatgcatcaacttcatttcttctcagtacgctaaaaaaaaaactcgagactagttctctg

SEQ ID NO: 661680 - DNA, 559 bp, Homo sapiens
gcatctaccggccgactcctatggaagagagagacaacgatgtgtgcctctttctgtgagctgtcgccgcgggtagatttaagaggcgaacacaaaggagtgactgagccttggctctcttggatggctactggaatatggtacactgcagtgttactctccagtattgcagtctctagatggtaactgaaaaaacctgaaactctgaggaacggaatctaaggcttatagtgcttgagtactgatggggaacaactgcagcgaacagcaccagggaagctggaggatgctcagtaggtgaatcgcatcttttgtgagtagcccagttagtccaagttgggatggcaggccagctgcaccattgggggtggcccacaaagcagtaccagcacatcatcccctggagcgggcaggtgttcccggatcatgtcggcagtcacaaagcccttgctgtaggcccaatcttttgggggatgatccagagtgaaccagagcttacagcgattgggatagcgggactgcagttcctctaagtcctccgggagatgatatctttact

SEQ ID NO: 661681 - DNA, 420 bp, Homo sapiens
  misc_feature (18)..(18): n is a, c, g, or t
  misc_feature (53)..(53): n is a, c, g, or t
  misc_feature (74)..(74): n is a, c, g, or t
  misc_feature (410)..(410): n is a, c, g, or t
aaccccacaaaaattgcnaaataaaataaagcctatgaaactttggatgtacnacctataaatccccccttaantcctataaatttgtgtctgtaaccctgaaatagtttgaaaacttctttaaaaatctcttgtatttcatccgggcgcagtggctcacacctgtaatccccagcactttgggaggccgaggtgggcagatcacgaggtcaggagtttgagaccagcctgaccaacatggtaaaaccccatctctactaaaatacaaaaattggctgggcgtggtggcactcgcctgtaatctcagctacttgggaggctgaggcaggagaatcgcttgaacccgggaggcggaggttacagtgagccgagatcacatcactgcactccagcctgggcgacagagattnactccatctc

SEQ ID NO: 661682 - DNA, 509 bp, Homo sapiens
  misc_feature (11)..(11): n is a, c, g, or t
  misc_feature (436)..(436): n is a, c, g, or t
gggagatgccntaaatgtaagggtcgtctgggaatgggacttagtagtaagtgtgtgagacagtgcattaccaatgatatttttgtggatttaattttttgttagttttgcttgaattcctgttaattgcttctggacatgacctaaggctagcttgtccaaccttggccatgatggttttgaatgtggcccaagacaattcgtagctttcttaaaacattatgctattttggccaggcgcggcggctcatgcctgttatcctagcactctgggaggctaaggcgggtggatcactgagctcagaagttcaagaccagctggccaacatatgaaatcccatctctactaaaatacaaaaattagtcaggcgtggtggcgcatgcctgtagtcccagctactcgggaggttgaggcaggagaatcacttgaacccgngaggcggaggttgcagtgagccgacgtcgtgccactgcactctagcctgggtgacagactgagactccgtctc

SEQ ID NO: 661683 - DNA, 233 bp, Homo sapiens
atgggagatggtcggagggtactttctcttccgggtaatcctcgggcccagccttagggcagaatagaggtatgtgtaggctattttggtaatatgggcttctgggtcaaaatcccggtgtagctggaattcccaatgcccggtattggtcacagccctcccatctccctctcaccactctcaatctggggcctggtctggttctggaactgggtcagtttcactggtcaatc

SEQ ID NO: 661684 - DNA, 260 bp, Homo sapiens
ggctgatctagtcatctaagaccagtagctcacattttcgatgtgtactgggctcacctcaatgggtgatggtcttccgggaagggttttcacgaagatcttggaattttgactgttagcggataccagggatctttgggccgttcacattttcgatgtgtcactggtcactccagatgatggcttgcggcaggtctacacgaagatctgcataccaactctcagacgcaggacgcaggttgcaagggggtccgaacgtc

SEQ ID NO: 661685 - DNA, 385 bp, Homo sapiens
  misc_feature (385)..(385): n is a, c, g, or t
gatgcttgtggatattgtgctgttacttgtcagtgcagtgttataagctgacgcaggcttatgcggaggagaatgttatgatgttacttatactagcattaggtcttctatagggtgatagactgtaccaattgggctgtgaggagtatacttatatgctagggatttgcttaggtactgggtgtagaactagagcgctatcttaagtggagagtgcttttacgcctactatggctgttacaactactactctctctacgacgcactttcctagggatcgagctgatcctctttggactaaccgtagggttcacaaggcgatttagaggggtctgtggtgacctatatagcagcactacaatgctatctggcacgcagctatccn

SEQ ID NO: 661686 - DNA, 613 bp, Homo sapiens
agtggagctgtagcactcaccacggaggtccatggctatctatggccttgtaagccgtgtgatacaaccacgaacccgttcagatcaagaaaagaccgttgatcaggagaaggacttcgtcgtactctatttactggggacacacttacaggatttctccatagatgcaggtgaaggtacgctcgcaggtcgtggtcattgaggacaagtcgtacgagagatcccgagtacatctacagtcagccttacgtctgcaggtgtacccaagcagctccgaagagacagcgaccatcgagaacgggccatgatgacgatggcggttttgtcgaaaagaaaagggggaaatgtggggaaaagcaagagagatcagattgttactgtgtctgtgtagaaagaagtagacatgggagactccattgtgttatgtgttaagagaaaattcttctgccttgagattctgttaatctatgaccttacccccaaacccgtgctctctgaaacgtgtgctgtgtcaactcagggtgtgaatggcattaagggcggtgcaggatgtgcttagttgaacagatgcttgaaggcagcagtgtccttaagagtcatcaccagtccctaa

SEQ ID NO: 661687 - DNA, 1285 bp, Homo sapiens
gttcggactccccttcggacctattcttcatagaccgaatacacaaacattattataatacacaccctacaccactacaatcttcctaggaacaacatatgactgcactctcccctggaactctacacaacatatttagtcaccaagacccatacttctaacctccctgttcttatgacttcgaacagcatacccccgattccgctacgaccaaatcatacacctcctatgaacaaacttcctaccactcacccatagacataacattatatgatatgtctccaatacccaattacaatcatccagcattcccacactcaaacctaaaaaacagacgaaacaagagggacggaaggcacaagcaagaaactcccaccgaagagggcgaccaaggacacacagacggtaccgcagaataacgttggtaacaaagggagtacacaaaaagagagagacaagaaccacagacagacaagacgccaatagaggccgcacggcgtcagcccacaacgccacggacgcacgcggcacacacaaggaagaccacgcggccacacccaacgcacgaagcggacagccgccaccaaacaaggagaacgtgaccaacaaaacgagcgaccaacaacaaaccgtaccgaagcaagtagcgaagagcaccccgcacgcgccaacacacccaccccccggcgacacggcggcacaccaccgcggccccaccccacgagcggacatacatggccagtgcggcacgcgccacgaagaacaggcacaccacggaggcggcaagtccgcgaacaacagaaacacaccagggagcaccggacacacgagggggagaggggacgggaggaagcacgggggggagggggcgggggggaggaggggaaggaacagagaaagggggagaaaggggaacagagggggcgggaagggggaggggagaacggaagaggagaagaagagggaggcaggagaaacagagcaggagaggaggaggggccagggaagggggggggcggggggagcgggagagcagaggggggagagggcgcaacggaggaggggagcagggagggcgcgagggggaggaggcagaagggaggggggagacggcgggcgcggacgggagagagagaaggacaaggcgggcgggcgggggcggagagcgacgggagagcggagggagggagagggagacgggagagagagccgggacagaagaacagggccgggagaggggaggaggggagagagaggggagacgaggaggggaggggagggggac

SEQ ID NO: 661688 - DNA, 270 bp, Homo sapiens
acttgggcgtcgatgatactagatcacttctgagccatgtatctgaagaacgttccacaaagtggtgagtcagctacctcgtcctgtgactcacctgacgtattacagagagttgctttgtagaccttttaacagtttagaatgttccatctagctctgtacttttcttgtctagccagatgcctaggctgaaccttagacagaaaatgacctatttcatgttgattatcttgcctacatcaataccatgttgtcacagtgctaccggtc

SEQ ID NO: 661689 - DNA, 1637 bp, Homo sapiens
gaaagacagaaaacaagggcaaaacaggagatgaggaaatgttaaaggataaaggaaagccagagagtgagggagcaggcaacaagcaaggcaaagtccgcagcagggcagggcagcagtcagcagcatggcagggcaggcatccagcagcagcagcagggcaacaacccagcagcatcagcagggcaaagccgagagcagtgcacaggcagcagcccagggcagtgcaaacaagtggctgcacggaaatgcgcccatgctgacggcatgatgtacgccaggacaagccaataacgaccaaactaagtacaggggcatgcgctcatttcaccgtcaacggacgtactaaacacgacggcacataacacatgagtccatgcacactctctccagtccatatagccagcgcacgattgcatccaagcagcacattctcgcaccacactcatcgggcatccacagagctgctacgcgcactgcaagccacagcacgcacacaccacagccaagacccacgcacacatttgcgcgcgcgccagctcctcaccgctcgcgcatgccgacagtggtacagacattctaccacgcggaacgcactcatgatactaacacgccttagacgcggttcccaatacggcgcaacctgtcacgcaggcgatgagacattgccagggggacaccaccttcgcaacagggtgcaccactttgcaaacgaaacgcacttatcccttgtactcgctgcatacagcatggactccacattggtggcactgcggccacactttcttcagcaccaagagggccccacgctgaatagccctccaccaaacccgctactacgcgcgcttacatatcacttctctacctatcacaagggggcaactacacacgttcccccttggtctggcctaagaccaagccccctcttagattgcaacgcctaatatcaatagcaacaatgccaagcgctgatctcacttcacgtactcaggggccaaacacgggatccaactccatcagcacccacccttgctggcaaacaaacgcaaaggcacggactcggcgagacacactatgcatcacacacagactacccacaacacaaccacaacgttgagcgcaaaagcccgacacaacaacaaaaaacaacacggagcgtcagaccgaccctcacaccgcgcatccccacacccacacggcgcccccaacagccacaagcaacgctagcaccccaccgtcacccttgaacaaacaagaagcaccccccataagcgcggacagctacacactaaacagacccactcgacacgcgcgccgtccgaccaaaacacacccactaagcgcagcacccaacgcccacacggacaccaatacgccaggccaccccactacgaacgcgtcgccgccacacgagcccaccacacacccacaaaccactcaccgcagcagggcagaccaatcaccgaaccagcacacacccgccgcccacacacacccatcccgtgccgacaccggcgcgcgactcacacaaacgcgaccagacagcaaggacgccccgtacacccgtccccacctcccagcccccgacctgccgccagccatcgagtcaatcgagcgacccagcccagccacagcag

SEQ ID NO: 661690 - DNA, 812 bp, Homo sapiens
gaaattctatgttggaattagtgccgggcgcggtggctcattcctgtagtcccaaggtgctgggattgcaggcgtgagccaccgcacccggccagagtccagatcctttttatatgactttttttttttttcccttctgttatcagtgtccaaaatttcaaaatgacgtattaatacctgcctgtggcgaaggtctgttcccatgccaggcccctttccgagtgaactcttgtccttaattttctgggaaactttctgtgaatttcattctcagtgattttctcccttaggtggtctggtggttttcctttttctttttttttttaaagactgagttttcacgcttgttgcccaggctggagtgaattggtgccatctcggctcactgcaccctttgcctccggtgtccaggcaattctcctgcctaagcctcccgagtacctggggattacagggcaccctgccccaaaaccggggctaatatagggtattttacagtaaaggcaagattttcaccatgtgggtcaggcgggtctcaaactcgtgacctcgggtgatccgcctgcattgggcctcccaaagtgctggggataacaggcgttgagccacacaggcccggcagtgtcgtggggattataccttccgggaaatttcggttactcaaaagtgggtggacccagaattatacctctccctcccgtgtggtgcccccaacccccaatttttcatattactttggatccattaattaaggggaaggatacctccaagttgaattcatctgaatggtccctttatatccgtagaatatg

SEQ ID NO: 661691 - DNA, 416 bp, Homo sapiens
ctactgatgatgtggtgccgagatcttaggctacatcctcgagaaacgagaagtgcctaaagccgactggtatagcatagattccagagtccgaaatccatctctggtggtaaaaggcctcaaagagaatgtagactaccatttccgtgtttcagcagaaaaacagtatggcataagcaaacccttgaaatctgaggaaccagtcacaccaaaaacaccattgaatcctccagaaactccaagcaatcctccagaagtactcgatgtaaccaagagttctgttagcttgtcctggtcccggcccaaagatgatggtggttctagagtcacaggctactacatcgaacgcaaagagacatccactgacaagtgagtcagacacaacaagactcagatcaccaccacaatgtacactg

SEQ ID NO: 661692 - DNA, 289 bp, Homo sapiens
gtggggaggctctcctgatcagatgtaggcatttgctcatcctcacgggtcttgcgagtggataggcagccagctccttagtgcccctgagatataactgttgctggagattcttttggcatctgctgttgtgagcatgtaggctggtgtaagttgggtgtcaggtagattaatgctggtggtcctgccaggcggattgggcttcctagatgtctgttggccattgctgagaatcctaaggtctggctgtggctcccatatatgccctgttcagccagatggcttctgc

SEQ ID NO: 661693 - DNA, 675 bp, Homo sapiens
gaggaggagaatatggagaggaaattaaactgctgtgtgacgatagtgacagaggatgagaacgcgtgtctgaattggcagaggagaatcggttgctaaggtggaaaagagactggatgagctggaatgagagactggccgaggccaaagaagagaacgtgggcttgcattaggacactggatcagacactacaggaacttaagctgtatatgagcaaggaccagaagagtctcgttccaacagaaactctggagctccgtgggtctttctcttctcttgtaagaagttcctttcgttattgccatcttcgctttgctggaaatgtcaagcaaattatgaatacatgaccaaatatttagtatcggagaagctttgagcaccagttaaatctcattccttcccttttttttcaaatggcaccagctatttcagctctcttattttttccttaagtagcatttattcctaaggtaggcagggtatttcctagtaagcatactttcttaagacggaggccatttggttcctgggggaataggcagccccacactttgaagaatacagaccccagtatctagtcgtggatataattaaaacgctgaagaacataaccttttgggtcacctgttggtccaactataggagagaccagggacatcactgggtagggattt

SEQ ID NO: 661694 - DNA, 843 bp, Homo sapiens
  misc_feature (415)..(415): n is a, c, g, or t
tgtactcggacgaggcaggctgggattacaggagtgaactcccatgcctggcctcatgatcctttgtagactgagggacaaaagaagagggtgaggcctcccctctcctcagcgctgagtgcaaggaccctcaaggcaactcttggcaaagccccatgtttccactggctgtttaggtggaattgcgtccccccgcttccgtatgttgaagtcctaattttcgggccctccgcttgtgaccatatttggaagtagaggctttgcagatgtcatgagttaagatgggggcctcctggagcagggcaacatgactgtatcctcataagaagaggagagacagaaacagacacacacagggagatgccacgggactcccaaagccacaagaaagcctggaacagccccgccctcacancctctgaaggaaccagccctgccttcacctggatctgggacttccagcctccaggactgggggagaatgaaactctgttgtttcggccacttaggctggggtcctttgttatggcagctgagtgggtgcctccctctctggggacggccaatccctgtaggggaggcagtggtcccggtccaggaaggtgagagaggctttctcagtgtcttcacttcgccagctcacgtggagactggtagcggctggagcccaagctcttctggggagccggtttactcaaggtcacccttgatccagcggagcccaaggtctaggtcaagcttcctctggggatgtccccaagggctcttcaaacggtgtccgtcagccatctgcccagggccgtcagccctggaggtgtagccggctgatctgcggcggggtgc

SEQ ID NO: 661695 - DNA, 214 bp, Homo sapiens
  misc_feature (150)..(150): n is a, c, g, or t
gcaccgtgtcccatctggccttccttttctccttttcaatgtagcaaactccctatctgtcatgaattatcattaaaagcttccatatcagcagtagatgcaaggcctaataagcaacaattccagacaaccacaccgagctacaatgtncaatgcatgtctcggacctagtgggcacactactggcattctcgcacaacgatgaaccagtgac

SEQ ID NO: 661696 - DNA, 103 bp, Homo sapiens
gcatgctgagtgacgtgtatcaccactgcggtgcatccctccctagtacagttcgtcgacacgtgagcaccgtgctgactccaaatatcgttaagctggagct

SEQ ID NO: 661697 - DNA, 184 bp, Homo sapiens
aaggggacgctgccggacttgattaggatgtcgctgtcgtgcttcaacacaccacaagctgctatcctgacatgtaaataaatcgcgatagagtctcgctctgtacatccaggctgcagtgcagatgtacaaaatcgggtcactgcaacctctgcctcccaggttccagtaattcccatctcag

SEQ ID NO: 661698 - DNA, 288 bp, Homo sapiens
aaatgtttcaaatgtaattgttgctcaccagggcagttatcaatgcaattttatattccttgaggggaaaaaaaggggttttattgtacatgtccaaggggggtgataaaagtattatttgtttaatttaattggaacaacccattgttttaacccacccatggtttgaatttgtttttttggggtgcccggggcatgtaaaaccagtatgctttttggatgtaaattttaaaaatccagtgtgaatgtaggttttcattaataaaacattaccccccgtttactcca

SEQ ID NO: 661699 - DNA, 205 bp, Homo sapiens
gccctgcagcagactgcttttcccagtgcaaggccttcagcatggccacgacatagtggcacatagctcatgatcctagcttgtttttggtcaactgtcctctgtcatcttgtgtgccaacctatccggcgatatctattggagttatctgggtccatgctcagcaccccagccctcatcttcatctctccccagtcatctccgt

SEQ ID NO: 661700 - DNA, 233 bp, Homo sapiens
tgatgtatacgggcacgagcacgcttcccaagcttggtgtgggcaatgtctgcaagtcgatcgagcttgctggctgacaccctttgggatcttgtggcttaacctccttgtggctttacgattggccttgcatagcctcgtgcacgtgcactcactggccttgtgcattgtttggcctgcatcttctttagtgcccttttttgttgtggtattgctcatgcgctgggtacctg

SEQ ID NO: 661701 - DNA, 368 bp, Homo sapiens
cattctcctggcgtccgcctcccgagatcgctgggattacaggggtgtgccaccacacccggctagatttttgtatttttagtagagatggggttcaccatgtggccaggctggtcttgaactcctgacctcaggtaatccacccgcctcggcctcccaaagtgctgggattatagacgtgagccaccgtgcctggccggttcattgatcttcatggtttgatagattagtggtttcagcaaatttggggaatgtcagccattatttcttctaacatttttttctcctttctcttttccagtctgcttttacacatatgttgctatgtgtgatattatcccagaagtatctgaggcacagattgcagt

SEQ ID NO: 661702 - DNA, 558 bp, Homo sapiens
  misc_feature (3)..(3): n is a, c, g, or t
gantggggggggaatacccgggtctttaggacccccaagcccggatggtgtttggtcttttccaacccctagttccccgccttatgggggggtcctaattaaaacccttaaacaaatattggcctttttcaaagggcccaattttcctttttttttggccttaaccccgggtccttagggtggggcccccaaaaccccggcccggggttttttttttccccccccgctttatcccccaatgtgggggggggggggccccgcccccgtttttttcccaacccccttccctttgccctggggccccaaaattttcccctttaacccaagccctgcctttttcccccccccctttttccggggccctttgttttccatccccccccccctgcccggcccccggtttggaatattgggggggggaagggggaaggggtgggcccccccccccccccccccttaaagggcccccccttttggggccccccccttaaaggggggccggcctggggggggcccccccttttttttcttttgggccattaaactgttttggcccca

SEQ ID NO: 661703 - DNA, 417 bp, Homo sapiens
gcagaatagacatctagacgtatggctaactggataacctagagtcctcctgcaacaaaacaccaagaggtgtcgaataaattttttttattttttatttactcattttttttggagatggagtctcactctgtcaccaggctggagtgcagtggtgcaatctaagctcactgcaacctccatctcccaggttcaagcaattctcctgcctcagcctcccaagcagctggcactagaagcgcatgccaccaaacccagctaatctttgcatttttagtagaggcagggtttcaccatgtaggccaggatggtctccacctcttttttttctttatcttttcttttttattttttttttttacagaaagggagttacaccctggtcgcccgggcgggagtggcaagggcgcgatccag

SEQ ID NO: 661704 - DNA, 1131 bp, Homo sapiens
tctcgttggttccgttgcctgttgtcttttctttccttttctcttccgttcttacgggttcctcacttcgcggtctgctgttcctacgttttcctgattttctgggctcctttgcactgcacaatggcacgtgctttcatgtacttaaccattcaggcaggccttggccctgttctgctaccggggatggtcactgtgctacctttcacgtcttggtcccccggccgcccgtacacagagtggaccgacatgggctccgttgtcccttgtcacgcggaagaagcaccaggtacgggatgtctttctcccttttgttggttgatgctcgagaccttctttgttgctttttcgggtatctccggcttacggtgtgttctatcctgtgtcgcttctagcgtgcacccttgtggtcgccgttcgcattgggcgtccccctgtcttccagtttgtggtgccctattacgtaactgacggcatgacaatcctacggccactgcctagaagtcgcgattctagtctacagctctcaggtttgttagtctgcgtacggcaattggtggggttctccgggttaatcacttttaggatttaaacctgttgtcccggttaatgttgtagggtatatctagccagcagtgatgcacgaatctttgaacattcgcttatggggcaaaacatcctttaactttgggctcgtctgccagaatgcagggtctgggagtgtccatgcagttcccgctgtatatagagggaaatgacctggtatggcatacgagccccacaggtccaccgtctcccctcccctcatattgtaagaatagctacacactaacattttgggaaggagaggcacatgaactttttgttaacatatgtggtccaacctagagttatgggactctatcattgtcagctacttgggatatatatttaagtttctctgtaaatgtacgctcgttaaactcatattttataggtttcgatttcagactcctagcaaacatgtataagcctgcatagcagcgagtgcctcggcttttgccggtctctattagttctttactgtcactgtcatgtaatcaagctaattctctgtggatgttgctgtaaagtatgcatggttcctttcag

SEQ ID NO: 661705 - DNA, 964 bp, Homo sapiens
  misc_feature (948)..(948): n is a, c, g, or t
ccctattcttttcatggccctcttctcctctattccgacgtgaatcaaatctttctcaagtgcctataatatgtctccatttgtaattcccattggtagttccctctacgatagtgctacgacaccatcgttgttgacgaatcttgtccgaacactctttcccatctcagattatctatcgcctttcctgtctggaataatctctgggtctctcctataagggccactttgccttttggtgctttactcaaccttccgcagtgccttcttggttctatcctcgatggcttgtttccgcaatatggaggtcctccatttctcgtttgcactatgtgggtatggagtccaagtaagccttcgtctttagtttctctctctgaccgattcgtttactcacgtgaattccactcatgcctcttcgtttgttacgtcatgctacattgccaaaggcatattctctttttcactcaccgaaccacttttgtttcggcttaggacatacgttttgtcaagttaggtactgtgtacaagccatgaaatgaactatgtgaatgagatcacttcaaacatttaatgatatctgtgctgaaccaggatcggaatgcaagatcctcgtgatagtcattagtctcccgacgcttatcatgagtgaatcctatgtactgatcgggtgattcatgtgctcaatcggggatatacactatggattcatgcttgtgtgcgacgtcatgaggtctcgggcactatgctgatgtccgttccttagtcactaggattacggtaaccgtccgcacggattccaacgtgttgagtctgagaagggtgctcgccgaccgttccgctctatccggccaaggtgcttttctgtcaatattctatggaatgcaaaaggaggtttttgttttattttgtttttttgtaagcgcctcaagatcaaataaaatctanaggctgagcctctata

SEQ ID NO: 661706 - DNA, 147 bp, Homo sapiens
gtgtatcctagcgttttacttccatctttgcttgtagaatctagactattatcatgaacccaagatataatcagtatacttacttacagtatggccaaagtgaggcaggtctggaacgaggggagggtaaaagacaggagtctccca

SEQ ID NO: 661707 - DNA, 392 bp, Homo sapiens
ccgtgcgactgttttcactggcagacctgcttgttgcttttatggcacatttccgtgtttggatcattaactaaatgctcatcacagtttcataaatagaacgagttctactggccgactttgctgttactgcttctctttgtgcagtgttagtattcaccctggtcagtgagtgccatgctttttggtgagggcagatcccagcacctattgaattaccatagagtaatgatgtaacagtgcaagattttttttttaagtgacataattgtccagttataagcgtatttagactgtggccatatatgctgtatttctttgtagaataaatggtttctcattaaactctaaagattagggaaaatggatatagaaaatcttagtatagtaga

SEQ ID NO: 661708 - DNA, 249 bp, Homo sapiens
aatcactcggtaccggtcgacagcttcctgagtagctgggattgcaggcactcaccacaccccttgctaatttttgtatttttagtatcagatggggtctcatccatgttggccaagctggttctctatccaccctacctcggcgtcccaaagtgctgggattactggtctctagccgtcgcacccggccaattagttagatctttctacggaagaacaactgacttgctaattttagtctgtcatcat

SEQ ID NO: 661709 - DNA, 148 bp, Homo sapiens
aaactttctggcatatgctaatcatcatgaactcccaatagctgaagctgaatggctttaaagtaacagactaataagcgtctcatggatatagtattcctatttgacgatgccagctgacaggattcgaaaccgctacatccacatt

SEQ ID NO: 661710 - DNA, 922 bp, Homo sapiens
gaggcatgcaaggggggaaatgaagtgcatcaaccactacgggggctacttgtgcctgcccgtccgtgccgtcatcaacgactacatggcgagggacccccgccaccagtgcctcccgttcaaaccccaaccctgcccaccaggtatgagcccgaacgatcaggacagctgttgtggatgtggacgagtgtgcccaggccctgcaacgagtgtcgccccagccaaggactgccataacttgcctggtccctatcagtgcacctgcccctgatgggttaccgacaagaatcgggcccgaggttgtgtggacatagacggagtgcccgttaccggttagtgccaaggcaccgctggcggtggacaccttgcctggttccttccgctggcagtgcgacccgggccttccagctggggccctaaaaccgctcctgtgtgatgtgaacgagtgtgacatggggggcccccaatgcgagcaggcgctgttcaactcctatgggacccttccctgtgtgggtgccaccgtgggtatgagctgcactcgggatggctctcctgcagggatattggatgagtgtaagatactacaggctaccactgtcagctaccgctgcgttcacgaggcagcgccggttaactccggcaattgcccacaagagctttaccaggctgctggccagacgcctctgcaagaacttggtgagtgtgagtctgtgcgcccagtgtccagagccaaactgtgtaactaccatggggtaccggtgcgggacacaacggtggtggggccttctccaggttctagaaccggttcgcggcaacctatggagaggctacatggcggatacacctgagagggcggattcaccggccacgggaacgaacgggcgggatagaccgcgccgcgccggaggaaaaacgcggcgcc

SEQ ID NO: 661711 - DNA, 220 bp, Homo sapiens
atctcaggcaggacgagcgagactttgtctcacaaaaaaaaacaaacaaaaaaaaaagaggccgagcgttggtggttcattgcttgtaatcccagcacttggggaggccaaggggggacagatcacgaggtcaggagatcgagaccatcctggccaacttggcaaaacccggtctctattaaaatacaaaaatttacctgagggtggtgcccacaccttg

SEQ ID NO: 661712 - DNA, 1021 bp, Homo sapiens
gggccggatgcggtggtcaagcctataatcccagcactttggaaggccaaggcgggaggatcatgacgtcaggagtcaagaccagcctaggtgaaaaccccgttctccattaaaggaatacaataacaacttacagggttttgcgccaaccaacaaccacaagcgtaaatttgtggtatacaaatacattaagtagaaggacccgggtcttcacccaattgtttggtgcccaggccttgagttctacacccgttgcactatgtgcggaatcccagccccgtacctcaaggcctcccccaaaaaagtgcttggggacatacaccaagggggtgttgaagcaccacccaacggtcattggaccttacaaagtccgcggggtcctggagcttagtgctaatagtgcccacaacttattggggcaccccgttgaccttccagagggcctaattctcacattttaaggccctcccagctcctatagacaaattgccttgatagattccccttcaacacttttaaccgtgcgcatcctctgggtcccccacacaacgtggacactacttgttttggctcacagagctcacaggcggttacactctcacgtgaggcacgaattcattgccattgagacacgcagctgtgccccaatagcttgcttggcaaactaaacaattattgcccgtgacttttcacaccagttgacgttgggcacccactattttattactaaacagcacgcgctaaactggcaaacgtgcggctaactcctcatgtgataccccctttcacagcgtttacgaacacagtcgactaatagcacattgtaattcaacaaagaggcgcggcctttggctagaacactaaatggcgggtacagcggtatcactcccttgagatagaaccattacacgcaggaccatataacctaacatcaggcaatgtctcaacacaacatatgagacggcgctagcccaacagtggagacataacaaaacgttcaatcaacagcacgtcaaatgca

SEQ ID NO: 661713 - DNA, 859 bp, Homo sapiens
  misc_feature (4)..(4): n is a, c, g, or t
  misc_feature (282)..(282): n is a, c, g, or t
  misc_feature (286)..(286): n is a, c, g, or t
  misc_feature (297)..(297): n is a, c, g, or t
  misc_feature (330)..(330): n is a, c, g, or t
  misc_feature (333)..(333): n is a, c, g, or t
  misc_feature (343)..(343): n is a, c, g, or t
  misc_feature (352)..(352): n is a, c, g, or t
  misc_feature (355)..(355): n is a, c, g, or t
  misc_feature (366)..(367): n is a, c, g, or t
  misc_feature (373)..(373): n is a, c, g, or t
  misc_feature (413)..(413): n is a, c, g, or t
  misc_feature (424)..(424): n is a, c, g, or t
  misc_feature (428)..(428): n is a, c, g, or t
  misc_feature (440)..(440): n is a, c, g, or t
  misc_feature (442)..(442): n is a, c, g, or t
  misc_feature (445)..(445): n is a, c, g, or t
  misc_feature (452)..(452): n is a, c, g, or t
  misc_feature (456)..(456): n is a, c, g, or t
  misc_feature (459)..(459): n is a, c, g, or t
  misc_feature (468)..(468): n is a, c, g, or t
  misc_feature (470)..(471): n is a, c, g, or t
  misc_feature (476)..(477): n is a, c, g, or t
  misc_feature (479)..(479): n is a, c, g, or t
  misc_feature (492)..(493): n is a, c, g, or t
  misc_feature (504)..(504): n is a, c, g, or t
  misc_feature (508)..(509): n is a, c, g, or t
  misc_feature (514)..(515): n is a, c, g, or t
  misc_feature (517)..(517): n is a, c, g, or t
  misc_feature (519)..(519): n is a, c, g, or t
  misc_feature (522)..(522): n is a, c, g, or t
  misc_feature (527)..(527): n is a, c, g, or t
  misc_feature (535)..(535): n is a, c, g, or t
  misc_feature (537)..(537): n is a, c, g, or t
  misc_feature (539)..(539): n is a, c, g, or t
  misc_feature (546)..(546): n is a, c, g, or t
  misc_feature (552)..(552): n is a, c, g, or t
  misc_feature (564)..(564): n is a, c, g, or t
  misc_feature (570)..(570): n is a, c, g, or t
  misc_feature (584)..(584): n is a, c, g, or t
  misc_feature (598)..(598): n is a, c, g, or t
  misc_feature (601)..(601): n is a, c, g, or t
  misc_feature (856)..(856): n is a, c, g, or t
aganaaaggttacaaagtaatgcaaaaagactaggtacagttatttcaaaacaaatatttaaaagtataattttgcataacgtttaacattctcataatgtttattgctttctccacacagtagagaaatgaagtgcataatacatgctgtgtctcttatcttttaaacaaaaactctcacgtgcttgatttcagcatattaagagattattttgtcattaaacgaaatcgaaaaagacaaaaccacaaccccattacatagcactagtttaggcatgggcnaaanttacttatgtncatcccattgcatacattcatcttgttttgggntcnaatgcgatcnctaacttgncanagagctttaannattgtngcttttctcttcctagtgctccctccttgcttcatcaccnccagacatgtnactnctcccaaagggngncangaatagntgtngcntcattaggngnnaatgnngngggtaaatatatnngggtggtcctnatgnnactgnntngnttnggccnaactcctncnanctggggngtttcnagttggcatganttaatngcctctggtggacncatggtaggcaacngcncataggtgcactatataaatgtaaggtttatataaagaagcaccatattttgagccatccaaaaaaaaaagtgcctgggggcctgcaggcagagcagaaatgcttgttaatctgagaactgatgaaataattgcttataccaatgcactgctaaatgtcacctcttggcatgtctgtacaaagaaggcaaactaagataaaactagatctttcaacttgaaaattattttcagcagtcattttgaccagtaaaanctg

SEQ ID NO: 661714 - DNA, 1138 bp, Homo sapiens
  misc_feature (379)..(379): n is a, c, g, or t
  misc_feature (660)..(660): n is a, c, g, or t
  misc_feature (677)..(677): n is a, c, g, or t
  misc_feature (679)..(679): n is a, c, g, or t
  misc_feature (713)..(713): n is a, c, g, or t
agcggagcggggctcctccgtgagccgcgcggcgcgcttcgctgcctggcggcctttccccgagcctgagcccgacttcccgaggccgccagtcgtcgcctgcccgcagctctgcggagcgtcccggagccgtgaggtggcacggcggcggcatgtggctgcgctgtttgcgagctgtgcgggccgtggggcgcgctgctggctccacgccggactgaccagctagctcctcagtagtcctgtggcggcgtggcgtgccggcgacgacgtgaggccactgaacctggcggagcgtgctttagaccgagatatatggttaacaagactacagaggacaacggggtgccaggacacgatacagttccttccttctcatgangcatgcaataggtagagatatggcctgtggcttacgtgcagatacgattatacctggattgcatgcggaagcctccccaagaaaaggcactctttgggacaagaaaatcatttgttcgcatcaaatgggagaatatacaaatggcggagaaaaagaaagacggctgagttgggaagccctcatataaaggaaatgggttcattgcgtggacgcaaggacatagaggattgaggcaaagtcgcaaaaagaccagagcctggcttaaaacctagcttacgggncgtcttttccctagggnangcgaagggaaagcgattggggctggggctagggnggcgaaaaaacaccggaacggtgtagcggagaaagaaacaagacttgaattccctccaagggtggggttgcgcttaccaaaggggtatgtcagcgaaaagggagtttgaacaatttgccgaaattgggggagccggagcgaggagagtaatggtctgcgaagggaatgggtttgcgtatccacttccttggggaaaccttggacttaccttggtgtccttaggggggggtaaggagcaaggtcctaatcgattagagaaatacgtctaggtgttgactctcaaacggaatgaatccccgggggatagcacgcaaaaatttcgaactttggtgtaagaaggggaactttatttggtgccacttggaaactaatttctgttgtgcatatgaaacgcggatagtacgttaaagaaccatgatttgggg

SEQ ID NO: 661715 - DNA, 349 bp, Homo sapiens
cagccacaacgtgcgtaacctcattccacgaggaaacatcagaaaaactcaacatcggggacatgttataaaataactggctcatacgctacaacatgtcacattcataaggacaaaggaaggctaaggagctgttcctaattagagatgactaaatacaatgcattagcctggagtggatcctgcaagcagcaaatgttttctcattgggtgaaaagcacatctactgggcacccattggtgcacatccgcagtcaacgtctgtcagcactccagtaaatttcagacagcacattcaggtacacaggtcatcgatcattccaattttcaatgcacgttcgcacacaat

SEQ ID NO: 661716 - DNA, 238 bp, Homo sapiens
caggaggcagtattatctgcaacggggcatgatggagcatcgtgccagtgctgggctcttccgtatctagatctgagtcatggctagatgcatgcatgctttctgaagcttcactgagctgtatatctaagacctgtgcactttgctgtatgtatatcacacctcaatggaaacttgtaaaagaatttaattacttttttttttaaagcttctaagtgaactttacctaaaggtatat

SEQ ID NO: 661717 - DNA, 210 bp, Homo sapiens
catgagctggtaccagtttcacttcctgagagaagtctttgctgactctcagttgtttcaggtttccttctccctgtggatatcatagcatcctaagctttattttcatggcatgtatcatagttttttattagaatgtaaactgtctgagggtagggactttgtcttgctcatcactgtatttcctgtcctgaagaaaagagtgcttgg

SEQ ID NO: 661718 - DNA, 902 bp, Homo sapiens
  misc_feature (500)..(500): n is a, c, g, or t
agcgggttaccaagagctctcgaagaaggtgacttcaacatcaaattcatccgcctgataattctcttatatatccctaaagagaggaagagaagcgcatagaggagaagggaaataatgtctcaggagcctatcttacggttcatgagcgaaatcttgcggtgctcagttgtagtaacgcctacaactcgtcctctcgtgcgtagcgttggtgcgcggcgtaactacttgtcagtctggtcgcacggagtacagccgtctacgtgaggggtgatcaagtgacgcgaaccattctttgcttaaatgtgcgctccgacagcccggagccttgtacgcgggcggtttggctttcgttaggggtgtagagctttgttctagtagtccctggtagtggttggacctgtaggtgttgtgttcgatgtgtgcctggactgccttgtgtacttcctgctaaacacatctgtgcgacttacttgtcatgagtctgtaccgtggacaanaactccctttaggctggtcagagaggcactcaggcctattgagggttggaagccctaggttgacatcgctatgctgaggacactgttgaccgggcccaggtgatctccaaggagtacaggagagaggcatttacccctcgcgtaacctaagcccaagacggccgtcctccttctgcaagagcaaggtcccgtctgagaaaagcactgggcactgctatggttctgctcctctagaaggataacataacatgtcccataatcgggagctctcacccgctgctggcgctttggtacctgcgctctgtgcgagttgatggatagttgcacgaatcgtttcggtgaaaagacccgttgacgctggtgaaccaaccaagtcattgccctggaaggtggtaggtccca

SEQ ID NO: 661719 - DNA, 222 bp, Homo sapiens
gacaaatctccctgtcagcattcacttggtcttgataccctggacaacctcttaaagtggagtaccatctgtcaaggagctacagatcaccagagagaagcctcctgaacctgaagaaggatcagctgtagtaccaactagagcttagtaatttctaaaaacgaaaaaatgatctttttccgagcttctaaacaatgtgactataactagcataaactcatt

SEQ ID NO: 661720 - DNA, 415 bp, Homo sapiens
acacggcagtgaatcgatactctggacctagctattatcttgggtatggataaggagagctctgggcatctggaggttactatgttagggaaatggagttattgtattttttttttttttgggaaaaaaacccggccccgtggggcaaaagcctaccccaaaaaaaagggtgtctaaaatgtccacggtcccttctttggcctcaaaaagtgacttttatctcaaagaaaaaaaatggacaagatgctccactcccttggcccccttccctcccccctcctgctgctcctcagcccccagagattgaccccgggcgggggcgtgggtggcaggacagcccctcagattaggtcagcaacattgaggggctttcctcaagggaggtgttgtaaaggtctccgtgtccgaagagtct

SEQ ID NO: 661721 - DNA, 306 bp, Homo sapiens
  misc_feature (118)..(118): n is a, c, g, or t
  misc_feature (141)..(141): n is a, c, g, or t
  misc_feature (206)..(206): n is a, c, g, or t
  misc_feature (208)..(208): n is a, c, g, or t
  misc_feature (265)..(265): n is a, c, g, or t
  misc_feature (299)..(299): n is a, c, g, or t
actctgtctgccaaatatttgcacccagccaataccactcctgaaacagaagatgaatcattccatcacaatgtcgcaggaacagattgccagtcttttagctaatgctttcttctgncattttcacgactaaatgctaanatgaaatctgagtattctagtacccagacattaacttaatcgattgtttgagggacgttcatcangnaaaccctactgggttggtgacattaccagacagaagttttgaagattttcagaatgnggatttacctttgcccgattgcatgtacttaccngaccctt

SEQ ID NO: 661722 - DNA, 715 bp, Homo sapiens
atttcctgccgctccgcctgtcgcgtatctctgccggtcgcaatggaagaagagatctgccgctgctggtcattgacaatggctccagtgcatgtgcaaatgctggttttgctggggactgactgctccccgagccgtgtttccttccatctgtctgtggctgccccagacaccatgtggctgtcatgtgtgtgtgcatttgtgccatgaatggactcctactgtgtgtgctgacgatggcccatgatgcaatgcgtgtgcatcctgaccctgaatgtaccccattgatgcatggcatctgtcaccaactggagactgacatgtgagaatgatctggcaccacaccttctacaactgatgctgcgctgtggccccggagtgatgcacccagtgctgctgaccagaggcccccctgaaccccaatggccagacagagatgaagatgactcaggattatagtttgagacctatcaacaccccgtgccatgtactgtgtgccatcccatgccgtgctagtccctctacagcctactagaggctgcaccacatgggcattttggtcataggaactctttggacgactggggtcacccaacatcgttgtgcccagtcttacgattgggctatgcccatacacccaacgccatcctgccgtctaggaacttggctgtgccgggacctgaacgactacctcacttgaagatcctcactgatc

SEQ ID NO: 661723 - DNA, 269 bp, Homo sapiens
tgagcgagcacggatcgaaccttcatcctcacggatactaatcgaatttgtttctgctcctccacaatggaaactctgaagatactttctaatcttaaagtgccaagctattacttttacttatctttatatatgattaaatagggccacacctacagcatatggaggttcccaggctagggattgcatcagagctgtagatgccagactactccacagccagaggaactcgggattttttagccatgtctgcaacctacaccacagta

SEQ ID NO: 661724 - DNA, 139 bp, Homo sapiens
  misc_feature (84)..(84): n is a, c, g, or t
  misc_feature (91)..(91): n is a, c, g, or t
  misc_feature (98)..(98): n is a, c, g, or t
  misc_feature (129)..(129): n is a, c, g, or t
aaaaattaaaaaattagctggatatggtgcacacctgtagtcccagctactcgggaggctgaggtgggaggatcttttgaaccntggaggntgaggcntaggacatgtgatcatgtcactgcactctancgtgtcactc

SEQ ID NO: 661725 - DNA, 108 bp, Homo sapiens
  misc_feature (68)..(68): n is a, c, g, or t
ctcagcggcggtttcgagctcacctccatctccgcctggcgcgagtggcgcaacaagcagatccgcgncggcgatttccactccaccaacagcaactacgccaactcc

SEQ ID NO: 661726 - DNA, 1561 bp, Homo sapiens
gcttgccggcggtgcccgcaagtgaggctctcgtgtcttactcccgtctgaatagtaatagaatctgagggcggcttattgaacccctaccgacttagtccctacgcggatctactgactactgcatctgcaggactactgcagaaacaatgcgatcctttggctcaattgtacacctgtctatgctagtggaaaccatgcacaagccatactcaaggtggattgcgcctaggagtgctcgattctatgaccaaaattcaaatccagtgaagtcttccacacgaaatatcgtgtctactacagtatatttgccatcggaaccgagtagaagggtgctatgcagttcataacagtgcccaggatcgaatgttcgtctcacgctgacatggttcccttcggataacagacatagcccgttcttcgtacgtagtgcccatggcatacattcttcatagccgacacacagcatttggtgtgccgatactgtcggtgagaactccgtgcaaggtcgaacgtcccatctttatacttgacatcttggccggacactcttgggccccccgagacgggggcgaatatgagaacgccgatgttgggctttacccaaacaagccgggtctgcgccttagaagggtattcgtgggtcacattcactggagtttattgcagtggccagcaggcatactttcattaccataagcgagcaggtcacataaaaaagttgacgcataggattcaagttagcgtgggacgcttatatcaattccgcgagacactgcacgcgttgtatagaaagctccgtcaattgacgcacctaggaatgagcaaatcgtcttgccaagacaataggcactctcctttaagagagtcctgactaggtgccccctggggggttcctttgcggcaaggtaacgggaaaaccccacgaatggtccttcgtggaagccattcacctgcgccaggcaccgtcccacctcgaacccttaaaactagagcggacacacgctgcaacgtccgacgaagtccaagccgaaacggagctggggggaaggcacaccatggcgctgaagggcaaaggctccaagccacaagcgaaggcgcccgtgagcgggtagcgcacccgcggaaacggacctggccgaacctgcgcgcaccgagactacctgcccacaatgccgcaccacagcggcatcgcaccccccgaccaaagtgtcacccgttacctatatgcacacggtcgacgatcgtggaacagaccaccacaacgcctgaacacttcgcctgcgccgacagtgaagccccgccagcagcgacggcacgtacccaacacaaagagcgcggcaacgcccgtggacacagcacatgacgcacaacggtcgcactgtcccgaggcccacacatccaggggccaccacgtgccaggctacccggtacatcacgctagaacgagcgcgccgcgtggtggcagtctccagacgtcggtagagacccgagcagcgccactccacgagccacgcaacagacacagcagacgcacgctgcgagagaagacaagaccaca

SEQ ID NO: 661727 - DNA, 475 bp, Homo sapiens
  misc_feature (179)..(179): n is a, c, g, or t
  misc_feature (192)..(192): n is a, c, g, or t
  misc_feature (217)..(217): n is a, c, g, or t
  misc_feature (282)..(283): n is a, c, g, or t
ctaaattagtgcagtcaagttctaacatatctcattttatagactccattgacaatggtccaaccgaaaagaaaaattggaaatgactgctaaccagacctcgttatgaaacctaatgtatgaaaagagtcgactatggtgcaccgtctcgaactaaaactaggtatgcgatttttccngtagtttcgttgntagtagtgcgaagatcgtatttacngtaggctaatgtgtttcgaactagacgcgtagtaaagcagaaaccatatgtaaaagatgttgttnngttagcccgtcgctcgtcgtgtccccctgcagtctaacacgacagagactctctggagaccttggcaaatgactcagaggttggggctttctgagtaaaagggacatttctttaagcatcatctatcaaatttatttcaatgtatgatgtttttacaactggtcagttcttttgtattcttacagctatggt

SEQ ID NO: 661728 - DNA, 879 bp, Homo sapiens
gccgcctgggtgtcagcggctcggtcccgcgcacgctccggcgtcgcgcagcctcgtgcacctgcaatggtccgtgcgtcccgcggctggctggccctgactccgtcccggcaggaatgggccatgatttccctcccgggccctggtgaccaaacttgctgcggtttttgtcctggggctggtgccctcggccccctcgcgggccagctgcaatggacttgcccgccaaccggttgcaggccggtggagggaggggaagtggtgcttccagcgtggtacaccttgcaactggggaggtgtcttcatcccagccatgggaggtgccctttgtgatgtggtacttcaaacagaaagaaaaggaggatcaggtgttgtccctacatcaaatggggtcacaacaagcaaacctggagtatccttggtctactccatgccctccctggaacctgtccctgcggttggagggtctccaggagaaaagactctgggccctacagctgtccgtgaatgtgcaagacaaacaaggcaaatctatggggccacatgatcaaaacttagaatcaatgtactggttcctccagtcctccatcctgccgtctccagtgttgtgcccatgtgggtgcaaactgtgaccctgagcttgcagtcttccaaggaggtaagccccgttgtccattacaggtgggatcggaggctccatcccttccagactttcttttgccacagcattagatgtcgtccgcgggcgacttaaaggctcaccgaacttttcgtctccagtggtggggcaatgtttggagggccacaatggggtgggactcgcacattaatttgaccttttgattaaccaggcgctgccgcactgttctgcgctttggc

SEQ ID NO: 661729 - DNA, 318 bp, Homo sapiens
gggctccgtgtcggcagtaaagggtccaggccaactggcaaaagaggtattgttgggcctcttcagctagtcgggagatgggcttagctcaaggctaactgtagcttgttttgggacagagacgttagccaggagtagccactcggattgcagctagctagttgcgatgatccggtgtaaaggttcagagcttgcggtaggaatccggagatgtggtagagaaagagcagtctgatatgctctgggttgatgtcgcgctggtgtcctagttagctttgaagaccggtcgacgcggccgcgaatttagtagtagtaggc

SEQ ID NO: 661730 - DNA, 197 bp, Homo sapiens
agtccatggaacttcccggggggaaaatgaatgaatcataaccgatgaagttatattccaacaatatgatgttcagaaggagtcttgggccagatgagaatcaggaaactggtttcttttttttttttttttttttttttttaacatcttttttttttcttccatttattatccttaaaggtttaaggggacatggt

SEQ ID NO: 661731 - DNA, 507 bp, Homo sapiens
cttaaaaatttcatctttcaaagtcttctcgtgaccattcttttgtggctgaatcagccttacattaccattaaataattgtccctctaaaaataatcagccacgtaaagatttcatccatcccctcagccatcctcttttgagacccattagcctaacactgtgtctattccttgatacttttgttgttgttgcttttgctcttatctaaattagattaagttacataagtatctgtcggcatttgcaatatttttccccgaaatagtagcattagagagtggtaattttgctcttatttgaattgaaagccatgttttattacagagaaagtagagataattctgctaatttgttagcgacttattaagatattcactattttggggggacttaacatattttagcttgtgtgaatgtgtgtgtatgtgtgtgcatatgctcatgtatgagactatgtaaccagtttatattatgaaccagaataataaaaaaatcagaaaaagg

SEQ ID NO: 661732 - DNA, 177 bp, Homo sapiens
ccccccccccggttttggcttggtttcccaagggggggtttaggggaaggtgggtttccgcctttttttttttaaaaaagaaggttggggaattttggggggggggggggtcccccccttcccggttgggggggggggttgggattaagggttttttttttaaccccccccggccca

SEQ ID NO: 661733 - DNA, 904 bp, Homo sapiens
ccagctcgcgctcgctatggcgtcgctcagcgtgataggcctagccttctgggtaagtggggacgcggcgtgggagattcggcgtttcatgttttctgctgtgtccccgagtcctgaggcggacgcggaggctgcggggtgtccgggagcctgagagcgggtgcgtgaggcgggttggccgcctgttcccctggctgcggtgcatgaggcaggcttccaggcgcacgtaccgtcgatgaggacggggacttggttgccgttttccagtgacgaggaatatgacaatggccaggtcctacgtgaaggatgacatcttccgaatctacattaatgagaaaaaagagtgccgggggaccaccggccatcgtgtgctcaggaggcgccccggaaatggtgcacccaatgtgatctgctgatgtgctgcaatgggcctgtggtatggaacccgctactggtgcagcgtctggccagagtacgacttgtgtagcgtctgcgagggacaagggcttgctaccgggggcgacaccaggctcgcattccccagccccttcgggcacctgtctgagggcttctcgcacagccgtggctccggagggtgcacatggaccttcgggtggccatgatggggcatgggtccatccagggaaactgtagcccacgtcctcctcgtgcgtgtgaggtcagcctggcccacggagaatcatgcttctggtccattcggagtgatccgagtgtggatttcctggagaccgttggggagagtttgggggtggcctacctctgggctggattgatatcgatgtgcgccggctggaaaggaaccggtgacctcgttcagaaagtcggagcggggaagggtcacgcaggtggtttgccccgagcgtggactttgggccctctgcgc

SEQ ID NO: 661734 - DNA, 967 bp, Homo sapiens
gtgggtccgaagctggcaggcgtaggatgccagggatgccgcctgacattcagggcttccattaccaaccaggtgagaatcccacgcgagcccaagccccacgagttccagtttgaaatgggtaccttggtcgctgatccgtcaccataggtcatgagtgcgtaaaggagaggatgagaaatctcaattcggtcttcattcgtgaaattcatctgagaagaagtcttcatttttttcctaggagtacgattaccgaagccaaatttagcagcctaagccgccgattctactggccggcccaaatccgtcacagagcaatgctgcacgctgaacttagagaaaaatggattaccctagcgcaccaacggcatccaaccattcgtggagcagctttaaacacaccagctcattcgtcgtgggatttataattgttttttggttggatgggctggcggactcagaggaggctgatcggcctccacagtgcgacacagaggcttattcatcccatcggtcagggcaaccaggcgaggggccttctccccctccatgacactccacaggcagcctcgacgatcctgcaagattgctcccttgccaatgggaagggaaatacgctcaaggcgatctaggctctgtacgtaaacccaagaaatacgattttctgtaaaatacaccgccattaaagccaggaggccaagatggcaaagcggtatgaactccccgacgcagcttgggatctggttgcagatatcttcaccaaaaatcagcgcaccgggcgccctcgggccgatgatcgcctgatgctaaacggtattctctgggtgctttgctctggcgcagcctggcgagacatgcccgaacgattcggccctgggtcaacgatctatcaagggttccggggatggcgtgattgcggagctttggatcagatgctcaagggtcttcatatccgatggaatgagca

SEQ ID NO: 661735 - DNA, 235 bp, Homo sapiens
tttggtatttttagtaaagacagggtttcaccaggctggccaggctgttcttgaactccagacctcaggtgatctgcccgcttcggcctcccaacgtgctggggttacagatatcagccacctcgcccggccccagcactttctttcacagactagcatttacctctgactctcatattccccagttataatctctagttggttccctcataattaaataaagatatgataagta

SEQ ID NO: 661736 - DNA, 535 bp, Homo sapiens
gtgggtccgaagctggcaggcgtaggatgccagggatgccgcctgacattcagggcttccattaccaaccaggtgagaatcccacgcgagcccaagccccacgagttccagtttgaaatgggtaccttggtcgctgatccgtcaccataggtcatgagtgcgtaaaggagaggatgagaaatctcaattcggtcttcattcgtgaaattcatctgagaagaagtcttcatttttttcctaggagtacgattaccgaagccaaatttagcagcctaagccgccgattctactggccggcccaaatccgtcacagagcaatgctgcacgctgaacttagagaaaaatggattaccctagcgcaccaacggcatccaaccattcgtggagcagctttaaacacaccagctcattcgtcgtgggatttataattgttttttggttggatgggctggcggactcagaggaggctgatcggcctctcacagtgcgacacaagatattcatcacatcgtccaggcatccagggatcctctag

SEQ ID NO: 661737 - DNA, 268 bp, Homo sapiens
  misc_feature (175)..(175): n is a, c, g, or t
  misc_feature (184)..(185): n is a, c, g, or t
atctatcatctcgtgcatttatcatttctttgtggcgagaacattttaaaaatccctatttctagctattttgtaatataccacttaccttactgttgcgaaccataagtcaccctactgtgcaatagaacaccttgaacttattcctcctatctagttgtaactttgtacccanttgaccccnncctcccttccttccactctcccctccccagtctctggtaaccactgttctgttccctatgagataaaactttttttgtcttcc

SEQ ID NO: 661738 - DNA, 500 bp, Homo sapiens
acttctgtacaccaatacatacagttcattcagttatctctgagtaatcatgtactgtactaaagtctagtcagctaccactgcacctaagaactccccaatatttctctctaaccctgccctctctaatgaactccaggccaatattcctactagatacttctcttcttagacaatccatccataggcaactcaaattcaccataacccaaactgaactcactttaatataaagaggccacaaggaagcaaggaaaattcaactgttttctcagagttgaaaatgaacacaaaatggattacagcagtgataaaggaaccttaaggaaaacaaagggcttcccaaacctgtaagtcaagtgtgcattcaagctgaatgtactaatctgtctaaaaacaaatgccttaatcataaaaggatctgggaagcaaaagcaagcagaagaggtgaacgaagaggctttaccacagggaaaaaccaccatccctaaaagtaagct

SEQ ID NO: 661739 - DNA, 272 bp, Homo sapiens
tgggttcggtcctgtaatggatgaggttcacactagacatttacacaggcagaacgagggccacggtctttacatttccatatgcctccagtatatgtccagttgtctttttccctgccactgtatagtatgatggtggtcaggacctgggggtgcccttgagtgatctcaaccatacctctaagctgagaagggaaaggtcactgattattacttaagccagacttaaagaacagtcccaaagcttctgacagccaagacaatgtcctctt

SEQ ID NO: 661740 - DNA, 151 bp, Homo sapiens
atgtcccatctatgaggctacgtttgcccatgcatcagcgtctggactggctggtcgggactcactgactacctcatgaagatcctcactgagcgtggctactctttgtcaccactgctgacgtgaaattgtccgtgcattaaagagagct

SEQ ID NO: 661741 - DNA, 228 bp, Homo sapiens
ctgagttagtgctggtgggtcaggtgtctctggctcttttaaaaaatttggtcttggtgaatggagatcgaggaagctcgggccaagggaggggtgggctgcctgttttgtccagtttacaaatatccacgcggaacctggggtttctaaacttggatgtccgttacgtgtaaactgggtctgggatgcttggccctttccttgggtgaatgcagtcttcttttcttc

SEQ ID NO: 661742 - DNA, 379 bp, Homo sapiens
  misc_feature (106)..(106): n is a, c, g, or t
  misc_feature (139)..(139): n is a, c, g, or t
  misc_feature (204)..(204): n is a, c, g, or t
cgccctcctgcagacccagtgtcccaccaccacggtacccgggaccctcgggacaacggttccaggtccggggccctcccttataatgggcggctattggagaagnctgtagaaaaaaggggtcggagaaaaggaggancccccccaaggaggaggaggaaaaggcctattacccgcccgccccgcccccgtatttggagaccnatttgcaggggtcccaaaagggcaggctcaaaaaaaatttggccctgagtcgggaaagtttagtggtttgatctgccgtttttaacggagcttttgtatttttttttttaatttaaaggaaccctgataaagccctcccaaccccctcccgggtttaataaaaggtatattccca

SEQ ID NO: 661743 - DNA, 344 bp, Homo sapiens
actgatccttctatttacccctctattgagtccccacctccacatatcacatcaacaaactactaatacaccacccaaaaatgactaatcaaactaacctcaaaacaaataataaccatacacaacactaaagaacgaacctgatctcttatactagtatccttaatcattttaattgccacaactaacctcctcggactcctgcctcactcattcacaccaaccacccaactatctataaacctagccatggccatccccttatgagcgggcgcagtgattataggctttcgctctaagattaaaaatgccctagcccacagtacacatggaatgcacacaca

SEQ ID NO: 661744 - DNA, 341 bp, Homo sapiens
cactgaccccccctgaaatttttggccagtcctctttcccgcagctgcagagaggaggaagactattaaagggcagtcctgatgacatgtttcgtagatggggtttgcaactgcccctgagctggagctgggtaaggacctccttgatgcctgtcggcacttttgaaagggccaaggccaagaactcctggccagggctgcaagggtttgcagccaatgcagaaaatggggcaggtcctttgagaacccctccccacctaccccttccttcctctttatttctcccccattgtcttggtaaatatagacttgggaattaaaatgttggttgaagtttggga

SEQ ID NO: 661745 - DNA, 125 bp, Homo sapiens
  misc_feature (52)..(52): n is a, c, g, or t
  misc_feature (73)..(73): n is a, c, g, or t
  misc_feature (100)..(100): n is a, c, g, or t
ggggccctcaggacatccacgtgagcgtctgcccagctgcactgatattgtnttgcaaatccagatttgttgncattactgatgggcgcgtgaaaccagngagagatgcacaagatttacaggcc

SEQ ID NO: 661746 - DNA, 707 bp, Homo sapiens
  misc_feature (10)..(10): n is a, c, g, or t
  misc_feature (167)..(167): n is a, c, g, or t
  misc_feature (310)..(310): n is a, c, g, or t
  misc_feature (313)..(313): n is a, c, g, or t
  misc_feature (430)..(430): n is a, c, g, or t
  misc_feature (456)..(456): n is a, c, g, or t
  misc_feature (462)..(462): n is a, c, g, or t
  misc_feature (500)..(501): n is a, c, g, or t
  misc_feature (511)..(511): n is a, c, g, or t
  misc_feature (614)..(614): n is a, c, g, or t
  misc_feature (620)..(620): n is a, c, g, or t
  misc_feature (625)..(625): n is a, c, g, or t
  misc_feature (700)..(700): n is a, c, g, or t
aaacacttantatcacacatacttaatatattagatatacacaataataaaatcactccctacacttgaaaactttacagaagcatttttaattttacaacacaaagctcaaacgaacctacaataagtctagtagtctgtttacgtgccaagggataaggctgtanaataaattaaccctttaaaaatgtctatgatcaagtacaattttctttttgagttcttcagagcaatgaccactaagaaatatttttaaaggctgaacagaatccagcggcaatgaagttaattaaataagaagactaagagnaanatttatagttctatattaactatacagtatatttgccagcttaatcaaatcagtttatacacctttaaaacatgaatactgaacttagtaaaatgtttttttgtatctaattatttnattttctgtttttttttttttttttntttttnaaatagtttcttctctcttacacaagactttaaagcgnntccaaacagncaatttaacttttttggaaaatatattcactgcagaaatgcccacaataagccatgctatctgatggtatggtaatgtgaaatggcatggtaacgtgaaatanaaaaantttanctagataattctcccttcaaacctgaagcaaaagtacagaatgctgagttcattactttatgtatctattgtaantaggaat

SEQ ID NO: 661747 - DNA, 244 bp, Homo sapiens
  misc_feature (236)..(236): n is a, c, g, or t
ttttcttattatagaatgagtttcctaggaatattcctactccaagtcatagtagcctttgtttcctcctttcgtagttaatcctgtgtattagttcattttcatgctgctaataaagacatacctaagactgggaagaaaaagaggtttaattggacttacagttccacatggctggggagacctcagaatcatggcgggaggcaaaaggcacttcttacagggtggcggcaagngaaaatga

SEQ ID NO: 661748 - DNA, 147 bp, Homo sapiens
tataagtggtatcttaaagggacataaaatttaaaaatcttaaatattggtgaatatggacaggataacctaataatgtggtgatctacattaaaatggacaaactatggatactggctggctggtcaaataaaaaaaaagaaaaag

SEQ ID NO: 661749 - DNA, 1397 bp, Homo sapiens
agtggggtctcatcagttgtggggggtatgataagtgagctgctgggtgatgaggtggttcgttgtgtggagagtgaagaagagagtgggggtggcgccgacgagttggtgggagtgtagctcgtgtggggcgcgaactgaggtatggttgtgcagccaggtcgagagcagaggggtgttgtatgtgaggtgatgttacaaggtcgtttgtggatgcatatgtgtagggggatgggtcggtggtgtgtttttgtcgtgggaggcggtatgtgttttttgtgtagcaaggaggagaaggttgtgcgttgtagagttgttggaaatcagtgtgtgttgtgtgggagaggggagagagtagttggtggtggtgtgcggtggtgtggagagaatggtgttggtacgagcaagaggttggggggggttgttgggggtgtgggctggtgagtagatggggcccatcgtatgccgcaggagttgtttgagggggcgccgcgtggtgttgtagggggggcctccgcgagggtagcctggcgtgcccccacaggtttgtgagggggaagggtgggctgcttgttgggggtgctgaatagtttgttggtagagccccgcctctatctccttttgaattgcggtgggttctggcgcgaattgtcggggagaggtgccctcttgttgggttgcacgccaagtgtgtctcacccgcacagcgcttctcgccctgtgtttaaccccctcgtgcccccttttgaaagagtatagagttcacactgtttcacgcagggcacaagtgtcctgtgaacacaccacacacaggggtatttctttggcccctcgggggcccgccacagggagcctctcttgagaagcctctttctctgttgtggcgcctcttgttttgttttgttgcactacccctcgtgggttttgtttttcaatatggagctctttcacggagattttggaaatttcacataagccgtgtccacaaggctcgcacccacactttcctataaatgtgttaaagagaactttaagtgtgaccacggttcacagttgagaaggtggctgtttgtaagaacttaaccaccgccacggtgagaagcccacgccactcagtggccaaatcccttgaaatgttcttctttaaagaaaaatgagatgctggtcaatcgcagcgttcaagcactctcctggttttttgaatgctgtggctccctctgctaatctcacgtttcctggcttttcctccctcagccccttttcaccccctttgctgtcctgtgtaagtgagatttggtgagaaatcgttgctgcacacccttcccccagcacccactttatgaggtctcaagcttttattattgccaataaaagtgctttatgccggcttttcccca

SEQ ID NO: 661750 - DNA, 1572 bp, Homo sapiens
ggttcactctacagcccggcctgttgcctcaactaccacgtgcaggtcgccaccattcatgctacgtgtagggtacactccatcgtcgatccgctgggatgatgactgcattaccatcaggcgtgtcccgcaaggttggatcgctggacgcgagtctcgaccagctggctctctggagcatggctcgctgctggcgccacaagcatggcccacacctcgctcccggccattgtcgctttgcgtctcctgcttggggtctgccatgcccatgctgccattcaatctctgtgccgcgaggcactgtcctggacttattctctcccacctacaatgaccgcctctcaagacgtctcgaggcacatgggcgcgctacgtggccttactcagttacatgtcttcacgaatcacgaaggtgaaacgacctgggggctcacggcggagttcgcatcgtcccaaggccatgagtgatgcttcacggcctcgtttgacccaaacggtagacgttgcttctgcccgcgggtgcccgtgtgtccacgtctgccaaatctatccggtgctcggcgtatcagtaccgtagtcgcgacgacctgtggcgtccctcgtactttgagggggcgtcacggtcctaggcgtgccgtggcgggcactcggcccatgcgccggatggaactcctcaccatcgtggccagggcgcatggttggaccaccctggtgcggaggaccccttatttcccaagtttggccgaggaccggggggcctggcgggcttgccaacgggcaggcttggccgctttggtcccttaggttggcgaaaggccttgggggggccttgttggaacactgggcctttggcgaggtggaaccctttggcggtgtcttgcacccgggcatctgctgcaattgaaggggcctgtggggcttaggcgcgccccggatcacctgtggcgcggtttggcccgtgcccatgtgccctgtggccgttgcgggccacggctttgacctaggcggggcttccccttttttggcctttcccccgaggaactcctgttgaccggagacgcccggcctccgccagggtgacaccctactaaagaaacgctgttcaacccttggcagcacaggtttggcttgagttggaggaaccaaccaaccgtgcgacctttccacaccggactcgggagtttgcatgcgcattggccatgcgctggggaaagactaggcagtggcattggtgtggcttattgtaaccggaacttaaccgtagcaagtggtaataacagaagggagccctttggtgactaaagtcggctggagagaccccagtccttgcattggaataacaggccttgatacctacccaggcgaagcaaagcacacaccgggaccccggatgaaggcccttggaaatggccacggcaccacagagcccacgacctatcacacccaggttggagcagtaacccactagcgacggcgcgacccagaaaaacgccaggcacacacgcggatcttcacaattggccacaccatacgcaccagctgagcagggggctactcttggcgactccccag

SEQ ID NO: 661751 - DNA, 151 bp, Homo sapiens
ttaatctttactcctacatactccccccattattcctagtaaccaggcgatctgcgactccttaaatgttaaccatcgatgtagtactcccgctgtgaagcccccatacgtataaataattacatcacaagactgtcttgcactctgtggt

SEQ ID NO: 661752 - DNA, 663 bp, Homo sapiens
gctgagctgtgtttcgtcggaagctgtctctcgaggcacatcacgctggagcttggattctgtggcagctgtcagtgactggagcccagtcatggcatgctgcccccgttcccagctgagatgttgccaggcgagcgcttctaagtgcaggcagagtggcgagcatctggtgactcactcgtgcagaacttgctccccacgtgccgcatgtcgatgagcgcggccagtcctatccctcgagggcaggtcccgtggaccagtctcactgttttgctaggtgccagaggagccaagtctattaaaatggaagtggtattctgtgatggccgggcttgctgcatcgatgtaggcagctgcgagtttgcggaagctcgtgcctatgggcggactgggctagtgaggactggaggcatgggggctcatgcttccgtacagcccgtagacgtgcgagctcatggcgaaggttggcggactgtcatgtggcttggtattaggtcatggcccgtcgatggttgtggggtattgaatgtggtaagtggcaggcaagtgtgggaaacgtctgtgcgaggtgctggcttgagacccccgaagcgttccaccgtgtcccgtctcctatgtggcagctggggagcaagtgagatgtggactttgtatgctggccaa

SEQ ID NO: 661753 - DNA, 823 bp, Homo sapiens
  misc_feature (12)..(12): n is a, c, g, or t
  misc_feature (93)..(93): n is a, c, g, or t
  misc_feature (99)..(99): n is a, c, g, or t
  misc_feature (108)..(108): n is a, c, g, or t
  misc_feature (111)..(111): n is a, c, g, or t
  misc_feature (135)..(135): n is a, c, g, or t
  misc_feature (154)..(154): n is a, c, g, or t
  misc_feature (202)..(202): n is a, c, g, or t
  misc_feature (229)..(229): n is a, c, g, or t
  misc_feature (245)..(245): n is a, c, g, or t
  misc_feature (259)..(259): n is a, c, g, or t
  misc_feature (299)..(299): n is a, c, g, or t
  misc_feature (321)..(321): n is a, c, g, or t
  misc_feature (368)..(368): n is a, c, g, or t
  misc_feature (372)..(372): n is a, c, g, or t
  misc_feature (379)..(379): n is a, c, g, or t
  misc_feature (409)..(409): n is a, c, g, or t
  misc_feature (423)..(423): n is a, c, g, or t
  misc_feature (457)..(457): n is a, c, g, or t
  misc_feature (534)..(534): n is a, c, g, or t
  misc_feature (561)..(561): n is a, c, g, or t
  misc_feature (578)..(578): n is a, c, g, or t
  misc_feature (681)..(681): n is a, c, g, or t
  misc_feature (804)..(804): n is a, c, g, or t
tgttcgggaggnggcagggggcccgggcagggggagtgcgcttcccaggcaccattcgcttaaagtgtgttaatgatttgtccagcaagtttntttacnttcccacanccnttttctcaacgtccccccagagtnttcaggggggccttcgacntgcaaaagcttcacaggagtgcgaggggccccagctcccaggggggcngatggagcttcaaacggtcactttttncatcacgtttttagcnacgtggacttcgtntgcttggacggtgacagctgctgactggcggcatatgtgntggtgatttttccagtccttgngttggcagaaggtggagcagtagttgactttgtggcagctggtgcantcgnttatagntttctggtcgaagttaaaaaaggattgttntttccgctctggtnaggtggattttggcttggtttgtggcagcttttnggtaggtgctggcatgtttggtttgtttaaacagcgtttttagctgctgcgctgtgttgagcaaggagttgaccatnttttctaggtaaagccagctccgcggnctctgacagctccagcncattgatcaacgcgggaggtgccgctttggtgggagtcgggggtgggaccgccagcgcaggcagggatgtcaacactatttttgggatgtgacgttggcaacnagctttggtgggagtcgggggtgggaccgccagcgcaggcagggatgtcaacactattttgggatgtgacgttggcacgcgcttctggaaacggtgcgatctggcagctgtcctgatagcggnggtagtgaggctcagggtg

SEQ ID NO: 661754 - DNA, 744 bp, Homo sapiens
  misc_feature (339)..(339): n is a, c, g, or t
gggagcgtcttctggaccattcgttgccgccgtcaccaagtgagcctaggggacgatgtacctagctgtgccctcgtagatcccaggtggcctctgtgctagaggcgtaggatgcctcccgcaactccatagaatacgcccgggtggtcacccgtatgcagtcctagagcaaggtccgagatggcagccatagatgcgtcgattcctggtcgtctacccaagggagagttccagagggaggctcgagatcgacaataccactcacccggccttttgtcgagattgtcccaaaaccaacgacacacctctgtcacgtccgcggcccctactgtgctgggnttccccactgctcctcgcctaccccctgctgctccgctgcaacccgggcttcacacggccgtgccttctcccctctatcgcacggcaccccagccccacactccgctcgctcgacccggtgctcgccgaccggcacaccccccccacgcaacgtcccgccccgcttacccttcccccccccgtgcccaccctccctcgctcgccgctacttaccaccctttcgcccccgcacgccgtgctccccctctcgcacaccacctcgcggccgctcgccctgcgcccttcccttccaccctcacgccttggcgcacgcccccccgccgcgcctcgcccccctcttcccccagtcctcgccttcccagctgaaccctctcgcctggccccttcccgccccatcggccctgg

SEQ ID NO: 661755 - DNA, 820 bp, Homo sapiens
  misc_feature (205)..(206): n is a, c, g, or t
  misc_feature (221)..(221): n is a, c, g, or t
  misc_feature (265)..(265): n is a, c, g, or t
  misc_feature (276)..(276): n is a, c, g, or t
  misc_feature (281)..(282): n is a, c, g, or t
  misc_feature (298)..(298): n is a, c, g, or t
  misc_feature (310)..(310): n is a, c, g, or t
  misc_feature (332)..(332): n is a, c, g, or t
  misc_feature (394)..(394): n is a, c, g, or t
  misc_feature (460)..(460): n is a, c, g, or t
  misc_feature (572)..(572): n is a, c, g, or t
cgaccgagggactgggagtcgttagtgagagtttcactcttgttgcctaggctggagtgcaatggtgcgatcttggctcatcacgaccttcgcctcccaggttcaagtgattgtcccatttcagcctcccgagtagctgggattacaggatgacgcggtcatggcacagaacttgcacccgcagggtggccgtctaacacgctgnnccatcgagcacatgnacagcacaggacacaggttccgggggacccccttccggggcccntaattgggggnacccnnaggaaacaattcgacnttgggaaagggnccccccgggggggggcaaaaanttgggccccccgggaggctctttgtgggggggggaacaaaaactaaaagcgggcggcacatnttccgggaaaccttgtgccatttggatataagtctccctcaatcccccttttgtccaaaagccccntgttgcgcaaaccaggggaaaaatatttccccgcccgttttgggaggccttttctaggaaaattttttccccaaaagaccagcccgtacccggcccagaaaagggacgaacnttttgcgcgggggaccccccctgtttataaacacccgcccctgagtgttggcggcattttcccaaacactttttggcgccaaaaccagcgccgccccctggggcgatcttttgtggggcgaaaaggcgggcgggggacaccccacccgcagagaaagtgtttatccccaccccccaacttttgggggcgcgggcgacgcaacaaaacggggcatctttttataaaaaccccccagagaacatcttttg

SEQ ID NO: 661756 - DNA, 163 bp, Homo sapiens
aacaaatgtctaaaattatatggaacctagaaagagctgaatacccaagcaatactaagctgaaagaacaaaatgggacttcaaactaaagtgtaaggctacagtaaccaaaatagcatggtattgatacaaaaacagacacatagacctattagaactggct

SEQ ID NO: 661757 - DNA, 161 bp, Homo sapiens
cgcgggagtacttaggtcgatggacctcgcactcagtgaggagacggccatgcctttcaagtgcatgcagcgcactgatttcatcctctagtatccgcgagcgtgcccacctagaagtatgtccgacaagcctggcagaaggcagacatcaatactcatgt

SEQ ID NO: 661758 - DNA, 312 bp, Homo sapiens
tccagttgtcaaatgatccttttttgaaatgttttcctttgggcttaactgggtgggctttccacagcacccctgttgatgtcatcgatgatgtcatgaggatgggggcctttaacattacagcccactgactgggcagtccccaggatctttttaagggttccagaaagttctttggctaaggatcggggccgcatttgtcgagcaatgttgacaatttcatcaaaagggattttcccactgggtttaatggttttctggttctttctggcttttgggggttccttgagggctttgatgatcagggcaaag

SEQ ID NO: 661759 - DNA, 275 bp, Homo sapiens
cacccagctcaagccttcgctcccagcccagtagacacacacacgtagatactactactactaatacggttgcgtacacgcgagggtgatccgattacgttagcatagcactagccattatttttttcatttcatctcatccgggatctgtcagttacaccacggtactagtagtagttgctgcggcgattccccgggaaaggaaaaagaggttgctgcggtgattcccgccatggaggtgtgctgctgctccacctcgtcctccctcctcgcct

SEQ ID NO: 661760 - DNA, 99 bp, Homo sapiens
gccccttttttcggggggcctttttttttttaagggtcccttaaaaacccccaaaagggggactttgcccccttttttcccccccaaataaaaccccca

SEQ ID NO: 661761 - DNA, 463 bp, Homo sapiens
  misc_feature (97)..(97): n is a, c, g, or t
  misc_feature (153)..(153): n is a, c, g, or t
  misc_feature (204)..(204): n is a, c, g, or t
  misc_feature (274)..(274): n is a, c, g, or t
  misc_feature (349)..(349): n is a, c, g, or t
  misc_feature (402)..(402): n is a, c, g, or t
  misc_feature (450)..(450): n is a, c, g, or t
attggcaacagacacacccagaaacaatactttggatgctttaatcccatcaagttgacacttaatattaaccatcacaggggaggtgatagccaangggtacagagtttcctttggagataataaaatattgggagaaaccagcccccgatntttcacgtaggttcttttctagtttccctaagtgtcagccagtctgagaantaaagggaaagagtacaaaggagaaattttaaagctgggtgtccaggggagcatcacatgtcagcaggtnccgtgatgcccccctgagccataaaaccagcaagtttttattagcaattttcaaaggggagggagtgcacgaatngagtgtgggtcacagagatcacatgcttcaagggcaacaaaagatcacaaggnagaagatcagggcgaaacttagaatcacttaatgaacttccatgtccntctgtgcatgatt

SEQ ID NO: 661762 - DNA, 696 bp, Homo sapiens
atttttgtgggggtttttccccaagggggaaattttttgggccgagaaaaacccccaaatttccgcgcgccgagagacttttttttaaaagggcccccccaaaaattttttttcccaaaaaccccctttaagcccctaaaaatccttttgggggcagaaccttttttttttccgcggcaaccctttcctttttttaaaggggccaactagttcccccaggggggggccttttccttaaaaagaaaaaagattttcaccaaaaccaaggggaattttttaaaaaaaaaaaaaccggggtgggggggtttttccaaaaaaatgggcctttaaaaactaaattccctccaacagggaaagaaaacctttttcccccccctaatttccaggggggaaaaaacaacccacttcccctttttaaattgggtgaaaagcccacttttgtttcaaaaaacaaatcaaaaaaacttttttaatttttggggagccctagcccttttttaatataaaaagcgggcgggggggcccctttcccaaatgaaaaagttcttgcccaaggggcccccccaccctttttaaaatatttttttttaaactctctgaacgggaatctttataattttgcccattgttgagccgggaaccaaaaaataaacccttgtttttgggggggaaacataaaaaaaaaaatgtgactga

SEQ ID NO: 661763 - DNA, 1147 bp, Homo sapiens
gttgttgttctttgagacagtcttgctctgtcacccaggctgggagtgcagtggcatgatctctgcaacctctacctcccaggttcaagcaattcttgtgcctcagcctcccaagtaactgggatctacaggtgcacgctaccacacctggctgatttttattatgtctttagtagagacagggtttcaaccatgttgcccaggttggtctcaaaactcctgagctcaggcaatccacccgccttggcctcccaaagtgctaggattacaggtgtgagccacacacacccagactatttttatctttcgtttattaattttacaagttggggggggtctcaagtttgttaccctggcatggtctcgaactcccggacttaagcgatcctctgggctccaagacccaacgtaccagtctcaggtattctttactaaacagatcacataaccttaagcttctcttatctgcatgccatgtgagatgtggcttttcacccttccggccatgatcggtgaggccttcaccaagaccacgttgggcaactggtaagcgtccaattaaaaccctcgtgttgggtacaactttaacaacacacaacacattccaccatcattcgaccagacaatactaacgaatcgctgagttggtggacctgcacgaaggacgatacaccaccgacacatgaccgcaccacagtcgcggaagctacacacgcgaagtctcccgaacgacacccacagagcaattcaccacaaccccaaaacagtcgtaaacacaagtcacacggcgacaaagccaagataacgagccacccccaaagcgatcgggcacactgggtcgcaacagcgggcgacccaacaagagcagacgaccggagaagcagcacgccagaagagaggagacttggataccacacaagagcacccgcagaaacgcaccatcagacacaacaagcacccagcatagacaaacgacgctggacgcaacgcaacaacgcgcaggaacacgagaactcgcccacatgaggggatcgcacccaacaggacagcatagccacggcgatccgagcgcaggtacagaggaggcacagaaggtgttcatgtaacgccaggaaagacgacacagcaacgcacacgcagcgcgaac

SEQ ID NO: 661764 - DNA, 360 bp, Homo sapiens
gacttcctaagtaacctcctatttcatacatgtcattaaagccatttcatgggcatgtccctacagaagcatttcaagaagcagaaatttctggctgggtgcggtggctcatgcctgtaatcccagcactttgggaggccgaggcggacggatcacgaggtcaagaggtcaagatcagcctgaccaacatagtgaaaccccgtctctactaaaaatacaaaaatcagatgggtgtagtggcgcgcgctgtaatcccagctacttgaaaggctggggcaggagaatcgcttgaacccgtgaggtggaggttgcagtgagccgagattgcaccactgcagtccagcctgggtgacagggcct

SEQ ID NO: 661765 - DNA, 264 bp, Homo sapiens
caccctggcgcactctctggcgcaccgtgcgacggtatgcttgccccacaatataccgatgcgaggccaggccgctctggtaccgtctcaaggtgttttgacggcttcccaccgcccctacgacctcgaaaaatgcggatgcgtggtcccgtgctgccctcaacggtcgctgcgtctgcaagcctcccagaaatgtttgcctcattcttgggtcgcctgtgctcacgcagcgttgcgtctggaagctaccagagacacgctgac

SEQ ID NO: 661766 - DNA, 616 bp, Homo sapiens
aggatcttgaacggtctgttactcattcagctgataggaaggtaccgctgttcatgccattgcgaggcaagctgaccggtgccggcatcacggcaacggcatctataccgtagtgacgtgctacgcgaaaaagggccgggattgaggtcgacggcttgggggtccatggactcagaagcgaccgcagccaccaacgccctggagcatgaagcagatatcgccaaggtccaggattggcttgggacatgccaacatcagcacgaccaaaatctacgatcggcggcagaatcgaccagaggactcgccgacctataaagttcggtattagaaaatcatgatgactcgaagctccactaggctacagagattctgtacgtgcatgtgcctcaacatcattactcatgatcgtccttcgttgtcgactcattcagcgtagcgtgaagctatccgccgagatgggtttccttcaggcacaaaaaacccgccaataggcgggggcatgtctaagactggtcgtctgtatcgaagcggtccagaagccttggaagccaagcgtagagccaggcaaaagctcgaaccataccgattgctttcgcacacagacataccaagcgtc

SEQ ID NO: 661767 - DNA, 239 bp, Homo sapiens
catgcatcgtatttttaatatatttattagagacagggttcaccagtattgggcagattagtcttgaactcctggcctcaagtgatccacctccctcggtcttccaaagtgctgagattacaggcatgagcaaccatgcctcacctgtcaaatcttaacttaaaagcaactgtagtttcttcaaacattcttctgtcgaaagaatgcactccttttggtaggtatgatgcaggacgggt

SEQ ID NO: 661768 - DNA, 986 bp, Homo sapiens
  misc_feature (187)..(187): n is a, c, g, or t
  misc_feature (265)..(265): n is a, c, g, or t
  misc_feature (417)..(417): n is a, c, g, or t
  misc_feature (438)..(438): n is a, c, g, or t
  misc_feature (449)..(449): n is a, c, g, or t
  misc_feature (470)..(470): n is a, c, g, or t
  misc_feature (497)..(497): n is a, c, g, or t
  misc_feature (508)..(508): n is a, c, g, or t
  misc_feature (552)..(552): n is a, c, g, or t
  misc_feature (568)..(568): n is a, c, g, or t
  misc_feature (603)..(603): n is a, c, g, or t
  misc_feature (610)..(610): n is a, c, g, or t
  misc_feature (682)..(682): n is a, c, g, or t
  misc_feature (686)..(686): n is a, c, g, or t
  misc_feature (726)..(726): n is a, c, g, or t
  misc_feature (734)..(734): n is a, c, g, or t
  misc_feature (810)..(810): n is a, c, g, or t
  misc_feature (971)..(971): n is a, c, g, or t
gaccggaagagacacgcggggcttcaggctgctgccccattggaagattactccccaggcttcccttgccccaagcagtgagctgactggaatggtaccccgggaggcccctgagtctgctcagtgcctgtgcccttccctcaccatcccaaatgccaaggatgtgcttcggaagaggcacaagagnaggagccgacagcaccagcggttcatggcccggaaggccttgctgcaggagcaggggctgctgagcatgcctccaganccagggtcctccccactgcccacccctttcggggcagcgacacaactgaagctgccagcagtgggaagcagtgtctgagggctggatctggcagtgccccatgcagcagaaggcctgctcccgggaaagcctcagggcccttgcccagcaantgtgtggctatcgactgtganatggtgggcangggaccccgagggcgggtaancgagctggcccgctgttccattgtganctaccatggcnatgtcctctatgacaaatacatcaggcctgagatgcccatcgcngaataccgtacccgcnggagtggcatcactcggcagcacatgcgcaaggcngtccccntccagggggcccaaaaagagatccttaagcccctgaagggcaaaggtggggggggggcacgcgctgcacaangacntccaggcgctcaagtatgtccaccctcggagccagacccngggatacnacctatgtcccaaacttcctcagcggagcccgggcctgccacaaccccgggcccggggtctctctaaatggacctnggccctgcaggctgctgcaccaagaagatccaggtgggccagcacgggcactcatcagtagaagatgccacgacagccatggagctctaccggctggtggaggtgcagtggggacagcaggaggccgcagctctggacctgcccgaggacagagaactgangcagacagacatgga

SEQ ID NO: 661769 - DNA, 323 bp, Homo sapiens
  misc_feature (15)..(15): n is a, c, g, or t
acggtgacgagtccntagtccaagtaagcggaagacggatgatgagtgtattaacaagttaaggtgatgcgtgggccaagtacattgcagaagttaaaatgtacaaagtctctaccagtgcggtgactatcatgaaactcggcccctggtgaaatgacgcccctcccccacctgcccatggtcctgggattctctgcgcatgtcattactatttaatgcagcggttgcggcgactgccttccctgagaggacttaaaatgcagttggaaaccgatatgcttcccgccgcctttgacggattctccaggcctcgtcggtccgtg

SEQ ID NO: 661770 - DNA, 291 bp, Homo sapiens
atggtgcaatctcagctcactgcaacctctgccttctgggttcaagtgattctcgtgcctcagactcccaagtagctaggattacaggtcatctgaatatccaggcacaacccaggcatactagaccttgatcacactggaagtgcgtgaccatggggatgtggtgtgtaaagcaagaaaacatagggacagaaatacaacactggagagatcacttgatgtcatttctgatggcttttatccatcctgcccaaataaaataaacaaattaccctgctactttaaaaaaaa

SEQ ID NO: 661771 - DNA, 389 bp, Homo sapiens
ggctgtctttttgtactttttgttccagagctgcttctgtctggtttatttaggttttatccttccttttctttaagagttcgtgaagagggaagccagcattggggccttgatgcagagtaagagcatgtgaggggtagtgggatggtggggtaccagtcactgtaggggtcatccttgtccatcggtatcagaaatgtgtgatacatttgcatcaggagtggttggcctgtgcctgggcctagcacgaacatggtgctgtcctgacagcactcttcggcaggcatggctggtgcctgaagtccccatatgtgagggctccgccaagaatttgtggcctgccttgttagggatagcactgagcatctctagcattgtcagccccagcc

SEQ ID NO: 661772 - DNA, 169 bp, Homo sapiens
aagtagagatggggtttcaccatattggccaggctggtcttgaactcctgacctcaagtgatccacccacctcagccttacaaagtgctagggttacaggtgtgagccactgcgcctggccccttccctcttctttaacgccaccttccatcccttctgtcgtcttctc

SEQ ID NO: 661773 - DNA, 280 bp, Homo sapiens
tgtgttgagagaagttggtatgagttttaatggtcatttgtctatccgtatttaggccttacaggtcgcactccatctctgtcacatattgctgtcatttttaccccctttcttttctttttataatcctttcaaagaatgcacagcccacccttagctcacaggatgtactagaacaagttgcgggttgcagtttggctcgacctgctctgtgccactgctgacttgccattcttggagcccactttctgttcttgtcagccaattccctttctggtgt

SEQ ID NO: 661774 - DNA, 415 bp, Homo sapiens
  misc_feature (369)..(369): n is a, c, g, or t
  misc_feature (388)..(388): n is a, c, g, or t
  misc_feature (399)..(399): n is a, c, g, or t
gaaactctcaccaaaccagaaatagaagggaacttcctcaacctgacaacagacatctacaaaaaccctgcagataaaatcacacttaatggtgaaagactgaatgttttccccctgagatcaggaataagagaacgatgttcagtctcgccacttctattcaacattgtactggaagttctagccagggaaatgggtcaagaaaaataaataaaggaaattcagactggaaaggaggacacaaaactgtctttatttgcagatgacatgatcatctatgtagaaagtccagtgaagctacaaaaagctactagaactaattcactgaatttaattaaggctggcagggaacaaaatctattacacatnaagttcaatttgttatttnctattacactnggcaacccggcaattg

SEQ ID NO: 661775 - DNA, 473 bp, Homo sapiens
aacacacacacacacacacacacacacacacattcacacacagacacacatagctgtaaattattgtagttacttgcagaagataaaattgtacaactcaattatataatgggaaactaaacattatgagaaacagttaatgttatgaaaatgaaagtatataaaatatgtctggatccttcttggggtgatcaagaatgtttgtaacaatattctaagtaattgcacatagcatgtaaaggaagaaaaccaagcaacatgccgttgctctctaataaagtataaacttgaaatagatatatgcaaacaaaaaatatgaaacagaagttacaaaaaaagtatcttggatgtgccaagtaagggtttgatcgtctctgccatcccttaatctccattggaaaccatatcattttctttcttttcttttcttttttttttttttttttgagactgagtctcactctgtcacccag

SEQ ID NO: 661776 - DNA, 313 bp, Homo sapiens
cacaaacgtctttagagaatgccatttttaagttctaattttcagaacgtatgtatttattttttttttttggagacggagtctcgctctgtcgcccaggctggagtgcagtggcgcaatctcggatcattgcaagctccgcctcccgggttcacgccattctcctgcctcagactcctgaatagctggggttacaggtgcccaccaccacacttggctaattttggtattttaagtaaagacggggttacagccatgtcagccagagctgatcttgaactcctgacttaaggtgatccacccgcctcggact

SEQ ID NO: 661777 - DNA, 355 bp, Homo sapiens
  misc_feature (113)..(113): n is a, c, g, or t
  misc_feature (310)..(310): n is a, c, g, or t
aggccccccaaatctgtggaatgttgcctggacccataataaatgattgttgaaggcccgggtgccggttgtcacgccctgtaatccccagcactttgggaggcccgaggttnttggatcacctgaggttgggagtttgaggccagcctgacccaacatggtgaaactccgtctctactaaatacaaagttagccatgcgtggtggcgcatgcctgtaatcccagctacttgggaggctgaggaaggagaatcacttgaacccaggaggtggaggttgcggtgagccaagattgtgccattgcactccancctgggcaacaagagtgaaatccgtctcaataaaaaatcataata

SEQ ID NO: 661778 - DNA, 197 bp, Homo sapiens
gcttggcacacactgaggttggggtgagtgtaggtctattgatatgttctttgttgcctccttagctgcagcaatcagtgatgtgaggctggagaagcgtgttggtaatcttcaggaatagatagctgtagcagctctttaggctgagcccctcttccgcagcccagaattcgcaggctagcaactaagcgtcgaac

SEQ ID NO: 661779 - DNA, 461 bp, Homo sapiens
ggctggagtgcaatgcccccagatcggacccctttattcgggggcagatttgtcaggcaatttttattgtctttttctaaggaaatgctcgctgaacagggaagcacctcggtgcctccctaagcgttgctgtttccaaggcagagcttgaaaaataccgggcttgacaggttgaccccttgcgggggaaactgccagccccatattttcgggggtatttccaatcttggcgcaacccaaattttagacaggcttggccagaaactttttaagaaaattgacagtcagttcaaagctaattttttttataccgaaaagtgctcactttttgagaaagggttttgcctcgcgtagccaagaactgactcataatttagctcagcgtcaggacacctttatagaagaacagcggggtttatgaatcaagcccagaattttgtataggtcggtcaacccaaagc

SEQ ID NO: 661780 - DNA, 495 bp, Homo sapiens
cttgctgttaaggccacggcaccctgagagaactaacacttgtgttaggaaggcagcgggttcacagccgcttcctgagcagagcgcgtcaggcccacctgtgtggctgttgggctgcagttggctcctggagacatgtcagggacaggcgcctcagagaaggatgatctggagtcaggcactcgtgtgaggcactgctggagtgaggggtcgaaagagggaatggatttgtgatttttttctaaagtgaaatttctcctgggcatttccactttcctccgaatttgcctatgctttaaccctttgctaagccttgcctcaagcacatccccaccgccaccgtctgcatttcactgttctcagggccgtaaatgtccggtattagccacaaccttttactggatttgcctttgccatcttacattgaaaacaatgccttaaaagggagaccgagatttctgcaagacgagtttcagctcaaatttctcgcccatg

SEQ ID NO: 661781 - DNA, 317 bp, Homo sapiens
  misc_feature (40)..(40): n is a, c, g, or t
taattagccaacgggggtcgacccgcgaagaggacgtcanaccgcccgtgccgaggtgcgcgccacccaggcgcgtatcgcgatgtttcaggcgcagatccgccaggcccaggcgagcttgcgcagtgacgaagcagaactgggctacacacgcatttatgcgccgatgtccggcaccgtggtcgcagtggatgcccgagagggccaaagcctcaatgcccagcaacaaacgccgctgatattgcgaatcgccaagctatcgcccatgacggtctgggccgaggtctccgaggccgacatcggtcacgtcaaacctg

SEQ ID NO: 661782 - DNA, 252 bp, Homo sapiens
gacgagatggagttcaccgaggccgagagcagtaccaggatgccacagccgaggaggagggcgagttcgaggaggaggctgaggaggaggtggcctagagccttcagtcaactggggaaagcagggaagcagtgtgaactcgtttattcacttccaggctgtcctgttggctgtccactgttccacttgctgttttacctgtccacatcctgctgtacagagaccacgcgttagaggattttcgtgagtcga

SEQ ID NO: 661783 - DNA, 2076 bp, Homo sapiens
ggacctggtgcctggggccgggcggcagggcgcgcaggtggcgtgcccagaggcctctgcagcatctccccggggtcggggttggggcagcaggtgcccgccttgggcagcccggttcacgctgtgtggccactctccctggggtccaaagtcccttcccgagggccggcctgtggagctacgggggtgctgggccagggtctgtgggcctcagtcccctctgaacctcactgtgccccagatcgtcaacacctgcagtggcccagacatcgcacgctccgtctcctgcccactgctctcccgagatgccgtggacttcctgcgcggccacctggtccctaaggagatgtcgctgtgggagtcactgggagagagctggatgcggccccgttccgagtggccgcgggagccacaggtgcccctctacgtgcccaagttccacagcggctgggagcctcctgtggatgtgctgcaggaggccccctgggaggtggaggggctggcgtctgcccccatcgaggaggtgagtccagtgagccgacagtccataagaaactcccagaagcacagccccacttcagagcccacccccccgggggatgccctaccaccagtcagctccccacatactcacaggggctaccagccaacaccagccatggccaagtacgtcaagatcctgtatgacttcacagcccgaaatgccaacgagctatcggtgctcaaggatgaggtcctagaggtgctggaggacggccggcagtggtggaagctgcgcagccgcagcggccaggcggggtacgtgccctgcaacatcctaggcgaggcgcgaccggaggacgccggcgccccgttcgagcaggccggtcagaagtactggggccccgccagcccgacccacaagctacccccaagcttcccggggaacaaagacgagctcatgcagcacatggacgaggtcaacgacgagctcatccggaaaatcagcaacatcagggcgcagccacagaggcacttccgcgtggagcgcagccagcccgtgagccagccgctcacctacgagtcgggtccggacgaggtccgcgcctggctggaagccaaggccttcagcccgcggatcgtggagaacctgggcatcctgaccgggccgcagctcttctccctcaacaaggaggagctgaagaaagtgtgcggcgaggagggcgtccgcgtgtacagccagctcaccatgcagaaggccttcctggagaagcagcaaagtgggtcggagctggaagaactcatgaacaagtttcattccatgaatcagaggaggggggaggacagctaggcccagctgccttgggctggggcctgcggaggggaagcccacccacaatgcatggagtattatttttatatgtgtatgtattttgtatcaaggacacggagggggtgtggtgctggctagaggtccctgcccctgtctggaggcacaacgcccatccttaggccaaacagtacccaaggcctcagcccacaccaagactaatctcagccaaacctgctgcttggtggtgccagccccttgtccaccttctcttgaggccacagaactccctggggctggggcctctttctctggcctcccctgtgcacctggggggtcctggcccctgtgatgctcccccatccccacccacttctacatccatccacaccccagggtgagctggagctccaggctggccaggctgaacctcgcacacacgcagagttctgctccctgaggggggcccgggaggggctccagcaggaggccgtgggtgccattcgggggaaagtgggggaacgacacacacttcacctgcaagggccgacaacgcaggggacaccgtgccggcttcagacactcccagcgcccactcttacaggcccaggactggagctttctctggccaagtttcaggccaatgatccccgcatggtgttgggggtgctggtgtgtcttggtgcctggacttgagtctcaccctacagatgagaggtggctgaggcaccagggctaagcaattaaaccagttaagtctcccagga

SEQ ID NO: 661784 - DNA, 571 bp, Homo sapiens
  misc_feature (13)..(13): n is a, c, g, or t
  misc_feature (279)..(279): n is a, c, g, or t
caatgccctgcanatgcttctattcaaattaatcattcatcttcttcactgtcaaaggttgagcttgttcaaatagtcatcgatggaatcaattacctggtggattgggaaaagaaatttgagaaaggccaaaatattaaagggccacccccttttccttaatttggcaaaaaattaacttttcctttcccaatttattaattatctggcttcttgtaccaccaacattaatctctacttttaaaagttttattcacttggaaaaattttaaattgganatacttgctatatttacaattaaactctttcctaaaataaaaaaaaaacattactgtgcccgactttacacaacgtcgactgtggaaaacctttggtttcccaaatttaaatccttttacgacatatccttttttcaactggtggcgtaatcgcaaagaggcccgccacagatcgcttttaaacaactgttgcacctccatagtggatagtggaaaattgacagcgttaatattttgaaaaacaccttaaaattttttaaaccctttattttccaccaatcgcttcgctttt

SEQ ID NO: 661785 - DNA, 539 bp, Homo sapiens
taaaccaggaagccaggtcttgcctgggtcagggcaggcactgggcccgaaggaggagggccacttcctgccagccctccaccgagcccacctatggcgcctccccaggaagtgctccggccagcccagggtaaacacgctagccctgcccctctgggaccatagcccggggacccagactcttggccacgctcattcccacccctacccaggaccggcagccggagccttgggtccctgcatgggcctggggcgccctgtgccccttcacctcgtcctcgtccagttgactgctgtggcagccggtgctacccgctgtgtccactgcaccctggccctgttctgagcggtcacagcagctggggagaagggccatcctggaagccgggcagatgaggacggaaccagacagtcccactgtggtgggcagaggtggggcctgggcctgaccacggggcagtgcaaggagagaggcatcctgagagggcctgaggtgtccccacctcccctgaacacccatccctcagtggccagcctgg

SEQ ID NO: 661786 - DNA, 571 bp, Homo sapiens
gcggccgcagaccctgaagtagggcagcgggcggagcggggtcgcagggggcggggaggggaggagcccggcaggggaggggaggagccggcaggggaggggaggagcccggcagggagggagggtcaggtgcgttcccggcggggctgagcaggaccccctcgccctccaggggacaccaggagaagattcggcagcggcagtccatcctgcctcctccccagggcccggcgcccatccccttccagcaccgcggcggggattccccggaggccaagaatcgcgtgggcccgcaggtgccactcagcgagccaggtgggccgaggggctggagggggctccacagggctcgttgtggggggctcggtgagcagccgccgtgtcccccatcaggtttccgccgtcgggagtcgcaggaggagccgcgggccgtgctggctcagaagatagagaaggagacgcaaatcctcaactgcgccctggacgacatcgagccaggtgggccgaggggctggagggggctccacagggctcgttgtggggggctcggtgagcagccgccgtgtccccc

SEQ ID NO: 661787 - DNA, 182 bp, Homo sapiens
cggtgaccaagctggagtggtcaggctgacatcgaccagcaggttcatgagcatagccaatgcctggaaggaagaacaggactgaggagacacagtgggaagcccgacctgtgggattagaggtggcttcccaaaggtggtgacctccacactggggacctgcagctctctagccaggcatt

SEQ ID NO: 661788 - DNA, 525 bp, Homo sapiens
ggacctggtgcctggggccgggcggcagggcgcgcaggtggcgtgcccagaggcctctgcagcatctccccggggtcggggttggggcagcaggtgcccgccttgggcagcccggttcacgctgtgtggccactctccctggggtccaaagtcccttcccgagggccggcctgtggagctacgggggtgctgggccagggtctgtgggcctcagtcccctctgaacctcactgtgccccagatcgtcaacacctgcagtggcccagacatcgcacgctccgtctcctgcccactgctctcccgagatgccgtggacttcctgcgcggccacctggtccctaaggagatgtcgctgtgggagtcactgggagagagctggatgcggccccggtagggcagggcagagcagtgccggggcttcatggggggccagcgctgcatgggggccagcaagggggtcctggtgggccagttctggagaggcagggctgacttcaggacctctcaccccagttccgagtggcc

SEQ ID NO: 661789 - DNA, 869 bp, Homo sapiens
  misc_feature (64)..(64): n is a, c, g, or t
  misc_feature (78)..(78): n is a, c, g, or t
  misc_feature (91)..(91): n is a, c, g, or t
  misc_feature (138)..(138): n is a, c, g, or t
  misc_feature (408)..(408): n is a, c, g, or t
aacaaggttcacgtggactttgtgatgggtttagtctgagagtaatgatggatggacttctcanagctctggagaatnaaaggcagctgcngaagctctcagctttactaaatgttcttctgctatttcaaaagcatnggaaaccttgaattcttgcaagaaattaggaagagatccaaccaacgatcttactttttatgtttcacaaaagcgcaataatgtatactttagtcagtcagcagctaatttagacaatgcttggaagaggatatcagtcattaaaagtgtattttcgagtcgatctcttctctatgtgggtaatagacaagctagtataattgaatacctgccaacccttcgaaacatctgtaagactgagaagctaaaagaacaaggaaaaagtaaaanaagattcctgcactattttgaaggaattcatcttgacattccaaaagagactgtgaatactttggcagctgacttcccttaatgttccatactaacaatgctttgtatagattatcatgtggtccttaagatacatttttatattatgtggatcttcatggaaaagtatatttctcgatgtacattttaaacaaacaatttgtatatttttttattggcgggtaaatatttaaaatatttgagttacaaatttgatatattgatggtaatcttttctgaatttctgattatctgaattaagcttgtggagtaattttggattgtgagtgaactgtctggaggaaaggcactaagatgactcccatttcagggtttataactttaagatacaaattcgaaacttatctggcgggcaaccttcaggtccacactgggtaaaacccccgcgaaatgggggttca

SEQ ID NO: 661790 - DNA, 3552 bp, Homo sapiens
taaaccaggaagccaggtcttgcctgggtcagggcaggcactgggcccgaaggaggagggccacttcctgccagccctccaccgagcccacctatggcgcctccccaggaagtgctccggccagcccagggtaaacacgctagccctgcccctctgggaccatagcccggggacccagactcttggccacgctcattcccacccctacccaggaccggcagccggagccttgggtccctgcatgggcctggggcgccctgtgccccttcacctcgtcctcgtccagttgactgctgtggcagccggtgctacccgctgtgtccactgcaccctggccctgttctgagcggtcacagcagctggggagaagggccatcctggaagccgggcagatgaggacggaaccagacagtcccactgtggtgggcagaggttcctcctctcccggccccgccccggcccggccccgccgagcgtcccacccgcccgcgggagacctggcgccccggccgaggcgcgaacagacggacgcaccggcgagcgccgaggggacaggccgagcgcggggcgccggaggcaggtgtgggacaggcactggcctcagaccggggccacactgaggtctgcccttctcccgctggccgccacccaagacaccatgagccagtccggggccgtgagctgctgcccgggtgccaccaatggcagcctgggccggtccgacggtgtggccaagatgagccccaaggacctgtttgagcagaggaagaagtattccaactccaacgtcatcatgcacgagacctcgcagtaccacgtccagcacctggccacattcatcatggacaagagcgaagccatcacgtctgtggacgacgccatccggaagctggtgcagctgagctccaaggagaagatctggacccaggagatgctgctgcaggtgaacgaccagtcgttgcggctgctggacatcgagtcacaggaggagctggaagacttcccgctgcccacggtgcagcgcagccagacggtcctcaaccagctgcgctacccgtctgtgctgctgctcgtgtgccaggactcggagcagagcaagccggatgtccacttcttccactgcgatgaggtggaggcagagctggtgcacgaggacatcgagagcgcgttggccgactgccggctgggcaagaagatgcggccgcagaccctgaagggacaccaggagaagattcggcagcggcagtccatcctgcctcctccccagggcccggcgcccatccccttccagcaccgcggcggggattccccggaggccaagaatcgcgtgggcccgcaggtgccactcagcgagccaggtttccgccgtcgggagtcgcaggaggagccgcgggccgtgctggctcagaagatagagaaggagacgcaaatcctcaactgcgccctggacgacatcgagtggtttgtggcccggctgcagaaggcagccgaggctttcaagcagctgaaccagcggaaaaaggggaagaagaagggcaagaaggcgccagcagagggcgtcctcacactgcgggcacggcccccctctgagggcgagttcatcgactgcttccagaaaatcaagctggcgattaacttgctggcaaagctgcagaagcacatccagaaccccagcgccgcggagctcgtgcacttcctcttcgggcctctggacctgatcgtcaacacctgcagtggcccagacatcgcacgctccgtctcctgcccactgctctcccgagatgccgtggacttcctgcgcggccacctggtccctaaggagatgtcgctgtgggagtcactgggagagagctggatgcggccccgttccgagtggccgcgggagccacaggtgcccctctacgtgcccaagttccacagcggctgggagcctcctgtggatgtgctgcaggaggccccctgggaggtggaggggctggcgtctgcccccatcgaggaggtgagtccagtgagccgacagtccataagaaactcccagaagcacagccccacttcagagcccacccccccgggggatgccctaccaccagtcagctccccacatactcacaggggctaccagccaacaccagccatggccaagtacgtcaagatcctgtatgacttcacagcccgaaatgccaacgagctatcggtgctcaaggatgaggtcctagaggtgctggaggacggccggcagtggtggaagctgcgcagccgcagcggccaggcggggtacgtgccctgcaacatcctaggcgaggcgcgaccggaggacgccggcgccccgttcgagcaggccggtcagaagtactggggccccgccagcccgacccacaagctacccccaagcttcccggggaacaaagacgagctcatgcagcacatggacgaggtcaacgacgagctcatccggaaaatcagcaacatcagggcgcagccacagaggcacttccgcgtggagcgcagccagcccgtgagccagccgctcacctacgagtcgggtccggacgaggtccgcgcctggctggaagccaaggccttcagcccgcggatcgtggagaacctgggcatcctgaccgggccgcagctcttctccctcaacaaggaggagctgaagaaagtgtgcggcgaggagggcgtccgcgtgtacagccagctcaccatgcagaaggccttcctggagaagcagcaaagtgggtcggagctggaagaactcatgaacaagtttcattccatgaatcagaggaggggggaggacagctaggcccagctgccttgggctggggcctgcggaggggaagcccacccacaatgcatggagtattatttttatatgtgtatgtattttgtatcaaggacacggagggggtgtggtgctggctagaggtccctgcccctgtctggaggcacaacgcccatccttaggccaaacagtacccaaggcctcagcccacaccaagactaatctcagccaaacctgctgcttggtggtgccagccccttgtccaccttctcttgaggccacagaactccctggggctggggcctctttctctggcctcccctgtgcacctggggggtcctggcccctgtgatgctcccccatccccacccacttctacatccatccacaccccagggtgagctggagctccaggctggccaggctgaacctcgcacacacgcagagttctgctccctgaggggggcccgggaggggctccagcaggaggccgtgggtgccattcgggggaaagtgggggaacgacacacacttcacctgcaagggccgacaacgcaggggacaccgtgccggcttcagacactcccagcgcccactcttacaggcccaggactggagctttctctggccaagtttcaggccaatgatccccgcatggtgttgggggtgctggtgtgtcttggtgcctggacttgagtctcaccctacagatgagaggtggctgaggcaccagggctaagcaattaaaccagttaagtctcccagga

SEQ ID NO: 661791 - DNA, 509 bp, Homo sapiens
  misc_feature (10)..(10): n is a, c, g, or t
  misc_feature (24)..(24): n is a, c, g, or t
  misc_feature (48)..(48): n is a, c, g, or t
gtcttggggnaaactacagaatanctaaaaaacaggaaaaagtaaaanaagattcctgcactattttgaaggaattcatcttgacattccaaaagagactgtgaatactttggcagctgacttcccttaatgttccatactaacaatgctttgtatagattatcatgtggtccttaagatacatttttatattatgtggatcttcatggaaaagtatatttctcgatgtacattttaaacaaacaatttgtatatttttttattggcgggtaaatatttaaaatatttgagttacaaatttgatatattgatggtaatcttttctgaatttctgattatctgaattaagcttgtggagtaattttggattgtgagtgaactgtctggaggaaaggcactaagatgactcccatttcagggtttataactttaagatacaaattcgaaacttatctggcgggcaaccttcaggtccacactgggtaaaacccccgcgaaatgggggttca

SEQ ID NO: 661792 - DNA, 343 bp, Homo sapiens
gtgcaagagagcacctgaccaccatatagcaatcacacgcacatcatggaggctgtgcaaaagtatcctacaacccacaacttcagcaggcaccatatccatctcactacccagaggtacatcagagagcaggagccaggcaggtgacaaagatgtggaaggcttctaagtggttggctttgccgtctcagaagtgcgacgaaatgaaaatccatcaaaacagaatgccattccatgtttcaggcttttacctcacctcaaatcaaatgtctgtactttcatttattggtcccataagtagacacgcacttggacttctggttttagaacattctatggttat

SEQ ID NO: 661793 - DNA, 3680 bp, Homo sapiens
taaaccaggaagccaggtcttgcctgggtcagggcaggcactgggcccgaaggaggagggccacttcctgccagccctccaccgagcccacctatggcgcctccccaggaagtgctccggccagcccagggtaaacacgctagccctgcccctctgggaccatagcccggggacccagactcttggccacgctcattcccacccctacccaggaccggcagccggagccttgggtccctgcatgggcctggggcgccctgtgccccttcacctcgtcctcgtccagttgactgctgtggcagccggtgctacccgctgtgtccactgcaccctggccctgttctgagcggtcacagcagctggggagaagggccatcctggaagccgggcagatgaggacggaaccagacagtcccactgtggtgggcagaggttcctcctctcccggccccgccccggcccggccccgccgagcgtcccacccgcccgcgggagacctggcgccccggccgaggcgcgaacagacggacgcaccggcgagcgccgaggggacaggccgagcgcggggcgccggaggcagcaggaccctcccgagggcctgaccgtggaggtagcactgcacacccactccctgtgggccggagccaggaggcacttcctgggtgtcggagcccagaaggaaaccagtggccgggaagcaccagctgggtgtgggacaggcactggcctcagaccggggccacactgaggtctgcccttctcccgctggccgccacccaagacaccatgagccagtccggggccgtgagctgctgcccgggtgccaccaatggcagcctgggccggtccgacggtgtggccaagatgagccccaaggacctgtttgagcagaggaagaagtattccaactccaacgtcatcatgcacgagacctcgcagtaccacgtccagcacctggccacattcatcatggacaagagcgaagccatcacgtctgtggacgacgccatccggaagctggtgcagctgagctccaaggagaagatctggacccaggagatgctgctgcaggtgaacgaccagtcgttgcggctgctggacatcgagtcacaggaggagctggaagacttcccgctgcccacggtgcagcgcagccagacggtcctcaaccagctgcgctacccgtctgtgctgctgctcgtgtgccaggactcggagcagagcaagccggatgtccacttcttccactgcgatgaggtggaggcagagctggtgcacgaggacatcgagagcgcgttggccgactgccggctgggcaagaagatgcggccgcagaccctgaagggacaccaggagaagattcggcagcggcagtccatcctgcctcctccccagggcccggcgcccatccccttccagcaccgcggcggggattccccggaggccaagaatcgcgtgggcccgcaggtgccactcagcgagccaggtttccgccgtcgggagtcgcaggaggagccgcgggccgtgctggctcagaagatagagaaggagacgcaaatcctcaactgcgccctggacgacatcgagtggtttgtggcccggctgcagaaggcagccgaggctttcaagcagctgaaccagcggaaaaaggggaagaagaagggcaagaaggcgccagcagagggcgtcctcacactgcgggcacggcccccctctgagggcgagttcatcgactgcttccagaaaatcaagctggcgattaacttgctggcaaagctgcagaagcacatccagaaccccagcgccgcggagctcgtgcacttcctcttcgggcctctggacctgatcgtcaacacctgcagtggcccagacatcgcacgctccgtctcctgcccactgctctcccgagatgccgtggacttcctgcgcggccacctggtccctaaggagatgtcgctgtgggagtcactgggagagagctggatgcggccccgttccgagtggccgcgggagccacaggtgcccctctacgtgcccaagttccacagcggctgggagcctcctgtggatgtgctgcaggaggccccctgggaggtggaggggctggcgtctgcccccatcgaggaggtgagtccagtgagccgacagtccataagaaactcccagaagcacagccccacttcagagcccacccccccgggggatgccctaccaccagtcagctccccacatactcacaggggctaccagccaacaccagccatggccaagtacgtcaagatcctgtatgacttcacagcccgaaatgccaacgagctatcggtgctcaaggatgaggtcctagaggtgctggaggacggccggcagtggtggaagctgcgcagccgcagcggccaggcggggtacgtgccctgcaacatcctaggcgaggcgcgaccggaggacgccggcgccccgttcgagcaggccggtcagaagtactggggccccgccagcccgacccacaagctacccccaagcttcccggggaacaaagacgagctcatgcagcacatggacgaggtcaacgacgagctcatccggaaaatcagcaacatcagggcgcagccacagaggcacttccgcgtggagcgcagccagcccgtgagccagccgctcacctacgagtcgggtccggacgaggtccgcgcctggctggaagccaaggccttcagcccgcggatcgtggagaacctgggcatcctgaccgggccgcagctcttctccctcaacaaggaggagctgaagaaagtgtgcggcgaggagggcgtccgcgtgtacagccagctcaccatgcagaaggccttcctggagaagcagcaaagtgggtcggagctggaagaactcatgaacaagtttcattccatgaatcagaggaggggggaggacagctaggcccagctgccttgggctggggcctgcggaggggaagcccacccacaatgcatggagtattatttttatatgtgtatgtattttgtatcaaggacacggagggggtgtggtgctggctagaggtccctgcccctgtctggaggcacaacgcccatccttaggccaaacagtacccaaggcctcagcccacaccaagactaatctcagccaaacctgctgcttggtggtgccagccccttgtccaccttctcttgaggccacagaactccctggggctggggcctctttctctggcctcccctgtgcacctggggggtcctggcccctgtgatgctcccccatccccacccacttctacatccatccacaccccagggtgagctggagctccaggctggccaggctgaacctcgcacacacgcagagttctgctccctgaggggggcccgggaggggctccagcaggaggccgtgggtgccattcgggggaaagtgggggaacgacacacacttcacctgcaagggccgacaacgcaggggacaccgtgccggcttcagacactcccagcgcccactcttacaggcccaggactggagctttctctggccaagtttcaggccaatgatccccgcatggtgttgggggtgctggtgtgtcttggtgcctggacttgagtctcaccctacagatgagaggtggctgaggcaccagggctaagcaattaaaccagttaagtctcccagga

SEQ ID NO: 661794 - DNA, 250 bp, Homo sapiens
  misc_feature (69)..(69): n is a, c, g, or t
gatgcctatgctcctcttcatgggggcacagcggcttgcgggcaggcagcgagaggcgcaggtgagganggctggacggtgagagggaggtgctcagcccctgaccgtgatccttggacagacacccccaaaccaaagcttatgcctttaagcattcctttctgggacagagaatggggtccaggatatgagaaggggcaggaaaaaatggacttctttggcttgggagccccaaggggaggctggactg

SEQ ID NO: 661795 - DNA, 4364 bp, Homo sapiens
  misc_feature (1089)..(1089): n is a, c, g, or t
  misc_feature (1110)..(1110): n is a, c, g, or t
  misc_feature (1288)..(1288): n is a, c, g, or t
taaaccaggaagccaggtcttgcctgggtcagggcaggcactgggcccgaaggaggagggccacttcctgccagccctccaccgagcccacctatggcgcctccccaggaagtgctccggccagcccagggtaaacacgctagccctgcccctctgggaccatagcccggggacccagactcttggccacgctcattcccacccctacccaggaccggcagccggagccttgggtccctgcatgggcctggggcgccctgtgccccttcacctcgtcctcgtccagttgactgctgtggcagccggtgctacccgctgtgtccactgcaccctggccctgttctgagcggtcacagcagctggggagaagggccatcctggaagccgggcagatgaggacggaaccagacagtcccactgtggtgggcagaggttcctcctctcccggccccgccccggcccggccccgccgagcgtcccacccgcccgcgggagacctggcgccccggccgaggcgcgaacagacggacgcaccggcgagcgccgaggggacaggccgagcgcggggcgccggaggcaggtgtgggacaggcactggcctcagaccggggccacactgaggtctgcccttctcccgctggccgccacccaagacaccatgagccagtccggggccgtgagctgctgcccgggtgccaccaatggcagcctgggccggtccgacggtgtggccaagatgagccccaaggacctgtttggtgagtgaggtttgagaacgggctggacgtcacaggggagaaatgggcactgcatccaggtgggggacagctgctcctgccccacagctgtgcctggtctggcccaggggatctccgggtgcccagggaggcctctggaccctaatcaaccttccgaaagctcctggccactggatcccctcccccacacccgtaaggggagaggcctttactaataattcagggagcatcaatattgattccgctgcactcattgctgtaacctgatcacagcgaggttcaggcaggataagccgccaggtgtctgctccaggaggggggcctggccagnccccacctccccccactctgnccttccccagagacgaccctgccctctcgctagctagatgcacccttcacttatgtctttggacaaggtgcctagtctggaaagcgagaagacctgggagggcagggagagtgaagctggcagctctcagagtgggaagaagccgggctgggacccccttcctgtcccccaccctccnggacagaaaccccccgggcacaggctgctggtccccactccactcagagcaagcccatcgccttctccgagctgcgtccttctccaagggggcttccctggagggagggagggggcttcctgcaggtcctgatttcacacccacatccttcctggtggccaagaggtccacggagcagcctccctccgcttgactccaccttcccttgtgggtccagtcccaactggacgggaggctgtgggtcctgcccgtcgggggagtgactggtgtctcccggttcagagcagaggaagaagtattccaactccaacgtcatcatgcacgagacctcgcagtaccacgtccagcacctggccacattcatcatggacaagagcgaagccatcacgtctgtggacgacgccatccggaagctggtgcagctgagctccaaggagaagatctggacccaggagatgctgctgcaggtgaacgaccagtcgttgcggctgctggacatcgagtcacaggaggagctggaagacttcccgctgcccacggtgcagcgcagccagacggtcctcaaccagctgcgctacccgtctgtgctgctgctcgtgtgccaggactcggagcagagcaagccggatgtccacttcttccactgcgatgaggtggaggcagagctggtgcacgaggacatcgagagcgcgttggccgactgccggctgggcaagaagatgcggccgcagaccctgaagggacaccaggagaagattcggcagcggcagtccatcctgcctcctccccagggcccggcgcccatccccttccagcaccgcggcggggattccccggaggccaagaatcgcgtgggcccgcaggtgccactcagcgagccaggtttccgccgtcgggagtcgcaggaggagccgcgggccgtgctggctcagaagatagagaaggagacgcaaatcctcaactgcgccctggacgacatcgagtggtttgtggcccggctgcagaaggcagccgaggctttcaagcagctgaaccagcggaaaaaggggaagaagaagggcaagaaggcgccagcagagggcgtcctcacactgcgggcacggcccccctctgagggcgagttcatcgactgcttccagaaaatcaagctggcgattaacttgctggcaaagctgcagaagcacatccagaaccccagcgccgcggagctcgtgcacttcctcttcgggcctctggacctgatcgtcaacacctgcagtggcccagacatcgcacgctccgtctcctgcccactgctctcccgagatgccgtggacttcctgcgcggccacctggtccctaaggagatgtcgctgtgggagtcactgggagagagctggatgcggccccgttccgagtggccgcgggagccacaggtgcccctctacgtgcccaagttccacagcggctgggagcctcctgtggatgtgctgcaggaggccccctgggaggtggaggggctggcgtctgcccccatcgaggaggtgagtccagtgagccgacagtccataagaaactcccagaagcacagccccacttcagagcccacccccccgggggatgccctaccaccagtcagctccccacatactcacaggggctaccagccaacaccagccatggccaagtacgtcaagatcctgtatgacttcacagcccgaaatgccaacgagctatcggtgctcaaggatgaggtcctagaggtgctggaggacggccggcagtggtggaagctgcgcagccgcagcggccaggcggggtacgtgccctgcaacatcctaggcgaggcgcgaccggaggacgccggcgccccgttcgagcaggccggtcagaagtactggggccccgccagcccgacccacaagctacccccaagcttcccggggaacaaagacgagctcatgcagcacatggacgaggtcaacgacgagctcatccggaaaatcagcaacatcagggcgcagccacagaggcacttccgcgtggagcgcagccagcccgtgagccagccgctcacctacgagtcgggtccggacgaggtccgcgcctggctggaagccaaggccttcagcccgcggatcgtggagaacctgggcatcctgaccgggccgcagctcttctccctcaacaaggaggagctgaagaaagtgtgcggcgaggagggcgtccgcgtgtacagccagctcaccatgcagaaggccttcctggagaagcagcaaagtgggtcggagctggaagaactcatgaacaagtttcattccatgaatcagaggaggggggaggacagctaggcccagctgccttgggctggggcctgcggaggggaagcccacccacaatgcatggagtattatttttatatgtgtatgtattttgtatcaaggacacggagggggtgtggtgctggctagaggtccctgcccctgtctggaggcacaacgcccatccttaggccaaacagtacccaaggcctcagcccacaccaagactaatctcagccaaacctgctgcttggtggtgccagccccttgtccaccttctcttgaggccacagaactccctggggctggggcctctttctctggcctcccctgtgcacctggggggtcctggcccctgtgatgctcccccatccccacccacttctacatccatccacaccccagggtgagctggagctccaggctggccaggctgaacctcgcacacacgcagagttctgctccctgaggggggcccgggaggggctccagcaggaggccgtgggtgccattcgggggaaagtgggggaacgacacacacttcacctgcaagggccgacaacgcaggggacaccgtgccggcttcagacactcccagcgcccactcttacaggcccaggactggagctttctctggccaagtttcaggccaatgatccccgcatggtgttgggggtgctggtgtgtcttggtgcctggacttgagtctcaccctacagatgagaggtggctgaggcaccagggctaagcaattaaaccagttaagtctcccagga

SEQ ID NO: 661796 - DNA, 205 bp, Homo sapiens
accggatcgggcgagaaagtgttgtgggaagacagtcagatttacgccgattactatgatagtgaaatggatttaggcgtaggtttgatctggggtgtagcctgacgaatagtgggacatcagtgcaatgaagcctcctatgaatggcaaatacagctccgtattgtataggacatagtggaagtgagctacacacatattacgt

SEQ ID NO: 661797 - DNA, 3617 bp, Homo sapiens
taaaccaggaagccaggtcttgcctgggtcagggcaggcactgggcccgaaggaggagggccacttcctgccagccctccaccgagcccacctatggcgcctccccaggaagtgctccggccagcccagggtaaacacgctagccctgcccctctgggaccatagcccggggacccagactcttggccacgctcattcccacccctacccaggaccggcagccggagccttgggtccctgcatgggcctggggcgccctgtgccccttcacctcgtcctcgtccagttgactgctgtggcagccggtgctacccgctgtgtccactgcaccctggccctgttctgagcggtcacagcagctggggagaagggccatcctggaagccgggcagatgaggacggaaccagacagtcccactgtggtgggcagaggttcctcctctcccggccccgccccggcccggccccgccgagcgtcccacccgcccgcgggagacctggcgccccggccgaggcgcgaacagacggacgcaccggcgagcgccgaggggacaggccgagcgcggggcgccggaggcaggtgtgggacaggcactggcctcagaccggggccacactgaggtctgcccttctcccgctggccgccacccaagacaccatgagccagtccggggccgtgagctgctgcccgggtgccaccaatggcagcctgggccggtccgacggtgtggccaagatgagccccaaggacctgtttgtcccaactggacgggaggctgtgggtcctgcccgtcgggggagtgactggtgtctcccggttcagagcagaggaagaagtattccaactccaacgtcatcatgcacgagacctcgcagtaccacgtccagcacctggccacattcatcatggacaagagcgaagccatcacgtctgtggacgacgccatccggaagctggtgcagctgagctccaaggagaagatctggacccaggagatgctgctgcaggtgaacgaccagtcgttgcggctgctggacatcgagtcacaggaggagctggaagacttcccgctgcccacggtgcagcgcagccagacggtcctcaaccagctgcgctacccgtctgtgctgctgctcgtgtgccaggactcggagcagagcaagccggatgtccacttcttccactgcgatgaggtggaggcagagctggtgcacgaggacatcgagagcgcgttggccgactgccggctgggcaagaagatgcggccgcagaccctgaagggacaccaggagaagattcggcagcggcagtccatcctgcctcctccccagggcccggcgcccatccccttccagcaccgcggcggggattccccggaggccaagaatcgcgtgggcccgcaggtgccactcagcgagccaggtttccgccgtcgggagtcgcaggaggagccgcgggccgtgctggctcagaagatagagaaggagacgcaaatcctcaactgcgccctggacgacatcgagtggtttgtggcccggctgcagaaggcagccgaggctttcaagcagctgaaccagcggaaaaaggggaagaagaagggcaagaaggcgccagcagagggcgtcctcacactgcgggcacggcccccctctgagggcgagttcatcgactgcttccagaaaatcaagctggcgattaacttgctggcaaagctgcagaagcacatccagaaccccagcgccgcggagctcgtgcacttcctcttcgggcctctggacctgatcgtcaacacctgcagtggcccagacatcgcacgctccgtctcctgcccactgctctcccgagatgccgtggacttcctgcgcggccacctggtccctaaggagatgtcgctgtgggagtcactgggagagagctggatgcggccccgttccgagtggccgcgggagccacaggtgcccctctacgtgcccaagttccacagcggctgggagcctcctgtggatgtgctgcaggaggccccctgggaggtggaggggctggcgtctgcccccatcgaggaggtgagtccagtgagccgacagtccataagaaactcccagaagcacagccccacttcagagcccacccccccgggggatgccctaccaccagtcagctccccacatactcacaggggctaccagccaacaccagccatggccaagtacgtcaagatcctgtatgacttcacagcccgaaatgccaacgagctatcggtgctcaaggatgaggtcctagaggtgctggaggacggccggcagtggtggaagctgcgcagccgcagcggccaggcggggtacgtgccctgcaacatcctaggcgaggcgcgaccggaggacgccggcgccccgttcgagcaggccggtcagaagtactggggccccgccagcccgacccacaagctacccccaagcttcccggggaacaaagacgagctcatgcagcacatggacgaggtcaacgacgagctcatccggaaaatcagcaacatcagggcgcagccacagaggcacttccgcgtggagcgcagccagcccgtgagccagccgctcacctacgagtcgggtccggacgaggtccgcgcctggctggaagccaaggccttcagcccgcggatcgtggagaacctgggcatcctgaccgggccgcagctcttctccctcaacaaggaggagctgaagaaagtgtgcggcgaggagggcgtccgcgtgtacagccagctcaccatgcagaaggccttcctggagaagcagcaaagtgggtcggagctggaagaactcatgaacaagtttcattccatgaatcagaggaggggggaggacagctaggcccagctgccttgggctggggcctgcggaggggaagcccacccacaatgcatggagtattatttttatatgtgtatgtattttgtatcaaggacacggagggggtgtggtgctggctagaggtccctgcccctgtctggaggcacaacgcccatccttaggccaaacagtacccaaggcctcagcccacaccaagactaatctcagccaaacctgctgcttggtggtgccagccccttgtccaccttctcttgaggccacagaactccctggggctggggcctctttctctggcctcccctgtgcacctggggggtcctggcccctgtgatgctcccccatccccacccacttctacatccatccacaccccagggtgagctggagctccaggctggccaggctgaacctcgcacacacgcagagttctgctccctgaggggggcccgggaggggctccagcaggaggccgtgggtgccattcgggggaaagtgggggaacgacacacacttcacctgcaagggccgacaacgcaggggacaccgtgccggcttcagacactcccagcgcccactcttacaggcccaggactggagctttctctggccaagtttcaggccaatgatccccgcatggtgttgggggtgctggtgtgtcttggtgcctggacttgagtctcaccctacagatgagaggtggctgaggcaccagggctaagcaattaaaccagttaagtctcccagga

SEQ ID NO: 661798 - DNA, 125 bp, Homo sapiens
  misc_feature (65)..(65): n is a, c, g, or t
atcaaacccttttatgttgctgtgcggaggtaaaatcattaacttgtgcaaatgacaaacaactnatatcaaagatacaggttaccaagcataaaacgatacagttaaaccaattcgagaaaaat

SEQ ID NO: 661799 - DNA, 257 bp, Homo sapiens
aaagatatatgtagacacaaagagagagagaccctgtctcttaaaaaagaaaaaaaaaagcaaagctgttttctatctatagtggatatggaattatacattcccaccagcaatgtataaaagttcaagtttctccaagctccctggcagcatttagtgttacagtttttttaattttaactatctaacaggtaagtagtgatatctacggtgattcatttgcattcctgatgtctaataatgtgaacatgttgtcc

SEQ ID NO: 661800 - DNA, 3812 bp, Homo sapiens
taaaccaggaagccaggtcttgcctgggtcagggcaggcactgggcccgaaggaggagggccacttcctgccagccctccaccgagcccacctatggcgcctccccaggaagtgctccggccagcccagggtaaacacgctagccctgcccctctgggaccatagcccggggacccagactcttggccacgctcattcccacccctacccaggaccggcagccggagccttgggtccctgcatgggcctggggcgccctgtgccccttcacctcgtcctcgtccagttgactgctgtggcagccggtgctacccgctgtgtccactgcaccctggccctgttctgagcggtcacagcagctggggagaagggccatcctggaagccgggcagatgaggacggaaccagacagtcccactgtggtgggcagaggttcctcctctcccggccccgccccggcccggccccgccgagcgtcccacccgcccgcgggagacctggcgccccggccgaggcgcgaacagacggacgcaccggcgagcgccgaggggacaggccgagcgcggggcgccggaggcagcaggaccctcccgagggcctgaccgtggaggtagcactgcacacccactccctgtgggccggagccaggaggcacttcctgggtgtcggagcccagaaggaaaccagtggccgggaagcaccagctgggtgtgggacaggcactggcctcagaccggggccacactgaggtctgcccttctcccgctggccgccacccaagacaccatgagccagtccggggccgtgagctgctgcccgggtgccaccaatggcagcctgggccggtccgacggtgtggccaagatgagccccaaggacctgtttgagcagaggaagaagtattccaactccaacgtcatcatgcacgagacctcgcagtaccacgtccagcacctggccacattcatcatggacaagagcgaagccatcacgtctgtggacgacgccatccggaagctggtgcagctgagctccaaggagaagatctggacccaggagatgctgctgcaggtgaacgaccagtcgttgcggctgctggacatcgagtcacaggaggagctggaagacttcccgctgcccacggtgcagcgcagccagacggtcctcaaccagctgcgctacccgtctgtgctgctgctcgtgtgccaggactcggagcagagcaagccggatgtccacttcttccactgcgatgaggtggaggcagagctggtgcacgaggacatcgagagcgcgttggccgactgccggctgggcaagaagatgcggccgcagaccctgaagggacaccaggagaagattcggcagcggcagtccatcctgcctcctccccagggcccggcgcccatccccttccagcaccgcggcggggattccccggaggccaagaatcgcgtgggcccgcaggtgccactcagcgagccaggtttccgccgtcgggagtcgcaggaggagccgcgggccgtgctggctcagaagatagagaaggagacgcaaatcctcaactgcgccctggacgacatcgagtggtttgtggcccggctgcagaaggcagccgaggctttcaagcagctgaaccagcggaaaaaggggaagaagaagggcaagaaggcgccagcagagggcgtcctcacactgcgggcacggcccccctctgagggcgagttcatcgactgcttccagaaaatcaagctggcgattaacttgctggcaaagctgcagaagcacatccagaaccccagcgccgcggagctcgtgcacttcctcttcgggcctctggacctgatcgtcaacacctgcagtggcccagacatcgcacgctccgtctcctgcccactgctctcccgagatgccgtggacttcctgcgcggccacctggtccctaaggagatgtcgctgtgggagtcactgggagagagctggatgcggccccgttccgagtggccgcgggagccacaggtgcccctctacgtgcccaagttccacagcggctgggagcctcctgtggatgtgctgcaggaggccccctgggaggtggaggggctggcgtctgcccccatcgaggaggtgagtccagtgagccgacagtccataagaaactcccagaagcacagccccacttcagagcccacccccccgggggatgccctaccaccagtcagctccccacatactcacaggggctaccagccaacaccagccatggccaagtacgtcaagatcctgtatgacttcacagcccgaaatgccaacgagctatcggtgctcaaggatgaggtcctagaggtgctggaggacggccggcagtggtggaagctgcgcagccgcagcggccaggcggggtacgtgccctgcaacatcctaggcgaggcgcgaccggaggacgccggcgccccgttcgagcaggccggtcagaagtactggggccccgccagcccgacccacaagctacccccaagcttcccggggaacaaagacggtgagagctgctgcttcgaggcgggggtcccgggcccaggccacctgggggaggaagtgtggggggggtccctgggccgggggcgggggcaggggcaaggcagcggcgggcctgagtcgcgcgccccctcagagctcatgcagcacatggacgaggtcaacgacgagctcatccggaaaatcagcaacatcagggcgcagccacagaggcacttccgcgtggagcgcagccagcccgtgagccagccgctcacctacgagtcgggtccggacgaggtccgcgcctggctggaagccaaggccttcagcccgcggatcgtggagaacctgggcatcctgaccgggccgcagctcttctccctcaacaaggaggagctgaagaaagtgtgcggcgaggagggcgtccgcgtgtacagccagctcaccatgcagaaggccttcctggagaagcagcaaagtgggtcggagctggaagaactcatgaacaagtttcattccatgaatcagaggaggggggaggacagctaggcccagctgccttgggctggggcctgcggaggggaagcccacccacaatgcatggagtattatttttatatgtgtatgtattttgtatcaaggacacggagggggtgtggtgctggctagaggtccctgcccctgtctggaggcacaacgcccatccttaggccaaacagtacccaaggcctcagcccacaccaagactaatctcagccaaacctgctgcttggtggtgccagccccttgtccaccttctcttgaggccacagaactccctggggctggggcctctttctctggcctcccctgtgcacctggggggtcctggcccctgtgatgctcccccatccccacccacttctacatccatccacaccccagggtgagctggagctccaggctggccaggctgaacctcgcacacacgcagagttctgctccctgaggggggcccgggaggggctccagcaggaggccgtgggtgccattcgggggaaagtgggggaacgacacacacttcacctgcaagggccgacaacgcaggggacaccgtgccggcttcagacactcccagcgcccactcttacaggcccaggactggagctttctctggccaagtttcaggccaatgatccccgcatggtgttgggggtgctggtgtgtcttggtgcctggacttgagtctcaccctacagatgagaggtggctgaggcaccagggctaagcaattaaaccagttaagtctcccagga

SEQ ID NO: 661801 - DNA, 1401 bp, Homo sapiens
  misc_feature (1401)..(1401): n is a, c, g, or t
tctcaaaattctgtgacaaattttgagacccattgagcacgcagttaaatgagaaaagatagaaaatgaaaaaaaaaaaaaaaagaaaaatagaaagaaaaataaaaaaagaaaaacaaaacaaagataatgccgtgcgcggcactgtgacttatactatgcactaacgagacgacgacgcaacagtagcgtactcagcaatctgattattctccaattgggggccctccatagaccatgcactgtctatcttatgttgacttactccaatggagggccccgaaggacaactagagaacctattacacgacaaacacgatgatttacaggggactatctcgaggctaagactgtagctgatcctgaatctgaatgcagagaatagagatgatagcgctcgaccacttcccgaacggctgatgtattcttacccatacacagtagggaccaagacccacgaagaatgcatatgaccctttcctgcgccggtacaccagctcggagctgtcaaaaactcacctacatcgggatcccgaaagttatagcacaacataggcatatccaacatgttatcaaccaaacacactaatcagtgaacaagaaaccctcaagcatactggacggggataaacatgcggctgcaagagcgacaagctccaagccgactcaacaattaaccgcaacaaaatctgcgactaacaaaacctcccgaaacacgacggcacccatatcggtggccgaattgcacatggggaacggggaaactggagcgaaccaaaccattcgccttggaaccccaagcatgcataaaccaattgaccctttggaaaaaccaacacggagactcggccccacggttcacccccgataaaacgaatatgacaacatagcaccagttgagcaaccaccgcctgtcatcgaaccgctctagagactatgacttacccataaccacgccactcctatccaaaatagaaaaaagccccgttgggccctgctctctccacgagatagctacacaacattagcgtgctactaggtccacgagcacacgataggcacaaagcacaaattggtagccccacacacccaggcaaaggagcgaacacattaggcaaatacacgaagaacacgagcataaaatcccaacatggcccataacccatacccaccccctcctcaagcaacacaataatccaaatcaccacagaccttacccaaaagacccaaagcacatacccctctccgaccctcaccacacaccccaccccctactacataaccccaccaacaccaaagacctactcaccaccccacaacacaaacctacagctaaacccaaccacaacaatctcatcactctaaccacatcccacacgcaccccaccccccacaaccacn

SEQ ID NO: 661802 - DNA, 3588 bp, Homo sapiens
taaaccaggaagccaggtcttgcctgggtcagggcaggcactgggcccgaaggaggagggccacttcctgccagccctccaccgagcccacctatggcgcctccccaggaagtgctccggccagcccagggtaaacacgctagccctgcccctctgggaccatagcccggggacccagactcttggccacgctcattcccacccctacccaggaccggcagccggagccttgggtccctgcatgggcctggggcgccctgtgccccttcacctcgtcctcgtccagttgactgctgtggcagccggtgctacccgctgtgtccactgcaccctggccctgttctgagcggtcacagcagctggggagaagggccatcctggaagccgggcagatgaggacggaaccagacagtcccactgtggtgggcagaggttcctcctctcccggccccgccccggcccggccccgccgagcgtcccacccgcccgcgggagacctggcgccccggccgaggcgcgaacagacggacgcaccggcgagcgccgaggggacaggccgagcgcggggcgccggaggcagcaggaccctcccgagggcctgaccgtggaggtagcactgcacacccactccctgtgggccggagccaggaggcacttcctgggtgtcggagcccagaaggaaaccagtggccgggaagcaccagctgggtgtgggacaggcactggcctcagaccggggccacactgaggtctgcccttctcccgctggccgccacccaagacaccatgagccagtccggggccgtgagctgctgcccgggtgccaccaatggcagcctgggccggtccgacggtgtggccaagatgagccccaaggacctgtttgagcagaggaagaagtattccaactccaacgtcatcatgcacgagacctcgcagtaccacgtccagcacctggccacattcatcatggacaagagcgaagccatcacgtctgtggacgacgccatccggaagctggtgcagctgagctccaaggagaagatctggacccaggagatgctgctgcaggtgaacgaccagtcgttgcggctgctggacatcgagtcacaggaggagctggaagacttcccgctgcccacggtgcagcgcagccagacggtcctcaaccagctgcgctacccgtctgtgctgctgctcgtgtgccaggactcggagcagagcaagccggatgtccacttcttccactgcgatgaggtggaggcagagctggtgcacgaggacatcgagagcgcgttggccgactgccggctgggcaagaagatgcggccgcagaccctgaagggacaccaggagaagattcggcagcggcagtccatcctgcctcctccccagggcccggcgcccatccccttccagcaccgcggcggggattccccggaggccaagaatcgcgtgggcccgcaggtgccactcagcgagccaggtttccgccgtcgggagtcgcaggaggagccgcgggccgtgctggctcagaagatagagaaggagacgcaaatcctcaactgcgccctggacgacatcgagtggtttgtggcccggctgcagaaggcagccgaggctttcaagcagctgaaccagcggaaaaaggggaagaagaagggcaagaaggcgccagcagagggcgtcctcacactgcgggcacggcccccctctgagggcgagttcatcgactgcttccagaaaatcaagctggcgattaacttgctggcaaagctgcagaagcacatccagaaccccagcgccgcggagctcgtgcacttcctcttcgggcctctggacctgatcgtcaacacctgcagtggcccagacatcgcacgctccgtctcctgcccactgctctcccgagatgccgtggacttcctgcgcggccacctggtccctaaggagatgtcgctgtgggagtcactgggagagagctggatgcggccccgttccgagtggccgcgggagccacaggtgcccctctacgtgcccaagttccacagcggctgggagcctcctgtggatgtgctgcaggaggccccctgggaggtggaggggctggcgtctgcccccatcgaggaggtgagtccagtgagccgacagtccataagaaactcccagaagcacagccccacttcagagcccacccccccgggggatgccctaccaccagtcagctccccacatactcacaggggctaccagccaacaccagccatggccaagtacgtcaagatcctgtatgacttcacagcccgaaatgccaacgagctatcggtgctcaaggatgaggtcctagaggtgctggaggacggccggcagtggtggaagctgcgcagccgcagcggccaggcggggtacgtgccctgcaacatcctaggcgaggcgcgaccggaggacgccggcgccccgttcgagcaggccggtcagaagtactggggccccgccagcccgacccacaagctacccccaagcttcccggggaacaaagacgagctcatgcagcacatggacgaggtcaacgacgagctcatccggaaaatcagcaacatcagggcgcagccacagaggcacttccgcgtggagcgcagccagcccgtgagccagccgctcacctacgagtcgggtccggacgaggtccgcgcctggctggaagccaaggccttcagcccgcggatcgtggagaacctgggcatcctgaccgggccgcagctcttctccctcaacaaggaggagctgaagaaagtgtgcggcgaggagggcgtccgcgtgtacagccagctcaccatgcagaaggccttcctggagaagcagcaaagtgggtcggagctggaagaactcatgaacaagtttcattccatgaatcagaggaggggggaggacagctaggcccagctgccttgggctggggcctgcggaggggaagcccacccacaatgcatggagtattatttttatatgtgtatgtattttgtatcaaggacacggagggggtgtggtgctggctagaggtccctgcccctgtctggaggcacaacgcccatccttaggccaaacagtacccaaggcctcagcccacaccaagactaatctcagccaaacctgctgcttggtggtgccagccccttgtccaccttctcttgaggccacagaactccctggggctggggcctctttctctggcctccaggctggccaggctgaacctcgcacacacgcagagttctgctccctgaggggggcccgggaggggctccagcaggaggccgtgggtgccattcgggggaaagtgggggaacgacacacacttcacctgcaagggccgacaacgcaggggacaccgtgccggcttcagacactcccagcgcccactcttacaggcccaggactggagctttctctggccaagtttcaggccaatgatccccgcatggtgttgggggtgctggtgtgtcttggtgcctggacttgagtctcaccctacagatgagaggtggctgaggcaccagggctaagcaattaaaccagttaagtctcccagga

SEQ ID NO: 661803 - DNA, 722 bp, Homo sapiens
ccacgaggtgttgtttttcgcgccgtcctctttttggcccctttttttcctccgccacgttggttggttgctgggctcgctccgcgggaccccattgtgtggcggcggcggtatcctgccgcggcgcataagtctgtccggtttgggcgcgcgtcttcgtttttcacgagatggtttcctcccgtctgtgcgtgggtgtctccgcgcgcacactattttcgtcccgcgaggattgtctcgcgcccccctatttctcgcgctctctgagggcattgggggcccaacactcgccacgcgcgagtatgttcctcttctccccccggcccacggcggtgccattcacactcccacagcggagatctccctgttcagcaggccgcacaaacacaaaggatggtgctgctcaagaaaacgtagacagcagggacaactcgtgcgtcacaccgctgagacaagacaagacatatcagccacacactggtgggaggtgcacacgcgagggagatactctccgtgcccggcagagagagatcttcacacagcaagacggagcgagagtgaacagagacgttccgctttcacgctgtaccaagagaaccccgaggagattcacgtaagacaaccagtgttgcccccccctgtggaccccggggggggccaccaccgtggagaaaacgcgctacaccaccaggagaggccacgaggcgtcccatcaaaaaaca

SEQ ID NO: 661804 - DNA, 532 bp, Homo sapiens
tagtatacttgaagttgggtggtataatgcctcccactttgttctttttgcttaggaatgctttggctatttgggctcatttttgcttccatgtgaatattagaatagtttttttagttttgttaaaaataatcttggtagtttgataggaatagcactgaatgtataaattgctctggagagtatggccattttaatgctattcattcttccaatgcataagcatgaaatgttttttcattcatttgtttcaactttgatttctttcaacagtgttttgtagttctccttgtagagattttcacgtccttggttaactgtattcataggtatttcatattctttgtggctattgtaaatgggattgtgctcttgatttgactctaagcctgggcgttactggtgtatagaaatgctactggatttttgtacactgattttatatcctgaaaccttgctaaaattgtttaacagttctaggagcttttggcagagtccttagggctttctaggtatagtttgactttttcat

SEQ ID NO: 661805 - DNA, 220 bp, Homo sapiens
taacatgtactcagggaccattcaccactgctctatttagccgccagtctcttcagcaatggtgagggtctggtgtacacattatttcatcacccaggtaataagcatagcacccgacaggtagtttttcggtcctcaccctcctcccatcttaccctcaagtaggccctgctgtttgttgttccctttttttgtgtcaatgtgtagtcactgttaggtc

SEQ ID NO: 661806 - DNA, 681 bp, Homo sapiens
ggcgtctgtgggctccggcttgcctgtgcggagatgagcgggtccctcggccgagctgcggcggctctgctccgctgggggcgcggcgcgggcggcggtggcctttggggtccgggcgtgcgggcggtggttctggcgcgagtgtgggtagctcgggtacgttggacgcgctggtgagaaggacaggtgtgcgtcttcctcaatgggacgccggagcagcccagtgcggcttcagcaacgccgtggtgcagatcctgaggcatgcacggagtccgcggattacgcggcctacaacgtgctggacgacccggagctccgacaaggcattaaagactattccaaattggccaccatcccgaaaatgtgtacccgtcaatggcgagtttgtagggggctgtgacattcttctgcaagatgcaccaagaatggggacttggttggaagaactgaaaaagttgggggatcactcggggccctttaagatgaaaagaaagaccaagactccaagtgagggcggcaagtcctcgctgagcagagagggagccgttcatgtcagagactcactgccagaaaagccttagccatatgggttttcactattgagaccgaattgttgcgcctgatcattttggtttcatgagcagtgggtgatcaagtaggaactggtgttcgggctaaaga

SEQ ID NO: 661807 - DNA, 1017 bp, Homo sapiens
ggcaaggagtgagacgtctaggtccacaggaagacctgcctcactgtcggcttcacacaggtgaagctcggaagacacaaaggcgcggtttggctaagctggctggaagctatcaggaccacttacaatgacagatacgatgagatccggcgctcactggggtggcaatgtcctgggtcctaagtctgtggctcgtactcgcccaagtcgtcgaacataggcttgaaggctacagaacgtggccactacgacgtggggttacagtgtacactgtaggagcttttctggtacgagtaaacacataaattgaagactaagtacagaattttccgtttcaacacataaaagaaaagaagacgagaatttaaagatgagaaagagacaaatacgggggtgcacctgcaccggagaattctcgcccgcagggaggggcgccatgagttccctcggcgcaccacaggttgtctcttgtgcttacaaaggggggcgccatagaaggagtcgtggcgattgcacacatccaaggcgtggcccggctaatggcggtgtatgaaaaaccatatcgagccaacggaggcatagaaccccgaggcccattgcgcgggacattgtgaggcgcaagagaatccaaccactgcccttcgagtgggcggcccatcatgtggaggtgcataacggaactgacgcctggagggacatattcagacagtacccccagacagagggccaatacataacatgaccttggttcaagcgcggtgcagatgaatgaagtgcggttgacaatgactggggaaggcgacatatagggcaaggcgaggggagggaaggcaacatagatattgcgcgccccaggagtgcgcagtcaatgtcacatgtacgaatgacagcacctgttgtatgtattcccccgggggacatagggtgtacactccaccatgtgtccgacgggcgcaagagcaaccggttgaagcgcatcaagaccgcccagaccatgaccccgaaacacaagtggtg

SEQ ID NO: 661808 - DNA, 344 bp, Homo sapiens
cctagaggatccccatcaccctaaattattatggatgatataaaacttaaccacgaaagatgaggccaggtgcagtggctcatgcctgtaatcctagcacttgggaggtcaaggcgcgtggatcacctgaggtcaggagttcaagaccagcctagccaacatggtgaaaccctgtctctactaaaaatacaaagattagccaggcatggtggtgcacgtctgtaatcccagctacttgggaagctgagggagaaaaagcacttgaacccaggagatggaggtttcagggagccgagattgtgccactgcactccagcccaggtaacagagcaagactctgtctt

SEQ ID NO: 661809 - DNA, 432 bp, Homo sapiens
gctcgacttttttttgagacagagtctcgctctgttgcccaggctggagtgcagtggcgggatctcggctcactgcaagctccgcctcctgggttcacgccattctcctgcctcagcctcccaagtagctgggactacaggcgcccgcactacgcccagctaattttttgtatttttagtagagacggggtttcaccgttttagccgggatggtttcgatctgctgacctcgtgatccgcccgcctcggcctcccaaagtgctggtgttttttaattttataatactttctgtacaaaatagaaatgaatttttttcttttttcctttttttttttttttttttgagacagggtctcacccttgcgcaggctggagtgcagtgacaagatctcagctcactgcagcctcaacttccccaggctcaggtgatc

SEQ ID NO: 661810 - DNA, 2261 bp, Homo sapiens
catgtggaccctgagtgcagcaatcagagcacaacgccgacggacacctctgcaaggagacatggcaatacacatccacacgacgtgatccagtgccttaatcctgatgcagggaccagaacgacgctgcgaccgcgccgacgaacggaaccggctacgttgtgctattatcacacgaacagcaacccgattgcacaagcaaaggtaagactcactatacagactctcccaattctgacaatacaagagagagcattgtccgccaaggcagctctactcgacaaccgctagcacacccacgactcagtaaagatcggacccctatcgaccacggtccatgatccacactgctacacccagcgacagcttgaacactgccgcacgatggacccgatgcaattacaacatgacacaacttcacttgttctcacaacacgcaaccaacaccgtacactagccgtctaccagacatacagaacacatcctacatccgccaacacccgcacgaccacaccacccacaagcaaccaactgcagcaaaaccccaacacatagccagcggccaccagcacagaacccaccgcgagcaaaacacgcgacaacacgagggacagacaacacagctcacccacacaacaccaactacacccgcgcagctccacatcaaaacaaatgagacaagagaccacaaccacgctcactaacagcacaacagcccggcggaacacacacaagcacgacgaacagcagaccaccgaatcaaatactgcccgtccacgcagcaatcacacatcaggcaccaacagcaccaacgcgagactcacaccacagcacagcgcaccgcgatacaccataccatttacccacagccagccagtcgtgaaccgatcgacatactcgacacgcacagaaaactgctcatccactacgacgcaccacagcaacagcagacgcaacacacgaccgaccgctcgacgaacacgatacacagcttaggaacatacaaactatgacaacacgagacagacgacatcgagcgactcacatacacatacacacacagatacaacacacataggacacgagaacaagcactgaacatcaccaacgagaccgcgaacgacacgacacagactcggacgagagtatcgagttgcgacagccgaccgagagacagaagtgctagatagcagcacagcgtacgagctacagagcgcagcgcccacagacaactcgaaacgcaaaagccaccagaaccactcaacaccgatacgtacaacgcgagcgcgaagccgagcaaaaggagcgcgtcgagaggagacagaggtcacacagcgagagcccacgcagccctagatcgaacgacagacgagaaacgaaccgagcaagaagtacagcagcgaagcctgacgaacagccagacgcacagtagagagaagctagccacacagccaaagcagaagcacacggcagcatcaaatacactagtaccacaaccacacacaccaagcactccccacaccaacacactcacacctcaacatcacataacagcatgtcacaacacactcaattaacaacaacacacagccaacaaacagcatccaaacatcattacacacactataacaccaccacacactaaatacaaaaaccactcaacaatatacaaactacacacacaatatgattataaaacatacaaacagaacgacacccaacataccccatactacaaacaatcatatatccaacgcagagggaggcgctagaaggacgaagggaagtagaggagaagatagagaagtgaagcagtcacgtgcaaggacaggtgccgagtgagttacaatgaggaacaggcaccgagtagagcaagcgagcgaggaggagacccgaagctggtcgagaagcctgcagtgcgcacagactacagtccgtcggcgagcccaaccccagcgaccagctcagccgcagcagagccgcgagtagcaggcacagacagctgagagcgcgtaccagcacgcctaggcaccgagcacccactgcaggtagcgactaaagtagagagagagagcagacatcacatcgacgtctaatcgtagacaacgacagaggaacatcgaactcgagctcccactaagcagaccagaagcagcgcacagccacccggcgggccaacacgcaagccagccctctgcccagactgcacagcgagcacaactcgacgcaacacaggcccagccagcgagacagcgccacgc

SEQ ID NO: 661811 - DNA, 175 bp, Homo sapiens
acccaaatatttacagcctactgatctttgacaaagcaaacaaaaacataaaaagtggggaaaggacacccttttcaacaaatggtgctgagataactggctagccacgtgtaggataatgaaactggatcctcatctctcactttatacaaaaatcaactcaagaggtcgacgc

SEQ ID NO: 661812 - DNA, 781 bp, Homo sapiens
ggcgctaccgctacctgggacgtagccacagatacccatacagaggcaccccagacacagaaagccatacaccaagtacgggcctaccagcacctggccccccctaccgcccacccctaggggccccgatgcagcgagtacagagcggcagataccggcagtacagataggactaggagcacgcagtcacgcgcacatatagcgcgcgcagccacatactaggtatccgacgcacccaaccgtgtcccgcgtggacttcatagcctaccgctagtgcgactgcccagtaaccatgttgcctacgcccagcagatgcctgccacgcacagctacagctgctactccacaacgcaacacgctgacgccacaaccttgccacagcactcccgctcgcctcgcccccacccagcccacaatgaacatacccgaagacacacacctagccaccgaacaacgcgaccctagaaccccaccaaagaccaccacctcgcacagcgcagcccgacacgcaccgcatccaaccggcaacacaccagaccgcaccacactccaacaacacagcacaacaggacaccaagccatacaacttcccccgatggaccgacccacacattcacaccgtagcacttactaacgactatagaccaatggaaaattaccccaatcgaacatatgcccctaggacaacaccatatgatccccattgccctcctcactttaaagtcttgcgacatttcaaccattctccacacgttcttgccaataagtccctgctacccct

SEQ ID NO: 661813 - DNA, 707 bp, Homo sapiens
  misc_feature (54)..(54): n is a, c, g, or t
  misc_feature (63)..(63): n is a, c, g, or t
  misc_feature (67)..(67): n is a, c, g, or t
  misc_feature (72)..(72): n is a, c, g, or t
  misc_feature (79)..(79): n is a, c, g, or t
  misc_feature (83)..(83): n is a, c, g, or t
  misc_feature (99)..(99): n is a, c, g, or t
  misc_feature (107)..(107): n is a, c, g, or t
  misc_feature (152)..(153): n is a, c, g, or t
  misc_feature (159)..(159): n is a, c, g, or t
  misc_feature (173)..(173): n is a, c, g, or t
  misc_feature (179)..(179): n is a, c, g, or t
  misc_feature (181)..(182): n is a, c, g, or t
  misc_feature (187)..(187): n is a, c, g, or t
  misc_feature (190)..(190): n is a, c, g, or t
  misc_feature (201)..(201): n is a, c, g, or t
  misc_feature (205)..(205): n is a, c, g, or t
  misc_feature (213)..(213): n is a, c, g, or t
  misc_feature (216)..(216): n is a, c, g, or t
  misc_feature (220)..(220): n is a, c, g, or t
  misc_feature (224)..(226): n is a, c, g, or t
  misc_feature (237)..(237): n is a, c, g, or t
  misc_feature (243)..(243): n is a, c, g, or t
  misc_feature (245)..(246): n is a, c, g, or t
  misc_feature (248)..(248): n is a, c, g, or t
  misc_feature (250)..(250): n is a, c, g, or t
  misc_feature (262)..(262): n is a, c, g, or t
  misc_feature (265)..(265): n is a, c, g, or t
  misc_feature (283)..(283): n is a, c, g, or t
  misc_feature (300)..(300): n is a, c, g, or t
  misc_feature (303)..(303): n is a, c, g, or t
  misc_feature (312)..(312): n is a, c, g, or t
  misc_feature (344)..(344): n is a, c, g, or t
  misc_feature (352)..(352): n is a, c, g, or t
  misc_feature (365)..(365): n is a, c, g, or t
  misc_feature (369)..(369): n is a, c, g, or t
  misc_feature (391)..(391): n is a, c, g, or t
  misc_feature (402)..(402): n is a, c, g, or t
  misc_feature (405)..(405): n is a, c, g, or t
  misc_feature (454)..(454): n is a, c, g, or t
  misc_feature (458)..(458): n is a, c, g, or t
  misc_feature (461)..(461): n is a, c, g, or t
  misc_feature (471)..(471): n is a, c, g, or t
  misc_feature (478)..(478): n is a, c, g, or t
  misc_feature (480)..(480): n is a, c, g, or t
  misc_feature (484)..(484): n is a, c, g, or t
  misc_feature (487)..(487): n is a, c, g, or t
  misc_feature (495)..(495): n is a, c, g, or t
  misc_feature (498)..(498): n is a, c, g, or t
  misc_feature (525)..(525): n is a, c, g, or t
  misc_feature (528)..(528): n is a, c, g, or t
  misc_feature (537)..(538): n is a, c, g, or t
  misc_feature (540)..(540): n is a, c, g, or t
  misc_feature (561)..(561): n is a, c, g, or t
  misc_feature (574)..(574): n is a, c, g, or t
  misc_feature (625)..(625): n is a, c, g, or t
  misc_feature (631)..(632): n is a, c, g, or t
  misc_feature (674)..(674): n is a, c, g, or t
aaggacatgatttggagccgtccacatcttatcagacgcctttccactaatccnccccacttncccnatccntgacccnaacngcctggcccgtccggncagaagancagaggccgtaagaccaagctcccacagctgcaaggcgtaaaacnnatctcnccaccaattccccngggtananncaagnctncctttccccanatcngcagacanttnacanaggnnncaacattcccntccagnanncncnatcctgccctcnctnccatgaccaccaataacnccctcatcacgaccaanccncccagaagnccccccacccagtccccccactaccccccccncccatccntcccgcccccgcnactnacagccgacacgatgacgagantcacccgccanccncccacctgccccaatcccccccacccccaccccccccctgccctcccangccnccncccccccccnggccacncnccanccnatcccccnagncgccaaccagactgcacagccaatgcnatnatccaaaanngnatccaatggccgaattaagtnacaaattcgagtncttcttaatttctgcagttcttccatagaaacattaatttcaacaaaattncaaatnngggaagggctaacagcttgtagttcctttagtcccgcccttnctgtgattcgatctggtacactgacatgtttat

SEQ ID NO: 661814 - DNA, 614 bp, Homo sapiens
atggcattaatgcttacttaatgtcctatatgtggtgtgaagtgtagtttcttctaagaagaatgatattacagttacagaagtaatctgtatatgaaatctgagtctgtgtgaaatagaaattcttggattgtatttgaacgtgatttccttggagtaaatgtaatgaaatgtaaagcctaatccagattgttatagaaagttgtatgcagacatctttacttccttaagtgaccaaatgtgatctaactagttcctgtacgtgacttttcaactctaaattgcattcatactcatattaagcggccgggcatggtggttcgcgcctgtaatcccagcactttgggaggccaatggcaggcggatcatgaggtcaggagatccagaccatcctggctaacatggtgaaaccccgtctccactaacaaatacaacaaacaaaagcaatcagccaggcgtggtgggcaggcgcctgtaggcccagctactcgggaggctgcggcaagaggatggcgtgaccccaggaggcagagcttgccgtgagccgagatcggccactgcattcaagcctgtgtgacagagggagactccatctcacacaacaaaaccacaca

SEQ ID NO: 661815 - DNA, 141 bp, Homo sapiens
taactgtcagctttgtggtccactccttatattttcgagaccaactctcagtggcacttagaatgtgtgtctccttgcatggcttttctcagcggatcttatagttagatactgtttcttttggcctttagctcttccaac

SEQ ID NO: 661816 - DNA, 626 bp, Homo sapiens
tcccctttgttgctcagctcccccgtgtttttggaggtcttttttttctactccagtggtttctcatttttttgggggggaaatacctttgagcagaattacagagtgggaaaaaggagttctctcttcaccccttttctgtgttctcaagagtttcttttttatctccctttcctgtgtgtctgtgaacaaaaagcgtgtgtgtggaattcaaccacccaccgaagctctctgtggtgggaaaaaaaaaaacccgtgtctctcccttctggctctctggggtggaaagccgtgggggggtgcttggcgccccgtggtgttagatgggtgctttagaatctctcttacctttctttctcctctctctttttctctgtgtttttgtgggggctctctagaagaatgtctccccccgtggtgtctctttcttgtgtgtgaatattgtgagaacagggtttcagctatttgtcaccacaccgctgtgtgttcttctgtgtctcttacatatctctctttgtgtgtgtaataaaacataatagcagaacaaaaaaaaacattttacacacacaaatgtgcgggggtgtgtctattaaccagaagcgtgtcgccacccacacacagggtgg

SEQ ID NO: 661817 - DNA, 133 bp, Homo sapiens
gaatgagctcgaccgttaccctgtacattgatgtcaggttttgtccaaccctgcgccaagatcactctcgagcctctcgagcgtggttttggccacaccctgggcaacgcgctgcgcctgatcctgttgtcct

SEQ ID NO: 661818 - DNA, 596 bp, Homo sapiens
atcccaacactttgggaggccaaggcaggtggatcacttgaggtcaggagtttgagaccagcctgaccaacatggagaaaccccgtctctaccaaaaatacaaaactagccgggtgtggtggcacatgcctgctatcccagccactcaggaggctgaggcaggagaattgcctgaacccgggagacagaggttgcggtgagccgagatcgtgccattacactccagcctgggcaacaagagcgaaactccatctcaaaacaaacaaacaaacaaacaaagaacatagatcaaataatagaaccttggcagggtgtggtagctcacacctgtaatcccaacactttgggaagccaaggcgagtgggtcacttgaggtcaggagttcaagaccagcctggccaacatggagaaaccacgtctctactaaacaatacaaaaattaggcaggtgtggtggcatgcatctgtggtcccagctactcgggaggctgaggcaggagaaattgccgaacctgggaaggtggcaggttgcagtaagccgatatcaacggccactgtactccaagcctaggcgacacgagaaagactccgcttaaa

SEQ ID NO: 661819 - DNA, 517 bp, Homo sapiens
tcggaccggtcgacagttcctgaggcttgctgaagttgcttaattagcttagaaacaatggggtcttctaaatatacaatgcagtcatctcggagacagagaaaatttagacttgcctgtctctcctgttctgaatacactgtctttctttctcttgcctgactgtcctggccagaacttccagcactatgttgaataggagtggtgagagagggcatccttgccttgtgccagttttccaagggaatgcttccagctatagcccattcagtatgatataggttgtgggtttgtcacaaacagttgcttatttggagatacattccatcaatacctagtttattgagagttgtcagcattaagtgtataatttgatcaaaggtctcttctgcatctattgagataatcatgtggttcttgccattggttctgtttatgtgatggattacgttgactgatttgcgtatgttgaacaaggcttgcatcccagggataaagcccaagttgatagtggtgg

SEQ ID NO: 661820 - DNA, 96 bp, Homo sapiens
ctagaagattcagcaaagtacttttgtgctcttggggaccgtggcctctaccggccttcctcgataggagggattttttcgacagcacaactcttc

SEQ ID NO: 661821 - DNA, 235 bp, Homo sapiens
tgaggatccccggtcatctgtctagaccaaataagagatcaaaggaaagaggaaggagagagctaaggattgatttgtagaaagtccccatgattagaacttggatagaggaagtattttaatagtacttactggaggaataatcaaagtaggggaaagtcacagtaccaaaattatagaagccacagatatgagagcttccagaaggttcaaagcgagcagtttttcaagcatt

SEQ ID NO: 661822 - DNA, 312 bp, Homo sapiens
ccccccttcttttgggaaaaggggttttgggaaacccaaggttttgccctggggggtccccccccgggggggggggggccccccccccaagggttttccccgggggggggggttgggggggggggggcccccccctttccccggtttcccccccccccccccccccccttggggggtggccccttttttcccgggggggcccccccctttgggggggcccggggttttttttccccccccccccccccccccctggggtttttttttttttttggggggggggggggtttttttttgggggtttttttccca

SEQ ID NO: 661823 - DNA, 546 bp, Homo sapiens
atgaatgaatatatgtattcagtgtgtttatatatttcatttcatacatgtgatctatatcatatatatatatatatatatatatatcacaatgaatattgcataaaattaaagcaaatagtaagaagagttaaccaaatgttccctgaatgcagtgggaaaagatgaaaaggagaagacaggcaagcacagtggctcacacatgtaatcccaacatattgagaggccggtgcaagaggatcacttgagcccaggagctcaagaccagcctggacaacatggcaaaaacccatctctacaaaaaagtataaaaattagctgggcattggagcatgtgactgtagtcacagctaggcaggagaatgaagtgggaggatcacctgagcccacgaggctgaggctttagtgagccttgatgggaactctgctctccagcctggatgacagaataagaccctgttttaaaaaagaaatacgctagacgtttgtaccacattttcaggatttaaaattcactgagcagaaattccacaaggtaaatttaat

SEQ ID NO: 661824 - DNA, 572 bp, Homo sapiens
gctttgaaactgcaaaacttgttcggagctcttaattacaatatctgactattttctacagctctgatcttttgacttctacatatagtggaaatctgccaatactacacttgcgctggagatgggaactgtaacacacgatcagggtatgctaattttaagcaaactgtaaagatctcatagaataccatggtataacagtggggtgatttcagtttgtcgcataattcacatataggacgaattttaatctacaaagtattttccttgctatgtattcgtgtgctggctttctctttctgtttgtattgaggccatatgtcactctgtcactcagcgctggagtgcggtggtataatctcagcgtcacgtgcagagtcgtctgacctaccaggttcaaagtcgattcttcgtgcctcagcctctcgagtagctgggactacaggcgtgcacgccagcaccgcccagctaatgtatgttgtattcattacgtagagacatggatttcaccatgttggccaggctggtctcgaactcctgacctcaggtgatccgcctgccttgtgcctccc

SEQ ID NO: 661825 - DNA, 678 bp, Homo sapiens
tggcttgactcaggatttaaaaactggaacggtgaaggtgacatccttcggttggtgcgagcatcccccaaagtttcacaatgtggccgaggatttgattgccatggtgttttttaattatcattccaaattatgagatgcgttgtacaggaagtcccttgccatccataaaaagcgagcccattactctctagaggagaagtggcccagatcctctcccaatttccacacagtggagttgatagcattgcttcgtgtaagattatgttaatgccacatgtgttttacttcttcgccttaaaattttttaattgtggtctagatttcgaagtgattgacccttccgtgcccccccattcaccccttttagtgggccccacaacttgaagatgtatcgaaggctctcgggtcctcccttgggaattggtgtggacggcacgccagggcttaccctgtacacttgacttgacgaccatgtatcaattaaaataggtgccaccccttttaaagaaaaacgacacataacacacaagacaaacaacagtacaccaaaaactagcagaaaacaacacacacaagagggggcacgcgcataaaaaatccaccgaagggacacacacaattagacaccccaaactctagtagagcaaggcggcccataaagacaaataaacacaa

SEQ ID NO: 661826 - DNA, 814 bp, Homo sapiens
agcgggtcgcgagcgctgcgtcgggaggcgctccgaggttcgacgctgtgccccgcgaagcccgccttcggtgctcggctcgtgtggatggatcccgtacccggtgacagactcgtggccgctgggtggtctggcctggctcgttcggcgctctgcacccccggccgcgtgggtgcttcagactggcgactcgtctctgtcacgccgtcgcacgtggtggcagcccgcactatgcctttggctcgatgctttgcgcgcagaacctctggctagctctcctgtgccttgagttcttctggattcagtctagcagaacccgccggacaacgtggtggtcgatatccaggtcgtgtgtggagacaagagacctcctgactgtctgggctgtgcttcgcctcgtaccatgaataccccgaatgtaattccaagatctactggtgctccatggtatgaaacgcatgtgctgtgaaggctgttggcactagtgaatgccacggaccacgcggtgtgctcagatgtccggttgacatgggaaaagaccaagacaggtgcctggataccttcctgtacgtgggaccagtggtgcggctttgccagtcttggtgccagagggccaacggccccgagcgccagtgccccatccccgaggtctcagccgggatcatgcagggctctctctctggatggcaagacagccagacaatgtaagggcggacttcctggagcggatcagtgtcctcgggtgatgctcttcgggtctccacttctgcgtgaaggacattgactccatctgcgaggcctccaagcctctatg

SEQ ID NO: 661827 - DNA, 112 bp, Homo sapiens
ctggtgcatcctcctcattctcctcatccatgtgaccttctctggcattctgggcattggcgtgtacccttccgcttacctgtgcccatgtgcctatgaaggtccaggtatg

SEQ ID NO: 661828 - DNA, 266 bp, Homo sapiens
acagaggctgaatggcgtgaacccgggaggcggggcttgcagtgagccgatatcgcgccactgcactcctgcctgggtgacagaacgagactccgtctcataaaaaaaaataaaaaaaaattctttttttcacaaaaaccctgaaataagttggacaaattttaacctagggggacctcttaaattgggtaacactgcttgggaaaatgtgatttaagcatttatacccttttataaaccttgaacttgtgctttgcccttaaaac

SEQ ID NO: 661829 - DNA, 234 bp, Homo sapiens
aaagggaaaaaaaaatgaaggtcctttccaggagtttcatttcttttcccccattggaccaccccgcagtacttttggcccggctccaaggaccaaaattggtttactctccgacccctaaaaagttccaaacctgtgtcttaaaagaattatttatagttcctataactgaattgcccaatgtccccttaactgataaattaaatttggtaaaataaaaaggccgtttattta

SEQ ID NO: 661830 - DNA, 679 bp, Homo sapiens
  misc_feature (369)..(369): n is a, c, g, or t
  misc_feature (410)..(410): n is a, c, g, or t
ggaagggtagatataaatattgtatatatacacaaatacataaaccagtcaatagcattgaatattcacagtgcccaaattatggtccttgaaataccattttctccatacgcttgtttatattttcaaaaagaaataatgggaggatgaactaaacacgaatgaaaatggttacctataagggaagggaaggaaaaggcagagagatagcaaatagttcctttctgattgtaccttgtttttatagttctgaatttagaaccatataaatatttttttatttttattttttgagacagggtctcactctgtcacccagcctggagtgcagtggcgcgatctcggctcactgcaacctctgcctcctgngttcaagcgattcgtcatgcctcaggctcccgagcagctgntattacaggtgcacgccaccacgcctggctcatttttttcttttctttttttagtaaagacagggtttcacccatgttggcacagcttgtctttgaacccctgacaaatgatcccacccacattggcctcccagagtgctgagattaccggtgtgagccaacacgtccagccgatataaacattttagaaattaatcttaaaacactccccaaccgtcctctcgcaaatgcccctagaccgaacgcctaggtatatatctaggtgtggc

SEQ ID NO: 661831 - DNA, 126 bp, Homo sapiens
  misc_feature (81)..(82): n is a, c, g, or t
gggagttgaaattgtcctacaggagccctggagaattcagcacttctcaaattctatactggcagatgaaggaacccaatnnacctgaggatacctgaaaaaggaccatgggcctctgggtgtgga

SEQ ID NO: 661832 - DNA, 159 bp, Homo sapiens
ccgaccacggctccgtcgcaggccgcacttctcaccccaggttctctctgcccgggtccagtcacacacttgtgtccctcttcatcacattttcaccctgtgttcgtccacaccagtcctcatcccttccagccatgtgcacacactgtgtcgcgcatt

SEQ ID NO: 661833 - DNA, 854 bp, Homo sapiens
  misc_feature (654)..(654): n is a, c, g, or t
  misc_feature (656)..(656): n is a, c, g, or t
agcgggttcagctggctgcggccgagtcatcgcctaccgctggcagggccgttgagcgaggcgactgaggcgccgattggcctgattgtccactgcgcatgaagtgagcatctagttcttcctgggaccccgcacagtttgtcccgcagctgagagaccagagtgtcctggatgtggtccagccgtgtggatagtccgatgggtcttactctggaagaaacccgtgcatggtgtcacttcggaacagcagtatagtgcgcttgaccgaggtatagccttacaatacgcttgaaagtcctccgagcaagcgataatgtttggctcgaagtttcgacagagagaaacgtacttcattcccaagccctaagacgccaggacccgtcgtaagatccagagagttacgtgtcccacggcgtcgtccgtctgattggcctccaagatccatgaggtcttgccctgtgaacctctggggtgcgcactgagctgcatgggacgatccatgaggtgcggattagggctccccttggtcaccgcgtccctgagtcctggtaaccacaagtccttgagcgtgtgaaaagacttgtgcatgtctgttgacgcaatactaaggtgacacttatccactaggcaaattattgacagattatttgcttntnagtgaagaaatctggccatttttccactttagttgccactcttggcgtagtagacgtgtgcactcgcgtgccacgtgtactaactggcgagatactggttttattccgagcgtagataatggggaaatgaaaagctgggccactgtaacaccttttttccattctagatacgctcattcattcctgatttgttgtacc

SEQ ID NO: 661834 - DNA, 250 bp, Homo sapiens
  misc_feature (2)..(2): n is a, c, g, or t
cnggtaagagcggtctcaacacacttggctgtatagcagaaatggacagaacattgtaaatcaactataataaaaaataaaacaacaaatactgctaatgaacctaagaattcatatttgatattttccttgtaaaacttactgtgtatgcatcatttggttagaagtatcttttattactttggtaaactttcattactcaaaggtacataaaaagaaattacaactataggggaaaaaagaaaacacc

SEQ ID NO: 661835 - DNA, 442 bp, Homo sapiens
cgagggcagtgtgacacgacggcccgaggtatcacgatggccagagtgcatctgagggccgggggtagaatgctcgatgcctataatcgcaccagttaagaggctgaggcaagagtatcgctggacactcaggagatcaagaccagcctgaataccaatgcaagatgctatctttatcaaaaatttgaaaatattaggcatggtggtatgtgctcataattccaggtacttgggaggctgacattgctgagaccagctcagtcggggagaccctaacccagtggcgctagagggcataaaagacacacacacagaaatatagaggtatgaaatgggaactcaggggtctcacagccttcagcagctgaaagccctaaagagagatttacccacatatgtattaacagcaaaccagtcattagcattgtttctatagatcttc

SEQ ID NO: 661836 - DNA, 230 bp, Homo sapiens
gtcgacagaagtgctggggaagcaagtcaaggcaaaaggaaaggtatatgcgcaaagggacagacacagaaggggagagcatggctggagttgcagcgtggtgggttagagagtacacagtgtggaggaagagggagaagcctggtgaaggtgagtggacatgttgagaaatgcctaatacccttggcgaaagaaacttgaatctttgttatccatctgtgatagggagc

SEQ ID NO: 661837 - DNA, 897 bp, Homo sapiens
  misc_feature (53)..(53): n is a, c, g, or t
  misc_feature (68)..(68): n is a, c, g, or t
  misc_feature (70)..(70): n is a, c, g, or t
  misc_feature (118)..(118): n is a, c, g, or t
  misc_feature (121)..(121): n is a, c, g, or t
  misc_feature (126)..(126): n is a, c, g, or t
  misc_feature (131)..(131): n is a, c, g, or t
  misc_feature (133)..(133): n is a, c, g, or t
  misc_feature (138)..(138): n is a, c, g, or t
  misc_feature (144)..(144): n is a, c, g, or t
  misc_feature (170)..(170): n is a, c, g, or t
  misc_feature (287)..(287): n is a, c, g, or t
  misc_feature (350)..(350): n is a, c, g, or t
  misc_feature (374)..(374): n is a, c, g, or t
  misc_feature (401)..(401): n is a, c, g, or t
  misc_feature (431)..(431): n is a, c, g, or t
  misc_feature (484)..(484): n is a, c, g, or t
  misc_feature (511)..(511): n is a, c, g, or t
  misc_feature (522)..(522): n is a, c, g, or t
  misc_feature (525)..(525): n is a, c, g, or t
  misc_feature (539)..(539): n is a, c, g, or t
  misc_feature (570)..(570): n is a, c, g, or t
  misc_feature (573)..(573): n is a, c, g, or t
  misc_feature (577)..(577): n is a, c, g, or t
  misc_feature (579)..(579): n is a, c, g, or t
  misc_feature (594)..(594): n is a, c, g, or t
  misc_feature (604)..(604): n is a, c, g, or t
  misc_feature (610)..(610): n is a, c, g, or t
  misc_feature (621)..(621): n is a, c, g, or t
  misc_feature (629)..(629): n is a, c, g, or t
  misc_feature (637)..(638): n is a, c, g, or t
  misc_feature (673)..(673): n is a, c, g, or t
  misc_feature (689)..(689): n is a, c, g, or t
  misc_feature (698)..(698): n is a, c, g, or t
  misc_feature (722)..(722): n is a, c, g, or t
  misc_feature (730)..(733): n is a, c, g, or t
  misc_feature (736)..(737): n is a, c, g, or t
  misc_feature (745)..(745): n is a, c, g, or t
  misc_feature (753)..(753): n is a, c, g, or t
  misc_feature (768)..(768): n is a, c, g, or t
  misc_feature (777)..(778): n is a, c, g, or t
  misc_feature (780)..(782): n is a, c, g, or t
  misc_feature (794)..(794): n is a, c, g, or t
  misc_feature (808)..(808): n is a, c, g, or t
  misc_feature (861)..(861): n is a, c, g, or t
aaatttatttataggcaaggtgcactggaggcacttcccagtggtgcactgcngcgcggggtgtcccnangcagctagatacatgttaactgcatagagtaccataaaggagcccacnggngggcntcacngncaccnggcccngcgggctggggcttccattgtctacngggtctgtccacaccccagattgccttgtggtcctttcccctggccaagaagataacagttttttaaaaatccccttctgatatggatgtgagcgagcggtggggttcagtttgggnccaagcagtgccatttacaaagagcatgggaagcacctccttagggggggggcagggccatcnccacgttgtcaggggccgcgccgntgcctgccaggccctgggcccacttgngcgggcggctgtggggtgggaggccctggntctcacggtacaagtagaagccggtgatggcattccaatgtggccgtggctgngtgccttccaatgggaagttggcaatnagttcctcatnatncttgtggagcgccncaaagccaaagaagcggcgcacattgttggnagngagnanacgagagtgcaactnggacgtgcgntggaanactgtgtactnattggcgnggtaatgnnaacagtaggactactggcggtaactgagtggtgancagtaatgcttgaggnacttggtanaggaacaacaggatggacaacacnacgatgannnnacnnacaaaganctgggacncataactgaaactgnggctgaacnncnnncggaagtctganaggttgtcagggtnctacttgcaggggaactggacaggattacagtggcgtgggctgatgggaagtncactaactggacgtgagttaggtagggtacacgaac

SEQ ID NO: 661838 - DNA, 492 bp, Homo sapiens
  misc_feature (250)..(250): n is a, c, g, or t
  misc_feature (289)..(289): n is a, c, g, or t
  misc_feature (403)..(403): n is a, c, g, or t
  misc_feature (420)..(420): n is a, c, g, or t
  misc_feature (449)..(449): n is a, c, g, or t
  misc_feature (476)..(476): n is a, c, g, or t
atactgctgtggtttgaatgttccctccaacactcatgttgagacttaatccctaatgtggcaatactgaaaggtggggcctttgagatgtgattggatcgtaaggctgtgcttcattcatgggttaatggattaatgggttatcacaggaatgggactggtggctttataagaagaggaaaagagaactgagctagcatgcccagcccacagagagcctccactaagagtgatgctaagtggaaatgtnaggtgcagctgccacagaagggcccccaccaagggaaantgtctagttgtctagtggatccagggccacaggagagagtgccttgtggaagcgctgggagcaggaccttgaccaccaccaggaccccagaactgtggagtcagtgggcagcantgaagcgcccccctttnggaaaagcttttaggcaccagcctgcaancccatttcgagcagccacgtaggctcnaccccagcaaaagcca

SEQ ID NO: 661839 - DNA, 122 bp, Homo sapiens
tatcagcaggatcccctggccaaggttctctcactccagcctcccgcagtcagctggggcattcacaggtgccccacccatcatgcccgggctcaattttttgtggtcatttttcagtcagc

SEQ ID NO: 661840 - DNA, 123 bp, Homo sapiens
gcctagagatccctcgtaacagcgctcgtaacgtcgtacgagcctagagatggcttttgcatgtttcccagctgtcttgaactctggctcatgtgatctcctgttcggctccaaagtgctgga

SEQ ID NO: 661841 - DNA, 167 bp, Homo sapiens
gcttctgctgatagctagaaaaaagttattacataattctgaagatgaacagagacttaagtcagaaattgaagaagaggagctaaaagatgaaaatccacaccattaccagtgtccagttctcacactgcccagagcaatgttgatgatcgtaaaacagagactcg

SEQ ID NO: 661842 - DNA, 120 bp, Homo sapiens
gacgtgaggtcttgttatagtgggagcttctcaagatggactcaaaagttccaaatgtggcttgcaaggactgcaccttctgctcgacgccctgcagggaggctcacaggtgctgggtac

SEQ ID NO: 661843 - DNA, 747 bp, Homo sapiens
gtcaacaccattcttgtgagcgtaactaggcaatggcttgttactggtggaggatcttgaatatgagtgtccaggttcttggcgtttgagcaaagaatggacaaaacatacaaacaaagcagtgaaggaatgaaacaacaaaagcacagatttactgaaacaaaagtaaactccacagaatgggagcagactcaagcaagcgactcaagagcattggttacagaattttctgggtttaaatactctctagaggtttcccattgctatttagtttacaccctatgtgaatgaaggagtggcccacaaccagtctaattcgtctgggaaggctaccaatcagaggctgatgttacaaagttataccgctatgcaaatgaagacgaggtcacaaccaatctgatggtttcaggagaggaccaatcagaggtactttccatttttcatctgcaatgcagaaagggtggaggttacaaagggagtagcctctgatcctttgtgttccttgagcgtggaaagtggggttttccttttgatttagttctagaagtcagcatgaatcagccttaggttccctgcctccagaccctattcttcttcttcacctaagatattctaacctttgtgttaccttccaagaaaacaatgatgtggtactagcaatgggcagcacaggttgttatcttctgtggagtcatgatcaatgaacaagtcctctttattctctaagcaatgctaaaaacactaaga

SEQ ID NO: 661844 - DNA, 499 bp, Homo sapiens
ggattacaatcagtttggtattggtttttccattgcaatgatgccctcccacttttcatatggctatatgtatcataggctggcaatgttagaaatttcttactctccacatggaaatacagtagctacaaatcttacagaacaggtactcaaaaaccagatcctacagtgagttgtaaaagccacagaaatattagcaaatagaattgtgcatcagttaagcttctttatctctattttgacaggagagttgttctgggtttatgggagcctgaaagtctagaaaaagattaaaagccgctgtttacctctgttaatcttcctaatcagcaagtaccaggtaccttatgtaatggaactgagatttctaaggcactgcttctaagtaggaatcacactgcagtgggttagtgacaccctgctcagaaatggtgcctgtgcaaaatgtttcaactagctccaggagagcaaagtcagctagtgttcacaaacaaacaaa

SEQ ID NO: 661845 - DNA, 1145 bp, Homo sapiens
  misc_feature (336)..(336): n is a, c, g, or t
ggagaagtgctgctgccctgggaagaggctcaggacaggcaaaggaggaagggacgagtctacgactctgacacgcctctgctcaccggaacgttcgtctgagcatccgtaagagctcacttcgtccacagagggaagaaacaaacaagacagcaggagactcgtgtgaacccctctcagcccctccctgtactcagcacatcaatgtggaaaggggagctcgtgttcacaagtagtgatgaacttcactcatagctcactcacatcatccaagtcaagacaaggttgaaatcaccccagaggtatggtacattggcaggctagttgaccgctgtnaactcgggttgatgcctcgagagtactcggtatgactaggctaagctaggtgagtttggctgaaggggtggtcatgaaacatttcacgcgtaattcacgtcgacagagcgggtttgcaaagaccttggtccgaagaaaaactcgcaaaggaaggggaccccgtcagtgagtcagtcttgtgaggggtcagagtcagacgtgaaagtaggtataattgtgtcccagtgaaaactccgttgagtgagaagagtggttggaaagagttacttgggcaacacccaccatagtttggaaggatgtgttcgaggcccaggccaaaaggtttgtaaacctcagtgttccagctctacatgggaaagtgcatccgccgtcctcgtagtaggcacatgaaacaggtgaacttggatcgattatgaggcacactttcctaagcggccaattgttttggacgatacccttaggacgaaagtttacggggaataatcttacccaacgccttttaacgattttgggggcctagcggccttaaacaggttagggttccaggataggacacatcccccagtgactacaatgggtaccaggaagggggtattgaaagagacggacaaggcatatgggaaacaccactcggggatactaacataccattatgcctgaggcacccaggtgtgtatacacggggagtaaaaactcgcaaataaccaggggacaccccttattcgagagtgagtgggactaattaacgagggaaacccgtaaatacatgggttgggcttcttcaccggctcggtgtatgacccccagag

SEQ ID NO: 661846 - DNA, 117 bp, Homo sapiens
attatatgcaacgcactgcatgttcgctgttctgtctgtgcggggctggggcaggcggtggcgtggcagcagcgacagccgtggcgcgcttctggcgccggtgggcgcagatcgccg

SEQ ID NO: 661847 - DNA, 237 bp, Homo sapiens
gtcgtgatcaaaagtcgatatgagaagtcaggggaccgtgtgagtcccatgaagcatggagacagtatgcaggcgtagtgaagtgggcaggcagcgtcttgccagaggatgaggatgaaaaggaggaccaggaagaggaagaacaggaggaagaagatgatgatgaagatgatgatgacaccgataattcagatgagcttgacactgcccagttgctggaggcggagttggaggagg

SEQ ID NO: 661848 - DNA, 344 bp, Homo sapiens
  misc_feature (34)..(34): n is a, c, g, or t
  misc_feature (143)..(143): n is a, c, g, or t
atagctctgatagctttaattttccctaagcagntcgtgtctatcagatgtgcacatctggctgtgccaggttgaagtatagtggaacccatcagtagtaatgtgtagtagttatgacttgttgacatttttccattataaanctttacatttgtgacattgggttataatggcaatttaattaactggtggggactttatacttgtcattggcgctgaaaggttgacaggatttcagccaccacttgtgaatttttatttagatttccattatgtatttatcagaattctttgttaatatttggaaaactacacgaaggcatttgggaaaaaaaacacttttc

SEQ ID NO: 661849 - DNA, 443 bp, Homo sapiens
tggctgcccgtactccttcccacggtactgaaacttgatgtccaagtcagtcattggcagacacgctcgatccacagtcctggacagctatataagcgctgtataggtgcctgggcgtacttaccatctccaggggtccagttttgggccacactgcctccgggctggagttcgcccacactgcaattgcccacactggctgtcgctatacaaagaacctaaaacaaaagcatatggtgagcagacaggggtaccacacgtgcacatcacttgctgatgctctgagaactcacaaggtcagtagacaagaaccaaacattgaaccctgacccagtgtgatcttccagcccatccagtgattcccataaactaacgcaataagaaataaggtcccctgctcctgcttcctagtcatattatttctcccaaaaattcatagttta

SEQ ID NO: 661850 - DNA, 695 bp, Homo sapiens
  misc_feature (695)..(695): n is a, c, g, or t
aggtgatggtgaggaagaggatggagatcattaaaaatggctgacccgaaaaaaaaaaaaaaaaaaaaaaaaaaaaaaaaaaaaaaaaaaaaaaaaaaaaaaaaaaaaaaaaaaaagagggggggggggcggggcgcgaaaaaaaagtagttttaaagtggggaggcgggggctataaaaagtcttttctcttagagggggcgcacaattttatggcgcgccgccccttttttgtgtggaaaaagaggggggcccaatatgaggggggaggtgtatatatatatatcaagcaggagggtgggcgggcgctgtttttattaacaaaaagaagagagtgggcgggaacaacggtggagaaaagggaggggagtctttggggaaaaagaggaaacacctcatttatttcgtgtgtgggtgtggaaaaaaacagggggagaaaaattatataatatatatgagtatttatatatacaagagcttataggcagggcaatatatatataaatattcttaaggggggagtaagaaagcgcagagcgaaacaacacaacccggtcacaatatgtctgcggctgtgcagcgtgcggaaaagaaaatgtgtgtggtgcagacgagggtgattttgtaaatatattatagagaatatttatttataaacacaggagggctaccttcataataaaaataaaaaaaan

SEQ ID NO: 661851 - DNA, 815 bp, Homo sapiens
agcgggccggcggcgtctggcaagggccgggagaacggcgagagcagctcctcctggaaaaagcaagctgaagaccgatcaagaagatcttcgagtgcgaagagaccctcgagaaccggggccttttccgacagtggtttgagctgagaagagaaggcgatctggcaaggctctattgctgtgagggtgtatccctaagaaggcgctgaagggcaatggaagaggcaggcatagagcaactgacgatagcccggtcctgacagaaagacttaccgcaatgaagaactagttgttgcgcctggacagacactttagtgacaatgcctcgaaatcgacctagtagctgtgtgtcattgcctgcatggctgtcctgggtggagcagcatgtttgagccggagtacgtgcgagagaggggctttatacgagagagaggattgccagtgatctcttgactccgcctaaagtcttggaaacggccgtgtactgatctccacaagacatgggcatccgtccatcgagacgacctcaatgcccgaaaattcgtcttgtactcacagtcgacagatgaggaggtccaaaactaacttgatcagtgactttggattgtcagaaatggacgggcaaaggagatgtgatgtcctacgtgccttgtgggaagctccaggactatgtcgctcctgaagtcctcgcacagaaaccttacagcaaagaccgttgactggctggtccatcggagtgatttgcctacgatcttggctctgcggcttacctcctttttatgatggagtgactcaagctcctttgagtcagatcc

SEQ ID NO: 661852 - DNA, 656 bp, Homo sapiens
  misc_feature (165)..(165): n is a, c, g, or t
  misc_feature (225)..(225): n is a, c, g, or t
cgtcctccccaaccctccctgggtttcctcttccgaatggcaatgccacaacgggttccatggaggtcagcgccaagcccacaggcttgttggagagcccaagctggataggctgctcctggacttgaagcaccaaaatattggccccttcccgcgttgaattgntgcaggaaatcatgaaacacattgtacccattcttgtgctgcccagggttaacgagaaantacagaaaggcttccctctcccgacgccggccaaagtccagctttacaaagtagtggttcagcccccccaaaacttcctgctgttcggggcaaacgttgtctataaatgaaggccccaggggggccgggggctgtcacccgcccctgttcctgatggggtgtggggccccgggtgcctttccccagggaatcctttccagattttaaccaagagccccctgccaactttttcggcccaggttccaaaaaggatttaaacccgaggaacccttattccttggaaaagggcctgggggggattttagggattatgagcttctttcaaggggtaagggggcaaaaaaatttccccccggaatcgggtttccattggaccccaaaaatttccctttgggcttcatgaaaaaaaacttttggtttttttcatgtga

SEQ ID NO: 661853 - DNA, 231 bp, Homo sapiens
caaagaaacaaaccaaaccaaccagctcttggatggaaagataaaatagcgcttttttgaaatggagaggaaaaacttgggaaggaagaggccggctgtgggggcaacggagccagccatgtaagaatcagagctgctccttcctgtgaatccaagggggccccatgtcttctggcgagcaacagtacaaagcagggagctaattaagagattaaaacttaaaaccaaaaa

SEQ ID NO: 661854 - DNA, 313 bp, Homo sapiens
  misc_feature (6)..(6): n is a, c, g, or t
  misc_feature (8)..(8): n is a, c, g, or t
  misc_feature (26)..(26): n is a, c, g, or t
  misc_feature (33)..(33): n is a, c, g, or t
  misc_feature (38)..(38): n is a, c, g, or t
  misc_feature (63)..(63): n is a, c, g, or t
  misc_feature (98)..(98): n is a, c, g, or t
  misc_feature (139)..(139): n is a, c, g, or t
  misc_feature (142)..(142): n is a, c, g, or t
  misc_feature (144)..(144): n is a, c, g, or t
  misc_feature (148)..(148): n is a, c, g, or t
  misc_feature (157)..(158): n is a, c, g, or t
  misc_feature (172)..(172): n is a, c, g, or t
  misc_feature (217)..(217): n is a, c, g, or t
  misc_feature (259)..(259): n is a, c, g, or t
  misc_feature (261)..(261): n is a, c, g, or t
  misc_feature (285)..(285): n is a, c, g, or t
  misc_feature (295)..(296): n is a, c, g, or t
  misc_feature (299)..(299): n is a, c, g, or t
  misc_feature (304)..(304): n is a, c, g, or t
ttggananaaaaacagcagaattttnataaganaaganaagcaaaaactaataagaagatggntcacataaagaagagaaacacagagaatgcttatnacgcaatcataaattgggaagctaatgtcaccggttcccanctncnaagnagtattttnncaacttcagatgtntcacaacataacattctcacgagtcacagcaaaaccagacaaganaagagaactgagatggaatactatacccatgagaagcaagananaggcactttgaattcaaatgcagnttatgaacanngtnatttnttcaataaa

SEQ ID NO: 661855 - DNA, 175 bp, Homo sapiens
ctgaggttccccctgcagctcgggcttggcccccatgctagctagccctgagcacctgcttagtgtaggggggcatccggctgggacggtcctttgtttcatttccttggactctgaggcctcgagtcaatgggtcctttacgacggtcctcttacgggatgtgttgcagccagg

SEQ ID NO: 661856 - DNA, 406 bp, Homo sapiens
ttaaagtggttcccactggctaaatttaagaccatttgtgcctccaaaataaataatgacaaggccgggcatggtggctcaatgcttgtaatcccagcactttgggaggccaaggggggcagatcacttgaggtcaggagttcaagaccagcctggccaatatggtgaatcccatctctactaaaactacaaaaattatccaggtccatcctggctaacacggtgaaaccccatctctactaaaaatacaaaaaaaattagccaggtgtggtggcaggcactatagtcccagctactcgggaggctgaggcaggagaatggcgtgaacctgggagccagagcttgcagtgagccgagatagcgccagtgcactccagcctgggcgacagagcgagcctctgtctca

SEQ ID NO: 661857 - DNA, 1298 bp, Homo sapiens
catagtgaccctatttctaatcgcaatggcattcctaattgcttaccgtatactgaatatatattctaggctatatacaatctactgctatatagtgccccaacgattgtactgctccctacggtctactacaaaccattacgctgacgccataaaactcttacaccaaagagcccctaaaacccgccacatctaccatcaccctctacatcaccgacccacagaccattagctctcaccatcgctcttactactatagaaccccgccatccaccaataccccaaacacccacctgagatacaaacctcaacactaaagaacatagacctaagtacaactaaccgaggccacacactcacatagccgcctgagaccgatcacaacatccaacagacgcgagactgcggagtaccgaggcatcgagaccatccgaagcagctcacacagaaaagcgagaccacaagcagaccggcacgcacacgagcagacagcacgccaacccccccccaccacaactcaaccactaatgacccatacaccccataccaacacacacatcaaaacgtaattccataacttaacctcaatactctcggctcacctataaaaacatacaacaaacccacacacaaacaacacaccaacacaacaccacaaatcacgaagacgaaccgcccgcgcgcgcaagcacatgagcaccctccgacgcccccccgccccccacaaacacacatcatcacaacagcccacgccagacacaaacaacaccggaacacgacgcacacaccaacccacagaccaaaaaaaggaacgcacaccgccaccaaagccaccacagcgacgaggacagagaaaagaaaataagaccggccaggcaacaatggagccccagccacacaccgctcaaaccgcagacaacagacacacgcacccactccacatacacccgcaccgacagccgcacgcagcgacacaccaacacacacaagacacaccccgtaacccacgccaccacctaccgcgaccacaccccccgaccccaccgcgcacccaaacacacacaaaccacaaccaacacagaataatagagaccagagcaccgccaacagcccagcagcgacagagcacaccaccaccagcagaaccaacacaccaacctagcaccacccaagaaagaagaagagaagaccacaacaacacaaaacccacccaacctaaaaagaaccagaggggacgcgaacaaccgccggagcaagaccacaacaagaacgcgcccaccccacaccagagaacaccc

SEQ ID NO: 661858 - DNA, 482 bp, Homo sapiens
tactgtggtccatgattcctgacctatgatttatgggagtgtgtgtgtgtgtgtgtgtgcgtatgtgtgtgagtgacgatctaaataagttcatgtattgtctagaggcacttgatctttctactcaatctctacttactttggagcccgatactgcttcatcacagttccttacatacgcagaaacttattcaatgtttgctgagctgtgtacgtaggcagaataatggttccccaaagatgtccacattctaatcccaggaccctgtgaccatatcacatggcaaagcggcgttcaggccagcgttggcacttaagatcacccaactcagccaagtttaagcatcagccagcagcatcatggattcatccaggttccttaaaagttggcgcctgtgcaggccagccagcaggtcagcagtgatctgctgtgggaagcacctcaacctgctattgaaggcggaggacgggagcacaagcag

SEQ ID NO: 661859 - DNA, 400 bp, Homo sapiens
aaaatctccatcgcgacccatttaaaaataatttttcatccaggcacagtggctcatgcctgtaattccagaactttgggaggcagcagcatgagaatcatttgaggtaaggagctcgagaccagcctggcctagatggcgaaacccagtctctattaacaatacaaaattggccgggcgtggtcgctcatgcctgtcatcccagcactttgggaggccaaggcgggcagatcacctgaggtcaggagttctagaccagcctgaccaacatggtgaaaccccatctctactaaaaacaaaaaattagctggttgtgctggcatgcacctatagtcccagctacttgggaggctgaggcaggagaaccgcttgaacccagaggcacagcttccagtgagca

SEQ ID NO: 661860 - DNA, 363 bp, Homo sapiens
cctgcccatattcgcactcacatgtatggtggcaagtgtaatgtgtaggtttctttagtcacatcaaaatttgaattaaaattcatatgttacccacaaaaaagttacatagccgggtgtgctcttttacctgctataaggaatctgtagagtttagggggtcgaagcttcgtctctccgaaaaaacaagtctctagaagattcattatacgaagaatataagggttagctctctatatattccgtaggctataatatttattcgtacgctttcggcattatatagagtgggacagggtaccatataggtctgtatataccccatgcgagcaagtggtatgcaagacgatgtttgggagtgcg

SEQ ID NO: 661861 - DNA, 1259 bp, Homo sapiens
  misc_feature (204)..(204): n is a, c, g, or t
agcggagtcgagtgcacgcgaatcgagccggcctgggcgccgactgcagagtccgtgaagagcgctggtgagtctttgccgaggtgttcctgagtttcgcatcgcatccgttcgttgcatgctggttctgctgcttcgtgggcccctacgcgcggtatccgacagcaatgccgcccagaggatgtagtgaaagttgactagtangtccggagatctccattgcactctaggacggagtggccatgtcccaagtttcgcttactagtctcagtgaagcattgcatcgtacttcccccgtgtgcaccgcggatttcttactaggaaggacggcgggcatgcttgaaggacttcgaagactgggcgtgtggacctgtgacagcgctatcctatgacagtatgatgacccattggaaacatttcaattgagcctcttgggcaaggggacatgtactcaagttcgacatggaaggaacgcattgatgtagcgcaattatcttatcctctcagggcttggctccattgatcctcgtggacacgcggcgttatcccttggacgagccactggggctccctacgagtcatgtggcatgatggtggggaaaactggcgcggaggagcatgtacccattgcttggtgtttgacctatgagataacagacgatcctgattattctttctttcacaggcttctcttgccgaacacgcccatgggatttaacctttgggggcagagctggttagcgacgacatgttgggcatggcgcgtgcacgtcccgtttcattgcacacggaaacggattggacatgcgcttccattcccaattcgtgaatcgcaagacaatggggaccggggcccaaggtttgttaaaatcaacgttgccatcgcgttctgggacgcaactcgggccctttttttggggccccggcgtacacttctctgggtcccattggttgacattttgccttgggagtccaaaccgtggcgggtcgttttccctttggccttaggaacaagcaggcgtctattccagtccccaaacgcattgctgggcgagcggcaaatgggcatcgggtacggggtccccaacggttgtttgacccaaggttgggcattgcggggacagccacgaattgtgcgacactcattttccgtgggaaaaacttgtcgtggggcgcccttggagcaggggcggcctctttgaactcacgtacacaggaaagtcgtccttttgggaaaccaaggcaggccacacatacgg

SEQ ID NO: 661862 - DNA, 181 bp, Homo sapiens
ccggtacccagagttggcgtgcccagggtagagtacagttgctatcggggctcacggaaggctgcgccttccggttccaagtgattctcctgcctcagcctcccaagcagctgggactacaggagtgcaccaccacgtctggctaattcctttttcctttttttttttttttttttttttt

SEQ ID NO: 661863 - DNA, 732 bp, Homo sapiens
  misc_feature (166)..(166): n is a, c, g, or t
  misc_feature (360)..(361): n is a, c, g, or t
  misc_feature (382)..(382): n is a, c, g, or t
  misc_feature (425)..(426): n is a, c, g, or t
  misc_feature (442)..(442): n is a, c, g, or t
  misc_feature (473)..(473): n is a, c, g, or t
  misc_feature (490)..(490): n is a, c, g, or t
  misc_feature (498)..(499): n is a, c, g, or t
  misc_feature (522)..(522): n is a, c, g, or t
  misc_feature (527)..(528): n is a, c, g, or t
  misc_feature (535)..(535): n is a, c, g, or t
  misc_feature (537)..(537): n is a, c, g, or t
  misc_feature (539)..(539): n is a, c, g, or t
  misc_feature (546)..(546): n is a, c, g, or t
  misc_feature (574)..(574): n is a, c, g, or t
  misc_feature (582)..(582): n is a, c, g, or t
  misc_feature (587)..(587): n is a, c, g, or t
  misc_feature (594)..(594): n is a, c, g, or t
  misc_feature (600)..(600): n is a, c, g, or t
  misc_feature (604)..(604): n is a, c, g, or t
  misc_feature (619)..(619): n is a, c, g, or t
  misc_feature (624)..(624): n is a, c, g, or t
  misc_feature (643)..(643): n is a, c, g, or t
  misc_feature (646)..(646): n is a, c, g, or t
  misc_feature (672)..(672): n is a, c, g, or t
  misc_feature (691)..(691): n is a, c, g, or t
  misc_feature (700)..(701): n is a, c, g, or t
  misc_feature (705)..(705): n is a, c, g, or t
  misc_feature (710)..(710): n is a, c, g, or t
  misc_feature (713)..(714): n is a, c, g, or t
  misc_feature (717)..(717): n is a, c, g, or t
  misc_feature (722)..(725): n is a, c, g, or t
tcaaagtataatctttttatagccaactgctaatgcaaattaaaacatatttcattttaacatgatttcaaaatcagtttttcatactaccctttgctggaagaaactaaaaatatagcaaatgcagaaccacaaacaattcgaatggggtagaaacattgtaaantcatttgaagtatattcttattggaaatgtacttttggataagtagggctaagccagttggatctctggttgtctagtcattgtcataagtaaacctagtaaaaccttgttctatttttcaatcatcaaaaagtaattataaatacgtattacaaacaagtggatgtttttaatgaccaattgagtaagaacanncctgtcttaactggcctaaanttcttctggtagtgtcagttcaactttcagaagtgccacttanngaaagttgatttttgnttttgtaatgcactgttttaatccctctctnttttttttttttttggnttaaaagnncaatactaaactttatttgtaancattnnaactatnancntttttgncttattgaaaaaaaaatgtgagaagcgntttaaacncgttngtaaagnctatgnttgnattggaatatttganaatgnccgatgtgaagtacatgcntanttattgggggcctgaaccaatgggtnttacttttctgactaaaanaagggttannttgntgggncanngtncctcnnnntttcctt

SEQ ID NO: 661864 - DNA, 426 bp, Homo sapiens
atacatatacgaatcgagctcgttaccggaggagcatccctagctctgaagtacagcgtgagcatgcctgtccctgtagtacatatggggagcctccctacctctataatccatagaagtaccatctccagccctattgtccataggtggtccattcgtctataccgaatatccccagaatgtatgtccctagccctgtaagtccgacggtgatgaatctctgctctggaaatcagaagacgaataatctccccccctgaaatcagtgtccaggtcccttcccctcctcgatagtcaccatgcggtccgtctctagctccagtgagctgaaagaatgctcctctacatttgcaaaaggaggccccgaatgcccctggaaatcgaagggaagtgaatctctgccaggaaagttgccagagtgtctct

SEQ ID NO: 661865 - DNA, 394 bp, Homo sapiens
gcttcaagagcgaaactctgtctaaaaatttacaaacacgaaaagcgaatattccttctacccccctccctcttctccttctaggattcaattcacgtttgtcagactttctcaggcatggagtatatttcctacagtttcttcagattttgttcagccttcccccctcacgcttcattcagagaggtttcttactgttctctcgtgggctcatttttctcttcagcagtatctaatctgctgaatccactgaattctccattttggctactgttttttttagatctagtatattacttgtttttcaggtctgctttgcccccttatattatgtttccagttccttgttgaaatgtatttattctacttttatctccatcaacatgatagacat

SEQ ID NO: 661866 - DNA, 329 bp, Homo sapiens
tgtggtgctctcagaggatccgagaggtgggacacgggcacttggggaaccaccgtcgagggaggccagtacaacaacttctcaggcaacagcctgcctgagtaccccactgtgcccagctacccgggcagtggccagtgtgcttagagggagcctgccctgcccgcaccgcccaccacctcctccccttcattcctgctgctacccctgtgtcccgagggctgggagtacctggggccccatccccccagctgtgatggtggaagccggtggtggccacggactgcccccctcctgccagggccacagaacccgtggtcccacctctc

SEQ ID NO: 661867 - DNA, 210 bp, Homo sapiens
tacttttccagggggaagaaatcggctggttgtctccactctcttcattacccacctgcatgctagaggatgtacatagtccatgaggatcacttatggtaggcatttcactttcattgcgcgaggcgagcggggcagttctttcaggcctagcttgaagtattaggcagtatcgtggcactctagctctagctcccgtaccctccctta

SEQ ID NO: 661868 - DNA, 356 bp, Homo sapiens
  misc_feature (354)..(354): n is a, c, g, or t
ggggatgcagtatttattcacttcctgaacagtccctagataggtggttctgatagcctgttggggcttaaatgacctgaaaccttatttgtatgtgagtcattattgtgatgaaattgtgtacttcagcaagagttttacctgtaattaatttctctcatgcctgaaagttaggaaagttgggaaggcagttgccccaatgtaacaaatgctttgtgatcttggggtgagcctgttccccatcccattgcaggggaaagctttttagtcctcctcattctctgtatttcccagcgtctgggcatgtaaaaacgttggggactgaatcttccgagggcatcatttctcctgcanaa

SEQ ID NO: 661869 - DNA, 1482 bp, Homo sapiens
  misc_feature (291)..(291): n is a, c, g, or t
  misc_feature (309)..(309): n is a, c, g, or t
  misc_feature (401)..(401): n is a, c, g, or t
  misc_feature (621)..(621): n is a, c, g, or t
  misc_feature (1094)..(1094): n is a, c, g, or t
  misc_feature (1106)..(1106): n is a, c, g, or t
  misc_feature (1481)..(1481): n is a, c, g, or t
cttgtaggacagatcttctagcaatgaatacttgaggctgaagtccaagacaccacactcaaatatttcttgtaggacagatcttctagcaatgaattctctttgtttttgtttatctgagaatgttgtaatttttccttctcttctgaagaataattgtgctggatatggctgacttggttggccctctttttctttcagtcctctatagatgtcattccactgcctctggcatctgtggtttccatggcgggagcaccgcaccatgtctcagtctctttttagcttctnactgtttgactgtggtgngtctaattgtggatctttcagtgtgtcctacctgcagttctttgagcttcttggatatagaggttaatatttcttgtagtctgattgttacntcttctcttcacttattgatcttctgcctagttatattgatattgaatgtgggtattgaatccttcggttttgtcagcttcatgttcagccagtgactggacaggggacccctttaagtgctttgcaccagtaactctcatggttctgctgacacacagttgatgtgtggtgagtatgccttcagcgctccattgtggttctgcaaatttgggaaatttnaggttgtcgtttctcgaaatattttatgtccatgttctcttcccccacttggactccagctacgtgtgttgatgtggagctgggcacagccttggaggcctccttgactttcctttattccggaattttttcttcttctcagaatgggtcatctcagttgacctatcttcaaggtcacagatgcttttgccaaacaaaacctgatgtcaagctgctctagtgaatttttcatttcagttattgtacttttctactccaaacttccatttggctctctcctataatttctgtatctttactcatattctttgtttagtgaaacattctcatactttaattctgtagacacagtttcctttagttatttgaacatatgtgtagaagctgatttaaagtacttgtctaagccgggcgtggtggtgtgcacctgtaatcccagctacttgggaggcagaggcaggagaattgcttgnacccgggaggcngaggttgcagtgagccaggatcgagccattgtactccagcctgggccacagagcgagacgctttcaaaactagatagatagatagattagatagatagatagatagatagatagatagatagatagatagataggataagataagatagataggtgacttgtctactaagttcaacatcagggcttattcaggggaagttcctattgatgaccttttttcccatgtcagagccaaggaaataacatactctttctttgtggtctcatatatatgtattttttgaagactggacactttaataatgtggctgtgcaactctggaaatcagataccctctccacgagtttgattgttgttctgttggctggttaccnt

SEQ ID NO: 661870 - DNA, 981 bp, Homo sapiens
  misc_feature (127)..(127): n is a, c, g, or t
  misc_feature (145)..(145): n is a, c, g, or t
  misc_feature (152)..(153): n is a, c, g, or t
  misc_feature (180)..(180): n is a, c, g, or t
  misc_feature (188)..(188): n is a, c, g, or t
  misc_feature (195)..(196): n is a, c, g, or t
  misc_feature (198)..(198): n is a, c, g, or t
  misc_feature (216)..(216): n is a, c, g, or t
  misc_feature (222)..(222): n is a, c, g, or t
  misc_feature (228)..(228): n is a, c, g, or t
  misc_feature (240)..(240): n is a, c, g, or t
  misc_feature (243)..(243): n is a, c, g, or t
  misc_feature (252)..(252): n is a, c, g, or t
  misc_feature (271)..(271): n is a, c, g, or t
  misc_feature (273)..(273): n is a, c, g, or t
  misc_feature (277)..(277): n is a, c, g, or t
  misc_feature (279)..(279): n is a, c, g, or t
  misc_feature (292)..(292): n is a, c, g, or t
  misc_feature (294)..(294): n is a, c, g, or t
  misc_feature (304)..(304): n is a, c, g, or t
  misc_feature (319)..(319): n is a, c, g, or t
  misc_feature (327)..(327): n is a, c, g, or t
  misc_feature (330)..(330): n is a, c, g, or t
  misc_feature (336)..(336): n is a, c, g, or t
  misc_feature (338)..(339): n is a, c, g, or t
  misc_feature (348)..(349): n is a, c, g, or t
  misc_feature (378)..(379): n is a, c, g, or t
  misc_feature (383)..(383): n is a, c, g, or t
  misc_feature (388)..(388): n is a, c, g, or t
  misc_feature (393)..(393): n is a, c, g, or t
  misc_feature (403)..(403): n is a, c, g, or t
  misc_feature (411)..(411): n is a, c, g, or t
  misc_feature (426)..(426): n is a, c, g, or t
  misc_feature (429)..(429): n is a, c, g, or t
  misc_feature (443)..(443): n is a, c, g, or t
  misc_feature (447)..(447): n is a, c, g, or t
  misc_feature (449)..(449): n is a, c, g, or t
  misc_feature (468)..(468): n is a, c, g, or t
  misc_feature (474)..(474): n is a, c, g, or t
  misc_feature (483)..(483): n is a, c, g, or t
  misc_feature (491)..(491): n is a, c, g, or t
  misc_feature (500)..(500): n is a, c, g, or t
  misc_feature (504)..(504): n is a, c, g, or t
  misc_feature (509)..(509): n is a, c, g, or t
  misc_feature (513)..(513): n is a, c, g, or t
  misc_feature (524)..(524): n is a, c, g, or t
  misc_feature (527)..(527): n is a, c, g, or t
  misc_feature (537)..(537): n is a, c, g, or t
  misc_feature (539)..(539): n is a, c, g, or t
  misc_feature (542)..(542): n is a, c, g, or t
  misc_feature (555)..(555): n is a, c, g, or t
  misc_feature (560)..(560): n is a, c, g, or t
  misc_feature (563)..(563): n is a, c, g, or t
  misc_feature (571)..(571): n is a, c, g, or t
  misc_feature (578)..(578): n is a, c, g, or t
  misc_feature (582)..(582): n is a, c, g, or t
caacacaagctcagcaggaccagtgggaggacggatccaggtgtggcacgcggaacagcgagggatgctcaaggacagtgctatgctagaatacctgaagattgcccaggacctggaaatgtatggnatcaactatttcgagatnaaaaacnngaaaggaacagaccttggcttggagtngatgcccntggactnnanatttatgagaaagatganaagttnaccccnaagattggcttnccntggagtganatcaggaacatctctttcnangacnanaagtttgtcattnancccatcgacnagaaggcacctgacnttgtgttntangccccncnnctgagaatnnacaagcggatcctgcagctctgcatgggnnaccntgagntgtanatgcgccgcnggaagccngacaccatcgaggtncancagatgaaggcccnggcncnggaggagaagcaccagaancagctngagcgcagntggaaacngagaagaanaggngaganaccntggagagaganaangagcagatgntncgngagaaggaggagntgatnctncggctgcnggactangagnagaagaccaagagggcggagaaagagctctccgagcagatgagaaggccctccaactggaggaaagagaggaggcgagcccaggagggaggctgaagtctgggaggcgacgatggtccgcctgcgggcaagggagaactcgagagacggcgcggatcgattaagagcaggaagaggtgggtgcgaagctggagaagacacgggcagaatgacatggtggggaagggggagccccaagacaaggtccaaggtggacaccggggaagagccggaactgggagcagaagatgactgggttgagccagccccgccacttattcgaacacgccggaagcgaaaaggatataaaaacaagtgaataacgaacaaagaaacgaaaaacgaaaaaacacaaggaatc

SEQ ID NO: 661871 - DNA, 295 bp, Homo sapiens
tcagggtgttagaacttcttccatgtatgtagttagtctaacctctcatttgtaggtctctaagaacttgttttcctaatctagatgctccaatgttgggtgcatgtatctttaggatagttaagtcttctggatgaattgaaccctttatcattatgtaatgcccttctttgtcctttttgaccattgttatagtctgttgtatctaatataagactagcaacctttgttcttttttgttttccatttgcttgataaatcttgctccttacctttactttgcacctagtatgtt

SEQ ID NO: 661872 - DNA, 634 bp, Homo sapiens
gggacgtattttctttctgcttttaaaaattattcaggccgggtgcggtggctcatgcctgtaatcccagccctttgggaggccaacgtggacagatcacctgaggtcaggagttcgggacaagcctggccaacatggtgaaaccctgtctctactaaaaacgcaaaaattggccaggtgtggtggcaggcgcctgtaatcccaattagtgggttggctgaggcaggagaatcacttgaacccaggaggtggtggttgcagtgagctgagatcgtgccactgcaccccagcctgggtgacagagtgagactccatcccaaaaaaaaaaaaaaaaaaaaaaaaaaaaaattttgtggggggccgcgggcccccgaaaaagttttttcaaaccattcgcgtgggggggcgcgaggggccccagagggtaggtggaacatctgtgcgcaataagcggttcgcccagaaagaaacccgcggcgaccagagaaacaggtcggtcggggttccctccccaaataaaaaaaacgcgcggggggcacacccgatgtgttctggaacacaatcaccgaggggagctcgcgaggacgatgccggcgctctccaaaggggtccaagggaccgaaaaaaataccga

SEQ ID NO: 661873 - DNA, 121 bp, Homo sapiens
  misc_feature (92)..(92): n is a, c, g, or t
  misc_feature (97)..(97): n is a, c, g, or t
gaggcccgagcccaccgcgccgggccccggacgccgcgcggaaaagatgaatttacaaccaattttccggattgggttgatcaggggtgttngctgngtgttggctcaaacagatgattat

SEQ ID NO: 661874 - DNA, 231 bp, Homo sapiens
tcaaaatggggggttttggggggggggcctagtccccccagttttaaacagccaggagggacctgcatttaagcatttggggtgccatgggaatgggatgccccccaggtattgtatgcccccgacccccgcagaggcagaatgaacccataggggggtggtgggaatgtttatcatggtacttccccccccccacattttttgaaataaaataagggattttattttcca

SEQ ID NO: 661875 - DNA, 188 bp, Homo sapiens
ctatagatagcttgtactgcctctagctagttgtcctgctactgtcagcatgtcactgcctacagcctatatgtactgcctctgatactagctatgtatataactatatactatggtcatatcatccactctgtccatcagcaacagtagatactatcccccaatgattgctgctggcaaggctgagc

SEQ ID NO: 661876 - DNA, 199 bp, Homo sapiens
tccaagataggtgtctggcagctcattctcacaaacatctacctgactcctcgggcacctacctgctgtgtggcccacaaccagatgggcagtgcatcctgtgagctgaccctctctgtgactgaaccctcccaaggcctgcagtggcctggcagctctcgcattgggtgtgctccgtgtggtgcatcctctcagcagt

SEQ ID NO: 661877 - DNA, 248 bp, Homo sapiens
agcgagcgacatctagaggatcccgaaaccctaataacgggaccaggtgttttgggtgtagttttgaagttccccaactcatataagtaacttcattatccagtagattacagaagttgcccataaatgcagcctcaaataatgattcaacatcattgctctatacgtgatgccatgattaggcatgatttttgtcactgaaaatctaaactatacaatgtaggtattttgcgtgtatggttctactg

SEQ ID NO: 661878 - DNA, 331 bp, Homo sapiens
  misc_feature (48)..(48): n is a, c, g, or t
  misc_feature (131)..(131): n is a, c, g, or t
ctgaagttggcatcacaaatgttgatatttccaccgtggataaggatnagagcattgcacccaaaattacccgggtgacatacccagccaaagcgaagggcacattcatcgcagacagccaccagaacttngccttgttcttctagctggtagatgtgaccactggtgctgaactcactcctcatcagacatttgtccgcttccataaccagaagactggcccggaagtggtgtttgttgctgcgccagccaacacgcccgtgtacacgtttccactcgctacctttgcacgaccgcttgcatttgcctctgcctttcgcacctacactca

SEQ ID NO: 661879 - DNA, 926 bp, Homo sapiens
cccaactcagcctcccaaagtgctaggattacagacatgagccaccgtgcccagcctgtagtatagtttgaaattgggtaatgtgatgcctctgactttgttctttttgcttagaattgctttggcacttcaggctcctttttggttccatgtgaattttagaatagttttttctgaatctgtgaagaatgatgttgggaatttgataggaatagcattgaatctgtagattgctttagacagtatggacgttttaacaatattgattattccatgagcatgggatgtttttccatttgtgtcatatatgatttctttcagcagtgttttttagttcttctagagatctttcacctctttacatatattcttaggtatttatttcactgtggctgttgtgactacgcgacttgcattcttgaattggtgctcagcttgaacacttattggtttactagaaatgctactgattcccgtaaattgactattgtatctttaccaaaaatacattttctttatatactatgtctatagaattgtccctcttatatctagtaatttctactaacatatcaactattttaactttagtaaccctaattcacagtgaaaaccctaagattccttaatataccatgacttcaccgatctcaccattacttgaagcgcaatctgtgacacttacctccccacaccgaggcatccctcaacttgtgtgccctacacggccttttgaatccgaacaatccatggtctcacctctagatatcaacttcccgtgaatatatccgacacatacactgatcatttgagcgcacttggatttctgcatacatcacccgtactcttccgggaacatgaatacaatcactctccgccttgaccaacttcttctccacttagtacctgttccctcatcccgcaat

SEQ ID NO: 661880 - DNA, 388 bp, Homo sapiens
atagacacgtaccatacgatccccttctatgatgagcatctcggggggagtaatacgtgcacagctattgatgaacactgttaccagacttctcgacattcttgcagtggcacgatcatgactcacggtagtctccaactcctgggctcaagcaatcctccggcctcagcctcccaagtagctggtattagggggtatgcacaaccagtgcccagctaattttttaattctattttaagtagagataggagtctcactatgttgcctatactggtctctaacttgtgggctcaagcactcatcccacctgggcctcccaaagcattggaattataggcgtgagtccccgtacccggcctcaacatttgattaggatacagtagggaga

SEQ ID NO: 661881 - DNA, 196 bp, Homo sapiens
cgctctctgctggaccctcttctcccatccctagctggctatgggtgggatactagggccatgtgcaaactgggcttcttcatgccaaatcagcctactccgcgatggagaaagacgtttggagttggtttcaagctgcggagaccaccagccaagcagcagtgcccacggagccagaggcactccagacccccag

SEQ ID NO: 661882 - DNA, 135 bp, Homo sapiens
gatccacgtcagatcacatgtaccagaagatgattgtcttcttgtcaggattcttcaccttcatagaccttgatttgtcacagttggttgattatcagaagctgtagaacagatctgagacttctatggtaggca

SEQ ID NO: 661883 - DNA, 362 bp, Homo sapiens
ggccaaggcactaatgatgcgggcgtgaacgcggtggtccagggggacgtcctcagaatactagtcgtgctcgcgttcacccacaattctcagtatagcatccgctggcaggttcgtgtgttcgttgtcgtagcccggtgatggtaattcggtccgggggctggtatcgccatcgtcacttcatcaggcaaacgtggaggtacgacgttcatgctcgcgaaccgggatcggggtacattacatgccccactttctcccggataatcttggagatggtatttggggtctacagtgacactcagcttacaactccttaaagcccggtcctccggctcggcctgtagctccttcacacgctccag

SEQ ID NO: 661884 - DNA, 278 bp, Homo sapiens
agagtcgggcagagagtgatctatggagtagtatgtctagatctgacccgctgtgcagtatatcgtcttacagagcgtcgtttaacatgtctgtgactgagtaatctcgtagtgtcaatgaagaagttgccatttctttctttttttttgagacagggccttgctcagtcgcccatgctggagtacaatcaccacttactgcagctttgaccttccgggctcaagcaatcttcccatctcagtctcctgagtagcttggctacggacacgcgccacca

SEQ ID NO: 661885 - DNA, 120 bp, Homo sapiens
gactcggtaccggactgagattctgaggaactgtggtaaatcgagagtggtttcaggacggcagtgggatctgcgggctacagctgccgaggtaggtctggtgcaggcacttgatgtgac

SEQ ID NO: 661886 - DNA, 123 bp, Homo sapiens
agtattggtggacgatgtacctcatttacacttatgggctatgcatttcattccttattgatttgctttacttaatttaacatatcaattattcattttaataggatatagagcaaaataatc

SEQ ID NO: 661887 - DNA, 407 bp, Homo sapiens
  misc_feature (21)..(21): n is a, c, g, or t
  misc_feature (174)..(174): n is a, c, g, or t
cgtgggggggcatcggggctncggggtggggacccaaggctttttggggcagacccttgtcctttgggatgatgggccctgctatccccagtttctgccagttggttttatttggagggttgtgggcttttttttaaaaaaaaaagtcctcaaatcaggaagaaacctccaagnctatgtcctagtggagggggtaatcctaacccccagggtggccgccaggtgggacctgcctttatcccagaatgcccttgtcccagctttttgtccaactgttgattatgtgatttttttgaaaggtccattttcaaaagccagggggtttacattttcgctttggccagcccattttgtatttaaagcttttggggcccaataaaataggaggggctgtttgcagcccttta

SEQ ID NO: 661888 - DNA, 211 bp, Homo sapiens
tgggcggttgagaaaaagacaagatactcagatttaaaagcataaatgttcactcttcaacatagttagctaaatttggggaggtcaagtttcccaaattcaggacaaaaaatccttcagtaggtcatccctgggtgtggcttgtggtggtgaatttgaataggccccaaagaagaaggctctagaaactgttcttggccaggcacagtgg

SEQ ID NO: 661889 - DNA, 119 bp, Homo sapiens
atggatggtgctataaaacgatatggtgaaataaccgaatcacttcaagaacgtaacggatctagaattgctgacaatattcgaattctggatatccaggattacttaactgattgtac

SEQ ID NO: 661890 - DNA, 359 bp, Homo sapiens
cagagtaaatctaggatctcccttgtctgccaacttatattttgttttatacacataaaatataaaatttggccaagtttttcccattgaaagaaatatccctttgaccttgaaatctctctagctcctatcttttctacttgcttttagagcaaaacgtctagaaagaaccacctacttttacgtcttaatttcccatggaactgaatgtattttggtttctttctcctaccactttcctgaaaatgatgttgatgaaacccccattaggttgttgtcaaacgtgattttttaaagtgttttcttcttaagttagtcttacttgacttttccacatgattgggttacttttgattatg

SEQ ID NO: 661891 - DNA, 1054 bp, Homo sapiens
  misc_feature (249)..(249): n is a, c, g, or t
  misc_feature (294)..(294): n is a, c, g, or t
tctgcactctgctttggtgtcgctctttccgtctttcgttccctccggtgccgtgcccccgtgtttgggccctccgtgccgtccctggttctcttgctgcgttgtctgtcttccgggaacccttgtcttcctgggctttttatgaccgtctcgccagcgactgggtgtccgggccgcaattcgagcccagctcttgtcgcaccccgaacccctgggcttacgtgtgcaggtcgcttggagcaggggccncccacttcctccctggcgagtatctgctcccatggatgcccacanccacgacggaacaccccaagtctccgtgtctggcccttcgtggttcgactttccacggctgggttaccagaggagaggcttgccaggactggggtggtcgtgcttcgctcaagtccctcgccattgctgtttcaatggtttgagggtcaccccactgctcctccatgcagagaccccctcatggacgcgttcagctccccttcccatcagacgcaccccacctgcgatggtgtcaccagcgcggcaacgcggtgggccatctcatccacctcgtcgagtcaacgaacacccgcttgagcatcggcttcgtatcaaaaggtccagacctgaaggggaaattttatctcgttcgttcttgtctgtctggttattcttgttgacacagagttttcgctcttcgttggcccaggctggagtgcaatgacacgatctcggttcactgcaacctctcgcctcctgggttcagagcagattctcctgccttcagcctcccgagtagctgggattacaggcgcccgccatcacgcccgggtaatttttttgtatttgttggtagagacgggtgattcactatgttggccaggctagtcacgaactcgctgacctcgtgatccgcccacctcggcctcccaaagtgctgggattacaggtgtgagccaccgttcccggcctctttttagttattccataaaatattaccttgaggcccaattctgcgcttaaggagcaatgtgcaccaataactgcgggtgggggctgt

SEQ ID NO: 661892 - DNA, 181 bp, Homo sapiens
agagtgtttatcgaatagaaggtaggaaacgtacaagtgtgtagagtgtggtcatgtatgagtgtagactgtagaaacacgcccatagcatgtagagcacgcatgtattcaacatgtgagatgtgagaacacactaaatggattcatgcggtggtgttctggtgatgtggatgtgattgga

SEQ ID NO: 661893 - DNA, 448 bp, Homo sapiens
gacatgatcgaatcgagctcggtaccggagagcatcccataagcagctatgctcgtctagtttagggtagagcctaagactgtatttaggtaaccatgtatttgaggtagccattggacagacctaaatggacattatatttctgtaaatacatgggaagtccaatatttgatttttatttggtttaaggtagttaacttgaatctagcaaatacttacaagcccctactatgagcaaacctccctgcttggcactgacccatatcaaggtaagtcagacacaaagcctaccgtttaaaattcagtgtgaacaacaggagatggaggaggtggggggaaggaagacaggcggaatacataaaccaccaccctgacccaagacacactgggagccatgagaaggtcatcggcaagactctagtggcattcaaaggtggggaagtcccat

SEQ ID NO: 661894 - DNA, 521 bp, Homo sapiens
  misc_feature (198)..(198): n is a, c, g, or t
aagcacatgatggctgggcaccgtggctcacgcctgtaatcccagcactttgggaggctgaggcgggtggatcacctgaggtcgggagtttgagaccagcctggccaacatggtgaaaccccatcgctactaaaaatataaaaaattagctgggcatggtggcgcacgcctgtagttccagctactcaggaggctgangcaggagaatcgcttgaacccgggaggtggaggttgcagtgagctgagatcgcaccattgcactccagcctgggcaacaagagcgaaactctgtctcaaaagaaaaacataagaggcgtgtggattacttgaggtcagggttagagatcaggctgaccaacatggtgaaaccctatctctactaaaactctagaattagccaggcatgggagcgcacgcctgtaatcccattctattgggacgctgatgcaggagaatacctttgaacctgtggaagcatgggatcaagtacttcgtgtatagggccccttgcaattcaagct

SEQ ID NO: 661895 - DNA, 960 bp, Homo sapiens
  misc_feature (603)..(603): n is a, c, g, or t
gcgggatgggcgcgggggtgggcatggtactctgctggctcggactattgggagaagggcgggcggctcgaggagagaggggatccgaggccgctgacatttgtgtcatgccgtcggcccaggggttgtgcctgagtggtgtgtgcccggccgctcgttgggtttgattgggactagaatgtgactgtgactggtctgccaatttgttcgtatgtctagttagtcaagggacaattggcacgatcccgtatcgagccggcttgcctagaaccaacgttcagtggcgcaaggccctagggaatctgagatggagtcagtgcgaacccgtttacgtccagatgtggcgagtccgaaaggaggtgctgttacgcctctatcttggcaaacggctagagaacccacatgttgtagcagtactcctcgttaataccagctctgaaatgagactgtcgagagccgttgtcaggcgccaggaaaggttgctcatatgggaagcgcaaatgactacaatagaactaaggtcgatcgtgcgaagagtgagctggaggggtctcgtaggctgcgaagcgacccggcgtagtccgaggcgtagaaatgcatgancattagctcgatgtgagtaatcccaacaccagaaacagtcgcgaggattcaaagttgagccaagacagcattaggcacagagaagatttggcaagcaactgtcgaaaaagccaattcctggacagagccgataagtcaatttcttaacagggcctttacagatgggtaaaaaacttaacccatgcccgagtggaagatgaggttgtccctgcaaatcgaagtaactagcctttctagagaggggaaacccttcatttggaatatccttatgaatggatgggaaccttttgtcagtacaagaaaactcaacttccggataaattcacccaattcagtgcccagatctccatacccctg

SEQ ID NO: 661896 - DNA, 616 bp, Homo sapiens
gcagaggaggtgaggagggaggaagcgtctggagtggggcgggcccggaactccgacccccggggctgcttcgagccccccagctggtcaccgaggcacctgcgcttcagccaggccagtagccgtcccctcgctgcaccctggccacgctcacagcgcgcccgagcgagccccgggctcacctcgtgagccagcgtggcgcagggtgtcaagtggttctctcagggtctcgggacagagtgagcaccctgatgaaggccacggtcctgatgcggcagcctgggcgggtgcaggacgatcgtgggcgcacctccgcaagggacggcaggaagaaccggttacaggctgactatctgaattatagacaatgaaccttgagacagacgataagcaatcataaatggaaaaagcgaatgaccctatcactatcttaaccaaaaatacatggaactcaatacgccaaaagattcatcagaagaagcgaagaggtcggacaacgaagcttcacacagcgactccattacagcaactatttaccacaaattgaacaatcgacccacacaaccgcgaaccgatcaaaggcacaaaacctaacactcaataatggctgcaacaa

SEQ ID NO: 661897 - DNA, 129 bp, Homo sapiens
acatacacacagttgtatagctgcctatagtaggtgccgcctcaggttaggggctctcagccctactctaacctctgacctcgtagctcattggaattgcgcccccaagatgctactctcccttctcca

SEQ ID NO: 661898 - DNA, 102 bp, Homo sapiens
ctacagagaagagacgagatgaagtaaactttaatagtgtaggaagctgaataatttatgaaggagaggggtcaggttgattcgggaggatcctatggtgcg

SEQ ID NO: 661899 - DNA, 740 bp, Homo sapiens
cctggcccccgatggaccctccgtgagctcctggtgcttgatgtgcccacaatggtcccccatgtgtggaatatgtgaaaccctgtgtgcagtgggatgagaatggtgcgatgcctggcgaagcaggtgagcctggtccttcctgggatgaatggcgtgccccccgtggacccaaaggagaaaggggagagaatgggctgagtcagtgcccttcagtgtgctgcctggacccccttgtgacccaaatggccctcccggagatgatggtcccaaaggcagctcctggtcccagtgggttttcctggagatcctggtcccccccggagagcctggccccgcgggtcaagatggtccccctggtgacaataggagatgatggtgaacccgtggcagactaggatcccccggctcctactggtgaaccatggtccatcggggcctccatggaaaaaggggtcccccatgtgccccgtcgatgtgcccctgatgtgcagacagtgggatgaggaagaggggccatagggtagaagccggcttgggaagtgccctcctgggaggacttggccccatcggccccccaggggtgcccctgggtaaggcccggaccggatgggccttcgatggggatcctggtcctgtgggtagacaatggtctcgcaggatcccaggcccggatggtccccctgggccatggtccccaggacttccggcctcaggagatctgtcccatgtcagagggc

SEQ ID NO: 661900 - DNA, 548 bp, Homo sapiens
tggttcattatataagctgatgtctatttgattttcctttagctgtaaaaaaaatgttatgtagttatcaatcatttattatgatcagtctctgaagccattggaccaaaaactctcctggattgagtttgtcatgcaccacaatggagccacctaccaacagtctcacctggttccagtactgctctatggatgtgctggactgaatggcaattgttactctctttgtcataatatgttgcttgattatcaaaagttgttaaggcaagaaagaaagaaaagagagtacatctttttgagatctaaggcaggcaggcatgatacagaaaatcatgccatttaatgtcaccactatgtatcaaggtatggagtaaattctttactacatttttcaagacctgtgccttcttgatttgtttgaaatttttaatctttgttaaacattatgtaaggtacaattttaatttcagaaaacctgtaataattcaattttaatgcttatctacgtatattttttaaactgaaaataaaatgagattcactagaaa

SEQ ID NO: 661901 - DNA, 148 bp, Homo sapiens
acctggtcgttcagacatttataacgggcattactttcatttatgaacggccctacactcagcacctaatcacctcccaaaggtctcacctcctaatatcatcacactggggacatagatttcaacgtatgagattttggagagacac

SEQ ID NO: 661902 - DNA, 425 bp, Homo sapiens
gagtctgaacatttttatgaaagattgttttttcagaaggaaaggctttctttacagccaccaacagtgtcttattgtaccaaagtcatggagcctggccagcattgggtgttatcattcaaatttttccgagtaaatgtaatccctgtcaaatgctctattcttttgatttgtactcctttgattactctagaacttaatatcctcccccacccctggtatttgttttatcttgtgggactatttgtgtccttgcttattgttctctaagactatcagtgtttggccaggcgtggtggcttatacctataatcccagcactttaggaggccaaggtgggaggatcacttgagcccaggagttcaagaccaacctggacaacatggtgagacccccatctctacaaagaaaaaaagaagaagaag

SEQ ID NO: 661903 - DNA, 948 bp, Homo sapiens
gggattcgtgtcgttcgtcgactcggcggatgtaggtgagttagtagggccgggttctgaggccgttgctatctttttactgtatgccacgctaggccatgagtagtgcgcgggttagcagaaccaggtgaggtagttgtgtagcactgatggatggcagtagtaagctattgaagttggctagaccttaaatgatggcgggttttgtgttactccaaaaggatagggcgattctgagtggagagacattgctggtttgttaatgtgacatgagtgatcttaggtgtcgtgtggtgttataaagaatatgaaacaagctcataggatgtttggagaaggattggggaaatgacggggtcgatcgtagtgcgaactaatggtagagcagggagttacgcgctaggtgtttccagtggaacactgacgtgatttggatttgatctgatagactctcgtcgtgtactgtggagagttaaaatatcttcttggggtgagagaaggtcgtgggacgaccgtagctctactgtatggtacagtgggctgtgacggagggtctgaggaggtccgatgggggtgtgactcatgttgaaatgaagttcagaagaggtagggttgtcgggtgtttcctgtacgagcgcgtttgttgacttggggaatgagaacggagacgagtctgtcttaggaaaagtggtggatagtagaggtggggaaaacgcgtactagttgttggaaacgtggatttgtactgtgcgatagagtgaggagaagcatctttaagttgggaccttcttgaagaccttgatgtaactttgcgaccatgagttggggcaaagtttgtgtgggcatgattttagtgttggataccccaagtatgagtgtgggcaataaggcgggaaatgaggatgaaggtggtactaactgaatggaaaggagagtatgtgacgtata

SEQ ID NO: 661904 - DNA, 881 bp, Homo sapiens
  misc_feature (1)..(1): n is a, c, g, or t
  misc_feature (6)..(6): n is a, c, g, or t
  misc_feature (63)..(63): n is a, c, g, or t
  misc_feature (65)..(65): n is a, c, g, or t
  misc_feature (93)..(93): n is a, c, g, or t
  misc_feature (140)..(141): n is a, c, g, or t
  misc_feature (145)..(145): n is a, c, g, or t
  misc_feature (147)..(147): n is a, c, g, or t
  misc_feature (150)..(150): n is a, c, g, or t
  misc_feature (153)..(153): n is a, c, g, or t
  misc_feature (157)..(157): n is a, c, g, or t
  misc_feature (166)..(166): n is a, c, g, or t
  misc_feature (170)..(171): n is a, c, g, or t
  misc_feature (223)..(223): n is a, c, g, or t
  misc_feature (252)..(253): n is a, c, g, or t
  misc_feature (316)..(316): n is a, c, g, or t
  misc_feature (320)..(320): n is a, c, g, or t
  misc_feature (353)..(353): n is a, c, g, or t
  misc_feature (358)..(358): n is a, c, g, or t
  misc_feature (393)..(393): n is a, c, g, or t
  misc_feature (447)..(447): n is a, c, g, or t
  misc_feature (469)..(469): n is a, c, g, or t
  misc_feature (483)..(483): n is a, c, g, or t
  misc_feature (494)..(494): n is a, c, g, or t
  misc_feature (613)..(613): n is a, c, g, or t
  misc_feature (680)..(680): n is a, c, g, or t
  misc_feature (707)..(707): n is a, c, g, or t
  misc_feature (731)..(731): n is a, c, g, or t
  misc_feature (857)..(857): n is a, c, g, or t
nagggngccgcggggaaggaggcggcgaagagcgcggcacttccgctggccgctggctcgctngnacgctcctggaggcggcggcgggagcgnagggggcgcgcggcccggggactcgcattccccggttccccctccannccananggnctngacnatagacgcnaaanngtgggcagtggtggtgctggctgcgttcccctccctaggggcaggtgggganactcccaaagcccctccggagtcatgganncaaatatagttcttccgatttgtggtgaatgctgctggctatgccacaattatggtacctggntacntcctggtgcagtacttcaggcggaagaaataantgganaccggtaggggcctctgctttcccctggtgaaagnttgtatgtttggcaatgagcccaaagcctctaatgaggttcccctggcgccccnaacagaggcggcagaaaccacnccgatatggcaagncctgaagctantcttctgtgccacagggctccaggtgtcttatctgacttggggtgtgctgcaggaaagagtgatgacccgcagctatggggccacagccacatcaccgggtgagcgctttacggactcncagttcctggtgctaatgaaccgagtgctggcactgattgtggctggcctctcctgtgttctctgcnagcagccccggcatggggcaccatgtnccggtactcctttgccagcctgtncaatgtgcttagcagctggtgccaatacgaagctcttaagttcgtcagcttccccacccaggtgctggccaaggcctctaaggtgatccctgtcatgctgatgggaaagcttgtgtctcggcgcanaacgaacactgggagtacctgaca

SEQ ID NO: 661905 - DNA, 223 bp, Homo sapiens
cgtgtcctgcgcgctgcgcgtctgtttctagggcaacgcgggcgtactcttagcaaccgcgcgcgcctaggtgggtcccccggcacccccagacctgccatggcgaccgcgagtcctagacgtctttctactcatggtcaacgggcaggtagagagcgcccagtttccagagtatgatgacctctactgcacgatactgctttgtgtacggccaagactgggc

SEQ ID NO: 661906 - DNA, 403 bp, Homo sapiens
  misc_feature (36)..(36): n is a, c, g, or t
  misc_feature (203)..(203): n is a, c, g, or t
  misc_feature (281)..(281): n is a, c, g, or t
  misc_feature (384)..(384): n is a, c, g, or t
  misc_feature (399)..(399): n is a, c, g, or t
gtctcaaaaaaaaaaaaaaaaaaaaagtctaaaggnaccagggatgacagtttccatatgttggaaaattaacatatggaaaatgctttacacttccaaaatgtattacataaacatgttttcattatgtattctcaatcactttgttaggatttgaactgatgcctctgacttcagaagttatacacattcaactgtactangataactatccagtattacgcctaatgctatatgcatcactgagttcaaattaagcaaaatttatttcaaatatttangtattttcagcatttagaccatcattccaaagtacttccacactggggccattaaaatatggcatgcaccattctctgggctttcaggggcaccatacccctncacaaacttgtggtngaat

SEQ ID NO: 661907 - DNA, 426 bp, Homo sapiens
tcagctgaggcagaggcgagagcgctgtcgatctgagagacttgtaagtagcgtggagtcttgcctggctcggaccctatgaccatgtaatgagaaccttcaagtaaatccaatagtgtcagtgcgtgtcagcagtgcagggtccgtctgattcactctgatgaggttctgccagaggtcagaagatggtctgtttgagatgacccagtgggacataagcacaggagggagtcggggtatggcaggacgaaggtctaataacaggggagcgctttggagctggccctcctgggtggggttcttgatgttcctgtgggaagggtgaagccaggagagggtggtggcccgtcttcctaggctggtctcccttcattcttcaccccaaaagggctagactgtgcgggtggtaggaaaggtccaggagtc

SEQ ID NO: 661908 - DNA, 405 bp, Homo sapiens
aagtcatctgtggacagcagcgttaaaagagcactgaagcctctggggcttcaggagtggcaggcaatcctgcctggatgctgctgtggggcttcatggagtttgcccctgcctgtgctaaagcatctagctggttccagcacccactcacctgtgtgctccctcctgcaaggagtggaacacagcaagtcttgagtgagtggagtttgatcccgctgtcactgaagtggctagccctttccagtgcttgttgactccagttcccgcacctgtttgcttgtgctccctcccttgaggagttgagagtggcgggctaagtaaacaaggcacccctgttgagagtctcatgaaggggtcagggaaattcctgcttcaataccatcatcattcttcacagaagttaga

SEQ ID NO: 661909 - DNA, 565 bp, Homo sapiens
ccaggcgagtcaggcctttctggacctcgcctgactcggatgggctgtgcctgaaattgacccagctccactagggattatgaagaaacaaggagtaagacccaagagccgctgcaatcttcccgccccagcccgtctaagcggccgtacggggcctcccccgcccgggagctggaggtggaaaagtcggccctaggcggcgggaaactgccagggggcgccaggaggtcctccccggggaggatcccaaatctgaaaaagcgaaaaggcttggagctaaaggtggtggccaagacccttctcgaccccttccagttcgtccgtaattccctgtgcgcagctccgggaagaggtgcacgaactgcaggcgcggtggttccccagcagaaccactctcagcatcgccatctttgtggcaaattctacatgggttacatttagtaacactttttgaaaatgatcgtcatttctctcacctctcatctttggaacgggagatgacttttcgcactaaaatgggactttattattcctacttcaagaccatcattgaagcaccttcatt

SEQ ID NO: 661910 - DNA, 849 bp, Homo sapiens
caccatcatccgaccgccgacggcgcatgctaccctctcgcgatggtcgcgtgtccctagcttgcttgaaggcggtgacaacgcgccaccgttggtgcctagcacaagccggttgttcctagcgatgggactcccttggtaatcagtgcttgaagccatttcccagcgagaattggagaccagtccctatccgagctggctgcgggacgatgtctgcacgcgacgcgctcggctgacgctgcttgcccgttggacccgcgacttctgggcctggtgtctccctggcttacgtagacatttgacctctaactcacatagtccatactccctggaatgcagcctaagatcttgaggccctcgttgcatcgcatcgagtggcactcagaggactcctcataatcccccagactcagagcccgagagcccttcccaagccacttggcttggctgcagagtagactgagagctggggccacgtatcccatgtgctggcaccatgctccctgtgctcaagtattatattacgcccccgttaactgtcccagtgatccttgtccagacctccactccaggagaggcgatgggacacagcaactggtgatgccatggacttccccttggccctgtctgggccaaccccttccattgggttgaagacaaagcaagtccccctggaggcgggtggcccagtaagccatctacagggttccctaggccaggcggagtatgaggatgggtaacagtattgggccccagatccctaagcccctccagctgtacaataggctgtgtgccaagtgcctggtcatcagtaagatgggaggattagcccaggggtctgtttatgta

SEQ ID NO: 661911 - DNA, 201 bp, Homo sapiens
ttgccctcggtcgccggctcatggattagggatttcacacaggtgatgctttggaagccctgagagcttcatttatgacctcaatgaaaaccccaacttcctgctgcagcactgatagtcccaggccaacactggggccggaccggcagccgagtgacagtgcgtggtccccaccgtcagatcagcccggggaccgagcat

SEQ ID NO: 661912 - DNA, 129 bp, Homo sapiens
ggtgaatcgcagtcatctataggggtacacaattgctgtgagtctctgtgccgcctgctttttagtcagtgtgtcctccacagagttgtgtacctcttggtgactttggagcaggagtgttgaggaata

SEQ ID NO: 661913 - DNA, 266 bp, Homo sapiens
  misc_feature (1)..(1): n is a, c, g, or t
ntcgatcgtctcccacttggttgcggacggtgagacaattggtcttgggacaacagcgatgccagcagtcatgcaaatggctgaaagacactcaggacagcgcaagggtcaacccccaggatggaccaaacataactcggatagcggaaaatggggtttcagaaagagactcagaagcggcgaagcaaaaccacgtcactgccgacgactttgttgcagacttctgtcatctggcagcacacggatacatctttaaataaagccgg

SEQ ID NO: 661914 - DNA, 447 bp, Homo sapiens
gcagagagtccagagaaaggagcgccatggattactacagaaaatatgcatgtatctttctggtcacgcttgtcggtgtttctgctttttctccattccgctcctgatgtgcaggattggccagaatgcacgctagaggaaaatccattcttcttccatgcgggtgccccaatacttcagtgcatgggctgttgcttctctagagcatattccactccacgtaaggtccaagaagactatgttggtccaaaagaacgtcacctcagactccacttgtctgtgttgctgaatcatataaacagggtcacagtagtggtggggtttcacagtggagaaccacacggagtgccagtgcattacttgttattatcacaaatcttaaatgttttaccaagtgctgtcttgatgactgctgattttctggaatggaaaattccgttgtccagt

SEQ ID NO: 661915 - DNA, 153 bp, Homo sapiens
  misc_feature (128)..(128): n is a, c, g, or t
tgatctaccggatcttatgtagcccgtcagccaagatgggctcgatggcatgtggagaagacttaaggctgttctgggattccaagaatgagctgaaaaagaaacatcgatggactgtacataccaanaccactagccttcaccaggaagcgt

SEQ ID NO: 661916 - DNA, 391 bp, Homo sapiens
ggtaacacaggcaacaactgaaacaaacagaaatacagattgcagcttctacagatggcacacgctgggatacccaacctacaactatatgatgtgaaaactgagacatgttagaaatctttcatccagaaaaaaatgcaaacattggtcaatacactggcttcaaatactaatccattacatacgtattcttactgtcatcactgctataatatttgtcttcctgactattgattctacaaaaatcacttatcagacaaaaactctaccactttttacggatacagtatgtaggaatgtaactagagcaaaaacttgatccttcatttccatttagctattaagtggacaggaacaactgttttcttttccttgtctgtttgaaagggag

SEQ ID NO: 661917 - DNA, 128 bp, Homo sapiens
  misc_feature (79)..(79): n is a, c, g, or t
  misc_feature (88)..(88): n is a, c, g, or t
ggcacggaggacccacgtcaccctacgtccagacaaccctagccaaaccacttaccaaagtaagatatgcgagatggantttaacccntgcgcaaaataaatatggaccccaagggaaagatgtaaaa

SEQ ID NO: 661918 - DNA, 358 bp, Homo sapiens
gagaatgaacaacatatgcaagattgcagactacggatagacccgaattgatagcaagacaatagagatacacagacaagacaaggtgcaaaattccccatcaagtggacggaccccgaggcagacctgtacgggaggtacacaatcaagtctgacgtgtggtcttttggaatcttactcacagagctggtcaccaaaggaagagtgccatacccaggcatgaacaaccgggaggtgctggagcaggtggagcgaggctacaggatgccctgcccgcaggactgacccatctctctgcatgcgctcatgatccactgctggaaaaaggacctgaagaacgcccactttgagtacttgc

SEQ ID NO: 661919 - DNA, 161 bp, Homo sapiens
  misc_feature (25)..(25): n is a, c, g, or t
  misc_feature (32)..(33): n is a, c, g, or t
  misc_feature (57)..(58): n is a, c, g, or t
  misc_feature (76)..(76): n is a, c, g, or t
agatactcagccttagggataacgncctgaannccggtgccctaaggcaaatcgggnncgcttacccagcttaaangagctcccacaattcagggggaaccgccctccaccgtttctgcccccccagaaactcaggaaaacttgtgaatttaactgggccc

SEQ ID NO: 661920 - DNA, 223 bp, Homo sapiens
gggaaaccccctttttttcttaaaattccaaatttgcccgggtttttggggcctgcccgtttttcccccttctccggggggttgggccgggggtttttttttacttgggggggggggggttccgttggcttgggttgggccctttttttcccgcctggggccccccccccggtttttcccccttgcccccccgcctggggccccagggttgaacttttttcca

SEQ ID NO: 661921 - DNA, 397 bp, Homo sapiens
tttttttttgagacgtagctcagctttgttgtccaggcttcagtgcagcagcacaatttcggctcaccgcaacctccacctcccgagttgaacggattctcctgcttcagcctctggagtagttgggattaccagcgcgtgccaccacgcccggctaattttgtatttttagtagagacggtttcactgtgttagccaggatggtctcgatctcctgacctcgtgatctgaccacctcagcctcccaaagtgctgggattatgggcgtgacaccgcacaaccttgtcttctcatctgtgaccaagactttgaaaagtggataaggtctggtattcactcatgtctttgtcttttgtatttttgaggcagggtctgctcagttgccaggctggagtgc

SEQ ID NO: 661922 - DNA, 308 bp, Homo sapiens
gaggttgaaatgacttctgtaagctcagctcattgtagtctgcatcctccacacgtgttaatgagttcttgtgcctcagcctacctacagagaggccagtttacatgtcacctgccagcacgtccagattatttatgtatttatctttagaatttattttatttttaagttcctggatacattttctaggatgtgcaggcgtgttcctttaatctgtgccatggtggtttgctgtacctattacctcttcaccttggtatttggccctgcatacattagctgtttatcctaatgctcttcccaccccc

SEQ ID NO: 661923 - DNA, 80 bp, Homo sapiens
aagaaaggttaaacactgtgagttgacacacacgtaccaaagtagtttctgagaatgattctttctagtttgctacgaag

SEQ ID NO: 661924 - DNA, 286 bp, Homo sapiens
cccgtttaaaaaaaaagagggccccttttttaaagtgggctttaatatgcttttaaataacccaatttgaagccacgtttagtttggttgggtttcccccccaagcaccataacccttgggtttgttccttatttgaaaaatcccaccccgggccttaaagttgaagctttgctttgttttttggggggcccacccccccttgacatggccccagacccttttaaaactttttttttccaaagtcaaaatgaattccttttttaataacccaagttttgtttttta

SEQ ID NO: 661925 - DNA, 472 bp, Homo sapiens
  misc_feature (79)..(79): n is a, c, g, or t
gagacagcccgaaaactgtaagaagtgccttttacctcctgccatgattctgaggcctccccagccatgtgaaactgcnccttccatctgcccatgctgcccccatctcctgatttgtgaaattcatcaggtgtgcacccttctaatggctgctccgatgaaaacagtaaaaacccatcaagccagaccaagaggagtgacctacttatatcagattgtgttaactttctgagaagagacagactcagacccagagaggagaacaccatgtggagatggaggcagaggttggagtgatgcacctacaagccaaggaacactgtggatggcagcagctgccagaagccaggagagaggcatggagcaggtgctccctcagagtcaccagcaggaaccaaccctgctgacactttgatttcaaacctctgtcttccagaacggtgatagaataaatttctgttgttttaagcca

SEQ ID NO: 661926 - DNA, 413 bp, Homo sapiens
ttgagtactagtctcagtacctgggtgacatggatcattcataccccaaacctcagcatcatacaatatgcccaggtaacaaaccttcatgtactctctgaatctaaaataaaatctgaaaaaaaaaaaaaatcatttatgtctctcttacggtaccagtgagccttggtactatttcctcattttatttggctgactccaactgagctccggaaagtgtctcctgtaaatactccttttgcaagtagagaatcttaatacatatttgtgtaatggtaagtatctctcagtgattttcccaagtttagttgtccttgaggtttgaatgggatatttttcactctgcccagtggcccttttaatagttttatgcctgtaatagtttaatgcggagtggggaatccttctagaag

SEQ ID NO: 661927 - DNA, 193 bp, Homo sapiens
tgatgctatcgtgaacctcggcgtcacctgcgcagtggtcttgcggaaactcagatcctcgcgggcccacctccacgagttccttgagttcactggtgtatgggattggggcctgatgaatgtgcatttctcacaagctttctcccagaggtgacgctgactactgtctggtcctggtaaatctctcttttga

SEQ ID NO: 661928 - DNA, 267 bp, Homo sapiens
agtctgtatcaagaacgtaagcataggtctcccactccaaagagcacacgtaaatctaagttacaaaaagcgagagcggtctcgaagtacaacaccagcccccaagagccgccggggccaccgtacaacttctgctgactctgcttcctcctccgatacttacccgcagtcggtctcgaagtgctgcagctaaaactcatacaactgccttggatgggcgaagtccttcccctgcttcagggcgattcggaaagggagatgcgcctt

SEQ ID NO: 661929 - DNA, 941 bp, Homo sapiens
  misc_feature (424)..(424): n is a, c, g, or t
ctaaagtgtgctccaataagcaccctggctgtttgaggcggagaacctggtactggatgccgagcttgggttggattaagccgaacgcacctccaattgtgcgctggtgatgtggcacttccgtggtgttcccgctccctctggtgcgtcctactagctccaaggggcagagcttccccgtggatgtcgcgcccccccctataatagggtgcgtcgttgtctggattcaacccgcgaggttttccgccccccttatttttccgcgtggtagcactcccctagtgtgcaccactcagcacttcttctcgcgccgatatgccctcatttgggtttccatcacggtgcgataattattcttggcaggcgctgaaggagttggctcgaatgcctgttgtttgagcgcccacgaccccacccccttttntggtccgggcgccttatccgcgcgactgtcctcaccgtcgcacgttatggcaaatcacgtgggggttgcgacccctcgcaggggttgtattcagaccgcgcacgctcatgtcgttgagtcacgctcgctcagtttcactcgcactgtgcgggagctcgcactagtcacggttttgcccttgactcaccccacggctgtacacaatttcggataacatagtctttccgcgtgttgtatgaaagcactttcactccttacgagcgctccagagtactcctctcattcatgaatacaaaattccctctccctcttaacaccctgcgagttcgtccacttaggttgcaggctccactcccccctcaagccccgacactcttttccgcacaaaaacaccactataataagactacaactttttttcccaccaataactcaaggtgttctaacaccccacctccactacctgtttatctacccccccccctcggccccccagaaccttttcccaacaaaacaa

SEQ ID NO: 661930 - DNA, 841 bp, Homo sapiens
agatggatcctgaggccgtgcgatgatttggtggcctctcttatagagtagaaagcagctaagcaccatagatatccgagtgacgatgatctatttgacattaccagtgacacaacggacgtgaccaccgtgaagatggcctaggatcttcactgtcttactaaagatactggactatgtggaacgtactgtaccttaaacatgtgctcgctctgtgtgattagtgacaaaaaactcccttccttatgcatactgagatagattagtggcacgaggaaggtgtcaatgtggattaaagtgctgtgcttaccttcccatgcaggataaagtgatcccttcttgctcattccctctgggtgggaaccatccagtaaatgcggacactagacgttacatcctctctagtggcaccatcacccttgaaaactgtgatacagtgtaatgaatgttgcatgacaacaggaggccaataaaaaggatctttctacatgcaaatttggttaacaaatcgaggggtgggccataaatcctctaccatatgaccggagttaacactaaaagtctctgggttctattgataaaaggggtcaaacaaaactgttatttattttggctaaaaaaacatgggctggtatattttaatggctggtctcaaggttagagaaagatactctctagaggcaatagaatgatctttcctaatagaagaaaaacgacaccgggaatgaaaggggcttcctcgtgaggaaacaaattatcctcggggaagagaatggctgattttgacccttgaagagaggttaacaaattcacagatcgccagaaaagtaagcccccaaag

SEQ ID NO: 661931 - DNA, 331 bp, Homo sapiens
gatcgcagtggcatagacgcttgttatacttatcctcatagggataggacaaggcatggtgtatgctatttgtttagtcaggtggtaacagaataagtgtgagcgcgtataataccagagccgcctaataataagagtactgcggcaagtactatagacccagcgatgggggcttcgagcatgggcgtacagggagaccatcaagtagagtcccgtcacaggaggtatctttcactcatccacagctcattgtgtaggctaatcatattcagttgttaggctccaggcagtttgatcagttcttgggctgcacaggttcagcgcaaaaaag

SEQ ID NO: 661932 - DNA, 121 bp, Homo sapiens
catgcgactgcagcgtagacacagctcgaatcacaccagacttaaggagagaggagtgtggagaggcagaaaactgtagagacgccctgctagggaatgcctatgagggaaatgggagcag

SEQ ID NO: 661933 - DNA, 659 bp, Homo sapiens
gcggagtgagtgtggagatgaatggctgggcgctggtgaccgggagcctggacccctgggaggtcggagcttgtcgaggtgatgcgtgctgtgctgcttgccctgtgatgcattggctgaccgcgtggctgagctcttcttgtctgcctgccttgccctgccctgctgctgtgttgctgctgctttgccctggtgcttgggctgcgcaccctggtttggggccccagccccccttgtttgtggtgcccttgtgctgcgttgtgagtgcatgctgggttgcactgtcgcatgaagacttccatggcccaaaaggcaacaacttgggttctttaaaagatgcatggcttggcaagtcaatgaatgcatgcatgcacattgacaacataacccagatacgaagatgccaccgagaagctcaatggctaatgcatgagtcaatgtaaaacctgtgctgaacggggaaattcactgaactcagattactacttgacgaagaggaatgtgctggccaagaaattcatttgataaaaacactgcagcgttaccctccaggtgtacagggaacaagctgactcttgcagagatgcaacttgacatcatgaatgatctctccaacagggtctggagtatcagccagggagccctgatccttgtccaga

SEQ ID NO: 661934 - DNA, 1074 bp, Homo sapiens
agtggggcccctactagtgtgttctattctattcgcggcgcgccgacgtgtgttcccaggttctgcccccaaggggggcccgggggctgccacggtgtggtgtcttctgaaatggaaggacgggggaaaacactagtgcgccgcgtagtggccccctcttgagagtgttattaagtggttataccacccaagcgcccccgccattgtgggtttcacaccccactgcgtccccctactcccaagggggtccttcctctcgcctctttgtggggcttcttctccgggggcacccactgtggcacacggatagctcgcgggggttgttcgtggtgaatatcgcacaaagtagagtttgtaccccaacggtgacgaaggaatgtctaatagcgggttgtgtggaccacccacaggttgtgtgtgtttaacaaaatatagatatacgccctttgtggggtgaagacccacgcccccctctttattttgttttgggtcttcgccaccgcccctgctcccccgcgccccgcacactcctcaaagggcccccatgttgggcccaccgcctctctcgagagttttttcgcgtgttctaaatttgtttgtgttaacgccccccagtgtatccctttcttctttgtctgcactggcgccccgcgatctcccaactcccacagggtttcccgagagccctgagacctcgccaatggccccgggcccccacagggccggggtaaggggaaggcccacggggctgaagcccccggaaccacgcccaagtaccctcgaggggctgtctttatggctgtgtattgccccttctttggcactccgcagacactccctctcttggctggcgccttgtctgcccaggggggaacccccccccgctccccacggtgaaccccagggtctgctccggggcccactttccacgcttggcccccgtctgtgacccttgggccagtcaccttgagcctctgtgtgcctcacacttcctcctctgttaaaccggggacccgtccctgcccctccctacctcacccggcatgtttgtgagaataaatgaggtaacgtgta

SEQ ID NO: 661935 - DNA, 322 bp, Homo sapiens
accaccgcgggggtactccagagatagccactacaggtctcctccatacacattatagccatccccaaatccacgtccactgccatatccatcagatcctcctctaaagttacttcctggtcctggtccgacctttcccgcgccaccacgtgaatcccctaagccacagttgcctcctcttcccctcctacaactctaaacttcctgcattccttgtctctagctaaagccttactctcatctcctgcttctgcatcatgagccatggatggtatggcttgcctgcgatatgatccattgcgatgaatcacgttcatcgtaa

SEQ ID NO: 661936 - DNA, 125 bp, Homo sapiens
acccctgaaagggtcttaataatttgaaagggaaagttgtgttttaaaatttggcgggcgcctttctccttttggggggatttcccttctttttttccccacaaaacgttgaaaaaaaatattcg

SEQ ID NO: 661937 - DNA, 180 bp, Homo sapiens
ttatgatggttgaattgaaaattggtgaagtttatgatggtgtaaaaggaacatgcattttgtggaaatgatattttgagtagtgatataattattttgtttttgagttggagtatagtattgaataaattagatgagataatggaactttattgtaaatagtttgtgttaataattttg

SEQ ID NO: 661938 - DNA, 397 bp, Homo sapiens
gtacggtgtcacggggaacccggtggctgtcctgaactacctcatcattagctatcagggacgcaacacattcaggtggctttgcgaacgagatgccagaggctcgtgaagtcaccaaggggaggagtgaagaaatcctgcatctcagtccctcacaagacagctgtctcaagcttttcaagctagtgagagacacatcagagcccctgggcactgtcgctggacgcggcctgagagtagctaccctcctttttcacctgagctctatcctcctacacatcacagtaacgaacacagctccgataaacacaactgctaagacagccaggccagcaacaatgaccacgatggggatagtggactgggaagataggtcccaactcaaggtgaggggctt

SEQ ID NO: 661939 - DNA, 843 bp, Homo sapiens
caaactgcgatagccgggtgctagcaggcatgaacctgcgggagatctccgactatgccctggaaggggctgtagaacgcctggagagcctctccttctatgacatagccatgctggcccgggtgcccagtgcgggcgactggaacaggtgcccgggctcaagattctctatgagccttcgaacaatgtacccgcgtccatgcgcgggtactgtgggccgagggcgactttgcctaactagtgcttgtcggacctgtacatggagcgtagggaactgtaacacaacatagcgtaggagagctggatctccatgcgacgaacgttatgccctgtgtgaacgctctcgcgcgaagctgaccatagtctggtaccatcgaccacataacactcacggcttggtccttctactacacaccacacactgtgcactttactcacgccatactagcccccagtagttgcgtagacccttccatggcctccaacaagcaaactgctactgcagatgtcctttgccgaccaatggcaagaactggtgtgatgtacccctgccccgaaagccttgcagggcacgagtagcgtcctacacaactgggtaaacgcacccgaagtccgcttgctcgatctgctggtcgattcgccgcctgtggccgaagtggcacgggcgtgggcaaccgctcggttgtccctgcgtttcattcggagccctgcaaagtcccagccccctggtgttgcgggagcccctccgggaacgcgtcccagcagccctccgcggtttcccgttgcagggtttgcccactttcccggggacggacttggcacctggacaccaacttgtttctg

SEQ ID NO: 661940 - DNA, 384 bp, Homo sapiens
acgtgattgtcacgctcattcagactggtactcacagatgtgctgtgccccactccctgctcattcagctgtccctaggcccaatgatatgttttctgcatgcagagttcctacccatcctttatgaacagccctcagactcaaagaagccagtccctgtcaccccagcctcttctgaattgtttctgactccttcagcacttacaatctacaccactcattgtttcatgcatctctgtcttctcccctgaaaccgtaaatccattgaggacagggatcagagagggaccagctctccttttttttttttggggaaacagagtctcactctgtcgcccaggtgggaggagcgggggagcaaccaggggggaccctcaagagctc

SEQ ID NO: 661941 - DNA, 93 bp, Homo sapiens
atttttttcctaagcattcatctctcaaacgaagtttttatattaaaccaaccgaacagtgaccaaaaaccaaaagtgcattcacccttccca

SEQ ID NO: 661942 - DNA, 2300 bp, Homo sapiens
gcatgcgggaagatggcgggccgggcgacttgagatccgcgggtctccctcctctttttccgtctgcgtcgggagctcccgggcacgtgaggccgtgccgcgtttactggcgggcgggacggcctagccgggcggcgcctcggaggaagccgcggaccccttaggtgctgggcccttggaaatcggcgcgtggggggcggtgctcgagctgagcgcgagagggcgggagagctcgtggggtgcgaggggagcaggacgcccggccgggcagcatgagtcagcagcggccggcgaggaagttacccagtctcctcctggacccgacggaggagacggttcgccgtcggtgccgagaccccatcaacgtggagggcctgctgccatcaaaaataaggattaatttagaagataatgtacaatatgtgtccatgagaaaagctctaaaagtgaagagacctcgttttgatgtatcgctggtttatttaactcgaaaatttatggatcttgtcagatctgctcccgggggtattcttgacttaaacaaggttgcaacgaaactgggagtccgaaagcggagagtgtatgacatcaccaatgtcttagatggaatcgacctcgttgaaaagaaatccaagaaccatattagatggataggatctgatcttagcaattttggagcagttccccaacaaaagaagctacaggaggaactttctgacttatcagcaatggaagatgctttggatgagttaattaaggattgtgctcagcagctgtttgagttaacagatgacaaagaaaatgaaagactagcatatgtgacctatcaagacattcatagcattcaggccttccatgaacagatcgtcattgcagttaaagctccagcagaaaccagattggatgttccagctcccagagaagactctatcacagtgcacataaggagcaccaacggacctatcgatgtctatttgtgtgaagtggagcagggtcagaccagtaacaaaaggtctgaaggtgtcgggacctcttcatctgagagcactcatccagaaggccctgaggaagaagaaaatcctcagcaaagtgaagaattgcttgaagtaagcaactgatggcatttgagaatttatgtatcactgagttttttgggaatatcttcgtggagaattacgcatcaaatttgattctcagagcaataaattatccatgaagtgctctcgttctcagtagcggcatcatggccagtagtgtctttgaggagttcaccacttagattactgagtaattgtggtttccacatttgaaaacaactccttttataattattcactgctttttgtcagtgaaatagacatcttgcctcctcaagtagcttcatcacagagtgtcatgaagacagacagtcaggctgaaatggacagttctttgtggactctacccttcccttcaaggagtatgtcatatatcacaaaagaaattgccttacactggttcacgtttgcagttacctgttgtacattgcatagatgtacacacgaatttaaatgtgatgtctttgtatatatctgtataatgttgagattacttacgaaatatgtctgagtgacacttttcacccttgtacagccaaaataatgtatatatggaaagtgacagacaaattctctaatctctttggtatctataacttattagaatcctctggatgagggttagaagagactttttccaaacttctacatgtagaagtatcataaatgtgctacacatttatgtttgtggatttaattaaagtattttaatatggttttcagtgctaaaattggagtcagatacttcttggttttaagctgtctacctaattgctgtctcccagcagactggtggcatgcccagtggctttgggggcaaggatagaaatgccatcaggaaatagctgaattcattgtgaaacatgaattcagtcatggtgataattggaaactcctttcaggtttttgcaagtagattttgtaatgtttgtgtatgcagccttgctgttgagtcagtccaaggggttttacttaggacaagttgtaccttgccctctctccagctctgctcccacattttcacatacctagctgtttctacctcattgggtaactcatttaccactctgtgcctcagtttactctgtagtttaccattagactgtgagctccttgagggactttgtcataatcactgttacatcccagtgcctcacaccatgcctggcccttaagaagtgctcaataaatgtctgaacaaat

SEQ ID NO: 661943 - DNA, 1824 bp, Homo sapiens
gcatgcgggaagatggcgggccgggcgacttgagatccgcgggtctccctcctctttttccgtctgcgtcgggagctcccgggcacgtgaggccgtgccgcgtttactggcgggcgggacggcctagccgggcggcgcctcggaggaagccgcggaccccttaggtgctgggcccttggaaatcggcgcgtggggggcggtgctcgagctgagcgcgagagggcgggagagctcgtggggtgcgaggggagcaggacgcccggccgggcagcatgagtcagcagcggccggcgaggaagttacccagtctcctcctggacccgacggaggagacggttcgccgtcggtgccgagaccccatcaacgtggagggcctgctgccatcaaaaataaggattaatttagaagataatgtacaatatgtgtccatgagaaaagctctaaaagtgaagagacctcgttttgatgtatcgctggtttatttaactcgaaaatttatggatcttgtcagatctgctcccgggggtattcttgacttaaacaaggttgcaacgaaactgggagtccgaaagcggagagtgtatgacatcaccaatgtcttagatggaatcgacctcgttgaaaagaaatccaagaaccatattagatggataggatctgatcttagcaattttggagcagttccccaacaaaagaagctacaggaggaactttctgacttatcagcaatggaagatgctttggatgagttaattaaggattgtgctcagcagctgtttgagttaacagatgacaaagaaaatgaaagactagcatatgtgacctatcaagacattcatagcattcaggccttccatgaacagatcgtcattgcagttaaagctccagcagaaaccagattggatgttccagctcccagagaagactctatcacagtgcacataaggagcaccaacggacctatcgatgtctatttgtgtgaagtggagcagggtcagaccagtaacaaaaggtctgaaggtgtcgggacctcttcatctgagagcactcatccagaaggccctgaggaagaagaaaatcctcagcaaagtgaagaattgcttgaagtaagcaactgatggcatttgagaatttatgtatcactgagttttttgggaatatcttcgtggagaattacgcatcaaatttgattctcagagcaataaattatccatgaagtgctctcgttctcagtagcggcatcatggccagtagtgtctttgaggagttcaccacttagattactgagtaattgtggtttccacatttgaaaacaactccttttataattattcactgctttttgtcagtgaaatagacatcttgcctcctcaagtagcttcatcacagagtgtcatgaagacagacagtcaggctgaaatggacagttctttgtggactctacccttcccttcaaggagtatgtcatatatcacaaaagaaattgccttacactggttcacgtttgcagttacctgttgtacattgcatagatgtacacacgaatttaaatgtgatgtctttgtatatatctgtataatgttgagattacttacgaaatatgtctgagtgacacttttcacccttgtacagccaaaataatgtatatatggaaagtgacagacaaattctctaatctctttggtatctataacttattagaatcctctggatgagggttagaagagactttttccaaacttctacatgtagaagtatcataaatgtgctacacatttatgtttgtggatttaattaaagtattttaatatggttttcagtgct

SEQ ID NO: 661944 - DNA, 323 bp, Homo sapiens
tccacagtcgtgggtgatagagtagcatcagcgagaggaagaaaactgggagagtgaaatgtgtggcagccacggaggtacttcgattgtccatgcaggatgtgaatggacaagcagtgtcatatatgactgacagagtagatacactactcttagttctgaattccagggtacacgtttctggatttaattcatttggcaactggtgtccattgaaggttccagagcagggatctgttaggagctaaacatgtaagaagaacatttgcagcaataggttaagtcataactctcagacagcatcagaaatgaagttgtgttca

SEQ ID NO: 661945 - DNA, 172 bp, Homo sapiens
cacatggaaggaagggaggttaaaggaagtgttgactaaaactatctattgtgtgaactatgctcactgtttgggtgatgggatcaattagaagcccaaaccccagcgctacccaagtattcccttgaaacagtactggccatgtgcttcaagatggttgggtaccgagctc

SEQ ID NO: 661946 - DNA, 2224 bp, Homo sapiens
gcatgcgggaagatggcgggccgggcgacttgagatccgcgggtctccctcctctttttccgtctgcgtcgggagctcccgggcacgtgaggccgtgccgcgtttactggcgggcgggacggcctagccgggcggcgcctcggaggaagccgcggaccccttaggtgctgggcccttggaaatcggcgcgtggggggcggtgctcgagctgagcgcgagagggcgggagagctcgtggggtgcgaggggagcaggacgcccggccgggcagcatgagtcagcagcggccggcgaggaagttacccagtctcctcctggacccgacggaggagacggttcgccgtcggtgccgagaccccatcaacgtggagggcctgctgccatcaaaaataaggattaatttagaagataatgtacaatatgtgtccatgagaaatctgctcccgggggtattcttgacttaaacaaggttgcaacgaaactgggagtccgaaagcggagagtgtatgacatcaccaatgtcttagatggaatcgacctcgttgaaaagaaatccaagaaccatattagatggataggatctgatcttagcaattttggagcagttccccaacaaaagaagctacaggaggaactttctgacttatcagcaatggaagatgctttggatgagttaattaaggattgtgctcagcagctgtttgagttaacagatgacaaagaaaatgaaagactagcatatgtgacctatcaagacattcatagcattcaggccttccatgaacagatcgtcattgcagttaaagctccagcagaaaccagattggatgttccagctcccagagaagactctatcacagtgcacataaggagcaccaacggacctatcgatgtctatttgtgtgaagtggagcagggtcagaccagtaacaaaaggtctgaaggtgtcgggacctcttcatctgagagcactcatccagaaggccctgaggaagaagaaaatcctcagcaaagtgaagaattgcttgaagtaagcaactgatggcatttgagaatttatgtatcactgagttttttgggaatatcttcgtggagaattacgcatcaaatttgattctcagagcaataaattatccatgaagtgctctcgttctcagtagcggcatcatggccagtagtgtctttgaggagttcaccacttagattactgagtaattgtggtttccacatttgaaaacaactccttttataattattcactgctttttgtcagtgaaatagacatcttgcctcctcaagtagcttcatcacagagtgtcatgaagacagacagtcaggctgaaatggacagttctttgtggactctacccttcccttcaaggagtatgtcatatatcacaaaagaaattgccttacactggttcacgtttgcagttacctgttgtacattgcatagatgtacacacgaatttaaatgtgatgtctttgtatatatctgtataatgttgagattacttacgaaatatgtctgagtgacacttttcacccttgtacagccaaaataatgtatatatggaaagtgacagacaaattctctaatctctttggtatctataacttattagaatcctctggatgagggttagaagagactttttccaaacttctacatgtagaagtatcataaatgtgctacacatttatgtttgtggatttaattaaagtattttaatatggttttcagtgctaaaattggagtcagatacttcttggttttaagctgtctacctaattgctgtctcccagcagactggtggcatgcccagtggctttgggggcaaggatagaaatgccatcaggaaatagctgaattcattgtgaaacatgaattcagtcatggtgataattggaaactcctttcaggtttttgcaagtagattttgtaatgtttgtgtatgcagccttgctgttgagtcagtccaaggggttttacttaggacaagttgtaccttgccctctctccagctctgctcccacattttcacatacctagctgtttctacctcattgggtaactcatttaccactctgtgcctcagtttactctgtagtttaccattagactgtgagctccttgagggactttgtcataatcactgttacatcccagtgcctcacaccatgcctggcccttaagaagtgctcaataaatgtctgaacaaat

SEQ ID NO: 661947 - DNA, 2434 bp, Homo sapiens
gcatgcgggaagatggcgggccgggcgacttgagatccgcgggtctccctcctctttttccgtctgcgtcgggagctcccgggcacgtgaggccgtgccgcgtttactggcgggcgggacggcctagccgggcggcgcctcggaggaagccgcggaccccttaggtgctgggcccttggaaatcggcgcgtggggggcggtgctcgagctgagcgcgagagggcgggagagctcgtggggtgcgaggggagcaggacgcccggccgggcagcatgagtcagcagcggccggcgaggaagttacccagtctcctcctggacccgacggaggagacggttcgccgtcggtgccgagaccccatcaacgtggagggcctgctgccatcaaaaataaggattaatttagaagataatgtacaatatgtgtccatgagaatgtaggaatgggctccagagagaagacatttatattatgaaatatgtacctttgttcctgaagtaaccgccagtggtctttaaactaaatgtgacattgtggaggttctgagtaacggacatttctgactgaagaagctctaaaagtgaagagacctcgttttgatgtatcgctggtttatttaactcgaaaatttatggatcttgtcagatctgctcccgggggtattcttgacttaaacaaggttgcaacgaaactgggagtccgaaagcggagagtgtatgacatcaccaatgtcttagatggaatcgacctcgttgaaaagaaatccaagaaccatattagatggataggatctgatcttagcaattttggagcagttccccaacaaaagaagctacaggaggaactttctgacttatcagcaatggaagatgctttggatgagttaattaaggattgtgctcagcagctgtttgagttaacagatgacaaagaaaatgaaagactagcatatgtgacctatcaagacattcatagcattcaggccttccatgaacagatcgtcattgcagttaaagctccagcagaaaccagattggatgttccagctcccagagaagactctatcacagtgcacataaggagcaccaacggacctatcgatgtctatttgtgtgaagtggagcagggtcagaccagtaacaaaaggtctgaaggtgtcgggacctcttcatctgagagcactcatccagaaggccctgaggaagaagaaaatcctcagcaaagtgaagaattgcttgaagtaagcaactgatggcatttgagaatttatgtatcactgagttttttgggaatatcttcgtggagaattacgcatcaaatttgattctcagagcaataaattatccatgaagtgctctcgttctcagtagcggcatcatggccagtagtgtctttgaggagttcaccacttagattactgagtaattgtggtttccacatttgaaaacaactccttttataattattcactgctttttgtcagtgaaatagacatcttgcctcctcaagtagcttcatcacagagtgtcatgaagacagacagtcaggctgaaatggacagttctttgtggactctacccttcccttcaaggagtatgtcatatatcacaaaagaaattgccttacactggttcacgtttgcagttacctgttgtacattgcatagatgtacacacgaatttaaatgtgatgtctttgtatatatctgtataatgttgagattacttacgaaatatgtctgagtgacacttttcacccttgtacagccaaaataatgtatatatggaaagtgacagacaaattctctaatctctttggtatctataacttattagaatcctctggatgagggttagaagagactttttccaaacttctacatgtagaagtatcataaatgtgctacacatttatgtttgtggatttaattaaagtattttaatatggttttcagtgctaaaattggagtcagatacttcttggttttaagctgtctacctaattgctgtctcccagcagactggtggcatgcccagtggctttgggggcaaggatagaaatgccatcaggaaatagctgaattcattgtgaaacatgaattcagtcatggtgataattggaaactcctttcaggtttttgcaagtagattttgtaatgtttgtgtatgcagccttgctgttgagtcagtccaaggggttttacttaggacaagttgtaccttgccctctctccagctctgctcccacattttcacatacctagctgtttctacctcattgggtaactcatttaccactctgtgcctcagtttactctgtagtttaccattagactgtgagctccttgagggactttgtcataatcactgttacatcccagtgcctcacaccatgcctggcccttaagaagtgctcaataaatgtctgaacaaat

SEQ ID NO: 661948 - DNA, 100 bp, Homo sapiens
ggtgctgaataaaatccacactttagattcttgcaactgtatcatatgtaatagtatcactttttctacatttggtcaaataaatttttacataaactac

SEQ ID NO: 661949 - DNA, 2371 bp, Homo sapiens
gcatgcgggaagatggcgggccgggcgacttgagatccgcgggtctccctcctctttttccgtctgcgtcgggagctcccgggcacgtgaggccgtgccgcgtttactggcgggcgggacggcctagccgggcggcgcctcggaggaagccgcggaccccttaggtgctgggcccttggaaatcggcgcgtggggggcggtgctcgagctgagcgcgagagggcgggagagctcgtggggtgcgaggggagcaggacgcccggccgggcagcatgagtcagcagcggccggcgaggaagttacccagtctcctcctggacccgacggaggagacggttcgccgtcggtgccgagaccccatcaacgtggagggcctgctgttgtttattcaggcaaatctggcttgctgggctaggctcagctgagggctgccttcgccatgaatccttctccatcaaaaataaggattaatttagaagataatgtacaatatgtgtccatgagaaaagctctaaaagtgaagagacctcgttttgatgtatcgctggtttatttaactcgaaaatttatggatcttgtcagatctgctcccgggggtattcttgacttaaacaaggttgcaacgaaactgggagtccgaaagcggagagtgtatgacatcaccaatgtcttagatggaatcgacctcgttgaaaagaaatccaagaaccatattagatggataggatctgatcttagcaattttggagcagttccccaacaaaagaagctacaggaggaactttctgacttatcagcaatggaagatgctttggatgagttaattaaggattgtgctcagcagctgtttgagttaacagatgacaaagaaaatgaaagactagcatatgtgacctatcaagacattcatagcattcaggccttccatgaacagatcgtcattgcagttaaagctccagcagaaaccagattggatgttccagctcccagagaagactctatcacagtgcacataaggagcaccaacggacctatcgatgtctatttgtgtgaagtggagcagggtcagaccagtaacaaaaggtctgaaggtgtcgggacctcttcatctgagagcactcatccagaaggccctgaggaagaagaaaatcctcagcaaagtgaagaattgcttgaagtaagcaactgatggcatttgagaatttatgtatcactgagttttttgggaatatcttcgtggagaattacgcatcaaatttgattctcagagcaataaattatccatgaagtgctctcgttctcagtagcggcatcatggccagtagtgtctttgaggagttcaccacttagattactgagtaattgtggtttccacatttgaaaacaactccttttataattattcactgctttttgtcagtgaaatagacatcttgcctcctcaagtagcttcatcacagagtgtcatgaagacagacagtcaggctgaaatggacagttctttgtggactctacccttcccttcaaggagtatgtcatatatcacaaaagaaattgccttacactggttcacgtttgcagttacctgttgtacattgcatagatgtacacacgaatttaaatgtgatgtctttgtatatatctgtataatgttgagattacttacgaaatatgtctgagtgacacttttcacccttgtacagccaaaataatgtatatatggaaagtgacagacaaattctctaatctctttggtatctataacttattagaatcctctggatgagggttagaagagactttttccaaacttctacatgtagaagtatcataaatgtgctacacatttatgtttgtggatttaattaaagtattttaatatggttttcagtgctaaaattggagtcagatacttcttggttttaagctgtctacctaattgctgtctcccagcagactggtggcatgcccagtggctttgggggcaaggatagaaatgccatcaggaaatagctgaattcattgtgaaacatgaattcagtcatggtgataattggaaactcctttcaggtttttgcaagtagattttgtaatgtttgtgtatgcagccttgctgttgagtcagtccaaggggttttacttaggacaagttgtaccttgccctctctccagctctgctcccacattttcacatacctagctgtttctacctcattgggtaactcatttaccactctgtgcctcagtttactctgtagtttaccattagactgtgagctccttgagggactttgtcataatcactgttacatcccagtgcctcacaccatgcctggcccttaagaagtgctcaataaatgtctgaacaaat

SEQ ID NO: 661950 - DNA, 339 bp, Homo sapiens
  misc_feature (29)..(29): n is a, c, g, or t
  misc_feature (34)..(34): n is a, c, g, or t
  misc_feature (41)..(41): n is a, c, g, or t
  misc_feature (69)..(69): n is a, c, g, or t
  misc_feature (108)..(108): n is a, c, g, or t
  misc_feature (220)..(220): n is a, c, g, or t
  misc_feature (336)..(336): n is a, c, g, or t
tttcaaacataacgcaagaaaatcctggnattgntacttgncttgaaaatcatcctcacaaactggggncagggcaattcctaacatttcggggaattaatgggatgncagggttaaatgggtctatataacaaataacgggggtatcggcattttcttttaggattgggggcaccacaggactgggaccatatttacatggggggataggtggccaagntaaggctcctaaaacaggtttttttggatcactggggggggaggtaaaacatccaaaggggcttattgggggttttaggaaccctgggggacctttagagattcacacagctatgnttg

SEQ ID NO: 661951 - DNA, 285 bp, Homo sapiens
ataggatccccgcatcttgggatcttctgttatttaaaaaaaaaaaaaaaaaaactaagattttttgttttaaaaactttgagaggtttagccggctttttcacagcttagaattcaaacgggtaacataataggtaatccaggagcgtgtctaataagtccatacaggggttttgaccatgctaaatactggggaagttagaagcatccagcccttgaagataaaaattgacctgtcttaaattgggtgggacagagaagagagatcccaaaatgccttgggcc

SEQ ID NO: 661952 - DNA, 117 bp, Homo sapiens
ataatagcggacccacggtggtgtactgagggtcactgagcctgggtaggtcatgctggagtaaaccgtgatcgcccactgcactccagtctgggaggcagattgagatcctgtctc

SEQ ID NO: 661953 - DNA, 191 bp, Homo sapiens
gaaaaaaaaaacccctaaaaacaacaacagaaaaaatcaaaccaacaccaaaatatagttaaaacggccttttagtgggaagagagagactcggtctccaaaaaacaacaacaacaacaacaaccaacaacaagccaaaccaaccacagattagttctgtatttattgatttatttggagacagcatatca

SEQ ID NO: 661954 - DNA, 736 bp, Homo sapiens
  misc_feature (512)..(512): n is a, c, g, or t
  misc_feature (550)..(550): n is a, c, g, or t
tcgctctacagacggtgttctggctgttaggcagcctattttcacagaacagagaagcatgttgtggaacaggtatgaccccagcttactaattgtgtacctgtttttttttcatacttatatgaaagactacatacttaaaacactggtgattatatttaggacctgaaatcataagattgtggtcttgctttttacttatttctgtatcttagcgatgtctagagttaataagtgttgcttttctaatcacagcaagtcaaggtgactgctgagggctgtggccagcctgaggggtggccgtggggctccgggggcacccctggaagtacttcctggctgagtggggagtaaggggtgggagttagggtgacctgaggcctggctgaggcagtgagagtgtagcaggccgtcatacggggccggggcctggggcagagaggatgctgacgtgcaggtaccagcggtgttctgtggagatgtctcaaaggctgttgactttggaatctganacttagggctcatccaaatggatgttacatttgcgggngtgtgtttaaggtgcagcgtatgaataaattcatttcctcacagatctatacactgaatttcagcatcactcatctcaagaccttggccctcttccctttcctggcctgcttcctgcagcatgtaatttgctagtgtccagaactagccagtgtgccttttctttccacacgcactgcctggttca

SEQ ID NO: 661955 - DNA, 380 bp, Homo sapiens
ctgcgatctgagtgcccgacgtgacctccacccctagtgcctgtgatctgactctgtccgacgtgaccttcacccctagagcctgtgatctgactgcccgacgagagctagacacctagtgtctgagatctgagtgcccgacgtgacctccacccctagtgcctgtgatctgactgcccgacatgacctccacccctagtgcctgtgatctgactctgcccgacatgacctccacccctagtgcctgcgatctgactctgcccgacgtgacctccacccctagtgcctgcgatctgagtgcccgacgtgacctccacccctagagcctgcgatctgagtgcccgacgtgacctccacccctagtgcctgcgatctgactc

SEQ ID NO: 661956 - DNA, 346 bp, Homo sapiens
  misc_feature (191)..(191): n is a, c, g, or t
tcaaggaggggcaaccaacttccccaaggggatattggtccttttgggcctttgggacccttgggcaagggggctttctcctcagggccaacttcttccctggaggaaaaaaggaaacaagggtggtccccaacccctgccttttgccccagcattttcaaaacaaagccttcaaaaaggcagtgtcttgncaaaggccccaggcaattcaggcctttttttggtccatccccctgcctcccattttgccccacacctgggatggggcaaggaaaaattttccccccttagttgggcaaccaggagggcccccgggaatggataataaaaattctaaagaacttga

SEQ ID NO: 661957 - DNA, 343 bp, Homo sapiens
  misc_feature (11)..(11): n is a, c, g, or t
  misc_feature (52)..(52): n is a, c, g, or t
  misc_feature (54)..(54): n is a, c, g, or t
  misc_feature (60)..(60): n is a, c, g, or t
  misc_feature (68)..(68): n is a, c, g, or t
ctctcacgtgntcaggctggctcgaactccgactcaggtgatctgccgtgtngnctccanagtgctgngattacaggtgtgagccacgtgctggcaaatttgtattttccatggaaattccgtatgttgagaagagtggggggaaaaatggaatggggaggcatttaggagactaattccaggtccaggaagaatattatattagctggggacaatagtaatggaaatggtgagaaacatcttgatttgagagtttaaatctgaggaaacttgtgatagattagagatgaggggtcatctctaattctctggtgcaaaaccaaaagactgtgtggtgccattg

SEQ ID NO: 661958 - DNA, 303 bp, Homo sapiens
  misc_feature (74)..(75): n is a, c, g, or t
gttattcatagaattttagtctttggctaggcgtggtggcccacgccctttatcccagcctttggaggccaaanncgcggatcacctaggtcgggagtttgagaccagcctgaccaacatggagaaaccccgtctctactaaaaatacaaaattagccgggcatggtggttcatgcctgtaatcccagctactcgggaggctgaggcaagagaatcgcttgaacccaggaggtggaggttgtggtgagccaagataatgcctgcctgggcaacaagagcgaaactccgtctccaaaaaaaaaa

SEQ ID NO: 661959 - DNA, 146 bp, Homo sapiens
atcctcctcctcctgtgcgaatcctcctcctcctgtgcgaatcctcctcctcctgggcgaatacctcctcctactgagcgaatacctcctcctcctgcaatgtgattgtatctgtacatagtgcaatgaggacatacgaatgtgat

SEQ ID NO: 661960 - DNA, 297 bp, Homo sapiens
  misc_feature (55)..(55): n is a, c, g, or t
ctgtgttggccagggtgttctccatctcctgacctcgtgatccacccacctcggnctcccaaagtgctgggattacgggcgtgagcaccacgcctggccaaacagtgtgttattgacacataaataggcaatagactaatggaacaaaatagaggatcagaaatacatccaaatacgttcaggaattttggtatatgattaaggcatcatcttaaatggtgttgagacaattagccatgtggaagaaagattaatttagactcatactgttactacttactattattattattttaa

SEQ ID NO: 661961 - DNA, 874 bp, Homo sapiens
ggattgtgaggcctccccagtcatacggaactgtaagtccattaaacctctttcttttgtaaattgcccagtcttgggtatgtctttatcagcagcatgaaaatggactaatacagtaaattggtaccaggagtggggcgttgctgaaaagatacccgaaaatgtggaagctactttggaactgggtaacaggcagaggttggaacagtttggagggctcagaagaagacaggaaaatgtgggaaatttagaacttcctagagacttgttgaatggctttgactaaaatgctgatagtgatatgaacaataaggtccaggctgatgtgttctcaaatggagatgaggaacttgttgagaactgaagtaaaggtgactcttgttatgttaacagagactggcggcattttgcccctgccttagagattctgtgaaactttgaacttgagcagagatgatttagggtatctggtggaagaaatttctaagcagcaaagcattcaacaggtgacttgggtgctgttaacaggcattcagtttcaaaagggaaacactataacaaaatttgaggggtgcattaaagtttggaaaatttgcagcctgacaatgcaatagacaaagaaaatcccattttctgacggtgacttgggtgctgttaaaggcattcagtttcaaaagggcacaatactgtaacaaaatctgaggagtgcattaaagttcggaacaatctgcaacctggcaaatgcaatagacaagacaatcccaggccaggcacggtgactcacacctgtaatcccagcactttgagaagccgaggcaagcggatcacattaggtggaagtccagacaggctgagcagatggagaacccgatta

SEQ ID NO: 661962 - DNA, 1157 bp, Homo sapiens
ggaggggagaggaaaaggaaggggcaggagagagaggccgggaggttgggaaagggaggaggaaagcattgaaaagggtgcgctgggaaaacggggagggctgcagagtgggcactgttgccctcactgccccggccggggcgagagcggtcctgcccctcgagctgcctgggtagtgcctggtggcctgtgctgtggtgccctgtgaaggctgactgtgggaagtgagcctgaggcttgtggttattggctgggcgcctgtgtgctgctgctgcttgggtgatggggcgtgagctggctcgggggaagtaggtccggggagagtgggcgggggtggctgccctgttgacaaggtgtttgcgggcgctggcggaaggcccggacagcggtcgccgtacccctgcccgggtggacgtgggggtctttgagggaacacaagcaggcacttcacgcatttggcaagattgaaagaaaagcggaggggccacagctggattgcacgaggcccctcatcgccactgggccatccatgggcgttggcttcgacggggtggaccgacacgattcgcttgggggaacccggctattcctgaggacttcccggggggatttaccgcggctttcctaagaaagacgagggtgggagagggccttgcgggggatgaagcgggccaaggggcatccagggaacgtggaacaggccaccggcttccccgtgtagaacaagggcacgggaagtagacgggggaggccctgcgcggcgaggtactttccgccacgcccggttggtgtgtagcagaccagctttgacatgtgagacgaattactttgcaggaccttgtggggagagattgaggagaaaagaattaccttgattgacacgtgggccttgcgacttacgatcgttcattcccaaccgccgcgggtggaggtggaaaacaaattcggaacaggggcaagagcattgggcggagacgaacagtggcgacttcacccgcggcgatccgaaagtgggacaccgacggggaacgcggggtgactttcgcaatgggtacctctctgacgagacattcgtgacccgttacgaaccagttcttgattgtactgggaggacttttagagcccgtctacgagtgaacatggacaggtgtctggac

SEQ ID NO: 661963 - DNA, 170 bp, Homo sapiens
  misc_feature (43)..(43): n is a, c, g, or t
gaaaagactgtaacgaaagagaatcagaattcctatttctcanaaattgtcaaaatattagaagtacattcaccgtcttctcttctgctcccttacactattaacagatccattactggaatttctttctagcagtgagggtaaccctaaatttctgtgccctatttcaa

SEQ ID NO: 661964 - DNA, 643 bp, Homo sapiens
tttatcttacttctgaaggcataattactgagtctatgtttgacattcgaaaccttcgagtgcaaatctagtcacatgatgcattgacattaagcatcaagcgcagaactgtaagatccgggacattaaggtagagcccgtttcatgtctatgcaataccaaccatcagttctaaacatgtctattcattgtcatagcagtcaatgcacatcgcaacatactgcaagttggaacacatgatgacattctggcatgtcacatgttgatatcgagaatcatgtgatgtctctagcattcacttggtacacagcttaaagccattgatatgtccgatgctggatgagggctcctaggccacaatttgtctcggtagatggtatcaagtgatctcaactcatcctcagatgtctcgagagcaacacttgtccatgcagacgcatgtaaggctttcactcagttaaacggatcttagaatggacactgttgaagattggtagcaaaggcaatcttcagttaggctttgaaacgtaggtctcaaagatcttttgtaagatatgcaacagagctcatgtgtgcgtctgtgcgattcaacaccagcagataagttaagctaattaggcacatcaagtaaatatgggttaac

SEQ ID NO: 661965 - DNA, 205 bp, Homo sapiens
ttaagtttagattaatgtccatttaaaaaatatgttgcttctatggttaggtaggctacgaaatctgcccttccccaaggttgcaatgattttctcttttgtttccttctgtaagttatagtttttgtgtgagccattctgagttcatatttttagttgtggttttatatgaagtcaggttaaagttattgatctcatgtgtaaa

SEQ ID NO: 661966 - DNA, 421 bp, Homo sapiens
atgtgctggttccgcacttgtaaggcagtacttgcagcaggttcttagctcttgaagctcttccgggaggaggaggtggtggagacaaatttgactgctggagctgctacccgcgccagtgccaaaggccacccccgagccctcgtgccactggcttgcacttgaagccatgagcccccgcacactagagcccatccacgttaggcctgacacccgccactgcatgcatggagtatgtagcttccacttgcgcacctccggcaatgacctccacctgaggccgccgccaagacctccaccgaggccagcgccatagccactgccactgccatatccagaggaaacactgcttgtgacaacagagatgttgactggtccaactccttctccactgagtctgcattcctcgccctccagcagc

SEQ ID NO: 661967 - DNA, 154 bp, Homo sapiens
ccccacatggtgcctgctccccattgccatgagggtatatattctgccatgagtgtatgcttcctgaggcccacaccagatgcagatgttggtaccatccttcttgtacggccttcagaactgtaagccacataaacctctttgcctcgcatcg

SEQ ID NO: 661968 - DNA, 978 bp, Homo sapiens
gctcgagtttcttttttttttttcttaatgggcttgggtaagggaggtagggggtagttggtgttaaatattttaagtggggtgatgaggaatagtgtaaggagtatgggggtaattatggtgggccatacgggtagtattaagtgggggcattccggaataggccgaaaaagtgttgtgggaagaaaagttcaaatttacgcccgatgaatatgatagtgaaagtggatttgggcgtaggtatgggtctagggtgctaccctgagaaataggggaaatcagtgaatagaacgcctccaatgagagggcaaatacaggctccttatggatacggacatacacgtgggaacgtagagctacacacgtgaagacacagtagtacgcggaacgaaaacagaggtacaacgtgagacagacgtaaggcgactaataaacaaggcccagtacaaggggccaacactaacagggaagacacagacgcacacggagtagaaataccataaggcgcctcacaaaaggcacacctgagaagagcaaaactacatacaccacaaatgcgcataacacaggggacaaatagctgggcggacggcaacgcaagaaataacattcggacccgaccgggtcgggagaaataagcagaacgtagaactatacgacggtatcagcgcagaaaagagcgacacaaaccagtgcccacgagaagatgataactaaaggtagagacaacacaacaaaaagagggcgtaacagcaaagataaagagagcggctaggacacacaaacagaaatagaaaagacccacagtagggaagaagagccagcagagggcacaaataatcatatgacacgccaaaaaaaaacacagaaccacgaacatgtggaaggaccaccgaaaaggagagggaaccatagtaaaacacgccagaggaaggaaagaacgaagtagaaaaacaaacacatgggaagaaaacaaaa

SEQ ID NO: 661969 - DNA, 347 bp, Homo sapiens
  misc_feature (12)..(12): n is a, c, g, or t
ggttctctcttnccggacctggtccgagcaggaggcgccatcatgggagtggacatccgccataacaaggaccgaaaggttcggcgcaaggagcccaagagccaggatatctacctgaggctgttggtcaagttatacaggtttctggccagaagaaccaactccacattcaaccaggttgtgttgaagaggttgtttatgagtcgcaccaaccggccgcctctgtccctttcccggatgatccggaagatgaagcttctgccggaacaagaggccgtgttttgggccatactatgatgtcggttcagaggcccaactgaggttttccctcggtacaccgcccagcc

SEQ ID NO: 661970 - DNA, 197 bp, Homo sapiens
  misc_feature (29)..(29): n is a, c, g, or t
gtcaccgaggctggcgtgagtggtggatnccaactttttcagttttcttgataggagagtggtcccaatgaccgtttctaccattactggaaggttgaagtttgatgtgtctcttgatattcccatactcatcattactttagtatgtacttattgccattaaaataaaacaaaaataacttaaatgtattcaacat

SEQ ID NO: 661971 - DNA, 972 bp, Homo sapiens
gaccttcctggattccatgagggcatgatcttagaggaagcggctgccttgttcgttcgattagcattatgagcctacgatggtccggctttgatcttcgggaccctacagtcctggactgagtgtcttggtacatatgggtgctgggggtgtgggtattgctgccgggccgattgtggcgatcagctggagaatgtgcatcagtgatatcggaactcgagcctctcgaggcaggcaaagtcgaactgaggacacctgaaggataattggggtcacactatcccatggactatcacgcgactgactacgtgtgtatgagtatcagtgcaataattgctccttaaatagtgatgtgctcatggtcatgggctcctcagcgtcgtagtcagactatctggccttcggtgactaccaaatctccgtgaggaactccaatggcgtactaacggagtcgatccgtagtggaaatggacaaatactaggctagactagggtccgtatagcgggcaccctgatttggcctctggccccgtgaactcttgggtcgtacactctgttcccaggttgatcaatactcctcgcgagcattgttttgcacgtggcaaaacgagtggacttgtagtttgggaggctttcaggcttgggactatccttgggaattggtagcaggtaggtgccgtggcacaagattgattgttgctgagcatgccgtcagtgtgtctggtcactatgtggggcgcctatcaattctcctttcatggaactccaggctgggtccaatccgagaagggtggcctgtgggcagtgccaagagactgcggggccgccgacacactgttgggcaggggtcctcctggtggccaggggcatagaaaggggcaccaaagggggtgggggggtggcccttaagaccaggaaggagagggtcgggaggcacagtcgttgggacggattggaccagcggtgttaaag

SEQ ID NO: 661972 - DNA, 104 bp, Homo sapiens
acacttattccgaagcctggtaggataagaatataaccttcagtggtgaccgaaaaatcagaatagttgttggtatagaatggggtctcctccccgggatacag

SEQ ID NO: 661973 - DNA, 868 bp, Homo sapiens
  misc_feature (51)..(51): n is a, c, g, or t
tggagacagagttctcacttcgtgtcaccttaggcgtggagtttgcagggngttggactctcggctcacgtgcaaccttccgactccgtgggtttcaagacaattcttctgcctcagcctccgtgagtagcgttgggattacagattgtgcaccagcacacccggcataattttgggtatttttagatagagacggggtttcgccatgtgtttggccaggcgtggtcttgaacctccgtggccttattgtgactccgcccaccttgggtttcccaaaggtgctgggatttacaggcattgagccaccttcgccgtggccagattgctagcatttttagattcaaacaatctcatttcagatgaattggtttggttttcacaatcattttaactcatttttagaagtgtccttcaccatttattagctgggtgtaagggcaataagggtacaaccatttccctataattccatctttaactcacaggcttaagtttaaattatattcttccaatggcctaagttattccctagaattaccggggcactttgggaacgcagcaacggtacacagcagcagcaaacttttcctctcatattgggggtgtctcaacaggttctagactttggacagtaatgattccaggtgcccacttatatttctagggaagagtgtctacttggggccggatatttggggccctattggtaggaacctcaaggaaattacttttggaatacttgataattacgcggttaagcaattttaagggagaattggtgaccacaaaggattttccatcggcttgttgtgaataaaatgggggtttttgagaattagccagattacagtgatggattaaaaacgtt

SEQ ID NO: 661974 - DNA, 1127 bp, Homo sapiens
aaatgcttggccagtgggtgcctctccatctccatgacctcgtgattcacccgcctcggcctcccaaagtgctgggattacaggcgtgagtcacagcccccgtgccataactttagcactttaaacaaataactagccatgtatgggccgtgcgctgtggtggctcatgcctgtaatctgagcacttatgggagaccaaggcgggtggatcccttgtgcccaggagttcaagaccagcctgggcaacatggctgaaaccccatttctactaacaaatacaaaaattagctgtgggcgatgtgtggataggccgagttccgggctgctacacggcggccactcagccgacgacgcagatgctgagcgcacctgactctatccggattgtgtgtggctttccccggcaacgctggaccctcacggagcatgaaacggaacgactgcacgacggattatgattctccataccacgaacttttctcatactacagtggccctgctgcgagtcaactccatattatctactaaagacaacatcgcgaccagcccactatgaaagatcggaccactcacatgtagcaactgcatgactcatgacgagcctggttaccacgtctctacctggaacttctgccaagtcacataggcccaagaaaacggtataccgacagcacctcctctctgaccttggccccatacacgacatactcgcctacgcttacaccgcaaaccaacgctcggacgcttcttgctaacctctgacttctcacactacagctaccctataccaacttattcggcgaacactcttgatcctgagtcttcctgtcccacggtggttccccataactgacttgatgaccacactggccatctgataaaatatacgcggacttaattggtaaactaactgtacaccactcccacaacctacacacagacatccaccatcaccgcgaacgactcgctgcagacacaaacaaaaaacaaaccatcaagtacgccccaccgcagccaccaaagacgcacccacccgcccgtacgcacggcacaggccaacccctccgcccccacatttagcacagcggaacacccaggccccaccggacccaaaaatacaaccgacg

SEQ ID NO: 661975 - DNA, 852 bp, Homo sapiens
  misc_feature (5)..(5): n is a, c, g, or t
  misc_feature (65)..(65): n is a, c, g, or t
  misc_feature (129)..(129): n is a, c, g, or t
  misc_feature (244)..(244): n is a, c, g, or t
  misc_feature (246)..(246): n is a, c, g, or t
  misc_feature (282)..(282): n is a, c, g, or t
  misc_feature (318)..(318): n is a, c, g, or t
  misc_feature (324)..(324): n is a, c, g, or t
  misc_feature (483)..(484): n is a, c, g, or t
  misc_feature (497)..(497): n is a, c, g, or t
  misc_feature (507)..(507): n is a, c, g, or t
  misc_feature (512)..(512): n is a, c, g, or t
  misc_feature (517)..(517): n is a, c, g, or t
  misc_feature (522)..(522): n is a, c, g, or t
  misc_feature (527)..(527): n is a, c, g, or t
  misc_feature (530)..(530): n is a, c, g, or t
  misc_feature (551)..(551): n is a, c, g, or t
  misc_feature (847)..(847): n is a, c, g, or t
aaaanataaataataatggaaaaaataacataaaacccaccaccttcaggcagaacaccgcagtngggggaagatgcatagaggtgggggaagaagtgtgaaaagaaagggcctggatgggtgggggtnccaaaaggacctaagcagcaggagacccccaggagtgggctttaggcccagcagctcccccttctcaaggtgagtccagaggccattctggagtgggcctgggtaccaggccatngnggtactccttttggtaccaggctggcctcctgattnctgaggcgttggctcggcaccccatgggggactgcnctcctncaggcctggcacaaagccagggggctaagagcagtctgcaggacagagggcaggaccacagcagggagggggctcctatgccagctccccctcatgccatatgaggccaggcctgtggctcgaagcccctgagctgggcatgtcctgagagtttgggannatccagggggtgnatttttatcnttagntctgngtagnttttnatntcttttttcagggttttttcntttttttatgtttcagcgcctcctccacacgtccatgccttccaccttgccacatggagcacagccgtgcccccacaagccagagggaacaacgaagctgccttgacctcagcactgaggtggtgggtagcatgaaggaaagatggtgcgcccggtggtttaggacacgagggtcccggtcccgaggctctgcggagcccgcactgtctggatggcctgctggttcttgaacttgaccaggcctagggtgatctgggcgttccagccgggatcttccagggggcagcggaagtcgntcttt

SEQ ID NO: 661976 - DNA, 326 bp, Homo sapiens
aggtgacccaagaggacccccacggggatacgccccttgacaattagggccacaggggctgccacacgcttcagtaggcgcttcagcggcagcagcgccttcagcaccatgttgtgcaccatgtgcgcgaactgctgcacgaagaagcatatagcctccgtctcagactcagccttacagtctggggtcagctttgcccggtagctctgggcgtaggccagcacgtaggtgggcgagccgacgaacaggaagaggctgttctgggtctggtctggcctctgctgggcctgcagctgggagcacatttcaaaggccacgcaggcccc

SEQ ID NO: 661977 - DNA, 1380 bp, Homo sapiens
  misc_feature (376)..(376): n is a, c, g, or t
  misc_feature (587)..(587): n is a, c, g, or t
actcagagatccaggacgggtgctgcaccatgagtgtcgtctgtgctcgagccccgagccagactcctggcgtgcatgtctctggagatcgctccaagcggactccctgctcaattacgtagtttgctgctgggttggtcaaggcaagttcaggtctacctggtgaggcagctggttgctcagggtgctcctagcagttcccgtgcgccatccctaccctactaggactctttcggcgcagccatcgctagggagctccataggagtgaccacggtagctcacatactgcgattacagaaattgcggtcgtgagacattacccaatgtggccgtgtccctcatgtggctatggagggagggcaaaagtccgtggtncaccgtcttcctaatgtacccttgcaactccgtacttggacacggttggactctctgtggggacgcacttccttgggcctcggaatgatttcgcccagtggggtttcccttaccatggatttgccttgggctaccggatcgggccttttggggctatccgggctctggacttcccttggcttggactagtttggggcctaggaaccaaatntggtttgcactaggcgctcactccgcagcgtgcaagggactttggagagtccacccagggcgcactttttccctcggcattaagtaggaatccattgcaccttgtgaacaagtggcgccgcctcaaatcgtttggggagggggcctctcccacatgcgggaaaaggaacatgtgcttctgggtaccaggcacgttggcaaaggggtctttggggcgaaccccacccatggcgggagaatgcgaagcggctatctcgcgttttggggggcccacgcggggatatttcgagcaccgggtcctgtgggaagagggggtgacaccacttagtaacagacggacgaaggtcacatatgcagccttgtggaatgtggcgacccccgggggagaaactacaacaaaacagttgtgagcacagtgttggtgtggcctgttctaaaaggcccaaattaaaggcggacgaaggagcatctccaccaacgaggttgcgcacaggggaggacattttaatcctcacgtaggaccgattcagtgaattaaaccgcggggcgaccaagtctgatatgttgcgaactcgcgtggggaaacaacaaacacccaggggtttttcattaaccccccgggttgtctcgacacggacaattcggagcttatacgaaccggccagataatagtgagatcggcgggttaactcacacaggtggttgggaacattcgcactaggacttgggtgcacagagttggggaacaacaccgcccggggggcactcggcaccacattgttggggccccaaaa

SEQ ID NO: 661978 - DNA, 122 bp, Homo sapiens
gcttcattacagatttaattgactgactaaatgaaaatgcctacccactcacagaacattcagtgtaaggtaaaatagacctgaggtatgttatgtgagtgggtaggcattttcatttagtc

SEQ ID NO: 661979 - DNA, 259 bp, Homo sapiens
gaaggcaaggaccaatgtttgatcgtgaaacagatgtcatgtggatagcattactatgtctgcacgtaattatacagagagatagatttgtgtatacacctaccactagcacatcctcacggagacacatgtgctcattgtctgttcttgtttgtgatggtttcaagctggcacttgcattgtgttatggtttgggaacccaaaagtaatgcatcgtgttgaaataagacagagttgttctcgtcagaaaaaaaaaaaa

SEQ ID NO: 661980 - DNA, 126 bp, Homo sapiens
ctgagctgacatacaaaacgtattcagctttataaacgtgtgataaaagataccgctagagtcacggacattcgacaggatcaaatcataatagaaatgaagatgggggtgggttggggggggggg

SEQ ID NO: 661981 - DNA, 122 bp, Homo sapiens
ggcctatgatttttgaaaccagcccccccttcaatcagatcaaaggaattccattctgttttaaaggcggggattcggcttaagatttcatttgaaaaaaagaattttcggcttaaacccca

SEQ ID NO: 661982 - DNA, 482 bp, Homo sapiens
tgtgtccggaacttccttgtggatattgtctgaccctactgctgctctgggccctgtgccccctgccgtgccacctggagtgtcactccacctatccccacacccaatcactaagttataatgaaaatgatataatagatacttacaacaaccacagaaaacgaaacacaacaaagcaaaacaatactataccactaaacataatatacaaacaacaacatacaaatcatcactacacacataatcaaaaaatacacaacaaaaacacagaaaataaaaaactacacaacaaataaaacaaaacattatataaaaacaaaaaaacaaaaaaaaacacaaaacacataaaaaaaaaaacaaaaaagaaaaacaaaaacaaacacaaaacaaaaatatagtaagaacattaaacataaaaaacatacaaccacacaacacaccacacacaaaaaaacaacaacaaaaaccaaccgaacacacac

SEQ ID NO: 661983 - DNA, 407 bp, Homo sapiens
ggtatctagaggatccgaggactctagcctgggctccagccaccccccatccccacagagctattgagccagtaccaactcagcaactccctggaaagagcctccaatgtcaactgaaagcttctcagccactgcctctgcagtggaactgctcttgccaccctcagactaatgaaggagcaaaggcccttctccacacctccaacaagctgcagttgacccaaggagagaaggccagttatttcccatgggtcccacacacaccccatggctcaccaccagacaggtttctccttgcttgggcccacagcacaaaccctccatcttgggctgactgcactgagtgactgctgacctgcatatctctgaggtggaacccccggagtcaagcaaactagggtaccgag

SEQ ID NO: 661984 - DNA, 686 bp, Homo sapiens
  misc_feature (374)..(374): n is a, c, g, or t
  misc_feature (518)..(518): n is a, c, g, or t
  misc_feature (535)..(535): n is a, c, g, or t
  misc_feature (588)..(588): n is a, c, g, or t
  misc_feature (612)..(612): n is a, c, g, or t
  misc_feature (680)..(681): n is a, c, g, or t
ccctcctggaaataaaggttaaccccgagctatttaccagccccttttttttcaaataaactctccaacctaaacccctgggcgggtggccagaaatccaacaagcttctttcgccctttattcatataaccaaaatccaggcctttatccacaactcgggggcttgaaaagaaaggtattttgaaatcacaccctccggtttatgttgctccagtaaaatctgcctggaaagaggcagtcttcttagcatggtgagctgagttcatggcttttttttgtagccagtcctgtccctggccatccatgtgatggttttggatggagttaaactttatgccagtgggcagtgcatgtggaaagtatcaaagtaagnctctcccctccaaagccctgagttttttggctgcatgaaggttttctttaaaatcagaattgtaaccagtttttttggcccgaaggatgaatacttggatattacttaaaaggaggggtggaaatgggtgtggcagtgtatggngtgtgatttttattttnttctttggtcatgggggccaaggaaaaaggcatgaattttccctgtcaggctnttacaaccccaggccctgtgtttnctgtttggaaaacatgtccccgtggctgtggggcccctgcttctgtttaaataaaagtggcctggaanntggga

SEQ ID NO: 661985 - DNA, 1587 bp, Homo sapiens
gaagtgctacatccagccaataacatggtaccgcacttaggtttggccgcatggagcccaagatccaggactatctacctggaagactgtatggtcaatgttataccggattcttctgtaccagtagaagaatccaatgttcacatcttcaagccaggattgctgttgcatgcggattgtattatgcacgctctcaaccacccgggcgcactcgtggtcccattaattcacgcgcatgaatcctggtaatgctgaacgtcttcctaggccgaggaaatactaacgacggctcgttgcattgctggtggacctactaatcttgactgactctgcgcggttcacgagatggtactccgatagacttgggaacgggctagtgtgccacgttgtctgccgctcacccatgtcgctgggcgccactgctaagccagcgagtcctcatcgaccggcgtcacgcgccggtcgacacgaattcccttgccactctttgcggaccctaggctgggcccctggaaccttcgaccttagagtgagccttgctgtgcaaccttagttcccttgaccttctccccgagctgcccctctggccaaacgtgttgcaccgcaaggcacggtaggtaccccaagggcaggttatctagtagctagattgtgcgctcgcaaaagtgaataaccccgcaggacacgacgtgctagcctatcccagataacgcccctatcgagatcccttgcttcaccgacacggggcgaccccagtgaggacgcgctactccgggaagtcagattggccccaaggaagtgcccctagacccggtgggccccaaagacgcagagacgtgaccttaacgtcaatatgaccacctttacaaacccgcgttgagtagttcccattatcatcctcctttttgagttttaaatagaaaggcagttgtattccggcgttggaacccacatagaacctcggccaaccacgtacagctttcacagacgtaacccatgttccctctatattacacaatgaacagcacgacgtgtggggcaagcatctcccccttgtcatgacgagacacattacacaactccgcccacataaagcagttagaccgccagtctcccacaagacgcttctcaaattcgccacttatgaaatccgctggataggatcttgtgctgtgtgcatcaacataccccggcgtggtggcggcacccccattgataatgatcgagccacagatctgctagccacactcacttagccaatggactccattgagaccgagggatctacccccacccgctaatgtgtattaccaccaataacatactatatatgactcctcgaatctcacagcggtaacattccccatggtgcctctgcagagtatatctgcgaaaattgtccctcaaggtgaagaaacaccgacaccacacattatctattcatctatggacaagtcagatgggatcgtaccacaataatcactgtcccgatgcccaagatacacctacccacaacgcaaaacgtccaccttttcaacggccatcagcagtcataggcgcatacccacattccactaagcaccccac

SEQ ID NO: 661986 - DNA, 235 bp, Homo sapiens
ccacgagcgccccaagctccaggacgcagacctcaccctgtaccagaccaataccatcctgcgcaccgggccgcacccttgggctctatgcgaaggaccagcagcaggcagccctgggggacatggggaatgacggcgtgtagaacctccgctgcagatacatctcactcatctacaccaactatgaggcggtcaaggatgactatgtgaaggcactgcccgggcaactgaagcc

SEQ ID NO: 661987 - DNA, 685 bp, Homo sapiens
  misc_feature (374)..(374): n is a, c, g, or t
  misc_feature (518)..(518): n is a, c, g, or t
ccctcctggaaataaaggttaaccccgagctatttaccagccccttttttttcaaataaactctccaacctaaacccctgggcgggtggccagaaatccaacaagcttctttcgccctttattcatataaccaaaatccaggcctttatccacaactcgggggcttgaaaagaaaggtattttgaaatcacaccctccggtttatgttgctccagtaaaatctgcctggaaagaggcagtcttcttagcatggtgagctgagttcatggcttttttttgtagccagtcctgtccctggccatccatgtgatggttttggatggagttaaactttatgccagtgggcagtgcatgtggaaagtatcaaagtaagnctctcccctccaaagccctgagttttttggctgcatgaaggttttctttaaaatcagaattgtaaccagtttttttggcccgaaggatgaatacttggatattacttaaaaggaggggtggaaatgggtgtggcagtgtatggngtgtgatttttagtctccttccgcgtcgggggcgcccgccagaggcccatgaatcttcccggcccgcctctgccccccgccggcttcctgtaagctgtttgaaagtcctgtccccgcggtggggcggccgctgcttgtgtttaaataaatgtggcgtggacgctgga

SEQ ID NO: 661988 - DNA, 390 bp, Homo sapiens
atggtcaggtgccattccacacccatcaggatggctcttattaaaaaaacagaaaatagcaagtgttggcgagaatgtggagaaattggaacctttgtgtactgctggttggcaagtaaaatggtgcagccaccgtggaaaacagtaaattggtgattcctaaaaaagtaaacttagaattaccatatgacccagaaattccacctctgggaatatatccaaaagaaatgaaagcagggactcaaattgatatatgtacacccacgttcatagtaacattattcagaatagccaaaagggagaggcaacccaagcatctattgatagatagacaaacaaacagataaacaaaatgtggtatatacatagagagaaatgttagtcactcta

SEQ ID NO: 661989 - DNA, 380 bp, Homo sapiens
tggttatcagttgtggtttataataatgaggagaaggaggaaagggttgaaaaaccaaacagaaggcccaagacatattttagacagtgacagccatcccctcaacactgacccccaaaccatgcattttggcttaggtacagttctctgtttcttggaaaaatgcaaataacctaaatgggattttaaaaaaataacagaacttttaaaaagtagttacaatgtattcaaaggaattctttcttaattatctaaaatggcttgaactgttatgcaagtaaggaattgcttttattaaatgccaaatctttttttaaagcaacctcagggagttactcattctcaatgagctgtgtctatgccagcaaaacaaaaagtgg

SEQ ID NO: 661990 - DNA, 679 bp, Homo sapiens
tgccttagacggaatctggctgcatgacgcacgttacctgcctagctgtccgacgatgtcgtcccagctagttgagctgcgagcgaccctgggaatactactaataagacattgcgatgaaaatgagacagctctgcatccgcgcgcggctaggcctcaaatgcgttcctgtgactggagcttacctcatgaatggcgagccatgcaaacgtcgaagtgattaatggcggatggtattgcactgctgggcgctggaagacgtagcatcctcatcattccatccacacatgtgacacgctgagtaataagagtgcttatagcgcttgcacaaggatgacatccaagggaccagagcaagaccatgagtgccagctctctacaatgttgactgtccccgtctctgccagcaatgagaggactgggcgcaatagtcgtgtgtagttgttggtcactgaacaatctgcgtgaggggcctagtctactcacgtgcataacatcagggactggtggtagaagcgttaccatagtgacagtacaacgtgctttgaaacagaaaagtgcgggatctggggtctcatgactagggccagcaccagcctgaggagtattccagacaatggaggttccattaaaaagagccttaatggttcgggagtcctatgctgctgtaaattgaccc

SEQ ID NO: 661991 - DNA, 1087 bp, Homo sapiens
  misc_feature (36)..(36): n is a, c, g, or t
  misc_feature (38)..(38): n is a, c, g, or t
  misc_feature (40)..(40): n is a, c, g, or t
  misc_feature (44)..(46): n is a, c, g, or t
  misc_feature (54)..(54): n is a, c, g, or t
gtcacttacatcttttcgccagattcctttgcactncntnggtnnnaatagttnatctatttttctttgacatcctagtttgcgtcagtgacagaacttactgcttagtctttgtactttttaaaaaatctataaatttaatgcactgtccaagtgaaatgtcctagttgtcattgtgattaaggggccaactttccaggcagctagcagagatactattctcttcctctcccagcaaatttgtattccttcgcccacgcattcctgctatactagatggcagccagtgatggaactataaagatgtctgtggtcatatgttgaatgtggcagcttgaagatgtactgccacgggtgatctagggcaggctgtcttccagtccatgtgttctcggtcgccgtagacagcgctctggctaccaccgtgaggctacttgaactgtcaggggcatctgcctaaaccagaatcttttgtcagaaaccttaacccaacaaaacaaatcttgagtagctcatgcccggctcttaggaattttgtctggttttaataaggaatgaaaagcatactgaaatgccgggggttaccttttgcgggtgccggaaaatgctgtatcgcccggtggtccctgggtcctttagtgggtcccgaaaccccggtttctttgttgcagggggtctttgagaatctggcgagttacgccctataaggggggttgtatgaaattgcgaatccagccgaggctcatcctggaatgatataataggcagaaaaccggtattgggacgacggggtcttgggccagactgagtacctactatcagtgacgccctgagttggactggacatgcgggtacaggcacagttgggaggttgtcggacttaacgttatggagccaagactaaataagtcctgagtgttccacaaccttcaggtgcaatctccctcagtcgaaagtatctcgagcctccttatgcacttatggtacaacctgcgatctggggcaagtctgccacaccaatattcaagttacgctatagccgcacgtctccttagttagctttacacttataacgaacggaggttag

SEQ ID NO: 661992 - DNA, 121 bp, Homo sapiens
ctatctgtgctcaggatcatcgtggacgaacgtttctaccctgtgaccctggatgtgctgcaccagattttctccaagttcggcacagtgttgaagatcatcaccttcacctaagaacaag

SEQ ID NO: 661993 - DNA, 288 bp, Homo sapiens
  misc_feature (138)..(138): n is a, c, g, or t
agcagagtcgatctctcagagagtatccccgctgattagcgaggaactgcttgagatacatttcggctgggtgttttatattaggtaaaatgcttgtgttcatactggttggtggtgaggggactgcaagccgtgtantcttttccagatgcaaccttaaaatcagtgacaagaaacattccaaacaagcaacagtcttcaagaaattaaactggcaagtggaaatgtttaaacagttcagtgatctttagtgcattgtttatgtgtgggtttctctctcccctccct

SEQ ID NO: 661994 - DNA, 987 bp, Homo sapiens
  misc_feature (36)..(36): n is a, c, g, or t
  misc_feature (38)..(38): n is a, c, g, or t
  misc_feature (40)..(40): n is a, c, g, or t
  misc_feature (44)..(46): n is a, c, g, or t
  misc_feature (54)..(54): n is a, c, g, or t
  misc_feature (578)..(578): n is a, c, g, or t
  misc_feature (718)..(718): n is a, c, g, or t
  misc_feature (740)..(740): n is a, c, g, or t
  misc_feature (833)..(833): n is a, c, g, or t
  misc_feature (949)..(949): n is a, c, g, or t
gtcacttacatcttttcgccagattcctttgcactncntnggtnnnaatagttnatctatttttctttgacatcctagtttgcgtcagtgacagaacttactgcttagtctttgtactttttaaaaaatctataaatttaatgcactgtccaagtgaaatgtcctagttgtcattgtgattaaggggccaactttccaggcagctagcagagatactattctcttcctctcccagcaaatttgtattccttcgcccacgcattcctgctatactagatggcagccagtgatggaactataaagatgtctgtggtcatatgttgaatgtggcagcttgaagatgtactgccacgggtgatctagggcaggctgtcttccagtccatgtgttctcggtcgccgtagacagcgctctggctaccaccgtgaggctacttgaactgtcaggggcatctgcctaaaccagaatcttttgtcagaaaccttaacccaacaaaacaaatcttgagtagctcatgcccggctcttaggaatttgtctgtttaaaaaaaaaaaaaaaaaaaaggtccaacttacttntatttaatttttttaaccctagtcacggtttacaatggtttgctaaagccgtgaaatatggtcggtgctgggggtgtatgagcattggccaactttatatttatggcagtgaagaagaaactaaaaattatttggaaatngaggagctatgtccaagctccntaaatccgtgtggggtgcatgtgggagaacgtgagtaagggcctcttgaaaggaggcttttgggaaaggggtcccccaggtttctgggaggtncctgcttggggatcactgctgcatagctgattggacctccccattggaagttggtcgatttggcttgggcaaggtttcattggactagtagaactcattctgttaagtgtatattncactactaattgtaaccctttctgctcaaaaaaaaaga

SEQ ID NO: 661995 - DNA, 596 bp, Homo sapiens
ggcagagtctagttgatatgccacggacactcctttacgagcccggattcggaccacttggggatcccagaatcgctccctgacgatatcctggaaaggactgacggaagggagcgcctggtgggcacggctcggtgcgcgtgggaagatagacacgtgcgcttgccgggagcacttgagtcgtcgcatgaaggttacgggcccgttctcatagcgatgacggccatgcccactacctcgtaacgaacgtattgctcggggaagtgccattccacacgttcccagctccctgttggtgggagtaaacctgtatataatctaattgcgttactagtcaagaagggactggcgcattctactagacctgagtaattatccgtgaatgatgggcgagtggacctgcgtattctcgatggcgcccaaaagccctcgtacggtctgggtagtgtaacggggagggtcctagccctgcggcttgtggtaacgggacgcgcgtctatgctctgggcgttgaggttaccgtgcacgtgggctcgtaccccattggggtctgacggtaccgggcgaggggtccctatgcccttggccggtgcttg

SEQ ID NO: 661996 - DNA, 721 bp, Homo sapiens
gagatcattccgaatgtgttcccaccaccgactagaccatgctcttctcggacaccatgacagacgaggtgatagatctggcttctgtctccttgaggaactccgtgtccggatatttgtgagacaggcaacacatatgtggctcccttctctgacgagacagagagcttcactccgaggatccggcctaatcgtgaaagagaccgggaaagccactcgtggcacctttgttgacgacgaccttcaactgaccatgtgagtgctgttcacgcaaaccaagacatgcaggcccaccgccatgcacactcctcctgggtgcctcactggggctgcagcgctggtgctgaccctccactggtcaactctgctcacagacgcacccggctggcaggccctccggcgcttgttaaggatgaacagattgacatcctcgctggccactgatgtggcagcccgtggacttgacattgagggggtcaaaacgcgctaactcaacttcacaatgcctaataccatcaaacattatgtccaccgggtggggcgaacagcacgtgctggcagggctgggcgctcagctctctctgcgctgggagaacgatgagccggacagcatgctgcaaagcgagattgtacccagctgccaaggccccctgtgacgcgccagatacttccccacgatgtcatcctcaaattccggcgacagattgacaaatgggacgcc

SEQ ID NO: 661997 - DNA, 413 bp, Homo sapiens
gacatactcgtgtttcctctatttatatagctatcccatagagcaatatttttgtgttgctgtctagtgtatcactttaacttgaaagacttcctttagcatttcctgtagggcaggtctagtagtgatcaactcacttggaaaaagtttgtctgggtaggtcttttaaagaattttaatttttatttttgagacagggtctcactctgttgcccagactagagtgcactgcgccgatcatggttcagtgcagactcaacctcctaaggttcaggtgaacttccaagtagctgggactaccggtatgcaccaccacacccagttaaattttgtattttcagtagagatggggttaaccatgttgcccaggctggtctaaactctgggctcaaatatcatcaataaagctccaa

SEQ ID NO: 661998 - DNA, 173 bp, Homo sapiens
  misc_feature (62)..(62): n is a, c, g, or t
ccaggacccttaaaaaaagcatggcccctgcaaaaggatgggctcaaggacagcttgcctgnctgcacccataagggtgaagccttttcaggtaaaaaaggactccaggtggggcctgtgcaaagggtttttacggggccagtaggattggggctataaaatccgtaaatgga

SEQ ID NO: 661999 - DNA, 372 bp, Homo sapiens
  misc_feature (33)..(33): n is a, c, g, or t
  misc_feature (174)..(174): n is a, c, g, or t
  misc_feature (224)..(224): n is a, c, g, or t
  misc_feature (366)..(366): n is a, c, g, or t
cccccaaatatttttgaaaaatatttccttttnaatatcctgccatagttttgtaccccattataatttggctctggaagaagttcaagatatgcccaaatagtccttggcacaatggctcacacctgtaattctgacacttttgggggccgaggtaggaggatcacttgaggnccaggagttcgagaccagcttggtcaacctagcaagagctatttccacanaaaagtgaaaaaactacccgggcgtggtaacactcccatagtcctagctacttaggaggctgaggtcaaaggattgcttgagcccaggagtttgaggctgcagtgagctatggtcgcaccactgcactccagcctgggtganagagca

SEQ ID NO: 662000 - DNA, 311 bp, Homo sapiens
agtgctaggtcccctgtagacatcgtgaagttccagctctccaggttcctgcagggtccatatcataggattggactggctagaggtgaggagattggggctcagagaggcttacttagctgctcatttattagctagaaaaaccagaggttaaacccaggtctggctctcttcaaacctcctccttttccttggtgttggcatgctccttgggtaacatctttcatgcctgcagcgccaatgcccaccaggagtgtgcctgtgcatcccaaatcccatcacgttgctcagaacgccttcttgagcaccag

SEQ ID NO: 662001 - DNA, 782 bp, Homo sapiens
caaatatattatttttttaccataccaacttctctcccatctctaaggtggctcagatccagggccactccctgcccccagcctggttggacagcaatggaatccgacagcccacagctgtgatgctccctcctacacccccaggcggcgaagccccgtcctgccagtcccttgtcccctttcagcccacctagttccctctctgctgccggtgatgggaggcctttctagagctggctcttctctctcccgtctcaggggcgtttctctgcaggtgctgtacacgcgcgtataacctgttcccgttctctatccttccccgtggtactgagctcacgtggactcccagtgcgaaggggcccatgggtcgggctgcaggccctggcctgtagaggctggggagcatgcctgtcactgactcctcactagacctactacttgagtttaggggatggtagggaacatatcaccacgtgcccattgtcctcataatagatgtggtgacttctcccggtagagcctagacaaggcgtcctccatggtggtagacggcgattcacggcacaaagtcgtaggagatcggcggacctcgtgactgcctggcttgagaacagtccaggagtccctttgggagccgagaatgtgaacgtgactccccgtcatttgccctgaaaatgctgttcctcaccagatatgctccgcgtcccctagtcccgatacgagcgactaggcccagccgtgtatgcaaggcatagaccccttcccaacaaggctaaccctca

SEQ ID NO: 662002 - DNA, 205 bp, Homo sapiens
tagagacgtgttgcaatgttgcttaggctgtcaaactcctgggcttaagtgatcctcctacctcggcttccaagtagctgggaccatgagtgtgtaccaccatgccaagctaatttttttgacttttttttttctctttttttggtgaaacagattctcattctgtaaccaaggttgaattgaattggcttaatcttggtccacc

SEQ ID NO: 662003 - DNA, 360 bp, Homo sapiens
gtatggttatcgcccaacactaggaactacccaaatgtctgtaatggtgaatggttaaagaacctatgggacatccataccatggaatacgatccagccataaaatggaacaaacctttcacacaggcaacaacttggaagaacctcaaggaaattatgctgagtgaaaaaaaaaaaaaaggccgttctaaaaatgggggataccgacatagttcctatttagtgtaaccttccacaaaaaaataactatattaaccagagatgaaaaacagataaggggatggccagagggtaagagatatggagagagaatagattggtgctgaagaggagatagctcaaggggagtctgggggaaga

SEQ ID NO: 662004 - DNA, 196 bp, Homo sapiens
cggcagtgtgacgagtctcctgatgctagcaggacccgccgatagtgctacagacatgaagctcatactcttttcgcgcaagcaaatagcaagctgcaactgctcaaagattgagaaatgaaaatatgaagacaatcaaagatacttagaagataaagctcaagaattagcaagactggaaggaggttattggcat

SEQ ID NO: 662005 - DNA, 434 bp, Homo sapiens
  misc_feature (147)..(147): n is a, c, g, or t
  misc_feature (192)..(192): n is a, c, g, or t
  misc_feature (199)..(200): n is a, c, g, or t
  misc_feature (204)..(204): n is a, c, g, or t
  misc_feature (216)..(216): n is a, c, g, or t
  misc_feature (228)..(228): n is a, c, g, or t
  misc_feature (237)..(237): n is a, c, g, or t
  misc_feature (239)..(239): n is a, c, g, or t
  misc_feature (242)..(242): n is a, c, g, or t
  misc_feature (255)..(255): n is a, c, g, or t
  misc_feature (265)..(265): n is a, c, g, or t
  misc_feature (306)..(306): n is a, c, g, or t
  misc_feature (314)..(314): n is a, c, g, or t
  misc_feature (334)..(334): n is a, c, g, or t
  misc_feature (355)..(355): n is a, c, g, or t
  misc_feature (367)..(367): n is a, c, g, or t
  misc_feature (376)..(376): n is a, c, g, or t
  misc_feature (379)..(379): n is a, c, g, or t
  misc_feature (389)..(389): n is a, c, g, or t
  misc_feature (404)..(404): n is a, c, g, or t
  misc_feature (411)..(411): n is a, c, g, or t
  misc_feature (421)..(421): n is a, c, g, or t
  misc_feature (425)..(425): n is a, c, g, or t
  misc_feature (428)..(428): n is a, c, g, or t
tgtgattgccatttctttccaaggccagtttgaacctgagggtgctttatcctaaaagttttaaccccagggtcccaattcagtaaattttgggaacaggcacgctatttttcatccattttctatcatgttgaaggcaaatttggnttttccccccaattttgaatttgtagacaaacttggacggtcccntgccccnnaagnctcctctgtccncatttttttttnccccccaancngtntttttttacgccngtaaggcagntctgttgtgggagcaaatggtccccttattttagggttttnctctttgnatgatgaaaaaaatgtgttntgaatcggggctgtcagcccngctgtcagaccnttttccccngcnaattagatgnatgccccaaaacggnagaattnaaaaaaagtnaaanggntgttta

SEQ ID NO: 662006 - DNA, 1435 bp, Homo sapiens
ctcctcagagggacgaacgccggcggtggcctcagagccgcgggattctggaccatgagtgcaggcgaaaccttcaggaccagcgaggctttctaggctcagcccgaccataggaccctggacctctccagtgaaatgtcctgcaccatgaacaccaacaagctggaagaaaatagtcctgaagaagatacagggaaattcgagtggaaacccaaggtcaaagatgaattcaaagacatttccatatacttctccaaagaagaatgggcagagatgggagagtgggagaaaattcgctatagaaatgtgaaaaggaactataaaatgctgatttcaataggtctcagagcccctagaccagctttcatgtgttaccaaaggcaagcaatgaaaccccaaataaatgacagtgaggattctgatgaagagtggacacctaagcaacaagtcagtcctccttgggtgcctttccgggtgaagcacagtaaacagcagaagatactctacacattaactaaagtcacaggaatcatctagaatgccatttagtggtgaatctaatgtgaaggaagggtctggaatagaaaatttgctgaatacaagtggctcagaacacgtccagaaaccagtgtcctcccttgaagaaggaaatacctctggacagcactctgggaaaaaactgaaacttaggaaaaagaacgttgaagtgaaaatgtacaggctgcgagagagaaagggccttgcctatgaggaggtcagcgagcctcaggatgatgactatctctattgtgagaagtgccagaatttcttcatcgacagttgtcccaaccatgggcctcctttatttgtaaaagacagtatggtggacagggggcatcccaaccactcagtcctcagtctgccccctgggctaagaattagtccatcgggcatccctgaagctggacttggagtatggaatgaagcatctgatctaccagtcggtctgcactttggcccctatgagggtcagatcacagaggatgaagaggcagccaacagtggttactcctggctgattaccaagggaagaaactgctatgagtatgtggatggacaggacgagtcccaagccaactggatgaggtatgtgaactgtgcccgggatgatgaagagcagaacctggtagcctttcaatatcacaggaaaatcttctatcgaacctgccgggttatcagaccaggttgtgagcttctggtctggtatggggatgagtacggccaggaactgggcattaagtggggaagcaagatgaagaaaggattcacagcaggaagaggtgggcactattatgattccttaaaaaagaaagagaagagggaattctccttgagaattttcattttctaactccttttaaaaaatgatttatggtaaataaaaatgtttaaattc

SEQ ID NO: 662007 - DNA, 271 bp, Homo sapiens
acatgagcctcgaggcgacgttgcagtgagctgtgattgtgccactgcactccagcctgggtgacccagggtacacagtgagacccagtctcaaaaaaaaaaaaaaaaaaaagaagggaaagtttgaaaaattgtttccccttttttggtttggtttttaattttttccggttaaaaggaaaggggaattccgtttgttactcggctttgttttatttggagggccctcattgctttttggtttccggaattgttcttgttaacttgaaga

SEQ ID NO: 662008 - DNA, 580 bp, Homo sapiens
  misc_feature (19)..(19): n is a, c, g, or t
  misc_feature (566)..(566): n is a, c, g, or t
acctctgcccaagaaagcntgggtgttgtccaggtttccccccagtgagacggcctgagatatggcctcgtgggaagggaaagacctgatcgtcccccagcccgacacccataaagggtctgtgctgaggaggattagtgaaagagggaggcctctttgcagttgagataagaggaaggcttctgtctccgacatgcccctgggaacggaatgtctccgtgtaaaacccgatcgtacattagttctattctgagacaggagaaaaccgccctgtggctggaggcgagatatgctggcggcaatgctgctctgttactctgctacactgagatgtttgggtggagagaagcatgaatctggcctacgtgcacatccgggcacagcaccttcccttcaagctatttgtgacacagatgcctttgctcacattttcttgctgacctctgctctgctgccgcattcctcatgcaaagatagtgaaaatggtaatgaataaatactgagggaactcagagaccggggccggtgcgggtcctccgtatgctgagcgccgtctcctgggcccnctgccttctctata

SEQ ID NO: 662009 - DNA, 241 bp, Homo sapiens
tgatgacactaagcctgtttttaggggcagatgctagacaatgtttaacaatctttttttttttggatggatggattaatggaaaagatggggcctaactatgtggcccaggagttcgaggctgcagggagctttgatggccccactacactcctgccggggcaacatagggagaccctgtctttaaataaataaatagggaccatttaaaatatgaaaggaaaggtatgttaattatgaa

SEQ ID NO: 662010 - DNA, 1581 bp, Homo sapiens
  misc_feature (548)..(548): n is a, c, g, or t
  misc_feature (564)..(564): n is a, c, g, or t
  misc_feature (569)..(569): n is a, c, g, or t
  misc_feature (578)..(579): n is a, c, g, or t
  misc_feature (620)..(620): n is a, c, g, or t
  misc_feature (774)..(774): n is a, c, g, or t
  misc_feature (792)..(792): n is a, c, g, or t
  misc_feature (801)..(801): n is a, c, g, or t
atgtgtctgctcgtttccgttgttcttttttacactgtttttttgtgttttcgtcttttcttgttctcgtgttcctcttgcggtttccctatggtttttatctccctttttttgtttttttctttttttatttggttctgtaccccggggggccctggcgtttctcaatctgtccccgggtccgttttttctgtctttgccttccggttcctgggttaacggtggcccaacacattggcaatttggaattatagtaaaccgggtttcagcaatgtgcttagccggtctctccggacctcaggggttatcagcccaccttcggcctcacgaagtgctggattacaggcctggacacccttgcccagcccacatcataccggttgaatggaactttgccacaaccacgcctttgctgtagcacacacatatatccctgaacctggtgtgagaataaagttttttttctttttcatgattcgtctttgagtacctcccaggctgaaagactcgttgtgacccagttaaaactttaaggccccaattctccntgaagaccttctcccntttangtggccccnnattttaagttgctttatctttgaaattttgcatgaaaaggnaatgaatggattcgaatgaaattgtcctttagagcatgattacttgttcccctggacaaatatttttctccccttgctcttcctggcctgaaacacgggaaaccagagtcacaaagttatctccctctccctgtgatgccttgagatttttttntggcgttgtttaatgccntgaaatccnagtcttcctccatgggaaaatactgttataccaaataattctagatgagtaacaaagatctttttaggccttcattttatgttttttcttaactgttatattatgattgtgacatagattatactactactaatttttggatgtttcaaaaggtcaagaagtaaaagatgttagaaagcaatgagtgagtcctttgatttttaacttattccccatgtccctatacttcgtgtgcttttccttttttttttggagacggaggctcactccgtcacctaggctagagtacaggggcacgatctgggctcgctgcaacctcggcctcccgtgattcaagtgattctcgtgcttcagcctcccagtgtagctgatattacaggcactgtgccaccatacccggctaattttggtattttatagtagagatggggtttcaccattgtggcccaggctgggtctggaactcctaacctcaggttgatccggcccgcctctgccttccaaagtggctggggattacagggcgtgagccactctgcccgggcttatttttcttatatgttttggcttcgtaagacggttctggtggagcagtggattggcaactctggctggacgtggctgggggaacgctttaaaacaaaaaaagtgtggccccacagagatctggattataatggtgcctggattaaatggggctgggagtagaattcagggcttggatatctttaaaaattccccaagtgttggcgacaccaaatttacagagtgggagacgtg

SEQ ID NO: 662011 - DNA, 1093 bp, Homo sapiens
  misc_feature (75)..(75): n is a, c, g, or t
  misc_feature (132)..(132): n is a, c, g, or t
  misc_feature (286)..(286): n is a, c, g, or t
  misc_feature (304)..(304): n is a, c, g, or t
  misc_feature (313)..(313): n is a, c, g, or t
cgtgatcgctgtggagtcagaccacacagcagttcggcaccacagcgtgccggcatcttctacccgtatttgatngtggcgccccattattcatagtagttgctttatctttgaaattttgcatgaaaaggnaatgaatggattcgaatgaaattgtcctttagagcatgattacttgttcccctggacaaatatttttctccccttgctcttcctggcctgaaacacgggaaaccagagtcacaaagttatctccctctccctgtgatgccttgagatttttttntggcgttgtttaatgccntgaaatccnagtcttcctccatgggaaaatactgttataccaaataattctagatgagtaacaaagatctttttaggccttcattttatgttttttcttaactgttatattatgattgtgacatagattatactactactaatttttggatgtttcaaaaggtcaagaagtaaaagatgttagaaagcaatgagtgagtcctttgatttttaacttattccccatgtccctatacttcgtgtgcttttccttttttttttggagacggaggctcactccgtcacctaggctagagtacaggggcacgatctgggctcgctgcaacctcggcctcccgtgattcaagtgattctcgtgcttcagcctcccagtgtagctgatattacaggcactgtgccaccatacccggctaattttggtattttatagtagagatggggtttcaccattgtggcccaggctgggtctggaactcctaacctcaggttgatccggcccgcctctgccttccaaagtggctggggattacagggcgtgagccactctgcccgggcttatttttcttatatgttttggcttcgtaagacggttctggtggagcagtggattggcaactctggctggacgtggctgggggaacgctttaaaacaaaaaaagtgtggccccacagagatctggattataatggtgcctggattaaatggggctgggagtagaattcagggcttggatatctttaaaaattccccaagtgttggcgacaccaaatttacagagtgggagacgtg

SEQ ID NO: 662012 - DNA, 1618 bp, Homo sapiens
  misc_feature (233)..(233): n is a, c, g, or t
  misc_feature (531)..(531): n is a, c, g, or t
  misc_feature (585)..(585): n is a, c, g, or t
ggatcgagacctgaaggtcctggatcgcatggccctatactgtcgctattattaccacgcctacataagactcgctatcactccttaacttgcacttccgccactcacaattttaccaacttcaaacacaggaacccctcagggactccaacataatagaccatgtcattagcgtaacctttcagccacgtaccacctttgcccacgacatgcataggctatgcgagagactnaccccttgtaggacgccacaacgagaagtgggaacttactgaagcgttgaggtttcccatctaagcagagtaaagtgctatctatcactaaggtacaaagagtacccgtcatgtctcaccgagtatcgtccccaccatctcaattgcacctccacgcctacacaagctcccaatggtcggtacacagctcctctctatcggcttgcgtggtctatactgagatcacttttggcacctgctgacgtacttcttgaaggaatcgcaatagggtccgtgcatatattgcgctcaatagaanatacggctcgtccatcaatcgtgctagtctcgtctagatcacgctcactattgnacaatagatagcaactattaaagcacttgacacctcttttcgccattgtagcgtagtcgcgcatattgatgggcgagtaaaaatttcataagacaagacgcgactcaattcgttgccctagctgatcgatatatctaagaaccgtagagaaagtcggcatccattttggccaaagtacttcctttcgatagtccaagtcctatcagttacgtcacccgtcggataagtgtagagcgattgccaggtttcgttctattccgagataatcccaccactttgaaaaagcctttccaccccggtgctggcaccggtccattaatccctcacatatacttctgctccaaccagggaagcgaatatcgttgcgcgttcaattgtaaccgtagtttcctgggccataatgcaaaaaagtccagaaacttaaactcgaaagctgccagtctttcgaaccatgctacggctaatatccactaaaaatccctcgcttcttcgaatgggaaccttccaaaatttttctaaatttcccccaacataaaattaaaggcttttgtttgcactttggacctttccttaggccaaaagcccttccggcttaaaaccatccgagccttttaaaacccccccaaggtaatattaaaaacctgaacgttggggcgaggaaacccttcttcctggttgccgtcaaggtaaaaaacccacaatttgtttccttggaatcccaacagttatttcacttccttccttaactttatccgggaccttccaccagtgaactacaggtgcacaaggtccctaaataaattcccgcgttatatcatgtatttttcccccccaaaagcccacattgggggggtgtactcctaaccccacccacatttttacacacataattaaaaccggtcgtatttaaaccgaagagagaaaaaaaccctccttgtgttttatatcacccattatattctccacattatccttctgatttacctataaccccgagacaaatataatcggggggttgctcttctacaaaaca

SEQ ID NO: 662013 - DNA, 349 bp, Homo sapiens
ataaggactgaaaatcattagaacgagcctaggttttgcaaatatttaaaaattattaaacagggccaggcatggtggctcacatctgtaactcccagcaccttgggaggctgaaggtgggcggatcatgagagtcttgagtgtgagaccaccctggcgaacatggtgaaacctcttctctactaaaaatacaaaaaattatccaggcatggtggcgggcacctgtagtcccagctactcgggaggctgaggcagtagaagcacttgaacctgggaggcagaggttgcagtgagccgagatcgtgtcactgcactccagcctgggtgtcacagtgagaatctgtctcat

SEQ ID NO: 662014 - DNA, 915 bp, Homo sapiens
  misc_feature (785)..(785): n is a, c, g, or t
ccgtgctgggtttaattcagtcaccgatggcatggtatctgagttcagcagtcgcctcgggaggtcggtagcgtctatgactgtctattgcctgccgcacatcatcctagcagggcgccgtctggcccaccagtgcggacaaaagcggtccgtgaacaccatgcggccgctcggtgtgccgccaggctctgctggtgagcgccgccaccccgctgcccaggtcccgcgatgccctgcctgcctgcgcacctctgcccttgctcccagctctactccatggtgcccctgtcctgccctgggggctggccgccacctgcgcctcggctcggagttcggcaagttgtgctgccatgtggcttgtctggagtattcgcgaggttggcctggagccctgggttgggccctggtggccggagggctgccactcttacgcccccagcttcctaccccttgtaatggcccctgggcagcctccggactggtgctgtcccttgggccctgttcgccctcggggctccccggccgggaacctcctttcgactctcaagaggggctggggtcccttccccctcccgaggggcttgcgtttttgccctgttgcgcgttccttgcgcgccagggaccccttgaagccgccgccggctggccatttgatggttggcgccccggagcaatgcctgctgctttgtatttggcgcaccccctggcctggttctttgagtttggccagggcccccctgattcacacccagccgggtgcgctggacgcacaactatctttggancccggcgagagttggttcgctccaggaggggggggtggggggctttttaaaccccgcggtcgggggacgcgcctttttttagccccggtatgcgcggggggcgtatcttatcgcgtgacgcgccttagtg

SEQ ID NO: 662015 - DNA, 1609 bp, Homo sapiens
  misc_feature (548)..(548): n is a, c, g, or t
  misc_feature (564)..(564): n is a, c, g, or t
  misc_feature (569)..(569): n is a, c, g, or t
  misc_feature (578)..(579): n is a, c, g, or t
  misc_feature (620)..(620): n is a, c, g, or t
  misc_feature (802)..(802): n is a, c, g, or t
  misc_feature (820)..(820): n is a, c, g, or t
  misc_feature (829)..(829): n is a, c, g, or t
atgtgtctgctcgtttccgttgttcttttttacactgtttttttgtgttttcgtcttttcttgttctcgtgttcctcttgcggtttccctatggtttttatctccctttttttgtttttttctttttttatttggttctgtaccccggggggccctggcgtttctcaatctgtccccgggtccgttttttctgtctttgccttccggttcctgggttaacggtggcccaacacattggcaatttggaattatagtaaaccgggtttcagcaatgtgcttagccggtctctccggacctcaggggttatcagcccaccttcggcctcacgaagtgctggattacaggcctggacacccttgcccagcccacatcataccggttgaatggaactttgccacaaccacgcctttgctgtagcacacacatatatccctgaacctggtgtgagaataaagttttttttctttttcatgattcgtctttgagtacctcccaggctgaaagactcgttgtgacccagttaaaactttaaggccccaattctccntgaagaccttctcccntttangtggccccnnattttaagttgctttatctttgaaattttgcatgaaaaggnaatgaatggattcgaatgaaattgtcctttagagcatgattacttgtccatgggaacaagtaatcatgctctaaatcccctggacaaatatttttctccccttgctcttcctggcctgaaacacgggaaaccagagtcacaaagttatctccctctccctgtgatgccttgagatttttttntggcgttgtttaatgccntgaaatccnagtcttcctccatgggaaaatactgttataccaaataattctagatgagtaacaaagatctttttaggccttcattttatgttttttcttaactgttatattatgattgtgacatagattatactactactaatttttggatgtttcaaaaggtcaagaagtaaaagatgttagaaagcaatgagtgagtcctttgatttttaacttattccccatgtccctatacttcgtgtgcttttccttttttttttggagacggaggctcactccgtcacctaggctagagtacaggggcacgatctgggctcgctgcaacctcggcctcccgtgattcaagtgattctcgtgcttcagcctcccagtgtagctgatattacaggcactgtgccaccatacccggctaattttggtattttatagtagagatggggtttcaccattgtggcccaggctgggtctggaactcctaacctcaggttgatccggcccgcctctgccttccaaagtggctggggattacagggcgtgagccactctgcccgggcttatttttcttatatgttttggcttcgtaagacggttctggtggagcagtggattggcaactctggctggacgtggctgggggaacgctttaaaacaaaaaaagtgtggccccacagagatctggattataatggtgcctggattaaatggggctgggagtagaattcagggcttggatatctttaaaaattccccaagtgttggcgacaccaaatttacagagtgggagacgtg

SEQ ID NO: 662016 - DNA, 344 bp, Homo sapiens
  misc_feature (85)..(85): n is a, c, g, or t
caccatgctgctaattttttgaaaaaagtatttttatagaaatagagtatctggggccggacgcagtggctcatgcctgtaatcncagcactttgggaggctgaggcgggcggatcactcgaggcctggagtttgagaccaacgtgggcaacatggtgaaacaccatctctactaaaaatatggaaaaaaaaaagtaactgggcatcttagcgcgtgcctttaattccagcttctcgaaaggctgaggcatgagaagtgcttgaaccctggaggcagaggttgaagtgagcccagatcgcgccattgcactccagcctcggcgacagagcaagactccgtctca

SEQ ID NO: 662017 - DNA, 156 bp, Homo sapiens
acagcacggcagggtgctgtggtgtaggctggcagctactgctccgattcagccatagcctgtagacttccatatccatgggtgaggctcttaaaaaaaaaggaaagagagagttcccgcttgtggctgcagtggtccttctccgagtggcgtggt

SEQ ID NO: 662018 - DNA, 489 bp, Homo sapiens
cctaatgtgtcttataacgatcttcatcaggtccatcagcatgtctcaatgcgttgcaggctacggcttcaggagagtaagatctcatagtaacgactgagaaatttagtgccagacccaagatcgaattgaggtgtgtagggctgcatttctttcttactaatttctaatgcttcctggtaagcctgctgggagttcgacacagtggtttgtttgttgtctccagatgccacttcagaaagatacctaaaataatctcctttcattttcaagtagaacaccttactttctggttgtgtagcattgggaataagatatttgtccaacagctccagaacatcattgcagatgtcctgcagatctgcctctatcttctcacgggactctttgcccatctgctgcttcttctcattcctctctgtattctgctcaaagctggagatgacacgccagacagagcggcggggcctaccacattcttgtaggcat

SEQ ID NO: 662019 - DNA, 154 bp, Homo sapiens
tgctgtgatatttgttgaggagccatggaggaagaagaagcagcaaagaagagaaagaagaatctgatgatgaagctgcagtagaggaagaagaagaagaaaagaaaccaaagactaagaaaggttgaaaataactgtctggggactggggaac

SEQ ID NO: 662020 - DNA, 277 bp, Homo sapiens
aaggcgggggttggagaacagtgcggagggaaggagtaggtgccagaagtacgtatgtcaggggcagattgacttacacgtgggtcctttgaagtgagagctttctttcgttatgttctctttccactcatcgacgggtgaggggctattctcagcagataaatgagatgcttacagtactaggccagaaaacagttgggttgacctatctatctccctaaattccttggggttaaagagaactcatgtagtgtacctcagatagctttctaaagta

SEQ ID NO: 662021 - DNA, 200 bp, Homo sapiens
cacgagggtttcccttgccctgtggatgcccagctcctgtcatccttccgtaggtcctgcagtacagtcttcccctgaatggcaccggggagccagggggactccacccccctaattacgcacacacatactcacagttgattacttgctggtctttgagtcccagctctcttaccctccctttactcgagcagcccgac

SEQ ID NO: 662022 - DNA, 661 bp, Homo sapiens
  misc_feature (240)..(240): n is a, c, g, or t
tctagacatgttagtttgggccgcactttcggatgtggctgagcactgtgtgaaagattcccgatggggtgcccttgacaagagagggggaagagattttgcgaaaatgttcgttgatgtggtggcgcccccttgttgtgagaaagaaagggtgtgaatagtcccccggaggcgcgcctgtagaggaggggtctaagaattgctgttgatagttgaataagtattgggagtgccatagangactgttagagagccgcccgggtgtatttgacaccatcgaaggattcgtgaatatgttcccggggttgtttaatatccccgcgagggaaaaatactcggttctggggggagaagacgttatatatattagcgtgcaaaatagtggtgtgcactcggaagtgacgtcgtgtttcgtcgtacgttgtgtcccagtgccatgtaccccgttaattggatccccacgccaggatgtatgtggctcgtggtcgttctaagatgtgctaggtcaagccgctggtgacatacctgaaacgccttataaggtcgcctggataaattttgtgtgagtagttccattgaagaaacaatttattgttcgccagttgtgtgaaatttttggcctggttaataaaagaatcctgtccaacccataaaaaaaaaa

SEQ ID NO: 662023 - DNA, 141 bp, Homo sapiens
catccccccctataccaaagcagacacttgactactactttggcagtgggtatagttatataacaacagaatcactgttacctataatgaatatactttactattaaaaaccacttgactagcgacggtactagtttccta

SEQ ID NO: 662024 - DNA, 191 bp, Homo sapiens
aacacaggcttccaggtttacctttctcagccaaggacacacgggtagttctccagtgaagatcactttcaaacctgtcaacccacaactggggtcatgatttgacgacgtcgcccgatggagggtgaaccaacttggatgatcaaggctttggccaatgtgggtaaccggggctgctgccgtggaaagga

SEQ ID NO: 662025 - DNA, 638 bp, Homo sapiens
gggctacacgcttgcatccccttccacactttggaagatttgttttttgctctttgcaataaatcttgctgctgctcactctttgggtccacactgcctttatgagctgtaacattcaccgcgaaggtctgcagcttcactcctgaagccagtgagaccacgaacccaccgggaggaacgaacaactccagacgcgccaccgtaagagctgtaacactcactgcgaagggtctgcagctttgctcctgagccagcgagaccacgaacccaccagaaggaagaaactccaaaacatccgaacatcagaaggaacaaactccggacatgctgcctttaagaactgtaacattcaccgtgagggtccgcggcttcatttttgaagtcagtgagaccaagaacccaacaattccagacacaatagcaccatggtgcactatgcagtccttaatacgtatatgtttataaaaacccattgaatatacaacaccaagaatgaactcaatgttaaactatgaactctgggtgatgatgatgtgtccaatgtagactcattgatggtagcaatataacaattcacattccaggtgtggtggcacaatggaagatcttctgtttgattaaatctcatcaaagactcg

SEQ ID NO: 662026 - DNA, 130 bp, Homo sapiens
cacggtatgatcaatgaatatcccctttaaagatgaactcctactaattattttgggctgttgttcattacagcttggcgcttcgatccagggatgtgtgctgggattttagccagtagcactctttaac

SEQ ID NO: 662027 - DNA, 316 bp, Homo sapiens
ctatagatagttctctcctaggttttgctgacagtgcttggtgaatctcacatgcttctgaagcattgaaaagtattgaacctgtgaacctttcagaagtcctcaggttgggaaagaccccacaccttctttaaggatcatttgtctcgccatcacaggatcttggaaatgtttcctagggtgtgtaaaaattaaccaggggggaatgaagcacatttttctggcaatcaaacttgagttcctcagagaacagatgcagagagacctgctcctgcttgcccggctacaggggccactgtggagtcacactgaggct

SEQ ID NO: 662028 - DNA, 178 bp, Homo sapiens
ggcacaaatgcgctgcggaacatggccttggacagtcagaaataagtgagctacatcggcaactacgccatgcgagacctagtccccaggcttccagtgatggaacaacagcaacagcacttgcaagcacggcccatgtcggatgacacagtgacagctgtctgcttgcacactgcac

SEQ ID NO: 662029 - DNA, 1444 bp, Homo sapiens
tgtgagtgtatatttgaaatgcaaatgcttgaatgaacattttaaaaatcaatgaattactgacaatgttaaaatgacaatgatgaatgactatgatgaacatgtgtctgaagatgtcactaacaatgatgatgtgattgataattgatgtttatacttcttgacccaaatgttgtccagatatttatagcacttacaacgtaacttccatgtatgcctaaccacacatgacacacatgtgttgcttacccaacttgtgctatttgcacacacatgcttgcgctatccccatatcacatatatgtaccaaccctaccacttttgtacccgagcgataaaggactcaattgtgtctcaatggaacaagaatcgaaattgtgtgtgatataattgcaaatacctattttgcattggaattgctaccataaggcagacactatggtaatgtacccatgccttccattttcaacataactgcccagcacatcacttctcctctcaatggaccccgaattgcgtcactagagtaattggtattggttgaacaatacatgcccccaggaaagtacatgtgccaatgctatggcttggctattaattgtgccctatggtgcacgtccattgtgtccaacgatggtactgtgttgtgcacgcatcaacatttattctgccccttatatattgtggtacacccatgtgaatgccacatataccccgcctgtcttgggtaaaggacgtttactattcactgctccttggctgtgaattttcctaaattgaaactcagaaatgaaacaaaccttgttcacacttgtcttaccatgaacgaaatctatgcgcaacttccttccactgaccaacggtaaccgtgcggcacacacacctcccactttgcacacgttttcccacaatgtcgccttggaaccttgtttggcttacccacccggtttctgcacaacgcactgtgggttcccctttttctccaatcagcctgtggggtttatggttcctttgggtggcctttttccccgatccttaaccgttgtgacactgcgattcttctcccgcacgtcacccggcccttgggtcttccagcgacgccgttctttcgcacctttcgactcccctgggttgggttgcagacccccctgtgtgatcttttgagcagcacgggtttcagcttcccagtttccccccagcgcttgggtgtccccctatgtgtggtggccctcccacaatgtcgcaaagtatatgtgcgccacatgtctttgttgcgcgcccccagcacagtaactattgactgcgggtgcgacaactaatcttgtgcgcgggtgagcaaacgtgggcgtgcatccacattggcgtcgctgcctgtggcgtgcgacgttattcatccccctgtgcgatgcacgatgcgcttgttgtgtgccgccaacctgctgtg

SEQ ID NO: 662030 - DNA, 394 bp, Homo sapiens
cactagtgtcggcctccagccttagtttctgtggtcaagtgtaaaaggaggctggccagaggaactggcgtctgcgccatccctgcgatagcccttttatgggctctgggagacagctttagggaataaatggtgagtctaccctttgtctacccactcatttgctccctccaagacttagccaactccttccccctcagagaaccaaatagcctgaggaagcaggagagttcatggatatggcagaccttagcagatttgatgctccaagacagcagttgagagatgctgtcaggacgtatcctagtcataccaaagacactgatcgtttctcagcctctctcgtgcttttctcctaatgaccatactcttgccaaaaatcgcgatatgttat

SEQ ID NO: 662031 - DNA, 276 bp, Homo sapiens
tcgacggaaggtggggtaattgcattcgtctgcagtagacacgagttcctccatacagaattgttaggaaatgtccactcctttgggggtgatttttctcctcagtgtagcacattttgtcgtaactgatttagggcaaaattctgaatttctccagccagtctgccatgcttggaatccagtttcctgtcatatgcgagccatccaagttgatgccaagtaagatttgcccagctcaaagtgaaagtgtttgcgtcttgggtcgacgcggccgga

SEQ ID NO: 662032 - DNA, 168 bp, Homo sapiens
gtgccagactgttattgaactcctgggctcaggatctcccagcttggcctcccacagtgctgagagttatgatgtgagcctgtaattatagacagcttggcctatttacctgttggaaactgaagaattatgaattttacatgttcttcaagtaaacaggttatgggt

SEQ ID NO: 662033 - DNA, 233 bp, Homo sapiens
caggaggcttgggcccaagagtgagaccaccgtgggcaacatagcaagacttcatctttacaaaaaaaatctgtaaataaaaaattagccagatgtggtggcgggagcctgcagtcccagctgctcagaagactgacgtgggaggatctcttgagcccagaaattaaatgctgcagtgagctctgactgcgccactgtactccagcctgggcgaaaggggttgaatctgtctt

SEQ ID NO: 662034 - DNA, 268 bp, Homo sapiens
aaagtttttaaaaaaaccttttttttaaggatttatttccccctttaagaatttccccccttggccagggatttggggttttaaaattcccaaagtcccttttttcaaaatcattggaaaccccgttgacccccccccccttgtaaaggatgggggaattagcttggaaccagggtatgatttgctattttttttttccctttttattggaaaaagccccccgttttaattttttttttccccaaaaaaatcccccatttggttccca

SEQ ID NO: 662035 - DNA, 382 bp, Homo sapiens
  misc_feature (17)..(17): n is a, c, g, or t
agccccggaatttgagnccagtctggacaacatagcaagacctgtctcgacaacaataacaacaacagaaattagcccggtgtggtggtgcacgcctgtagtccccagctactggggaggggaggcctcaggtcggaggatcgcttgagcacaggagttggaggttacagtgagctatgattgcatcagtgcactccagccctgggtgacagagcaagaacccgtgtcttaaaagaaaagaaaaacaggaggctgggtgcagtggctcacatctgtagttccagcactttgggaggtgcaggcagaggcggaagcggaaggatcacttgaggccaggagtttgagaccatcatgggtaacatagtgagacacccatctctta

SEQ ID NO: 662036 - DNA, 965 bp, Homo sapiens
  misc_feature (301)..(301): n is a, c, g, or t
ctgaagtggtcacataggctgactttttgtggaggaaaaaagcaaaataataaaaataaggcctacctttctctatgtctgaaacgtgaattgagtaccttctaagtaaagggaaaaatatcagatccatggcctcaaagcacaatccctgttctcatggagttcaattaattgggaagacaagttgaaaatcttagagcagtggtctttaaatatcagtatatattggaataatctgaggaaacatgttagaaatgcaaattccttgatcctgaaaccagagattctgatgtagtagatngggatggagtctgagtttttagcaagctctgccgcaacccctagtaattctgatacagttgatccatggtcatagtgcgaggaatcctgccatagaataggtacaagagtggcagctgtagccattataggtggacaccatgtgcacacatctgccagatgcctcattcacttgggttattccctttagtttgcaaggaatgccaggaccagccagggtggggtcccatgggcctgtgcttgaatccagtgcttgaacctgggcatagggtgtagggataggtcttaccagacacaaacaattctaagttaggttttctgcaacactctcattctgaaatatctctttattggccatttgtcttaactgataaatatataggaccagtttgttattttgtctgattttgtagctatagcagtatcgatcttattttcctaattgtcaccttcttttaagaatccttgctgcggtagggggcggaaatccttgctaagcttctatagctgggggattctccaattaggtctaggattctgtggtctcatatcagttttttgcttctgaggtctttcatggtacagagatggggagagtatcgaggggggatgtgccacatgagcgaagtcaggcagatgagaaaatgcatggatttattcaggaa

SEQ ID NO: 662037 - DNA, 259 bp, Homo sapiens
ccagcactttgggaggctgaggtggcctgatctcaggtggtcctgcggcattggcctcacaaagtgctgggcttacaggcttgacccaccacagccttgccattcctttcaatagcaaaagcctcaattacttttcctccaatttatataatggatagaaatttatcccctcctctggagggtgaggcaagtgatcttgtcgcgtgaacccaacagtttgagaccagcctgggcaacatggggagactttgcctccaga

SEQ ID NO: 662038 - DNA, 219 bp, Homo sapiens
atcctgctgctgtcgctacagccgctaagtacaggtttggctgaatgcttactaggagccaggtgctatcctaaccacgcaaagcactgtactaacgtaccaggcctctaagagccccaggaagcagggctatcatcatccccgcctgatggaggggagaggagagggatgctggacgtgggaccctgcgtgctcaaggtagcaagcccctgcggatga

SEQ ID NO: 662039 - DNA, 166 bp, Homo sapiens
cggcgccggaggagacgcacgcagcgtacttttgtcttcttcgcacgacttgttacaagagggcttcaagaggccttcttttttcctgtgcaaaaatggcaactctttaagggagaaacctatttgcaccagtttgcgggaggaagggggcaacaggttcacacaa

SEQ ID NO: 662040 - DNA, 101 bp, Homo sapiens
cgatctgttggccaaactgcaatgaagtggaaactgccatagtctttttttttttaaggttttattgtaactcttcttactagcattccccaaaccgatcg

SEQ ID NO: 662041 - DNA, 330 bp, Homo sapiens
tcgaacgtttgtctcagctagagcaaacacaatcccactgtagctccacttccaagatggcatatgcacagtagctgcacaggacacaggggctggcgcatagtattggctccttctctgggagggagcacagctgtatggactccaggcagctccttcagctgggcttagtgcctagaggactgtagggaagccagtggtgaagtctgtaggtgtccaaggtgctggtggcagtttctagaattgtcttgcttacttccttgctgtggggagaagttcctccttgttcccagctgatcctagatgggggaagggggatgggggggaggc

SEQ ID NO: 662042 - DNA, 170 bp, Homo sapiens
cgggacgccataggtgcattgtggaagcactttgctgtccacagcagccgcttgtgatgaactgtaacttacaagaaaagggctgggttttgaaaataacacaggctctaaaaaccctaaggagcggtcaacttttggcagaatcgggtttaccggacctcaggctcact

SEQ ID NO: 662043 - DNA, 425 bp, Homo sapiens
gccgagatcgcgccactgcactctagcttgggcaacacagcaagacttccgtcttcaaaaaaaaaaaatttgtttaagacttatttttatccaggttcctacttgttttcagttatggggttggggggtggggtgggagggcaatgacctccacacagtgttaccggatgaggagtctggtcttgctttgttttctctgccttttctgtcttgtcattggctctccgccctcctacacgcacccgcctgttgcttctctcattctcagttccttccaatccccttcacttctctttactccctccccaggtcagtgctcggcgttctcctctttctgttctccatctccggcagctgtctctgtctgtctgtctctgtctcgcctcaggtctctctctttctgggcttttgcgactaaagtgtgt

SEQ ID NO: 662044 - DNA, 111 bp, Homo sapiens
cgcagaatcctaagctaagaaagtgaaaaagacaatgtggccttggggaaacctaccttcctcacacacaactcttagcattagtgatcatcttgctggccgcgggtaccg

SEQ ID NO: 662045 - DNA, 1143 bp, Homo sapiens
  misc_feature (469)..(469): n is a, c, g, or t
gaggtagaggctgcagtgagctgtgatcgtgccactgcactcagcctgggtgacactgagaccctgtctggaaaaaaaaaaaaggtttcactaaatttccatgtcatcatcattacaattttacggattaacagggtaacggcaactctggacatcttttggctctatccagaaatttacaccaaatatgcctgttttaagtcaggccaggtgctcatttactacctcaaccttgtgacttcaagtagctcactgcaagcgctagcctcagctttatatccctaagaaaccaacccaacaatttcaagctggcaccaaatgtgactaaccaccaggaaagaagccaacctaaaggctacacacactgcgggacacgtgctacaaacctaagaaaccttttctccaaaaccacaattaatttactctactctggaccctgacagctcataccgtggcctcttaagcagtnttgaccctctacaacccaaaaggacctttaccacagcaagagctcttggcccaaacgaattcacggtaaacacccatgccttaaaactcctagcgtgttctaacactcgcgctgtaacccccttgtgtacgccaacctgcccctttgcgactctccagagagcccacagttcctcaacttttgcaattgcgccaaaccactgagccacactctggcccgcgcagcaccaaaacgctctttcaaaaccacctctatatcctcaacctttttaccccgttatacaacccacattaccactctgctctaccacctactctctcaccacacaacaccgaaacttcttgctcgccccaattctccaacccaacccctctacatcacccaaaataaacccaaacaaaaccttcttgttcccccggctctgagcacgcacttgaccacagcatccctaaccccacgaacgctcatcggaagtgtacaaacacccggcaagacaccctaaacatacaccagggacaacagttcctatctaaacacgcacttcttacacctaacccccacaacaacgcgccccccacaaccaagcagctcgacctctcttactctaaaccccctcaaactcacgttgcgccccgatactattactctcgtccgtcgtgacctcaacccgagga

SEQ ID NO: 662046 - DNA, 131 bp, Homo sapiens
taccaccaactgactatagacacccctggcaaggtcatccatgacaactttggatatcgtgaaagtgactcatgaccacagtccatgccatcactgcacacccagaagactgtggatagcccctccgggaa

SEQ ID NO: 662047 - DNA, 146 bp, Homo sapiens
cttgaccaacgctgtgcgctgcaggtcctttggccgcatcagcaggtcccagaaagaccccgaccccaaaggcctgtggccacttgcggccaccacagccatgacagggtgccctactactcctgtcccctccagcgttggggtcg

SEQ ID NO: 662048 - DNA, 427 bp, Homo sapiens
agggggctactcgttcatttccagggggagcctcagattccgagataaatgtgcaccatgtgcacggaatcgggtagtaagagccacaaaaagttcctctggaggtcgctcacgtgacaggtgacggtacctacagtaatggctcaaggggtatgagtcatctcactgagcacataaatatggcttcccagtggagaaacacagaccactggagatggcatacgcagggcatcatgcaagcttatagcttgggcacataggttaaggtcggcacccaggtacatggttcaacttaaatctatcacggtcaggcacattggctcacgactgtaatgccaccgcattgggactcaggtggatcacttgatgtgaacagttagatcccatcttgagcaacattgtatacacattctccactggatgtgcg

SEQ ID NO: 662049 - DNA, 342 bp, Homo sapiens
  misc_feature (43)..(43): n is a, c, g, or t
  misc_feature (52)..(52): n is a, c, g, or t
  misc_feature (72)..(72): n is a, c, g, or t
  misc_feature (77)..(77): n is a, c, g, or t
  misc_feature (103)..(103): n is a, c, g, or t
  misc_feature (108)..(108): n is a, c, g, or t
  misc_feature (130)..(130): n is a, c, g, or t
  misc_feature (178)..(178): n is a, c, g, or t
  misc_feature (247)..(247): n is a, c, g, or t
gccctggggccccaagggggttttaaaggggaaaacccttttngatttcccnaccaggaagggaaaaatccnccttnccattttaaccaccaacttttaaggngatantccggaattaaattggacccanggtgaaacgttgtaaaatgttttcatattaagaatgtaattatttccntattgtattttttaaaagctaaagtcatatttaaaattctctttgaaagaaacaggcaaagaaacagcnaagatttttttaaattaaatatgttagtagtgcccacttcaaatgactgtaaatatattttcactgtttctcaatgtatttaattcataaagtaa

SEQ ID NO: 662050 - DNA, 425 bp, Homo sapiens
agcggggggaggcgggaggcgggaggcgggaggtgttggggccgttgaagcggcctccctcccgcggcagcgcccgggtctgggccgaagcgcgtgtgcgaggaccgcggcgcgcatggcaccagtccggactctagacggccgaagggatgccagcgtgtgacacggcaggacggcgtgccgggtaacaagaacacaaggaccatggagagggcgcaacagccacgggacgacacgggctgcatgaagcggaggactgggagacgtccatggacaggcgcagagagagggacgcagaagagagtcaagaagtggcggggaaccatagcaaaatcgtagttcgcaatgagtgcaataaattgaaccaatacgaagcatcacaagaacaatgaggacgagtaaaaaagccaaattggcaaatgaaa

SEQ ID NO: 662051 - DNA, 829 bp, Homo sapiens
acatgtggattgtccccccgactttcttgaggtgttggatgcagccgcccccgtgctgtcaagcggcccttggcgtgccacccccgcactgtggcgttgtcggggaccttttcttcgaccggtggtccccgccccctgtgggggccgcccacggctcactcgttttgcgtgcttatgttcatcccaccccacgcggtttctttcccggcagcgtggcgtcatctccgacgcacgacgccggcggcgcccacactagacagtagcttgctggttcagggcggtctgcgctaaaggcgttgcgctctcgacaacggtgtgagtgccccacggaggagcgtgcatcgctgtacgcggtgaccaaacggctacgcttcatgtctccccctccatttattgcgcctggctcaacgcgcgctcgctctcttccaggatgccacattgccgtggatagggcgccgccgctccgacaaacttagtggttgttgtgcccaccaggccccgctctttgtataaaggtcccaggtattgggttcattgctgccgtcgtgtattgagcgcacatacggtgggatgattaccccccgccctcagaaggtcaaccgagacgatctatccttgcgggcgacaaccccatggggcgatgcttcaatttctatgccgttggagagcgctcgcgtcttgttaattcaattgtaggtttgataaaaagctcctcattgttgtctttagtgggcgaatccactgagagcgctccacaaatagtacgtccgccaagagtcgtctggaggcgcccccaagaaaaattcaaaacgggcacaacataacacaa

SEQ ID NO: 662052 - DNA, 1074 bp, Homo sapiens
  misc_feature (43)..(43): n is a, c, g, or t
aaccacagtggcaaaagcagagattgcctgggggggggaagancgcacaacacaccaaccaatcattggggggtcccaaccggaagaacacagagtttcgtgcgggttcccgacaaggctgatgccgcccaccaacgcggagaaggtagatgaggttgtcctgccacctcccgtccttctccggcatgggtagagcgccttctccaattaacgcccgcccgctccttgcagattgggcgttgtcctccgcaactaatgcaggagcgcccactcctgcctcgggcgagaaacagcttcgttttgcctggcgtcattaaagaatgtgagctccccgctcttgtgtctgacgtacatgtcacgaaggccggacacctcactcgcgctgttactaaccaagttatgctcttgtaagccttcgcccaaagagacttccagtatgtctacaccgatcgcccggtatagatcaatatagatgtgtctcaaatcataaaacaccatacagagagttggtacgtgatctctctgttcaattagatgtttcatatgcgccacaggtgatacatcctttacgcagacctactctcctctaatagtcgcccttgcgatgacagtcaggagcagatcacgcccacagatgcgatgatatataatctgtcggccgaccgctctctacatacatgtatatgtgatctcacggacatgtcctctcttctatgtgatcgcgcgtgcgtacatataataaggcggtgtgagtaaagaagtcagatgtagcacgcctttcatcagtagggcgtcatgtctagtgcctgagtccgttgtgagagacacatacgtttggtcatactggagtctccactcatactggcgtgatggcaacactattcaccaactgccagatcaacatcaaggtggtggattcttttctggatttccatatggggctctctcccctacttacatatgacaagattgcggcttcatgtactctcaagtcatggcaaaagtttgtttgtaacaatacaaatgatgcaggcaccctttttctaaacccaaaaaaaattgttccacaaaaca

SEQ ID NO: 662053 - DNA, 1474 bp, Homo sapiens
  misc_feature (386)..(386): n is a, c, g, or t
ctattgaaagaggggactgatagactcccaaggactatactccggccaggcttgggagtaacatcagtgcctgtccaggtgattgctgaggctgtcaagcaactcaccctggggtccccagtggtgcaatggactaagcttatatgtagatggcaagcaggcacacagcaatacaatattctcaatgcatggggcacacacattctgaggacttcgtcgcatgtcgtccattcctgcagcaaagacttagcgtagtaccattgcacagaatcccacacgatgactcgactgtgtgggtgagtggacatccacgctcatgctgatcgcattggctaggctggcgagagatttctggaacgcagggtggaaactccctacatgctggnagtgcaaggcttttacagaacctccaggaatcgagtcgaatgatcgagactatgtgtccgacagaaagcagcatacgcagtctggaacagaatatgaagcaagaagtcacaaggagacttggctgtggacgcgggaagaaagaaagtatcacaacgatggagcacgacgagacagctgcttggacaccacgtgatgccactgaaacagcatcctgagacatccaaagactgcatcctcccacagcagacacagcataaccatatagcatacagcatggctgcgaggactgcacagcaggatgcatcgctcgcagtgacattgtgcgtgcagagtatttactaatgacttgggaaatcaaatgaaagggtagcaaggcgatgggacgaccacgtacgaagagcataaacacagctgtgttacgcgtggagagatggcactttcaaacgaaaggaattaacggactttacacgtagggagtatgacagaatggaaccaccagaaaaagaggaaacaaacaaggcacgcgcaccggaactggcccaaaaggaagtgaggcacgacaccaacacatgcagaccgacggcgcaacggcacacggcgcgacaccaacagaagcccacaaccagacgacgggactcaacccgaacactggggacaccaccacagtaggcgaacacacccacacgaccacgaggcaagccgaacaacagaacactgagtgagcacaagaacgacgcggcaaacaacatcaccacagtgggggaaggaagacaacacgaagaaagattgctccggaaccggaaccaacgaccaaggcaaaggaggccaaacaagaatggacgaccgtaaaccagagcgagccgaccgcgcacggcacacgaacagaacaggaccagaaacaaaagacacagagacagaaaactaaaaaggagacaacaagcacagacaagacaacaccaaccaagacacacaacacgcacacagacgcgcggacaaagcagaaaacaagaacaacgaacctcgaaaacacacgacagacaaaacaatacaagcgccaccacgcgcgcgcaaacaagacagaaaaaca

SEQ ID NO: 662054 - DNA, 168 bp, Homo sapiens
agataggtaccatgtctatagctattgtaaatagtgctgcaataaacatatgtgtgcatgtatctttatagtagaatgatttatattaccttaagagtatatacccagtcaatggaacaaactggactagccagtatgtagaaaaactagaaattgagacccatatcc

SEQ ID NO: 662055 - DNA, 223 bp, Homo sapiens
cccccccggggggggcccttttttttttaaacccccggggggggggttctgggccccccggtttggttgggggggtccccccccgggcccctttttttttcccaagcggcccgggcttgcccggggcccccaggggggatttttggcccccggttttttttccttttgtggaaaaaaaaaccccggggggtttttttttttcccccggttttggggttgggga

SEQ ID NO: 662056 - DNA, 727 bp, Homo sapiens
tgcttcagctggtctacctcgctagcatgtctgggccgctggcaagactggcggcaatggcccgtgccaatggccaatgtcgcgctcgtctgcgcgcctggcctccagttcccagtgggccgtgtacacctgtgctgctgctgtgaatggtgccactactgcctgatgctgctgttgtgctgcctgtgctgctgccatgttgtacactgtgctgtgcagttgcttggatgtacctcgacctgctgatgatccttggatggctggctgtggcacatgctggcccgctgacagacaatgaaggacgcgagatcatccccactgccagcctgcagcttggccgatcctgcgaactgagcgatgggagctcagacaatgcttgctgtggctggctgttgactgatctgcccagtggaggctgtcctgcccaacatccaggcctgtgctgctgcccaatgaagaccagctgccaccggtgggggccgaaggcgccctcgggctggcaggaaaggccagccaaggcctcccaatggaagtactaagaaggggcccctgtgccctgtggctgtgccggccatgggcttccgccattgccaaccacaaaaggcccttttaagggtgcagcaactggcctcattgacaatatgttgaggcccgtcagactcgtgggagctggccgtgagtccctttcccttagtcgcgacgatggcaacaagtgatgtaagaacag

SEQ ID NO: 662057 - DNA, 248 bp, Homo sapiens
agtcggtatttacaaaggtccatggccacggtgatcttctatgtatgcaaggtaagagtttttaggacccacttcccgtgaaaatccgaaagtgtttctggctgtatgttcggtatttatctgttcttttcagcaggggttcatcaaagcaatattcacagctttggtccctcccaaaccagtagtggtcattcacacattcaagatgggcaaatccatccggaagggcccataatcggggtaccgag

SEQ ID NO: 662058 - DNA, 105 bp, Homo sapiens
aggatacacgctggctgcagtacatcagagagtttgtcacctagtataagcacggctcctcgtgaaggtcccccatccgacactagagggtctatgtaaaggagt

SEQ ID NO: 662059 - DNA, 199 bp, Homo sapiens
  misc_feature (43)..(43): n is a, c, g, or t
tcccaggatgagaaagtgggggaggaataagcaaatttactgngcatgagaaaagaatctttattcttttaaattatcaggcccagagagacatttaaatgagacagcaaacacatactcccccactttggagttatatatttacctcttgaaatggcttgctactggcacaaatagctataaattaacctaacaattc

SEQ ID NO: 662060 - DNA, 389 bp, Homo sapiens
  misc_feature (367)..(367): n is a, c, g, or t
  misc_feature (377)..(377): n is a, c, g, or t
cacgagggccagcacgtaccggttgatccattcggtcaaccagatctgcatgtcggtgcgctccttgaacgagccgatcttgtcgcgcgcaatggccttcaggtagtgcgcgaaacgggacaccgggaaaaggtagggcaggttggcgctgagccgctcgttggactgggcgtccgggtcgacaaggcggccggcgcgcgtctcgtcgtcctgcagcgaatgggcgccgatgaaggccgcgagatcagtgttcttgcggtgcaggatcggcatcaggccgagcttggcgagttccgcctcgcgccggtcgtcgatcgccacctccgtcgggcatttcatcgcgatcgatccgtcgtcggtcgggaangcatgcaccngcaggttgagca

SEQ ID NO: 662061 - DNA, 238 bp, Homo sapiens
cactccagcctgggcgacagagtgaaactctgtctcaaaaaaagaaaaaaaaaaggaccaggtgtcttgccatgtggctcaggctggtcttgaactcctgacctgaagcaatactcctgccttagcctcccagagggctaggattacaggtgtgagccaccccacctgacatgtcactcttcttttggggacttacgtgactcagtggcgcggctaggaccactggcgcggctaggag

SEQ ID NO: 662062 - DNA, 851 bp, Homo sapiens
  misc_feature (712)..(712): n is a, c, g, or t
cattaggaaaagttgctatttgaactttttattgatttttggggggagtaaagaattattttgtgatgcaaataaatatcctttaattgatcgacttgccaaatttagatttgtgtgcatcaggctttcttttttttctttttttagagaagttcaatataagcttttcttttctttgtttctttctttctttattttgagatggagtcttgctctgtcgcccatgctggagtgcagtggcgcgatctcggctcactgcaacctccacctcctgggttcaagcgattctcttgcctcaacctcccaagcagttgggactacaggcgtgagccaccatgcctggctaagttttagtatttgggtgtagacagggtttcacacatgttgctcaggctggtcttgaactcctgagctcaagtgatctgcctgcctcggcttcccaagatgctgggattataggcatgagccaccacccccagccagcatattcttttaaatatttatctaatcattcttctgaaagaaataattaatttattacttcattgtaatgttcaattatcaatggaaatctggcacttatttcccatgcaaagtttttgaacagccatggggaatgctgagctggagagtcaaaatcaaacttggggctggctaagaatactgcagtcaggcaggagcatatgggggctttatctgggatcagctgaangcttgcatttaccacaaaaaaaaaaaaaaaaaaaaaaaattttttgggcgccttgccctcaaaaattttttaaaccattgttgggccccggcccatgtgttgaacactggccaaacgttccccagaaaaccgggcaaag

SEQ ID NO: 662063 - DNA, 600 bp, Homo sapiens
tggatgttttaaaagggcaacccaccaaaacaaaaaaggatgtattcttaattttttttacacaaatcccatggaggatataagttaaaaataggtattgattcaactttatgaaatggttagaaagtaacccccaaaggagaggcttctctctccttcaaatactaaggcttttcattcattagaatgaatgtagtaatgttattttttataacacatcagtctgtaaaagctgtggttctcgcttcgttccattcattaatcatagctccctacagatagtctgcattcatattcacatgtaggtgtcatagccttacctatctgttaggatgatccatcagctgtttcgagacttttcaggatctgtatgcctttgatcaacattcagcgcacacattataatgagttctcgcattatgttgttcctcaagaagcgatttttgttcacctggcgctgcatctaacagccagggcatagagagcatacgtttatgacagagtgtgattcttcgacagatttcaattaatcgcttgccgcagcggtgacttcttgagcgttgccactgtgtggctgtagggctctatgacataatttag

SEQ ID NO: 662064 - DNA, 445 bp, Homo sapiens
ggatcccttatttatcccaacaccacgttccaagtcttaacctgttcagaacgatgggctgcgccactggccgtggtgacgctgtgggagagatcgtggggatcatcacacggcacaacgtcacctatgaatttctgcagggccggctgaggcagcactaccagaccatctgacagcccagcccaccctctcctggtgctgcctgggggaggcaaatcatgctcactccggcgggcacagctggctggggctgttccggggcatggaagattcccagtcacccactcactcagaaagccgggagtcatcggacaccttgctggtcagaggtcctgggggtggtttttgaaccatcagagcttggacttttctgacttccccagcaaggatcttcccacttcctgctccctgtgttcccaccctccagtgttgggcgatcgcggta

SEQ ID NO: 662065 - DNA, 661 bp, Homo sapiens
  misc_feature (24)..(24): n is a, c, g, or t
  misc_feature (244)..(244): n is a, c, g, or t
  misc_feature (298)..(298): n is a, c, g, or t
  misc_feature (303)..(303): n is a, c, g, or t
  misc_feature (307)..(307): n is a, c, g, or t
  misc_feature (332)..(332): n is a, c, g, or t
  misc_feature (360)..(360): n is a, c, g, or t
  misc_feature (406)..(406): n is a, c, g, or t
  misc_feature (417)..(417): n is a, c, g, or t
  misc_feature (421)..(421): n is a, c, g, or t
  misc_feature (463)..(463): n is a, c, g, or t
  misc_feature (467)..(467): n is a, c, g, or t
  misc_feature (471)..(471): n is a, c, g, or t
  misc_feature (484)..(484): n is a, c, g, or t
  misc_feature (486)..(486): n is a, c, g, or t
  misc_feature (493)..(493): n is a, c, g, or t
  misc_feature (509)..(509): n is a, c, g, or t
  misc_feature (522)..(522): n is a, c, g, or t
  misc_feature (546)..(546): n is a, c, g, or t
  misc_feature (554)..(554): n is a, c, g, or t
  misc_feature (594)..(594): n is a, c, g, or t
  misc_feature (600)..(600): n is a, c, g, or t
  misc_feature (660)..(660): n is a, c, g, or t
aggtgggctctggcagcgggtgtnaggtggcagtgagaagccaggccctcaggtgcagctcaggcctctgccgctggtggcctcatagttgagcacgtagtagtcgtggacgtacatgaggacggctattggctgtccgatgatgagcgacagccacacagctgcgttgccatagttgccctggaaaaagcggcccacgaaccaggccagtgggatctgagccatcatgcccgtgaacgcccanaggcggaacattcgcagagggacgctcaccaggtactcgtggaagaaggccgangccangaanacccctgtcctggccatccacttgntgctggccttcttccctgcagaggcagncttggccctggccctgcggcaccatgagttgacgtcgcggtagganaagagctttangaanaggatggtgttcgccatcagccccagcagggagcccactggngtgntagnctccaaccaggtnanaccacanccgctgggaaacacanaattggtggccangttggccacgtgcagcagcagtcncgcctgcnccgtcagggcacccaccgccaggcgcttctcaacctggantgcagncacagcaaagacatttggccgcaataaccaggcatggggcggggcaaacaatagggatcnt

SEQ ID NO: 662066 - DNA, 696 bp, Homo sapiens
cacgaacaaaggtgagggtgcatggtttgatgctgaagtccccggtgaagacgatagaagacttcctgcggaggttcacacccagctgcctgacctcaggctgcagcagcatcgggagcctggccgccaacaagtccagccacaagttgggctccagcttcccgtccaccccgtccagcgacggcatgcttctcaggctggaggagaggctgggccagcccacctcggccatcgccagcaacggctacagcagccaggcggacaactgggcctcggagcttgctcaggagcaggagtcagagcgcgagctgcggtacgaggcggagagcccggatgaggccgcactggtgtatgcggccagagcctacaactgcgtgcttgtggagcggctgcacgaccaagtgtcagtggagctgccccacctgggcaggctcaccttcgagctcctgcacacactgggtttcgattccgtccgcaagaggatgtcagtggtgatccggcacccgcttaccgatgagatcaacgtctacaccaagggggccgactcagtggtcatggatctcctgcagccctgctcttcaggtactcccacccctgcccagctgcaccccagctcgggggaggaggtcctgagaaatatccccacccaattccttctcttgagtaaagtgattttcattaatcctttccaacaaa

SEQ ID NO: 662067 - DNA, 236 bp, Homo sapiens
cgttatcgagagaaatagctgaaccaggcccttatgatcttcatgccctggtgttctagaccgacacggaccccacatctctgtgacttacctggagactacacttcctcagatgaggaagtgaagctatatcaagaagatgggtgaccacctgcaccaaccatccacaggactggagtggccctggaggactgggactgggcgtagtatctctcacgaagaggctcactctccaa

SEQ ID NO: 662068 - DNA, 276 bp, Homo sapiens
  misc_feature (5)..(5): n is a, c, g, or t
  misc_feature (19)..(19): n is a, c, g, or t
  misc_feature (187)..(187): n is a, c, g, or t
  misc_feature (226)..(226): n is a, c, g, or t
ttttntcctcgagacagtntcgttcttgtcgcccagactggagtgcaatggggcgatcttggctcactgcaacctacgcctcgcaggttcaagtgattctcctgcctcagcctctcaagtagctgtgatcacagacagggtctctgtgtcatgcaggctgagtgtagtgcgcaatcacagcttactncagcctcgacctcccgggttcaagtgatcttcccacctnagcctcccaagtagctgcaactataggcacgttaacacacctggctaatt

SEQ ID NO: 662069 - DNA, 98 bp, Homo sapiens
  misc_feature (3)..(3): n is a, c, g, or t
ccncccccccccccccagcaggagagcagcaaaatttatgcaaatttttgacggggttttccttgtcctgccaggattaaaaaccatgagttttttga

SEQ ID NO: 662070 - DNA, 244 bp, Homo sapiens
cacgaagggtgatctgtgctttaaaaagatttggtactactcattcactgattcatgacaccagtttgcagtaacacagaatatgaatagggatgtggcattggtttacattctagtaattcacttcagatttgagctggattattacaaatagttttttcagaagtagactttcagaatctcctaagcagattttcagagtgtggcttcattatgttgtttgaaataatttttcaaaattcca

SEQ ID NO: 662071 - DNA, 264 bp, Homo sapiens
  misc_feature (158)..(158): n is a, c, g, or t
tttctttatagcaatgcaagaatagtgtaaaacaccaccattctactttctgtcagtatgtatttgactaataatctaggcacttcatataagtgcaatcatacaatatttgtccttttgtgtctggcctatttcacttatcattatatcctcagggnttatccatgttgaagcatgtgtcagaatctccttcctattttaggccaaataatatttcattgttatctactattttttttattcattcatccatccgtggacatt

SEQ ID NO: 662072 - DNA, 323 bp, Homo sapiens
taaagttggtgcctgacaggttatatagtgatagctttcttcttatgaacaccagactacaactgacaagtacttaataatataaatattattatattgattagatactgcagtttggcctaataaaatgtgaagtttaaggcaccatttcttgctacactaagaagaccatccacaagtaatgaaatgaatagcacctcccagtagtgtgttttcccaataccactatgcattcatcagcaattcagttcaataaacatctactaagatcctactctttgaccaataaatcactggaatagaggttccagcatattctgaga

SEQ ID NO: 662073 - DNA, 194 bp, Homo sapiens
cttctggtactctaggatcccatgatagcgataggtcgtcacctcaggatatattcagacacttcgagcgtagtaactccttcactagtcactcaggatatatatagaactgcgagcgttgggggcgttcacctcagggatgatatctaagacacctatcgagcgtcaggtcatccccttcgccctcatcgtta

SEQ ID NO: 662074 - DNA, 597 bp, Homo sapiens
agaacctggtagaaagaaagaaaaggtcatgatgtaaccaggatcactctcacgaactctggggtcttcactcactgcctcctgacccattatttaagtacagtttttaaatgcttggtttcctgattcttcaacccaagatatatttgaaacagaaaattagaataggagaagggaaagaggataactagaattaagtgcatggagagctgcaaaaaacagactacaccaccagactacaaaggtagtgaggagagtaagaaacactaagagaaaaaaaagacccagaagctctaaatgtactctagtgtgggagtaatttaggataatggcagtagtcccaatcccattaccagatttcagctgagattagtaatttattttagtagcatagactctatatgtacttatctagaaaactcatttataaggagcagctttcactgatggaaccagataaaacaatggcactgtacttctcatttttccttttctgtgtatgaaattttaaactctgtgtgttgtatatccatatattatacatgtaaaaaaaggataagtctcagacctgaataaacgtcagatctatcagaagta

SEQ ID NO: 662075 - DNA, 970 bp, Homo sapiens
agactcccatagtctctactgatgctcttatctaggtcgcgatctcaccgagctacttatacaggccaaggtcaagtacttatgtcctaataatatcactagtgcactgccacttaagtgactgtatcagctgagatactttgggtcgtgaagctatgaggcagatgagagacatcccatattggagtaggacataccttgactgcaattacgcagttgaccagcatggaggtttgtttggagaaataggaaccatcccctgaaaacacacactaatggtagccactcaactgttgaaacggcactaggaagtccaatgggtgaggccgcctctgagacaagcctctgagttgaggctgggagacggctcccatctcttaggacgagtttgctatatttttagttatcacccctgcctctggagatgggtagaggaacatgagctgaccttctgggaagttaggttggtgaggagttgctgaggcactgcagggccatgcccagtagacgaggaatgtataacattttaagaggctgagagcaccccttgttgggcgcatgcccatggcagcttccttctgccgatcatgggagaaatcaagcactttcacctaaatggctagatgattgattcgggatgaaattctccactcctctcctttaccacatcaccactataccttcctgcaatacatccacgagaactcactgagtggcaaaagggataggaatgaatgttcacccagggccgagtacatgctaaggcactgtacctggaaccatttaaatttgccaccgtcttaatgttccttcacatttaaatctttacaggaagtagggtacagaacatacctatggattattgccagaatcgcagttccaggaccacgagggaataacggcaagttccacatgacattttttggtttcctatagtggctgtacaacgttacaatttccatatatatag

SEQ ID NO: 662076 - DNA, 952 bp, Homo sapiens
  misc_feature (47)..(47): n is a, c, g, or t
gaggccgcttactacggacagaccccaggtcctggcggcccctcagnccggcgaccacgcagcagggacagcagtcaggcaagtggcgaattgccatccctcctcactcctcctgttctccttccaacccaccggcacaccgtccattctcgtgcctttaggtggcgtagcgccgggataaccccttcccctgcggggtgtgcccttgtatgcctgcgagctggtgggccgtgtggccggagggtctcgcgggatgtcccccaccgcgaccgaccagggcaagccattccctggtgctccagagcgttagacgaaggatggtcctcctctgcgccggtctggcctgtgttccttgctgctgcctgtgtgctcgtgatgtgctggggcacccgctgacgactcgcagggcggtgacttctgaagctgctggggagtcggggggcaggcagacatgcgcggacggtgggcacctggcccgtgccgccagcacctcgctcacaatctggccacttgggaagaaaacgtgctatctattgtcccctttctctgcatcacttttgcggattttggtacttttaattcttttcatttctttaaagcccatgatcttttttccctgtgtccaagtgactgtgttgcaggctggcccgtgctctggcagcgactggtggggacgcggggatcggcccaggccccttgcccgccgggctcagcctcccatgcgctcgcccttgccttgtgtcccgggctagcctgtggaagtgggcgtgaacgatcgttgccacctttccaatcctacctcacaggggttgtgtggcggaccctgtgagtctctgggcattgtcaatgtcggttgtgctgcgccgggaagccagcgctcctccggagacctgggcaggttcccgtaagaaccgtacaggggtccggctaccggggctcctcctccaggttc

SEQ ID NO: 662077 - DNA, 225 bp, Homo sapiens
  misc_feature (53)..(53): n is a, c, g, or t
  misc_feature (62)..(62): n is a, c, g, or t
  misc_feature (64)..(65): n is a, c, g, or t
  misc_feature (75)..(75): n is a, c, g, or t
  misc_feature (100)..(100): n is a, c, g, or t
  misc_feature (125)..(125): n is a, c, g, or t
  misc_feature (148)..(148): n is a, c, g, or t
  misc_feature (155)..(155): n is a, c, g, or t
  misc_feature (158)..(158): n is a, c, g, or t
  misc_feature (160)..(161): n is a, c, g, or t
  misc_feature (172)..(172): n is a, c, g, or t
  misc_feature (175)..(175): n is a, c, g, or t
  misc_feature (209)..(209): n is a, c, g, or t
  misc_feature (217)..(217): n is a, c, g, or t
  misc_feature (221)..(221): n is a, c, g, or t
ctctctctctctctctctctctctctctctctctctctctctctctctcgggnaaatcactntnncacaattccnatggattttgtgctctttttgaaanaaaaaattctttagcgtaaacatgnattttttttcaatgtagcccctngggaatnaantnnaattttgagcntcntcaatacggaaaattaacttataccactgagggngagacccntctnaaga

SEQ ID NO: 662078 - DNA, 428 bp, Homo sapiens
cccacgaatatgtagcacttttcacactgtccatatccttgtgtttgcctccctgctatactctgggatcctggggattatgagactgtatagatgctcaaatatgtccttttacttctaggtctctccttcatacctccactcaacttggtgtatgtgatgtccctgtgcccactgaccggcttggcactatcactccagtgtgcgttcaaaccaccggacagatgctgtctgtagcgggtccatgaccaggcgtcatcaggtggcgggcaagatctgctagcaaccgttctgaacgcatggtattccgcttatcttgcatcgcacttgagcctttccatcttccctaaggacccgattccccggcggatacacttcacaggatagtgagtaagcaagcatgctggatgaggtttcatatttcggtt

SEQ ID NO: 662079 - DNA, 648 bp, Homo sapiens
ctgcaggaattcggcattagctacagttgataccctcacaccacgcaggaagagggcatcatcatgtcggacgattacttatggtttgaaggcatagctttccctactatgggtttcagatccgaaaccttaaggtacgtgatgagatcgagatacggtatgaagatgtaatagtattgacttaccccaaattaggaacaaactggttggctgagattctctgcctgatgcactccaagtgggatgccaagtggatccaatctgtgcccatctgcgagcgatcaccctgcgtagagagtgagattgggtatacagcactcagtgaaacggagagtccacgtttattctcctcacacctccccattcagctattccccaagtctgtcttcagttccaaggccaaggtgatttatctcatgagaaatcccagagatgttttggagtctgggtatttttctggatttgtaaaggaactgcgctatatggctcatggtttgaccacattcatgcttggatgcccctgagagaggagacaaactccctggtactgagttatgaggagctgcaggacactggacgaactcttgagaggacctgctcattcctgcgtaagaagttcgaactctaagaactgtccttatatctcgg

SEQ ID NO: 662080 - DNA, 337 bp, Homo sapiens
  misc_feature (67)..(67): n is a, c, g, or t
aaaaggccccccttgggggggggcccccccccggggggtcccttttttttaccaacccggggggttntttggttcccccccccccccaaaaaaaagggccccccccccccccccctcccgccccccccggggggggggggggggggtttttttttcccccccccctccccgggggggcccccccccggggggggggggggggggggttttttttttcccccccccccccgcccccccccccccagtttgggggtttttttggggggggggggaaggggggggggttttttcctttttttttttttttccccccccccccccccctgggggtttggga

SEQ ID NO: 662081 - DNA, 202 bp, Homo sapiens
accgacgctttcttgtgagataataatatgacgtagctttatcaggcacagatgttagattatttcaacacccagttccaaagttgcttccacattttcgggtatcttttcagcaatgccccactctactggtactattagtccattttcatgctgctgataatctaatacctgtgagagctgagatgtgccgcggatcttc

SEQ ID NO: 662082 - DNA, 1250 bp, Homo sapiens
  misc_feature (689)..(689): n is a, c, g, or t
agcggggtagcggacccgagcacagccagtgagcgtccggtcatgagctcagtccgcgaggctgatgcactgtggtcgtggttgcttgagtgctcgagctatctgtgtttggattgctaagtgttcttaagagaatcctccgtcccagtcctttgctcatccttgcaatgatctcgaggcgtcgctgccagcacatcgtactgcggtacgcagtggagtcgtaccgagatagagtagcgtgtgcagatccttaggtacgatagaacgcagggagtctctccacactaagttctaagacatagatttgtgcccgaagtgtattcgccccatgaattattagccctatggtctgtgtgaaaagcgataacatgatacgagacaggatggctttgcacccggacttagactgcttcgaaaagaagcgcgaattggttggtatccaagccattctccgctgcacgacaaggccttctctcagattgttgaatgggccgctataacggaattcaaaaacatagttggccgcggtcggacttgccactcagctctgttcccgtgcgtttaaactttggatccggggtctaattgtggccggaggggccatttggcttcacccttggtgaattgtgaaggtccttcccaagcaatctccacactcttatggggaggactgcgtgatacttctaacnttttaccgtgtaccgttcacaccccattattgcaattggtccgctttttggtggcccacgaatggcgcccaccgacacgtttgacgactaccattcgccgaattttaaagagcgcccacaccccttttcaataagagagaatccccaggggaccctttgttggtggtttaacggccgccattatattatcccacggttgaaacacataacggcggaaacaggactcaaacctgaccaacgcggccggttcaggggataagggttaaaggggcgcaatcaccatttggtaaccccgccttgtggacatattggtgcggcaaatttctttaataatggcaaattcgctgggtgttacaaacgccaagagaaatggtttgttgtgtttcccggccgcaattaaactctatggggttgcgccctgtgtacaccacctttctccggggaattctgcgcacaatgttaccttttgaaaaccaattgcaacaggcggcaaattggcgggcactctgggcgggatcacctttaagcaacaggggaacccccggccctgtaaacaggcgg

SEQ ID NO: 662083 - DNA, 191 bp, Homo sapiens
gggaccatgtaatgaatgaggttgatactaacaagaacagattggtgactctggaggagttttgaaagccacagaaaaagaggaatccttggagccagatagctggaagacattagatcagcaacagtccttcacagaggaggacctaaagatatgaaatatatgcttacaagaaatgacttagagaggca

SEQ ID NO: 662084 - DNA, 521 bp, Homo sapiens
aagtccgtgcatacacttactacctagctcaatacttccattgactctactgaatttcgagggtgtagttattgacttttatcatctaccagaacttattgctataggttctttttataatttctatctctttattgatattctcattttattaatatataattttgctgatttcctttagttctttgtccgagcttttctttaactattcaagcatatttaagatggttttacggtcttagtctagtaagtctgatacctgtgtctcttcaggaataatttctttattttctttttatgagatgcagtcttgctctgtgactcaggctggagtgcagtggcgcaatctcaacccactgcaacctcccgggttcaagtgattctcctgcctcagcctcctgagtagctgggactacaggtatttcagttactaaactgatctgaaagagcagcgtacagaaagtgcacagaataaacacagctctgggcaacagaacttagacactatcacctattaaacg

SEQ ID NO: 662085 - DNA, 151 bp, Homo sapiens
agagcatcagtaggcatgcgaggagtaacggactgatgcttgagactgggggcacaggtacctagaggacgggttgcgtgcccgtgtctggggtctgtcagcaagccgatccctgggctcttggcaagggctggcactgttgaagcgtggg

SEQ ID NO: 662086 - DNA, 1199 bp, Homo sapiens
tggaaatggagtctcgctctgtcccccaggtctaaaccacaggggtgtgatctccctgcaacctccgcctctgtgggtctcaagcgattctctcccaccttcagccctcacaagttagcgtgggacccacaggcacttgccaccacacctgtggcataattttgtgtattttaaatacagacagggtttacaccagtgtgggccaggctagtctcaaacctccgtgaacctctcggggtgtgatctccggcctatacctctctgtgcctctccacaaaggtcgcgtgggatttcacaaggtgtgttgacgccaaccctgttgccgaggcctatagtgtggctccccgtgtgtatattttatcaccatctcatctcgtgtctcttttccgacgccgcggcggaacccattgtgtgtattatacctttataccctgtgtaaacccctcgaggggggctcctatatgtgccctctctcgaaatctcccaaagagaaacgcgtgggggtttcacaaatctccgcggctttctccaccgagtgtatattatacgccgtggtgtgtgcaacattgtgtggagcccaatgtgtgtaatagctttgatcaacacttttctctctcgccgagagcgcccccccttttatcccctctacaatttgtatcatataaacaacaagtgacgagagataatgtgtggtatcacacataataaataacaacatcccccaccaacagtctgtgaggaagagcccgcaggggtggtcgatggaccgaagggttgtctccccgagaaagtctcctgttgttgataaaatcatcccccagaagtccccacaacctctccatgaggggagagcacccccccaaagagtggtgatcaagggagaagaggagtgctcccccctattagtaatgaagggggccccaaagacgaagagggtttttgtgggaaggacaaacctccaaggggcctgccgtttggggggggaccaacaaacctatattacgcgccaatagggaaaccccgctggttggtgttccttttattacccccaaaaaaaacacatcacgagatagaccaaagaacaacataacaacgacgcatacccgcgacaaaccacaagaataaaccacttcgtgatgcacggcgagtactactcatctacttcaacgaagggcgggcgaacgcggcgagaaaaacac

SEQ ID NO: 662087 - DNA, 179 bp, Homo sapiens
cacaggccagtctcgcttggctctcatgactgtggtggtggagatagtgtggggagcctcgcccatggtctcacgtggcaagaagtgcctttagctctggatcccaaccgtttggcacagctttgccactctccaggcccctctggaattgtccttattaaaccagtttccctagaaaa

SEQ ID NO: 662088 - DNA, 82 bp, Homo sapiens
tccccccttttttggggggggtggggcccccccgggggaatttttggttcccccccatggggtttgaaaaaccccccggggg

SEQ ID NO: 662089 - DNA, 1103 bp, Homo sapiens
  misc_feature (1092)..(1092): n is a, c, g, or t
gtctccgcgcccggcgctgggcggcgctcggctgtctccggccgatcgctcggcgctcgggtccgcggccgctgcggcgccgggcatttctccgcagctcggctcgcggccgcgcccgccgccgcccggcccgcgcccatgcaggccatcaagtgcgtggtggtcggcgacggcgccgtggggaagacatgcttgctgatcagctacacgaccaacgccttccccggagagtacatccccaccgtttttgacaactactctgccaacgtgatggtggacgggaaaccagtcaacttggggctgtgggacacagcgggtcaggaggactacgatcggctgcggccactctcctacccccaaactgacgtctttctgatctgcttctctctggtgagcccggcctccttcgagaatgttcgtgccaagtggtacccggaggtgcggcaccactgcccccacacgcccatcctcctggtgggcaccaagctggacctccgcgacgacaaggacaccattgagcggctgcgggacaagaagctggcacccatcacctacccacagggcctggccatggcccgggagattggctctgtgaaatacctggagtgctcagccctgacccagcggggcctgaagacagtgtttgacgaggcgatccgcgcggtgctctgcccgcccccagtgaagaagccggggaagaagtgcaccgtcttctagagccctggcccacccgagcctgagggctggcggggagcagccctggacgtgtccgctgttgtgttgagacgtgtggtgtccctgagtcggctgtggggagcggtgggggtgggccggggggaagcatggggatgaggctgggtggcaggatcctgtcctctctgccgcctcattctggggtgtggctccagccttccctggcccccgccggaggccgggagggagcagggtctccctcagggctgcaggggcaggtgcagggaagccccaggatgggcttccctggagggggagggtgggggggagttctgttccttgtgccccgaggtggggcagccccttctcattttatacaataaacattctccacctacnaaaaaaaacgc

SEQ ID NO: 662090 - DNA, 128 bp, Homo sapiens
ccccagttaaacagctgaaggaatttgaggggaagactttagtgtcagtcaccaaagaaggcctggaacttccagaggatgaatgtgtgtggttttggtggggagagaacaggagctgttgtaactgg

SEQ ID NO: 662091 - DNA, 410 bp, Homo sapiens
ttagtgaggtggttttcctcgatggcaaccagtgaatgacccaagcggacacatggcattctggaactcgcccagtatgagtcgctgctgtacgcagcccgttgggatctcacgggcgtaccacactagtgatgctgggtgctggtgatgtagggcagagtgccatgaacatgcagtacatcagccaccgatacccagaagatcaatgatcccaccatagaagatgcttataagctcaggatccgtctagatgctgagcctgccaatctggacattagggatacaagctggacaggcagaagttcacgccctgcgggcccagtctctgcgggcaggcgccgggtatctcatctgttcctcctctcccggctcgtcgccgttcccatgacgttcgtgcgttccaaccccag

SEQ ID NO: 662092 - DNA, 800 bp, Homo sapiens
ctttcacttctgagtcccagaggttacccgaagggcacccctctgacatccggcctgacttcttctcacagtgagcaagaaactagcgccccgatctcaatcattatacccaaatctctccctctagctaatagcgtaagccttctcctcactctctcaatcttatccatcatagcaggcagttgaggtggattaaaccaaacccaactacagcaaaatcttagcatactcctcaattacccacataggatgaataatagcagtgctaccgtacaaccgctaacataaccattcttaatgttaactagttatattatcctaactagctaccgcattcctactactcaacttaaactccagcgagcacgagcctactactatctcgcacctgaaacaagctaacatgactaacacccttaattccatccagcctcctctccctaggaggcctggccccattaaccggttttttgcgccaaatgggccattatcggaagaattcacaaaaaagcaatagccgtcatcatccccaccatcatagccaccatcagcctcgcttaacgctgctagttctagctacgcctagtctactccacctcaatcacactactccgccatatctagacaacgtagaaataaagatgacagtttggaacattacaagaaccacagcattctccccagatcatcgcccttacagctactcctagctattcgccttaatagtagtaatcttgatacagaggggatgagaagatctgttcgcgccgcaaaaagaggggggtcaaacccgggggccg

SEQ ID NO: 662093 - DNA, 811 bp, Homo sapiens
  misc_feature (800)..(800): n is a, c, g, or t
agcggacgagggagggagcagggccctggggagcccctgaccactccaccaggtcccacctttttcccaaggacgtctttctgatctgcttctctctggtgagcccggcctccttcgagaatgttcgtgccaagtggtacccggaggtgcggcaccactgcccccacacgcccatcctcctggtgggcaccaagctggacctccgcgacgacaaggacaccattgagcggctgcgggacaagaagctggcacccatcacctacccacagggcctggccatggcccgggagattggctctgtgaaatacctggagtgctcagccctgacccagcggggcctgaagacagtgtttgacgaggcgatccgcgcggtgctctgcccgcccccagtgaagaagccggggaagaagtgcaccgtcttctagagccctggcccacccgagcctgagggctggcggggagcagccctggacgtgtccgctgttgtgttgagacgtgtggtgtccctgagtcggctgtggggagcggtgggggtgggccggggggaagcatggggatgaggctgggtggcaggatcctgtcctctctgccgcctcattctggggtgtggctccagccttccctggcccccgccggaggccgggagggagcagggtctccctcagggctgcaggggcaggtgcagggaagccccaggatgggcttccctggagggggagggtgggggggagttctgttccttgtgccccgaggtggggcagccccttctcattttatacaataaacattctccacctacnaaaaaaaacgc

SEQ ID NO: 662094 - DNA, 1098 bp, Homo sapiens
  misc_feature (875)..(875): n is a, c, g, or t
gtctccgcgcccggcgctgggcggcgctcggctgtctccggccgatcgctcggcgctcgggtccgcggccgctgcggcgccgggcatttctccgcagctcggctcgcggccgcgcccgccgccgcccggcccgcgcccatgcaggccatcaagtgcgtggtggtcggcgacggcgccgtggggaagacatgcttgctgatcagctacacgaccaacgccttccccggagagtacatccccaccgtttttgacaactactctgccaacgtgatggtggacgggaaaccagtcaacttggggctgtgggacacagcgggtcaggaggactacgatcggctgcggccactctcctacccccaaactgacgtctttctgatctgcttctctctggtgagcccggcctccttcgagaatgttcgtgccaagtggtacccggaggtgcggcaccactgcccccacacgcccatcctcctggtgggcaccaagctggacctccgcgacgacaaggacaccattgagcggctgcgggacaagaagctggcacccatcacctacccacagggcctggccatggcccgggagattggctctgtgaaatacctggagtgctcagccctgacccagcggggcctgaagacagtgtttgacgaggcgatccgcgcggtgctctgcccgcccccagtgaagaagccggggaagaagtgcaccgtcttctagagccctggcccacccgagcctgagggctggcggggagcagccctggacgtgtccgctgttgtgttgagacgtgtggtgtccctgagtcggctgtggggagcggtgggggtgggccgttgggcaagatgggaattatgatagattgcattcagcatagntgaaaatgtccgggatggatacatatgttaaacaaacacctgttaaattcagcatactccttatgagaatacttgggcatttggttaaggggtgctcacggtctgacatgtgactagacttcaattactactggaagggccctaaagataccaactaggccagccctctctggtgggttaaaatgaaacctttgggaagttttgagcttagcgctttttttgt

SEQ ID NO: 662095 - DNA, 528 bp, Homo sapiens
cgcgtggctcacgctgtaatcccagctctcagggaggctaagaggcgggaggatagcttgagcccaggagttcgagacctgcctgggcaatatagcgagaccccgttctccagaaaaaggaaaaacaaaaaaccaaagggcaaaaacaacaaacacaaaaaaacacaaaaaaaatgtggtggcgggcgcggcttgggagccagagagaagaaggcttctaaacaccactctgctgttgggccgcccgcgcggcccccaaggagtggtaaagtaaacccgtggtgcacagaagccggtgctcccaaaaagaaaacccggcgcacaagacaatcaggtcggtggtgggtccccccccaaaaaaaaaaacggcgcggggggagaaaccgggcggcggtctgtgacaaacactccagaggtaggggctaggagagggcaaccagggggccgctaaccaaccaagaagcaggccccagcagagagcgcagaataacaaaataccgccacgaccgagggaggaagaagacaaaa

SEQ ID NO: 662096 - DNA, 1256 bp, Homo sapiens
  misc_feature (1245)..(1245): n is a, c, g, or t
cctcccagtgggtggggcaggcctctcacctgggcttgaaccctcagccggccccaccctctcctgccgccaccctcggagtcggggcctctgcctggggccccagtgtggggcgccctgcgcccttattcaccaccccagcccccggagcccggcctgcccaggtcgtcctccagccttaggtcgccacggatctggtgggctgggtccccctctcgaccccagacgcccctaactcgcctctggctccgggagagggggctgcccttgctgggcagagggtccgaggccgggcccgggagccacgtggcttgccctgtccgcagcgccgtggggaagacatgcttgctgatcagctacacgaccaacgccttccccggagagtacatccccaccgtttttgacaactactctgccaacgtgatggtggacgggaaaccagtcaacttggggctgtgggacacagcgggtcaggaggactacgatcggctgcggccactctcctacccccaaactgacgtctttctgatctgcttctctctggtgagcccggcctccttcgagaatgttcgtgccaagtggtacccggaggtgcggcaccactgcccccacacgcccatcctcctggtgggcaccaagctggacctccgcgacgacaaggacaccattgagcggctgcgggacaagaagctggcacccatcacctacccacagggcctggccatggcccgggagattggctctgtgaaatacctggagtgctcagccctgacccagcggggcctgaagacagtgtttgacgaggcgatccgcgcggtgctctgcccgcccccagtgaagaagccggggaagaagtgcaccgtcttctagagccctggcccacccgagcctgagggctggcggggagcagccctggacgtgtccgctgttgtgttgagacgtgtggtgtccctgagtcggctgtggggagcggtgggggtgggccggggggaagcatggggatgaggctgggtggcaggatcctgtcctctctgccgcctcattctggggtgtggctccagccttccctggcccccgccggaggccgggagggagcagggtctccctcagggctgcaggggcaggtgcagggaagccccaggatgggcttccctggagggggagggtgggggggagttctgttccttgtgccccgaggtggggcagccccttctcattttatacaataaacattctccacctacnaaaaaaaacgc

SEQ ID NO: 662097 - DNA, 1296 bp, Homo sapiens
  misc_feature (1285)..(1285): n is a, c, g, or t
cctcccagtgggtggggcaggcctctcacctgggcttgaaccctcagccggccccaccctctcctgccgccaccctcggagtcggggcctctgcctggggccccagtgtggggcgccctgcgcccttattcaccaccccagcccccggagcccggcctgcccaggtcgtcctccagccttaggtcgccacggatctggtgggctgggtccccctctcgaccccagacgcccctaactcgcctctggctccgggagagggggctgcccttgctgggcagagggtccgaggccgggcccgggagccacgtggcttgccctgtccgcagcgccgtggggaagacatgcttgctgatcagctacacgaccaacgccttccccggagagtacatccccaccgtgtgagtgtgggggcttcccgggagagcacaggccctccgtttttgacaactactctgccaacgtgatggtggacgggaaaccagtcaacttggggctgtgggacacagcgggtcaggaggactacgatcggctgcggccactctcctacccccaaactgacgtctttctgatctgcttctctctggtgagcccggcctccttcgagaatgttcgtgccaagtggtacccggaggtgcggcaccactgcccccacacgcccatcctcctggtgggcaccaagctggacctccgcgacgacaaggacaccattgagcggctgcgggacaagaagctggcacccatcacctacccacagggcctggccatggcccgggagattggctctgtgaaatacctggagtgctcagccctgacccagcggggcctgaagacagtgtttgacgaggcgatccgcgcggtgctctgcccgcccccagtgaagaagccggggaagaagtgcaccgtcttctagagccctggcccacccgagcctgagggctggcggggagcagccctggacgtgtccgctgttgtgttgagacgtgtggtgtccctgagtcggctgtggggagcggtgggggtgggccggggggaagcatggggatgaggctgggtggcaggatcctgtcctctctgccgcctcattctggggtgtggctccagccttccctggcccccgccggaggccgggagggagcagggtctccctcagggctgcaggggcaggtgcagggaagccccaggatgggcttccctggagggggagggtgggggggagttctgttccttgtgccccgaggtggggcagccccttctcattttatacaataaacattctccacctacnaaaaaaaacgc

SEQ ID NO: 662098 - DNA, 135 bp, Homo sapiens
catcggggttcacagggtggttataattttgtgatatttatgggctgggtgagggaggtaggtggtagttggtgtttaatactgttttagttgggtgatgaggcaatagtgtaacggagtatggagggtaattat

SEQ ID NO: 662099 - DNA, 611 bp, Homo sapiens
gtaacgaagttcttaagctcatagccgcacctgcagcatccagttacttcaagtgccagtggccgtgcctacccagatgtgtgctgcacttgctgatggtctactgggtggtacagacaacagagtgcccattccatggagtgtccggaacctcgagcctctactccagtgtttggggggatcctatccttgatcaatgagcacaggatccttagtagtccgcctccctcttggcttgctcaacccaatggactctaccagcagcatggggcaggactctttgatgtaacccgtggctgccatgagtcctgtctggatgaagaggtagagggccaggctttctgctctggtcatagctgtgatccggtaacaggctggggaacacccaacttcccagctttgctgaagactctactcaacccctgaccctttcctatcaggagagatggcttgtcccctgccctgaagctggcagttcagtcccttattctgccctgttggaagccctgctgaaccctcaactattgactgctgcagacagcttatctccctaaccctgaaatgctgtgagcttgacttgactcccaagcctaccatgctccatcatactc

SEQ ID NO: 662100 - DNA, 1221 bp, Homo sapiens
  misc_feature (1210)..(1210): n is a, c, g, or t
ttgttttgtgggggggaaatgtggtatgtgtctgctctagagccggggagggggcgcgcccccccccgggagccagggatgacacatctctcgtcctccagccttaggtcgccacggatctggtgggctgggtccccctctcgaccccagacgcccctaactcgcctctggctccgggagagggggctgcccttgctgggcagagggtccgaggccgggcccgggagccacgtggcttgccctgtccgcagcgccgtggggaagacatgcttgctgatcagctacacgaccaacgccttccccggagagtacatccccaccgtgtgagtgtgggggcttcccgggagagcacaggccctccgtttttgacaactactctgccaacgtgatggtggacgggaaaccagtcaacttggggctgtgggacacagcgggtcaggaggactacgatcggctgcggccactctcctacccccaaactgacgtctttctgatctgcttctctctggtgagcccggcctccttcgagaatgttcgtgccaagtggtacccggaggtgcggcaccactgcccccacacgcccatcctcctggtgggcaccaagctggacctccgcgacgacaaggacaccattgagcggctgcgggacaagaagctggcacccatcacctacccacagggcctggccatggcccgggagattggctctgtgaaatacctggagtgctcagccctgacccagcggggcctgaagacagtgtttgacgaggcgatccgcgcggtgctctgcccgcccccagtgaagaagccggggaagaagtgcaccgtcttctagagccctggcccacccgagcctgagggctggcggggagcagccctggacgtgtccgctgttgtgttgagacgtgtggtgtccctgagtcggctgtggggagcggtgggggtgggccggggggaagcatggggatgaggctgggtggcaggatcctgtcctctctgccgcctcattctggggtgtggctccagccttccctggcccccgccggaggccgggagggagcagggtctccctcagggctgcaggggcaggtgcagggaagccccaggatgggcttccctggagggggagggtgggggggagttctgttccttgtgccccgaggtggggcagccccttctcattttatacaataaacattctccacctacnaaaaaaaacgc

SEQ ID NO: 662101 - DNA, 849 bp, Homo sapiens
gtagtcagttccagcaacagcttacatgaggaggagcagtgtgttgctccttctgaaaggaatggtcatttgctgagcagcacgataaacaaaggatagccactgagacaagcctgtaaggctaatggtcatgcccattctggtttcttcaccaatgagaaaaactgggacctgggggagtttgcagaagccatccaagggcacctgtcttctcacagcacaggaacttcctgcagccctccctcctgtcttgtttctccgcttaattgagaggagaggacagaaccagatgcaaggcagttccaacagtaatgacattgctctaaggtgtggatccaagaaccggtgacaaggtccaggacaattccatcccgggacacttgacccaactaagagcactgtgcattgatggctaagttcagagctctgaggagatggtcaaactcatttggcaagaaaccaagatattttccaacctctgccagccaggtcctttggaggcggcattcaagaacgcatacattctggacaaatccttcatctcaaaatcatttgcccttcatgaaacccaaaggcattggctccaaagtccatttcccattcacttcagcacattgcatcttgtattgacttgacggcagacatctaagtccaacaaactcttgggtcaacttctcttctttcttgaacattcttgtgtgcatagaggtatcctctgaagggactcttggacttacttctggctctccagtgtgcctatccttcatcgggggatctatagggcccaggacgcaagtgcgaaccggggacgcggcacatctgagggaagcaggcacagtcatttcttgc

SEQ ID NO: 662102 - DNA, 804 bp, Homo sapiens
  misc_feature (793)..(793): n is a, c, g, or t
ttgttttgtgggggggaaatgtggtatgtgtctgctctagagccggggagggggcgcgcccccccccgggagccagggatgacacatctctcgtcctccagccttaggtcgccacggatctggtgggctgggtccccctctcgaccccagacgcccctaactcgcctctggctccgggagagggggctgcccttgctgggcagagggtccgaggccgggcccgggagccacgtggcttgccctgtccgcagcgccgtggggaagacatgcttgctgatcagctacacgaccaacgccttccccggagagtacatccccaccgtgtgagtgtgggggcttcccgggagagcacaggccctccgtttttgacaactactctgccaacgtgatggtggacgggaaaccagtcaacttggggctgtgggacacagcgggtcaggaggactacgatcggctgcggccactctcctacccccaaactgacgtctttctgatctgcttctctctggtgagcccggcctccttcgagaatgttcgtgccaagtggtacccggaggtgcggcaccactgcccccacacgcccatcctcattctggggtgtggctccagccttccctggcccccgccggaggccgggagggagcagggtctccctcagggctgcaggggcaggtgcagggaagccccaggatgggcttccctggagggggagggtgggggggagttctgttccttgtgccccgaggtggggcagccccttctcattttatacaataaacattctccacctacnaaaaaaaacgc

SEQ ID NO: 662103 - DNA, 308 bp, Homo sapiens
  misc_feature (297)..(297): n is a, c, g, or t
cctcccagtgggtggggcaggcctctcacctgggcttgaaccctcagccggccccaccctctcctgccgccaccctcggagtcggggcctctgcctggggccccagtgtggggcgccctgcgcccttattcaccaccccagcccccggagcccggcctgcccaggtcgtcctccagccttaggtcgccacggatctggtgggctgggtccccctctcgaccccagacgcccctaactcgcctctggctccgggagaggccccttctcattttatacaataaacattctccacctacnaaaaaaaacgc

SEQ ID NO: 662104 - DNA, 106 bp, Homo sapiens
tgcttctgcccttcctcttctgctgcttcctgcttctgcccttcttctgctgcttcctgcttctgcagcttcctgcttctgccgcttcctgctgcttcctgcttct

SEQ ID NO: 662105 - DNA, 945 bp, Homo sapiens
ctggttccaagccctgcttccctgtgcactccagcgacatctccagaccccttcttctaccaagccaggcccagagagctcaatgttcctcctgcagggagcccgcccctctccgttttgctggcccctctgtgagatttcccggggcacccacaagttctcggaggcacgctcaagatcggggacggtgtggcttgtgggctgcgtgctaccgggctggtgatgaggaacacaggtgtatgctgtgacacaggctgaaggagaacgctgacgctgagagtggatctgcacgtgaaccgtcagagtctttcctgaccgaggtggagcaactctgtccaggttaacgtcagcccaaacattgtggactttgctggctactgtgctcagaacgtgcttctactgcctggatgtacgtggcttcctgctcccaacggctccctggaggaccgtctccacgtgccagacccaggctgtccaactctctcctggctcagcgactggacatgcttctgtgtacagcccggggcaatgcagtttctacatcgggaacagcccagcgtcatccatggagacatcaagagtccaacgtccttctggatgagaggctgacacccaagctgggatacgtattggctggcccggttcaggcgcttgtggccgggtcagggcccccaggcagaagcaggattggtggccccgggtacctctccccggtgcggtgcccccttgcctacctgcccaaggcttccctccgcccgcgaagggtgctttgggaccgggaccccttttccttgggggggtggggccccacccttctgcgtgaggcctaaccccgtttttgtcgcacttcacactctgctgtagatgtggggctgtttttgcccccctcatcatgtgtggtgattcccccgcggttataagcccgccccctgtgtggctggttcc

SEQ ID NO: 662106 - DNA, 683 bp, Homo sapiens
tcaaagagcaaaggtcattatgaggtgactgggagcgatgatgagacaggcaagttacaggagagtggggtgtacctggctctaagaagtcccagacatgacctcctcgttctagcaatgacagtgggaataaggttggaataacagctacccgaggaggagatgatcagctaaccacaaagaaagagtagcaggacatataagtatgatgatgtacaatatatatatatataacaaaagaatcagaccatagagaatgaaggatgaacactaatataaactccaaagaaacagcacaacagactagacacagggagagaaaaaacgaagaacgacagcgacagcgagagaccaggaagaacaaagaggcgtagagaaaaggacgaaacggagtagaaggaggcacagaaaaaataaataaagaagaagagaaaagcgaggcaagaacacaaacagagagacgaccacagtgaagcgaacagaacagcaacgatacaaaagaacgaagaagaaggccacaagagaagaaaaaaacaaaaaggaaaaggacagaagaagccagaaggaaaacaagagaagaacgaacaacagaaagacgggaaaaaaccgcagcaaacgaaagagaagagaaagaacgaaaaaagaaaacaacacaagaaaaagcacacaaaaaaaacccacaa

SEQ ID NO: 662107 - DNA, 829 bp, Homo sapiens
  misc_feature (620)..(620): n is a, c, g, or t
gaatatatctgcgttataaaactagttttaagaagaaattttttggccctatgaaattgtaaccctgaacatgacattgtactcatataataatgatctaaaatgctgtatggtaataattaaatgggtaaagccatttacataatatagaaagatatgcttatatctagaaggtatgtggcatttattgtggataaaatctctcaattcagagaaatcatctgatgtcctatagtcacttggccagtcaaaagaaaaaataccctaatgtagttgtggaagttatgctaatatggtgtactgatataaaacctaaatgttctggcctaccctgtggtcataaagatatttgtgagcagactgtaaaaccaagaaaaaaaaaatcatggctttcttagccaaaatggcctagtatgtaatttggttcaacaatacaatgttcggatttaatgcacttgtgtcgctataaaacatcccttttttccatgtagattccactaatggagtactctaagaacgcataatttcagggactatattagtggtgaacagtacatattctggtgttcctatgtactttgtaccaatttttcattcccttttggctctgtgtgcgtggnatctaacactaactgtattgttgctgttacctccactaaacctccttcgtgcaaacacacacaccacaacaacaaaaaaaattggggggcgccggcgccggaaatctttaaaaactttgtgggcgcggcccggttaatgaaacggcacgttttccaaggaactgcagcacaggcgggccccaaaaaccggggcggttcaaaacacgttg

SEQ ID NO: 662108 - DNA, 825 bp, Homo sapiens
tacaaagggtgtcagcagatgcgaagtaaagaacgtcactttgaaacccattcatcacacagtatacgctacacatggaacacccaagccatgactgaacacgtgctcagtgcttgaacttctggaaattgttctttgactcatgacatttcgcagtgcagagaaggcagaagccaagaaaaacgtcatcttggagactgggcttggtaccgcagacatcagctttacatcgttcacaggagatgatggcatgcgaggaagatgcaatggagatcatgacactactgtaataaggccaggaaaactgccatttcaagttctgaagaatgtttgagtattggaatggagagaaacaacatggttccaagagggagggtgtaaaacctgtaaaatactgtcgaacatatgtattcattagttacaatctcgatgttgtgttgacttagtactgtctatttacgaacacgtaaaagataccgcaaatatgtttgagtattaaatcatttacctagcgttgtagaagtattaatttacttgaagcagatgtagaatgtggcaaattatgtcaagcatgtgtctccagcgtgatgtacttgtgcgccttgtgagtctatctggcatgtagctttaagggtgtactgtgaaaatcatcagaagtcttactggaagctatggtggggacacattgtccttgcgaaccaccagtgggtggcctaccccaggtctaagtgaaggtgacttgcggataaggggccccaatggcggcacgggactaactacaggggcacacagcgggagcccccagaccgcaaaattaaacccggg

SEQ ID NO: 662109 - DNA, 942 bp, Homo sapiens
gcagaccagtgagagcaccaaccatgcgggtgctgtaggtggtccatgctgccaggaccctcatcctcgtggcatcggtgtctggcagatgcggcaccggtcaagagcttctttgagagccaagaagcttgtgtagctgtcccaggcgtcacaacgcatcctcccaggctgtgggggaggaaaggacctcctggaacgtgacttcttctgtcatggagagactggatttcccgagccatacctgtttctgggaagggagaggggctgggaggcaaccctactaggcacatatgcttgaaggaccagcagcgatgcgtcatagttactgagcaggtatgttggggcaaagttcgctgccctctctctctgcgtacttctgggcactgtgtggtagtaatcacccgaggtgctggtaaagtccctcctcttggcggctcagaatcaggagtgttactggatcagggatgtgaggctgctgttgggggtgggggggaggcggaatggggcacggcaagccacgtgcttctgtacttgcctatgctaaactctaaggtgttttcgcagcacgtgtctgggagtatggtgcctgtccatagtccatcctgagcacccttgggaacctcactgttgctctactttccaggctagagctgctgatccagactgtgtgttagctgagagagagagcgtggacaggtttcgccaggtggcgaatgtgcggcctgcagtggacctgtgcctgctcaccatggcacgtcacttcagggcgctctcacagaaacgggaccatggcaaagccaaagccttggcgcttgcgtgagtgtcgactgtacaacctagtgccgctcatcgtccaacgtcgctcggcccgagtccctgaaccaacacaacggcgcccgctatatatccacggcgcccacccactcccttctttcaaggcct

SEQ ID NO: 662110 - DNA, 419 bp, Homo sapiens
tagttcctgtcagctaaggcccatgctttctgatactgctgataaggttttctatttccagatcaaattaaagcaaaccttactggccctgttactgaagctgtgcatgggggtcgtttgctgtgaggtgtttctatggctttgagccagggtatgaacatctctagtgttcatgttatttcctgagactagcactcacgggaagtagaatttattacaacctgctgtttgagttcatgaagagtaggacaatatgagactctggggcagtgaaagacttaccaggattccttctggaactgactcgtcagctcattcatgtcttacccagtctttaaacagtatttcatgataatggtctgcttttaattgctgggctttaccttaccctttttgtgattgcaggtcctacaggtatg

SEQ ID NO: 662111 - DNA, 624 bp, Homo sapiens
gcacgaggagagagagagagagagagagagagagagagagagagagagagagagagattgagagagagaattgtgatttggtacctatgcgcttccctaggttccgagaatcagtgctttctagttctctatattatccctagattctggcttacgccatattgattctgcttctttatccagtactgactttcatgcttgactgtccatccatggcttgattgctgttggtagtgtgattagagaccacatcttttacactccaatgcttcggtgcattttctttcaaccacacatagtccaacctgcttcctaatgcttccctgaatatccttcaactgatctatctttacctctatctccttcatttcccaatggctctcaagctagttgagtctccactcccatcccttgatgtctaattgcaaggttgcatgattgccccattccttctgtttgttcttcaacttcattcttgtgtatataatctcttaactagtcatgactttaatccttttcctgttttctatctgttagaatttcattctttacctataccatagctatgtggttcctttctttacagttcactatacttgctttttctttgcccggtgttgttct

SEQ ID NO: 662112 - DNA, 158 bp, Homo sapiens
ccaaaaagtcaaatcagaatggataagactcttaaccatcataatcacccagatcaaaaggacaagaatccttcaagaaacagtgaaaaaactccttagaacacccaaaaggacctagcttctgtagcatgacattaaagtcataaatgcaaggctag

SEQ ID NO: 662113 - DNA, 236 bp, Homo sapiens
atagtcttgtaccgctcggtaattctaggccgcttgattaccctgtgttccagccatacaactgtaagccgctcattacactctcattgctctggttggccatgtgatctgtcgtctcttctgtatacatatgtacttcatgttccatagcagcttcagaagccacagtagtagaagcctctcgcgcgtcagtgccagtgtagactcagtgtgtgcgagatcacgcgtcatttacc

SEQ ID NO: 662114 - DNA, 854 bp, Homo sapiens
ggatccgcaaggccgcccggggaactgctgacgcttgatgatgaaggacccacggcgtctgttctgaaggcaacgccctgtctgcggctggctggtccgcattggggtgctggatgatgggcacagatgaagtctggattacatcctgggcctgtaagatagaggatttcttagagagacgcctgtcagacccaggtcttcaatgctgggcttggccaagtccatccaccatcgcttcgcgtgctgatccgtcagcgcctagtatcagggttccgcaaatgcaggtggtgaactatctccgtccttcattgtcgcgcctggtattcctcagaagcacatcgacttctctctgcgctctaccctacgggggtggtccgacccgggaccagcggtgaagatggaatgaattgccaaggaaggggcccacgggtgagggctgaggggctggagatcgatcagacgggacggggaagggacttctaaacggtccagctcatgtgtccccgtccctgtgagccctgctgtgagaccttggtcattcgcgtatctcctcgtgaccacataccttaaacaccatggtaatctaagccgacgtctctaaccttgggccccgaggaagtcttacggaaccagggggaagttccacacgcaagggccatattatgccgaagaaaaaaacgaccgacggaaacagaaccccattccaccaaaggcgcggcagcaccttccaggccaccacagaagcgaaaccacaaaggacgaacacacgcgccaaggctccgatgtcccaacgtcaactactaagcgagggaagtgggtcccggccagggactacccaatcccgcgtcccccaa

SEQ ID NO: 662115 - DNA, 1318 bp, Homo sapiens
gttaggagataaatctcaagacatgtgtgtgagagagagagagagcaaggagagcgagctgtgatctgtgcttgccgcgaccgtgtgcccgtttgatcccgacattagctgttaggggcatcggagacacagagcgcgggcatagacaccgccgacaccggggactcatgtctatttatacctttccatcacacacgcgagcataggacacacacgacagctacacacctatggagatccgtagccagtcgaagaatattacgcgtcggggacaagccaggtgcacgactaaaaagaacaagaaaaaaacagaaagaaaacaagcgagggagaccaggtcacgctcacaagattcctcaaaaccgcatcatacgaggatgaggccgtcctgagagaatcaatgacccactgggcacatcgggatgaccccagggcaccagcgcatgactgcaccgcgcggggacaacctgccgagctcaacggctgcggcgacagccatggtctgcacaagccaggaaggcagcgccggaggagcaaacagggagccacctcaggcacgggcgccacccgtagaccgcaagagtaatgcacccccagggaaaactacggacagatagaacaccagaaacacacaacggcgtcgccagttcccccgaaacggcccaagaagccaagccgagccgactggcaagaggcgaagccgcacccgtagggagtccaaactcaaaggagaacagcgcgcggtccacaggacagacaaacaggcagaactactgagaagacacacacagaaaaacctccgaccacacacaacaacccacaggaacagcaagccaaccccacacagcaccaatagaaccgacggagcaccgaaagcgggcacgagatgggcagagacggcgcggccgggaacccaacgacccgcgcggcagacagcgaagcaataaacagcgcgcgtcgggagcggggagtgcacacccacgagcgccgacaccacagagcgggcgtggccagcccgcaggccacgcccacgcggccggcgcagagccggagagtgggagcgaacacgggataccagggctgggcgggcagcactacaccgaccagacgcacccaccgagacgaaattacattaaattcaagtacaccaaaattctaaaaaccacaacattatcactacatccaaactcataccaacacctaaccaaactaacatataccgaatcgaacatcaatgcattacactacaacctccgagtcacatacagaaccatccctaatattatactcccacaacataacataaactaaaaccaca

SEQ ID NO: 662116 - DNA, 365 bp, Homo sapiens
gaacacggcctctcttaaatgaaagcgcataaggtgctttcacacaaggacccagctatagtcaagaaggtacagctctcaacaacaggtcagaatgtcgtcctcttcttctgccttggccccggggaagcacaggcgttctggccaaagggctcagaaaatgtcgggcacgtatataaccagtgtaggcaccatcaataagtccagccccattgttgtgaatgaaccaccaggacacctgggccccatgccacgggtccttgctgtagtcttttcgcaaacctctgtgtgaccgtgaggcggcgtgttcctcaacaacatcgtggcatctggctgtgtgggctcagagtctgtgtatatgacag

SEQ ID NO: 662117 - DNA, 1267 bp, Homo sapiens
  misc_feature (41)..(41): n is a, c, g, or t
  misc_feature (259)..(259): n is a, c, g, or t
  misc_feature (264)..(264): n is a, c, g, or t
  misc_feature (269)..(269): n is a, c, g, or t
  misc_feature (272)..(272): n is a, c, g, or t
  misc_feature (285)..(287): n is a, c, g, or t
  misc_feature (315)..(315): n is a, c, g, or t
  misc_feature (318)..(318): n is a, c, g, or t
  misc_feature (321)..(321): n is a, c, g, or t
  misc_feature (323)..(323): n is a, c, g, or t
  misc_feature (340)..(340): n is a, c, g, or t
  misc_feature (346)..(346): n is a, c, g, or t
  misc_feature (367)..(368): n is a, c, g, or t
  misc_feature (376)..(376): n is a, c, g, or t
  misc_feature (384)..(385): n is a, c, g, or t
  misc_feature (391)..(391): n is a, c, g, or t
  misc_feature (394)..(394): n is a, c, g, or t
  misc_feature (398)..(398): n is a, c, g, or t
  misc_feature (403)..(405): n is a, c, g, or t
  misc_feature (408)..(408): n is a, c, g, or t
  misc_feature (410)..(410): n is a, c, g, or t
  misc_feature (414)..(414): n is a, c, g, or t
  misc_feature (456)..(456): n is a, c, g, or t
  misc_feature (474)..(474): n is a, c, g, or t
  misc_feature (515)..(515): n is a, c, g, or t
  misc_feature (545)..(545): n is a, c, g, or t
  misc_feature (549)..(549): n is a, c, g, or t
  misc_feature (724)..(724): n is a, c, g, or t
ttctattttgttattcattccatttgagtctttctgatgancttggctatactgaaatctgttattttagtgaggctccaaaatgagcaaagctaggcctgattagagtagagtgactattaaaaaacataactttctaggagctataaatcaaagttttaaaaagatgtttggatatatttgagtattccgatcatgaaaacagaaattgccctgcctactacaaggacagactgatgggaaattatgcacctggtcnacttngctcntangcagacgatgctnnnaacactaacggcctctctgatatctatngtnagncntagtactgatccccttncccagngctgcacacccctggtctggnnccccaatngcgtcgcnnccgaanccnatanccagnnnccngnaatncaattgaagaaaaatacatccaaataaagactttattattanacagaccagatagcatcnagaaatcatgtgactgttatgattatcagaatgtcttaacnttttagggcaaagttaacactgaaagttcnagcntaagtgttggaacttttgtgggaaaaaaaaatcacttttgaaactcagacttcagtgtatacccaataatttaaaattatgtgaaatgttttaaatttgtgaactcgtaattactgttttaatgattcagtttcttcagagtggtaattgtataaaattgctattgcagctttanattcaatatgatgtgcctgtaaaccaaggagttttccccgtttgtaaaaagacattgtagataattgaatgtttgattttagaaaggtcattagtttcttgttacacattttgttagtctggttttgttgcttatcgggtttaatattgttcttgaaaatagttgatgctatgttatgtataacttttctaataaaagttgtgttataagctgtagtatgatccgtctaataaaaggggggtagttctaaaatatctcccaggtgggtagcatggtgtcagtcgatcactacgtatttttcgtgacagaggggtccctaacaggtgagttgataaacagacggagggagggaccgcagtttttataccagtcggctatgtgggaaaagtggggccggggaactttgtagaagggaccctaccgggggggggggaatttcggaagtaacctacagacttgaaaggcgaggcgatgaaacattgagggttaagggtgaaaaacagggttgtgggtgtgaaaattggctggttatttggaaattaa

SEQ ID NO: 662118 - DNA, 574 bp, Homo sapiens
tctaccctacgccatcagtcggtgtgtcatcattggctatgcaacattgccctgtgatgctgtcaagatggtacagtatgagtgagaatggtcggaaagagattgacatagaaaaatatgcaagagtggaaaagatacctggtagtgcatcattggaagactccatgtgtcttgctgtggagtcatgattaacaatggatgtgacccatccactgtatgctggctgctatatcaagaagcctcgcattgtgcttgctggattcttctcttggaatacaatgaaaggagaaagccagactgacattgagattacacagaggaggaggacttcagccgaattctccagatggaggaagactacatccagcagctctgtgaggacataatccaactgaagcccgatgtgtcatcactgaaaagggcatctcagattgagctcagcaataccttatgcgggccaatatcacatgacatccgcagtagtccggaagaaagacaaataatcgcatagctatagcctgtggggcccggatagtaagccgaccagaggaactgagagaagatgatgttggaa

SEQ ID NO: 662119 - DNA, 1268 bp, Homo sapiens
  misc_feature (41)..(41): n is a, c, g, or t
  misc_feature (259)..(259): n is a, c, g, or t
  misc_feature (264)..(264): n is a, c, g, or t
  misc_feature (269)..(269): n is a, c, g, or t
  misc_feature (272)..(272): n is a, c, g, or t
  misc_feature (285)..(287): n is a, c, g, or t
  misc_feature (315)..(315): n is a, c, g, or t
  misc_feature (318)..(318): n is a, c, g, or t
  misc_feature (321)..(321): n is a, c, g, or t
  misc_feature (323)..(323): n is a, c, g, or t
  misc_feature (340)..(340): n is a, c, g, or t
  misc_feature (346)..(346): n is a, c, g, or t
  misc_feature (367)..(368): n is a, c, g, or t
  misc_feature (376)..(376): n is a, c, g, or t
  misc_feature (384)..(385): n is a, c, g, or t
  misc_feature (391)..(391): n is a, c, g, or t
  misc_feature (394)..(394): n is a, c, g, or t
  misc_feature (398)..(398): n is a, c, g, or t
  misc_feature (403)..(405): n is a, c, g, or t
  misc_feature (408)..(408): n is a, c, g, or t
  misc_feature (410)..(410): n is a, c, g, or t
  misc_feature (414)..(414): n is a, c, g, or t
  misc_feature (456)..(456): n is a, c, g, or t
  misc_feature (474)..(474): n is a, c, g, or t
  misc_feature (515)..(515): n is a, c, g, or t
  misc_feature (545)..(545): n is a, c, g, or t
  misc_feature (549)..(549): n is a, c, g, or t
  misc_feature (724)..(724): n is a, c, g, or t
ttctattttgttattcattccatttgagtctttctgatgancttggctatactgaaatctgttattttagtgaggctccaaaatgagcaaagctaggcctgattagagtagagtgactattaaaaaacataactttctaggagctataaatcaaagttttaaaaagatgtttggatatatttgagtattccgatcatgaaaacagaaattgccctgcctactacaaggacagactgatgggaaattatgcacctggtcnacttngctcntangcagacgatgctnnnaacactaacggcctctctgatatctatngtnagncntagtactgatccccttncccagngctgcacacccctggtctggnnccccaatngcgtcgcnnccgaanccnatanccagnnnccngnaatncaattgaagaaaaatacatccaaataaagactttattattanacagaccagatagcatcnagaaatcatgtgactgttatgattatcagaatgtcttaacnttttagggcaaagttaacactgaaagttcnagcntaagtgttggaacttttgtgggaaaaaaaaatcacttttgaaactcagacttcagtgtatacccaataatttaaaattatgtgaaatgttttaaatttgtgaactcgtaattactgttttaatgattcagtttcttcagagtggtaattgtataaaattgctattgcagctttanattcaatatgatgtgcctgtaaaccaaggagttttccccgtttgtaaaaagacattgtagataattgactctttcttttcgcggtcccctctttccctaccccccctttttgccaccccctttctttgttgcttatcgggtttaatattgttcttgaaaatagttgatgctatgttatgtataacttttctaataaaagttgtgttataagctgtagtatgatccgtctaataaaaggggggtagttctaaaatatctcccaggtgggtagcatggtgtcagtcgatcactacgtatttttcgtgacagaggggtccctaacaggtgagttgataaacagacggagggagggaccgcagtttttataccagtcggctatgtgggaaaagtggggccggggaactttgtagaagggaccctaccgggggggggggaatttcggaagtaacctacagacttgaaaggcgaggcgatgaaacattgagggttaagggtgaaaaacagggttgtgggtgtgaaaattggctggttatttggaaattaa

SEQ ID NO: 662120 - DNA, 202 bp, Homo sapiens
gccccggattaaatgtgcgcaggtagaagacgtaggggcctctagctgatcactaggcacgagtaggccaggcatggtggatagctagatggcatacttgagctccgtctctgaaagggccttcccaggcttgtactcctaccttctgcaggtagaggatcatgccctatgaggatcccgtaggaagctctactaccagccc

SEQ ID NO: 662121 - DNA, 838 bp, Homo sapiens
  misc_feature (680)..(680): n is a, c, g, or t
  misc_feature (690)..(690): n is a, c, g, or t
  misc_feature (693)..(693): n is a, c, g, or t
  misc_feature (714)..(716): n is a, c, g, or t
  misc_feature (722)..(722): n is a, c, g, or t
  misc_feature (726)..(726): n is a, c, g, or t
  misc_feature (766)..(767): n is a, c, g, or t
  misc_feature (778)..(778): n is a, c, g, or t
  misc_feature (781)..(782): n is a, c, g, or t
  misc_feature (801)..(802): n is a, c, g, or t
ccagccttcccctggggggggggccagtcgcgccgccccccccccggcgggtcaaggaataaactttcctcttgggggagaacaaaagttaaataaaattaaagaggggccctctctcgtttttgtggttgggggttcaaaaacacaccacccctcctctcccctctggggggggacccgccccaaccaaaaagtagggtagaaagggaagggccctctgcccatttttttattttccataggagggggggaaggagagggggtttatacaccctttttccggccgccgccaaaatcgcttcctcccaacaccacctctttttgaaggagtttttatatattttccttttttagagagacccgccaaaattttttgcgcgggctcttttgtgtatgttccccccccgtccctatataaagaggagggttatccctacactcttgttaagagaagggggtggccgcgccccaattcctacgacccgggttgtgtttagagaggggcgttccttttcccaccccccctttttttttattcccgggccgccccagtccccacaaaaatccccccccagagaccttttggggtggggccgtttgcccccttccccaaggaagcaacgaggtttccttttcttccagagtccctttgcggaaagagtatgcccaaattttctttncattctcttnccnaatttatatgtaccattgttnnnggagtngggnaaatgtaggcctgaagggatcaggtccctcataccactcnnaaggtacatcnatnntgtcccattagacaatcannatcgaagaacttggaataatagaaactacgatgttg

SEQ ID NO: 662122 - DNA, 853 bp, Homo sapiens
ttctgtggcccggagctgatcagtgtctagaacagatcagactttggtaatgatgcctgaaataaaattaccacctcgaaagcaacaggttcactccgtggcagagatgtgtaatccttctggctgacattgccactaaaatgggagctgagaaccagaagatttgtcacctgaacgagaccttgcgaacggatatggcatcgagcttagagtgtctccttatcaacaccgaaaataagcttctgtacagaaagatcagatgctaaggatataccttcccaggtggtttacacgaatacgtgtggtagtcatccatttaggcaatccagccgagctgggaggaaagtgacgcccctttggagtgaggcgagcagcacagaagacgggctgacaggctgagccaaggaattcccttgaaggaggtccctccagaagacattatttattacccacgattcattacaaagctcagccggatggacatctggggtgaccatgacacttgactaacatctgcgtcgcgtgagggaccacttgtaccttttgaatccagatcccacttgagataacaagctaatggtattgtgtccaaggggcagactaaagacttctgaaaaaaggccgccagtgtgaacataagataaccccttgtttaaaatattgcgcgacttctctttaaggggggctacttactccatgaatcactgtgtgcctagcaaattacggacgtgactttgggcactggtaccagaacactttctgtaccacatgcgaggcgttcctaaatgcgctctaatatcacacaggcccatggggcacaacggataaccgcctacccgtgaacaattgtgcc

SEQ ID NO: 662123 - DNA, 81 bp, Homo sapiens
ggaaaaccaggcaaacctgagatggagaactgacagcacgctaaccccggccctatagcacacctctaccccctctagagc

SEQ ID NO: 662124 - DNA, 116 bp, Homo sapiens
gagtcaagtaacctggacatcacaagaagaaattggtccacgagggcccactgactgtggctgggtgactaagtgacaatgcagtggattgtgcatgtgctgctgctggacgacct

SEQ ID NO: 662125 - DNA, 971 bp, Homo sapiens
aactgtgtgtgacaagactctatgttaggaaatgctggcttaggtaaataatttcaagagggcacaatagcctgaagaactttcctgcttgttcgttcattaatcctgaacctagaaaacagtcatgtgatccgcactccagcctgggtgacagaggaagactccgtctcaaaaaaaaaaggaaacagtcatgtgtatttcacctgatccccagaggcaacttaaaatgaagtgttgctgctgctataactaagattccctgaaggcaataaaaatggctgtcaattctggtgtaataacttctgttattgtcaccaaaatattgtatttccattgcttaaattatactgtattgagaaaataaaatgtttatttctgatatctgcttaatagatttatttacacctattcttttttctcagtggagaattctccacaatgaaaacactagaaaattcttagtattgaacactattatcctttcatttcttatgtcataaaatctgtattttgtccctgagttaacgcttataagaataatattttgctactaaatacatatgaaaatatttaaccagggatataattttctctgctgttttatatagtggcttcacatttgcatatattttgcctgttcaagaaaagtgaacaaaccaccaagaaattatctgatttattcattctttcaaatgggaaaataacctatatattgctataaaaaaattggttattaaatttaaataagttgattttgattatccggtgacagccctgcttttgtctatcaggtgaaggactgtcacaaaatattttcttttatatttcccataaatagactttcttttgctactttgataattttatgtttttatctctattactatttatgtaacaaaatatattttgcctattcttatattcagggaaatattgattgttaaaataaactgcagttgtttatcagagca

SEQ ID NO: 662126 - DNA, 302 bp, Homo sapiens
ggcacgccatacgaactgcagaatctcacctctagctttcaagaccaagaattggcaaattagcataagctcctggaaatgagttgctggctttgtatcttatacctgccagggaataccaagagttgtttctacagcacttttttttttttttggtttggaaaaaaattacgtgttgccaaccaacgaaaggaattggaaaaaaacttctcttttctctacagcaaattaattgtgagaaagctccttcacattcctcgtgccaatttgagggtccaaatccctttcgcctggaaaaaatt

SEQ ID NO: 662127 - DNA, 658 bp, Homo sapiens
agatgtcggcacaacctcttgtgctcttgcctcctgccacaagaacatatgtcccagaaaagggccactccatcagcctaggtccagaaatgagaggacacatggactgaacttgaagatggcccacagcagacctgcagtcaactctcagcctttatgtaatgcgggaaagaaggaaatgtgaatattatagactactaaaattctaaagttgtaacatagcaaaatgatcgatacaattagcagtggctatcagtctagcatattgtcatgctatatgcatgctataaaactattgaacaaaaatatcactatcctatcatggacacattggacttttcttttctccttatgactgcatcacgtgtgatgatcagaaatggagtgaagacagaaaaataagaaaattcaagaatgtgctacagagtgatcctctccctcttagagcacccacagaaaccactcatggcttctctgtctgcatcctctccacataaacatattctttaaggtaccagccccatatcacatacctgtatgtcagcccataataggccttaccttagaagccaaagatccataactacacagtattcatgttgtataatgtggaccagcaccaaaaaataaagtggcagacaataatgcctatgactaa

SEQ ID NO: 662128 - DNA, 378 bp, Homo sapiens
aactgtgtgtgacaagactctatgttaggaaatgctggcttaggtaaataatttcaagagggcacaatagcctgaagaactttcctgcttgttcgttcattaatcctgaacctagaaaacagtcatgtgatccgcactccagcctgggtgacagaggaagactccgtctcaaaaaaaaaaggaaacagtcatgtgtatttcacctgatccccagaggcaacttaaaatgaagtgttgctgctgctataactaagattccctgaaggcaataaaaatggctgtcaattctggtgtaataacttctgttattgtcaccaaaatattgtatttccattgcttaaattatactgtattgagaaaataaaatgtttatttctg

SEQ ID NO: 662129 - DNA, 899 bp, Homo sapiens
cctacgcgcaccccaccccagcaaccgcccgcttcagtgcacacccgtgtgcttatgaaccatgacaactttgttgtctgtcatgaatgtggaaatcgatggaagttctgttgagttggaagaattggcaaatatctggaccattaagaaaacggatttttgaactagctttaaactaggccaagcaactaggtttcctgcccaccaaacctttacagcacctcgggctacactttgtttttgacctaacaccccttcctctaatggctgtgtgtggttccaagaccagcgggggaggacccatataataacttttaccgggaccctgtttgcaaacatatttttttctgtttgtctaacccacacgcatgataccacccacccctccgcacattctccccctcccctcacgcgaacaccgcccttcactgtctttcgctttgcccgcgggagccgtacgcgtgggcacatgcctagccctcccttctatttatcgcctaactgcaaacctatccttttcggttaggccatgggcgccgccaatcctgacgcaggacacacggcgcaatccccatcagctgtaaacaatcacgcaactgatacctagtgggtcccgggcggaccgaaaccagctcgacgacgatgcacacggacctccccggccagcttataacctagtcataccccatcgccgtacaaaatcatctcttacgtcgtattacggaccgtttgccgcacagctcgcggttcgtcctcgcacgatggaatagtaaaccttcgcagccttccctgtaatacacatctgacatacgcccacccccttaacgtcccgcaatatattcagttccccccgccaccggacacccggccccacacctcgaggcgtgccggctgcgacc

SEQ ID NO: 662130 - DNA, 152 bp, Homo sapiens
acatccatctctaggacaagctgtcagatctgcaggcttggtctagaggtgggatgttatattaaagccctagctttgaaagcccaaaatgaaaagtgcctgggagaaatgtgtggtggattttttttttccacagccggggggtaggaggg

SEQ ID NO: 662131 - DNA, 425 bp, Homo sapiens
ggttttaccacaatttattcatccattcccttactgatggtcttttaattgatcgcctttctgggccttaccaaaaaatacaatatgcattagtaaacatataatcttaagtgctggcgctttttattccttagggatagattcccaggagattcctaggttgtaagagtatattattgttaaaacagactcacaatgctggccaaggaggctgttacaatcctacatttctaaaagcagctttgaaaataacggtttcccctcctttgtgagtaagtaagatgacaacttagacaaaagcttattgggctatggatgttctggataaatttgttccaaaaggccactcaatatattgtggtgacacgcccatccatggatattccataatattgttttaaaagcccagtttttgggtgcgcatt

SEQ ID NO: 662132 - DNA, 147 bp, Homo sapiens
cacgatagttggcaagggccacaaataaaacacaacacaagaaggaataacttcctgaattattgtcttcatcactatcctaccttctctcaccccacataatggctcaaacagaaacagtttactcacacccctgtcagaaccatt

SEQ ID NO: 662133 - DNA, 1350 bp, Homo sapiens
gctgttggactgtcagttgtgaccatgctggtgcctcccaatagactaacagtgcagtgccatgttggacccaatgagaatgactgcagcagactacacatgtacttcttgtcaaaatgattctccttcaatggttttcaaaacctttagcacaaatgatgatgcaaaaccttccatgccttgcctgcttggtgtccagttaaaactcatgtgtactgccagattctgtctaaatgtcttgtcatgtccatgatttactttgcttctgttacttgccatgatgttactagcagcatcatccatcaatcagtgcatcaagcaagaccctccatattgaccttgcacaagcttccattttcccttcttgcaacagcacacactcactacctcagtgagcacatctcaagctcatagccagtggcatgcatttcattgccaacattcttggcaacctcaggctttctttttgcttcgacaaatatccaatgtctccctttcaccaaaaacccaaaccccagtcctttcaaacattaccacatgcaagtggcctaacacttgcaaacccttcaatggcattacacacattgacagtatagcaagatgaacatttgggcatcatgtgatgccatgtgggcatttgcccacatgtgcacttcggttggcgattcaacccctgtggaacagggtccaaagattaccgatataccaatgaagccccactggacccagttgagcacaacaaccaattggagtctggacaaagagcgccccagaccgtttcttaagcttacaacaacactgttcggtcgttaattaactcccttctattggatagatttggtacctatcccctttgttccaaactcggttgtttggccccaatgggcgaacgcgatacttatttatcccacacacaactggtttccaaaagcatcacagggccactcacacattaaacatcccacgcatgcaattgtgaggccaagaaaccccaaggtttgccacattccaaagggtcttattaatgtgcacacactttgcacacattgctttggccagccaggtgtgaacactgccacgcaatctccctggcgtaatacccttgctggtggctaacaactaaacccccaagccacaagtgacaagcccaccaattttgtgctatactgccagtgtcgccctccgcccagttcttccccaccacacgcagcacaccgtgtcgtcaccaatcccgttgtaccagggcctttctatgtctccccacacaccttgcatcgtgaaccctcacaattcaccggtcacttacacctatagcccccccgtttcacagtggacttcccatagcctccg

SEQ ID NO: 662134 - DNA, 150 bp, Homo sapiens
tgatcagtaacaggctttggtcgatggacctgcaactcagttaggagacaggccatgcctttcaagtgcatgcagctcactgattgcatcctctagtttccgcacagtgcccaccagaagtatgtgcgacaagcctggaagaaggcagac

SEQ ID NO: 662135 - DNA, 131 bp, Homo sapiens
tcctactacagcctacgcggtatgcaggcacggctctactccaccttcacctacattaaccccgctcagcgccccatgtacacccccatcgccgacacctctggggtcccttccatcccgtgccgcagtcg

SEQ ID NO: 662136 - DNA, 110 bp, Homo sapiens
aagatcagtcgtacggaggcatgccactatatagacactgacggtcagcagtggatcaggaacggcatcctaaactcagccttccgctgaagtgcttactcgacgtctgt

SEQ ID NO: 662137 - DNA, 349 bp, Homo sapiens
cccaggagttcgagacctgcctgggcaatatagcgagaccccgttctccaaaaaaaaaaaaaaaaaaaaaaaaaaaaactttttgggccgcttgggccttgaaaaggtttttaaaccctttgtttgggcgcggggcccaattggttatttcacctttggtcaaaggctggtcccaaaggagatccgtgggccaatagattaggggttgggattacctcacaattaaaaacggccggggggcaccgggtgttttgtgaacactccagagggaggttgggggcatacagggttctaccacgggatctcaaggcgaagcaggatactaaattaaacccccgcgtggttggta

SEQ ID NO: 662138 - DNA, 830 bp, Homo sapiens
gggcgagcgccgccattgctcatgctgtcctggaggtgcctgtgacgatggtgccctgccgcctgcctgtctgcctgtgctgggcctgcccaaccctgacctgatgctgttcatgctgatgtctactgtgctgcctatgctctatgatgtgagctgtgtgtgctgtgtgctgtgccctgaatgccttcgctggccttcctgcgactgcgatgctgcctggctcgtttccttgaatcccctgattgaggttgcactgcctattcttgctgctgctgtgctgtgatgatgtgccctggtggtgagatggacgggctgcggctgtgctgtgcgtgcgtgctggcccgatggactcgttcggctccctcgcacgactgctcttcgggcaccttacttccccgagcagtcggacctgtgagccacctgctgttggagcttggcttggcccgccttctatccagtggcgcctaccgcgtgtgccacgcggtgtcggagactgcacttccagccccgcggctgcttgcgaaggtggcccctactggctgcaaggacgctcttgcgccagcagctccgcttcggcgcgagaggtgattgcagtggtcatggaccgtgttcaccagacatcgacatcttcagagaccttgcaagaaatatgcaggaaacagggagttgctgtgtatatccttctggaccaggctctcctctctcaaatttcctggatatgtgcatgatctgaaagttcatccttgaacaggaaacagttactgacagttcggactatcacaggcaaatatctactattgcaaggtcaaggaactaagattattgggaag

SEQ ID NO: 662139 - DNA, 354 bp, Homo sapiens
cgatccccctgttatccggggagctagcattacatggcatcatcgtcctgacatgagtgtgaaccgtaacagtttgctagaggagtcatctgaaacagatactgatgttgcaggtcaatggattgaaataggctgaaaaccctgagagtatggtgttcgcaaaagccaagagaaaaagtatttcattaatgagcgcatatgggacgggcactgtggctctcacctgttatccctgtcactttgggcggctgaggcatgaggatcacgaggtctgatcaacaccatcctggcttacacagtgaaaccctgtctctatctatgaatagcacctcgttcccccggcttggtgaccgg

SEQ ID NO: 662140 - DNA, 117 bp, Homo sapiens
gcaggatcgcaaaagtgactcttctatatctacaatattcaaaaagtttaaaaaataaaacaaccaatgagaacaataaatgttctcttgacccacttccctttcagctacattcca

SEQ ID NO: 662141 - DNA, 138 bp, Homo sapiens
agtccctcttcgtctctaacacgcctattaagcggaggtgttccaggctgccccaaaactccaggcctgccccttcccaatcttgaagaggaggcggctccttcggggctccaggctggcttgccgcgcacatgcatg

SEQ ID NO: 662142 - DNA, 825 bp, Homo sapiens
  misc_feature (509)..(509): n is a, c, g, or t
  misc_feature (554)..(554): n is a, c, g, or t
  misc_feature (596)..(596): n is a, c, g, or t
gagagtctgctcttcttggcaattaacagagtatgtgactggaggcaaatcgcgagggaatcgtctctacttcaaacgcatcgagacacgaccccttccgattcctcgctgcatacacgcatggtgactatcggtcgcgcgagtaactcagtacatgtccttcgggttcatactcgcgtgcatttccttggagacctcgtgcacagtaacgcaagattctgtgactaagggtatccttttggccaatgcatatacaatgatgcatcccagtaatttcgcacagaaatagagtgtccatcgcgaactatgcctgtgaaagcgttatacggtactggctcaagatatccgaatgaacgtgatgtcgtgctacttactacacttagctacatacatactgtgtcattcattattaaaccgtaggcgctgaaggaattgatagtggtgcttgtgaaacgaggagatgaagatctaaatatctttcagggtaagtggggccgagagtaagaagncagggactgattgaaaataagttgttcatgtagagaattgtcaanaagttcaggaaggatggtagtgctcggaagtatactcttttncaatgttgcattcatttgaagtcagagactgataagaggacgcagggagtaagatatgtctaagagagctattgataaagatgagctattaggtctctgtgatggtaaactggtgaacctattggtgcattggagaaatctataatgcaacagtggtttgggggcagaactgggataacgcggtattcaggtgggctaatctttggagaagggcctgtcctataatatg

SEQ ID NO: 662143 - DNA, 707 bp, Homo sapiens
  misc_feature (489)..(490): n is a, c, g, or t
  misc_feature (623)..(623): n is a, c, g, or t
gccacaactttccttggccccggtgtgctgagcaccacgggtggagccccccattagggaccaatgagtgcacggtcctacctagtctgttcctcacctcctggactcaccccgccatgcccgtctccccctggagctgtatcccctccgaggagcccaggagatgtcttcccctgagatgccccccctattaatttccccatatgcttcaaccacccccttgctccaaaaacccataccccacgacttaccgttgataccgacatccccagcgacagcacatggcaaggcccattgctgagggcaccggtgctttattggagaggggatctggcccagggataaggaaggttccccccttcccggaggatgggaaccagtcctggctgcccctgaccagtggggatatgccaggggctcttggcccaggccacaccagtcccaaatgggaagacacccagtccagtccaccaaaagtcgggagcgccnncaccaaacctggctataaggccccggaacccatataggagcctgagaccggtcccctgcacattcatcattaaactataccggatgaggctgtacatgagttaattaccaaagagtcatatttaccaaaatcngtacacacctttgaaaaactccccaaattgtcatctatgtatcaccagttgctagacccaaatattaaaatgggattaaattta

SEQ ID NO: 662144 - DNA, 252 bp, Homo sapiens
tacctactcaagcacttgaatttccctagatgcgctacctcaccctgccagacagacaggtaggcagaaggaggaacacttaacaccttttagactcagtcaagcatcaggttctccacaaagtcctcactcctgggtccccagctggaataccaccttcttccttcgtgctcctgttattccttgtagaggcttctggctcagtacccctaacccacggggtgggaataacaggagcagcagggaaagaca

SEQ ID NO: 662145 - DNA, 604 bp, Homo sapiens
  misc_feature (53)..(53): n is a, c, g, or t
  misc_feature (269)..(269): n is a, c, g, or t
  misc_feature (278)..(278): n is a, c, g, or t
  misc_feature (423)..(423): n is a, c, g, or t
  misc_feature (474)..(474): n is a, c, g, or t
  misc_feature (493)..(493): n is a, c, g, or t
  misc_feature (495)..(495): n is a, c, g, or t
  misc_feature (497)..(497): n is a, c, g, or t
  misc_feature (522)..(522): n is a, c, g, or t
  misc_feature (584)..(584): n is a, c, g, or t
cgatcccaatatatccggcctatccagtccccagtcctatgtgcctaccttcnagtagctctcaagtccattttctgctcccatccctatcaccaccacctacaggtcctcactacctctctctcagactaaagaaacaggtcctaattggtttccctgtttcaaatcttttttcctcctttcctgaagtagaagtatttagttataaaaatcacatgttaatcataaaaatattcaaatgatgcataaatgtaggaagtgaaatcatncataattcnccttcaagagacctctggtaaacaattctaattttgcctccttcttcctcccctcaaaatctttatactgcctccagaacaatcttccaaaacatcagtgcagacttaaaaccctttatggcaatcaatgcagcttcttgataantcaatggtaagaaaaaaggggagaggcctggcctcattaaggaaacttcanaacatcatcggcaatcaangngngggccttgattaatcctgatacaancaatcactgtaaacagattggcaatgaggaaattgattatggctggatagaaatatcctaanaattttgagtttcttaggat

SEQ ID NO: 662146 - DNA, 947 bp, Homo sapiens
  misc_feature (46)..(46): n is a, c, g, or t
  misc_feature (158)..(158): n is a, c, g, or t
  misc_feature (163)..(163): n is a, c, g, or t
  misc_feature (198)..(198): n is a, c, g, or t
  misc_feature (207)..(207): n is a, c, g, or t
  misc_feature (240)..(240): n is a, c, g, or t
  misc_feature (245)..(247): n is a, c, g, or t
  misc_feature (252)..(252): n is a, c, g, or t
  misc_feature (258)..(258): n is a, c, g, or t
  misc_feature (310)..(310): n is a, c, g, or t
  misc_feature (315)..(315): n is a, c, g, or t
  misc_feature (320)..(321): n is a, c, g, or t
  misc_feature (323)..(323): n is a, c, g, or t
  misc_feature (325)..(325): n is a, c, g, or t
  misc_feature (329)..(329): n is a, c, g, or t
  misc_feature (359)..(360): n is a, c, g, or t
  misc_feature (367)..(367): n is a, c, g, or t
  misc_feature (369)..(369): n is a, c, g, or t
  misc_feature (377)..(378): n is a, c, g, or t
  misc_feature (390)..(390): n is a, c, g, or t
  misc_feature (408)..(408): n is a, c, g, or t
  misc_feature (417)..(417): n is a, c, g, or t
  misc_feature (420)..(420): n is a, c, g, or t
  misc_feature (468)..(468): n is a, c, g, or t
  misc_feature (478)..(478): n is a, c, g, or t
  misc_feature (512)..(512): n is a, c, g, or t
  misc_feature (541)..(541): n is a, c, g, or t
  misc_feature (562)..(562): n is a, c, g, or t
  misc_feature (600)..(600): n is a, c, g, or t
  misc_feature (731)..(731): n is a, c, g, or t
aagccagcgctcacccacccggggtctctgtgcattgacctttggntgctgacttggagaaaagcacaaacacgaccagtcccatcctggctcccgtggggcttcttctatctacgcattgtatcgactgcattatttggactaagatgatgactcanttaanggaggagacaaatgctgactgtctaagcaagaatngcccaagcnggcaagaaaaagcacactgcatacataggatanaaaannncagancttctncctgccgatctgcaacatttcattttttttgcctgctaactatcaagaaggnttctnttggnnangntgtntccactgaacaaacaaaatggcagttaatnnttttgtntnttcttttnntgcggcccagtntcctcatccgtcatccangggagagtnttngggggagacatgaggtgcagctcatgcctctgcctatgggtcattttnttcggggatnactgtgatcatgatatcttcgttacccctgcggnccaccatgttcagggtgctttctcttttnatgacgtcgctgacatcattngcggagaccacggactgtccattgatgctgattatgangtcgttttccttgagaccaccagcttctgctggggtatcaggaattacttcaattatatacgctcctgagatcacgtctgggaagtcccggtgccggtccttcagctctttggctttgctggacgtgagtnacatcattcggataccaatatacttcttcttggtgatggcttttcctttggcctgtcggtcatgggactccgtgaggaactttttaatcttatcagatgggattgcaaaggagattccagctgtcactttcaaagtgttaattccaatcacttcaccgtccaggtttactaacgggcctcccgagtttccatagttgatgatggcgtcggtcttgg

SEQ ID NO: 662147 - DNA, 385 bp, Homo sapiens
  misc_feature (123)..(123): n is a, c, g, or t
aggatgagaagcagagagataaggtttcctccaagaactcactggagtcctatgccttcaacatgaaagcaactgtggaagatgagaaacttcaaggcaagatcaatgatgaggacaaacagnaagattcttgacaagtgcaatgaaatcatcagctggctggataagaaccagactgcagagaaggaagaatttgagcatcagcagaaagaactggagaaagtctgcaaccctatcattaccaagctgtaccagagtgcaggtggcatgcctgggggaatgcctggtggcttcccaggtgggaggagctcccccatctggttggttgcttcttcaggccccaccattgaagaggtggattaagtcagtcccaagaaggtgtttg

SEQ ID NO: 662148 - DNA, 1136 bp, Homo sapiens
agcgggcttgcttgggctctgctggcgccggccgcgcaccgctggtctcacaccgagtgctcacaggctcgcagctccgtggcgtccttttcgcttccctggctccctccggccgtgagctgcgccacctgtcccgtggcaagcgacctccgcgactccttcgaaattgaccagggtccttgtggttggtgcgcctgcgggtgcgcatgtcgtggcgttgttctactacctgctgcttcccgatctctggacgtgcaaatgttcatgtcactgcctctcatggcttcacgagctcctgtgtttgacgcgaaaggaccgtcgctggcagagagttcattctagctttgcaatcagatacctaagacagtgatcaatctttggatgacagcaatttgcagtcgaagtgaactgtgccgagttactgaacccacgaccgagaggaagtgctctttttcgataacactgtatcccccgaggaaacggcgaagtttactctttttaaatcctacatagaatacgtttagttggctggatctttccgacgttccttatttccaatatacttgggcttagatggcgacaatgctctcgctgctgtgtctaagtccaaccgtaaaggtgctcttaaatcgctgtgaagccaataagaaagatggcatgtatggtccaaaatggccccaatgtgcccaagaaactaccaggtttgcttaagatcacctcacttgcctccgaattgaagcaaaactgcaacagagaattgggcaattaaatttattcggcaagccattagtccgaaacacgatgagtttgggtacacaaaaagggacattatacatttcttggaacctttcttgcgccaaagcttttcggattaaacacccccccaacgtgcgtataggggtccataccgtggaaaggacataaaaaaggatatgcctagaaaaaggtatacggaaccagaaacaactttgacaaattcgtccacatacacatgtaagtcccctcgattacacagatagagttattatagatagcttgcgacacacgtgtatagtcccttgtttccaaaaaagacttattggcggagttaacatttcactatcccccctttagagcgcacaagttttttacgccgc

SEQ ID NO: 662149 - DNA, 319 bp, Homo sapiens
tttatttgtggtgttggtgggcgggggaaaaaggggagggctggctggagacgactctcttaatttttccccgctacaccagggagataccagggttcgtcatgggcagcaatgactacgatggacaagaagatagaggccctaatcctaattttctgagcaccatggaagccccctggattctagggagaccttgaggagaaagaagactcctgtaaatgcctgacattgaaattcctgcaagtctaggagcatgtgaactcaaaatggaaattaatttgatttaataaaaataaagaagaagaattgttttggcaaa

SEQ ID NO: 662150 - DNA, 388 bp, Homo sapiens
  misc_feature (44)..(44): n is a, c, g, or t
  misc_feature (280)..(280): n is a, c, g, or t
  misc_feature (296)..(296): n is a, c, g, or t
  misc_feature (329)..(329): n is a, c, g, or t
  misc_feature (339)..(339): n is a, c, g, or t
cagtgggaaacaaaactaaaaagacccctttgtgccaagttgantatgccttagacacatcctcctaccgtccccaatgccccctgggcaggaggcagtggagaaccaagccccatggcctcaaaatttccccccagttccccaagtgtttttggggacctaaaaccctggggcttacgtttttttttgcccagggtgggcctggtcctaagggcaggacagggggtttggaaatgtgggccttttataaacccccttgggccttcatcccatggcctgnggatggaaaatgggcngtttttttttatgggtattcagtttgtaaaggnatcctttgtnttcagtaaacagggtgcctttccaggggggggtgcccttttttccccca

SEQ ID NO: 662151 - DNA, 405 bp, Homo sapiens
cccatcgcgagcgggatcaaacagactgatctcggcgtatgcattccggccactactcagctcgcggctcggcgtcatgcactcctacaaaagccctcacccgccgttaaactgcatgcaacccagccgcctctacacattggcgcaactctgcacctacatgtgccaaagtacacagatgctccgctgagcacgtttcgtcgagtccctccctggcgtgagtggaagggcagcctaggtccatgcttgcgaccaacatttcggtcgatgctcggcgcagacgctctgcttgcctgagtggcaggggggcagccgtcttggaggcttcagacttcaatctcacaacctctcaccgcggcatcatctggggcgcagacttcaatctcgaacctctcacagcctcat

SEQ ID NO: 662152 - DNA, 300 bp, Homo sapiens
tggagccatccacccctgacacgcgcacgcgacgccgcggcgcgagccaccccccttcagagggacccaaccagggttcgtcatgggcagcaatgactacgatggacaagaagatagaggccctaatcctaattttctgagcaccatggaagccccctggattctagggagaccttgaggagaaagaagactcctgtaaatgcctgacattgaaattcctgcaagtctaggagcatgtgaactcaaaatggaaattaatttgatttaataaaaataaagaagaagaattgttttggcaaa

SEQ ID NO: 662153 - DNA, 301 bp, Homo sapiens
  misc_feature (26)..(26): n is a, c, g, or t
  misc_feature (31)..(31): n is a, c, g, or t
  misc_feature (62)..(62): n is a, c, g, or t
  misc_feature (69)..(69): n is a, c, g, or t
ttgttcttatcaaatgtagttttatnagaanaatttgacaagaaaacatgacaccttggaangggacanaaccagggttcgtcatgggcagcaatgactacgatggacaagaagatagaggccctaatcctaattttctgagcaccatggaagccccctggattctagggagaccttgaggagaaagaagactcctgtaaatgcctgacattgaaattcctgcaagtctaggagcatgtgaactcaaaatggaaattaatttgatttaataaaaataaagaagaagaattgttttggcaaa

SEQ ID NO: 662154 - DNA, 379 bp, Homo sapiens
ctaggtgctggcctgagcgcggtggcgggcaggcgatgcgcggcggctgctggcgagcgttgacagaagtggcggttgctgacgcctggaaattcccctaaaggtggagcaccacccaacccccctgaggttgacctgcctgaagctctccactcgctcaacccgatgatcatgggcacgtggcgttggtcaacacaactagaaagggcatccgtaccagtggaatgcatattcgagaatatatacagagggagaagaatatagaggcaatcgaggcgatgcgaatgcagagagcgaataacatagagcgaacagtcagaacagggaatgatccttcatcaccaggcgatatacgcaatcgaccaatggaaagaaaaag

SEQ ID NO: 662155 - DNA, 228 bp, Homo sapiens
tgctgagattacaggagtgagccactgtggcaaagcctcaagtggaacctattaataatacataaataacaaaaaaaatcaaggtctcagtcaccctaggtaatctctgcaggtgaggatttgaccaggaaatattgtcagaccacactcttacttgctctgcgacttcacaacgagaactgtgggcgctcaaagaaacccagcggctttattacccctctactatgg

SEQ ID NO: 662156 - DNA, 122 bp, Homo sapiens
gggaacatggaaagttagcagtgatgcctgcagggtctcagcaagttagtgtcaggtaccaggtccatatatgtacacaagcactgatagtgcaatatcatatgcaagtacactggaagacc

SEQ ID NO: 662157 - DNA, 1989 bp, Homo sapiens
  misc_feature (68)..(68): n is a, c, g, or t
  misc_feature (1798)..(1798): n is a, c, g, or t
  misc_feature (1804)..(1804): n is a, c, g, or t
  misc_feature (1817)..(1820): n is a, c, g, or t
  misc_feature (1989)..(1989): n is a, c, g, or t
ggggtcgaagggtcaggggccgaagcaccggccacaacttgaagccggaccggcctcttcgccccagnggctcgcggacgtagatgcatccagcgtgcgactatcccagcgcctaacggcagctggacttcgctcccgggacctccaatgggctaccaccttcgcccgcagaccccagcccccgccacgcccacacgtcgcactaggttggcccgcgcctcactggttacggggtcgacccccctagggggcggagctagagaggccacggccaatgaacgccgggggtaagcgggttagtacgacgagaagagtgacagacaggctccataaccagtagacgtagaaggcagaactgagtggcgggtacggcacccgatggctattcgagctctcgatctcggagactggagcgggccattcagaggcgcggggccgggcccggcggacgcttgttgttgtccggccgggggaggcggaggtcgctcgctcgctcgctcggctcgctgactcgccggagcgctctgtggcggtcggcggcaggtcggtcgcgagagcgggctctgtggaagggggcgaggctatgtcgcggtggcagcccggatgggccggcagggccgggagtaacgggacgtcgccgcggagcttcttcccccggatacagtgcggcccgagcggaggccgcggcgccgccctccgatcttgaagagcccgcgctgcgcggagcccgcccccgcctgcgcaccggcaccgacgcggagcgaccagcccagccagacccggcccggcgcggcctgatctaacccagccaggcaggcaatactagcccctctggagcacggagctccttccccaaagacatgaagctattggagaactcgagctttgaagccatcaactcacagctgactgtggagaccggagatgcccacatcattggcaggattgagagctactcatgtaagatggcaggagacgacaaacacatgttcaagcagttctgccaggagggccagccccacgtgctggaggcactttctccaccccagacttcaggactgagccccagcagactcagcaaaagccaaggcggtgaggaggagggccccctcagtgacaagtgcagccgcaagaccctcttctacctgattgccacgctcaatgagtccttcaggcctgactatgacttcagcacagcccgcagccatgagttcagccgggagcccagccttagctgggtggtgaatgcagtcaactgcagtctgttctcagctgtgcgggaggacttcaaggatctgaaaccacagctgtggaacgcggtggacgaggagatctgcctggctgaatgtgacatctacagctataacccagacttggactcagatcccttcggggaggatggtagcctctggtccttcaactacttcttctacaacaagcggctcaagcgaatcgtcttctttagctgccgttccatcagtggctccacctacacaccctcagaggcaggcaacgagctggacatggagctgggggaggaggaggtggaggaagaaagcagaagcaggggcagtggggccgaggagacctgcacactccagcccaaagggtctgtggccggaggccccacgagcaggccccagcagtcaccggctctggtcttgggccggccccggtgcccacctgtacccccacctcgcccatttggccgcgtgcactgagtgtcactttgctgcagctcgtttctttccaataaaagtttctgtgacttaaaaaaaaaaaaaacaaaaaaaaaaanaaaaancccgggggccctnnnntgcgggggggggaaaaaagggtgattgcacatgggccatcgggtcaaaagggggttcctcgagcccacagttttctgtccacaacgggggaagacttgcgcggggtccccctatataggaggggcggcgataatttgccagaaagcccgggtaacccggattatgaggn

SEQ ID NO: 662158 - DNA, 615 bp, Homo sapiens
ttgtgtgggagtctaagtctctttctaggcctctaaggacttgttttatgaatctgggtgctcctgtattgggtatatgtatatttaggatagttagctcttcttgttgaattgatccctttacctttatgtaatgcccttctttgtcttatttgatctttgttggtttgaagtctgttttgtcagagacttggattccaatccctgccttttatttttgctttccatttgcttggtaaatgttcctatatccgtttattttgtatagtgtgtctttgcatgtgagatgggtctcctgaatacagcccactgatgggtcttgactccttatccagtttgccagtctgtgtcttttaattggagcatttagcccatttacatttaagtttagtattgttatgtgtgaatttgatcctgtcatcatgatgctagctggttattttgcacactagttgatgcagtttcttcatagtgccattggtctttatattttggggtgaattttgcaataacctggtacccagtttttttcccttttccctaattttagaggctttccctttttaggaaccttctttgcccccggccaaggcccctggtgggggtgaccaaaac

SEQ ID NO: 662159 - DNA, 433 bp, Homo sapiens
ccgggatccttgtctgtcccgccatccctcaccccttctaggctgacaaattctgccattatgtttcaaaatagcttgaaatcacacccctagaatttcacatgcataagatgtgtatatattagcaaaatttaatgtcaagtcacaaaatgttaaaaatttatcacttttcaatcttaaaacttgacatgagaggatgctctaggatttagattcaactatttattaaacatctattttattttatttttttgagacggagtcttgctctgtcgttaggctggagtgcagtggcacaatcttggctcactgcagcctccacctcctggattcaagcaattctcctgcttcaacctcttgagtagctgagattgcaggcacctgccaccatgcctgcctaatttttgtattttagtagagacaaagggaaaca

SEQ ID NO: 662160 - DNA, 236 bp, Homo sapiens
  misc_feature (6)..(6): n is a, c, g, or t
gcgtanagtatattgttgaagaggatagctattagaaggattatgcctgcgggtatatgcgtgaggaagtacttgattggccagctatcactggaacgagggttatatcctggggagtactggaataaaagctagcatgtttatttctaggcctactcaggtaaaaaatcagtgcgaagcttagcgctgtgatgagtgtgcctgcaaagatggataagattgaaccgtatagcttg

SEQ ID NO: 662161 - DNA, 905 bp, Homo sapiens
  misc_feature (714)..(714): n is a, c, g, or t
  misc_feature (720)..(720): n is a, c, g, or t
  misc_feature (733)..(736): n is a, c, g, or t
  misc_feature (905)..(905): n is a, c, g, or t
cgagctggacatggagctcgttgcctgcctctgagggtgtgtaggtggagccactgatggaacggcaacgagctggacatggagctgggggaggaggaggtggaggaagaaagcagaagcaggggcagtggggccgaggagaccagcaccatggaggaggacagggtcccagtgatctgtatttgatgaggaggagccgaggccccagcttcatccagcttcaaccaatgcctggacctgtccacctgagaggcccctggggcctccccagctgctggccagaccctggcgctgccacagtcctggcactgcccaaggccatacctgcctagccctttggctccatcctgtggatgcccactcacccctcagactcctgctgcccatgctgtggccggacttgtcagcagggggcctggtgggaggagcgactgccctgcccaaatgaactgccacagcagggacagctggaccgcagagtttatttttgtatttctactgggcctgcacactccagcccaaagggtctgtggccggaggccccacgagcaggccccagcagtcaccggctctggtcttgggccggccccggtgcccacctgtacccccacctcgcccatttggccgcgtgcactgagtgtcactttgctgcagctcgtttctttccaataaaagtttctgtgacttaaaaaaaaaaaaaacaaaaaaaaaaanaaaaancccgggggccctnnnntgcgggggggggaaaaaagggtgattgcacatgggccatcgggtcaaaagggggttcctcgagcccacagttttctgtccacaacgggggaagacttgcgcggggtccccctatataggaggggcggcgataatttgccagaaagcccgggtaacccggattatgaggn

SEQ ID NO: 662162 - DNA, 2339 bp, Homo sapiens
  misc_feature (68)..(68): n is a, c, g, or t
  misc_feature (2148)..(2148): n is a, c, g, or t
  misc_feature (2154)..(2154): n is a, c, g, or t
  misc_feature (2167)..(2170): n is a, c, g, or t
  misc_feature (2339)..(2339): n is a, c, g, or t
ggggtcgaagggtcaggggccgaagcaccggccacaacttgaagccggaccggcctcttcgccccagnggctcgcggacgtagatgcatccagcgtgcgactatcccagcgcctaacggcagctggacttcgctcccgggacctccaatgggctaccaccttcgcccgcagaccccagcccccgccacgcccacacgtcgcactaggttggcccgcgcctcactggttacggggtcgacccccctagggggcggagctagagaggccacggccaatgaacgccgggggtaagcgggttagtacgacgagaagagtgacagacaggctccataaccagtagacgtagaaggcagaactgagtggcgggtacggcacccgatggctattcgagctctcgatctcggagactggagcgggccattcagaggcgcggggccgggcccggcggacgcttgttgttgtccggccgggggaggcggaggtcgctcgctcgctcgctcggctcgctgactcgccggagcgctctgtggcggtcggcggcaggtcggtcgcgagagcgggctctgtggaagggggcgaggctatgtcgcggtggcagcccggatgggccggcagggccgggagtaacgggacgtcgccgcggagcttcttcccccggatacagtgcggcccgagcggaggccgcggcgccgccctccgatcttgaagagcccgcgctgcgcggagcccgcccccgcctgcgcaccggcaccgacgcggagcgaccagcccagccagacccggcccggcgcggcctgatctaacccagccaggcaggcaatactagcccctctggagcacggagctccttccccaaagacatgaagctattggagaactcgagctttgaagccatcaactcacagctgactgtggagaccggagatgcccacatcattggcaggattgagagctactcatgtaagatggcaggagacgacaaacacatgttcaagcagttctgccaggagggccagccccacgtgctggaggcactttctccaccccagacttcaggactgagccccagcagactcagcaaaagccaaggcggtgaggaggagggccccctcagtgacaagtgcagccgcaagaccctcttctacctgattgccacgctcaatgagtccttcaggcctgactatgacttcagcacagcccgcagccatgagttcagccgggagcccagccttagctgggtggtgaatgcagtcaactgcagtctgttctcagctgtgcgggaggacttcaaggatctgaaaccacagctgtggaacgcggtggacgaggagatctgcctggctgaatgtgacatctacagctataacccagacttggactcagatcccttcggggaggatggtagcctctggtccttcaactacttcttctacaacaagcggctcaagcgaatcgtcttctttagctgccgttccatcagtggctccactcacccctcagactcctgctgcccatgctgtggccggacttgtcagcagggggcctggtgggaggagcaacgagctggacatggagctgggggaggaggaggtggaggaagaaagcagaagcaggggcagtggggccgaggagaccagcaccatggaggaggacagggtcccagtgatctgtatttgatgaggaggagccgaggccccagcttcatccagcttcaaccaatgcctggacctgtccacctgagaggcccctggggcctccccagctgctggccagaccctggcgctgccacagtcctggcactgcccaaggccatacctgcctagccctttggctccatcctgtggatgcccactcacccctcagactcctgctgcccaaatgaactgccacagcagggacagctggaccgcagagtttatttttgtatttctactgggcctgcacactccagcccaaagggtctgtggccggaggccccacgagcaggccccagcagtcaccggctctggtcttgggccggccccggtgcccacctgtacccccacctcgcccatttggccgcgtgcactgagtgtcactttgctgcagctcgtttctttccaataaaagtttctgtgacttaaaaaaaaaaaaaacaaaaaaaaaaanaaaaancccgggggccctnnnntgcgggggggggaaaaaagggtgattgcacatgggccatcgggtcaaaagggggttcctcgagcccacagttttctgtccacaacgggggaagacttgcgcggggtccccctatataggaggggcggcgataatttgccagaaagcccgggtaacccggattatgaggn

SEQ ID NO: 662163 - DNA, 1424 bp, Homo sapiens
tccacgcttaatgcgagcttttatttttctggtataaaacccctatgtggtacccacagcgggagcctgagtccgctgcacggagaacctcgtgggtggtgggtctctttgacgaagggtggctcaggtaaacctcctgtgtatagggaaacttggggtgaattacagctcttcctttccagaaggtctcggggggctcaggtataccgtgataggctctataaaaatgtggcatctcaaagggtggccttggggaaagttgtgcccagggtgtggcagtgtgtcagccccgggcttgagggtgttagcagttcactcgattaccagccattcagtgagcgagcttctataggccacaggtgtgcgcggagaacacgaaagtgcccgagtgtgccccccgtgggtgtgccagggaattgaagaggcgtatacacagcgccacagaaagcccgccaggggggcccgtgttcacacctttgccagagggggaaccaggtggtgggcgcttgcgccgagacctcttggtgtccccccccagggatacgcctcctgtgcgcgcaccggggggggcaccagatgtgagacaacgcttgtggcgccccagagggatatgacgggggccccccaaccgaggtatatgcgccggtgtgagcccaaccctatcactttgtgggacgacacctttataagcaccccgagaaccgcgatgcggtggcgccaatgtggtgtacgcttccccccagaagtgagccaaagccaaaatgtgccctgttggaacaccccgttgggtatgccagccgtgggccccgggacaccgggggtctcgatgcaatatcgtgcgccaccgtgggcccaatataatctcctttcagaaaaacaagcccctcagatcccctgcgggaagaaagagaggtgcccccccccaacggggaaacgggaacacacctccacaagtggagcccccaccacgggaaaatgcccccttaacagggcggggccacgcgggcacaacaggaggcacacacagacaccgccccccccgaggggggacacttgggcagcgccgctcacaatggatcctgtggaaccccaaagagcgcggccccaaattcgttggagctgaaccggcggcaaattacgcactacattaaatcccactcgggacattgggcctccccggaaaagcatccgggggggccacggggggcccacggagcccccggctcacaaggtgccgtgaacccccgggccccggggaatgaccacgcggcgcgaacaccctacgggggaaacaacagcggggtgtaccccatcccagggggacaacacgggcaccacgaggacccccgggaccacgggacctcactacaatgagcgacgaggcgtggatcacccgaccgaacagcacaaacgagacgacgcga

SEQ ID NO: 662164 - DNA, 865 bp, Homo sapiens
ggaagtgtccttggcacagattcagttccatttgcaggttgtgttcagtgtgtcctgtcatcatgactgtaccactacgccagtccctgggaagtggacctggcaccttccttcaccctcacatcaacaggaggacagttggagcctgagttcaagtttacctcaaataaaagcatgaatggttagtcaccagtatccaacttcagaccaaagtggccaaatattaaacagttagttttacagttggatttcaaaataatgtaaagtatgtgtcttgctgaaatatgagtcagctaaactcttatagtgatgattgtggaaccattttataacaatttttttgggtttggaaatatttttctagatttggagcttcaagaaatgacaaccaatgaaaacaggacacgaccaactaaccaatcaaattttagcgccccgccccccgcccgccaaggaatgcgtggttatgtggcatctccctggattctgtggcaggattttggtatatactagggcagtacatatgtgtgggagtacactggataggtgggaagtaattatatttagatttaccagaagtttctttcagtggaaataaacaatgcagtaatgttagatgcatgctgtagggacattagcaataaatgggtttggtgcagtacatgagaataggtgcaattagtagtcaatttgaccatcttgtattggatttctttcctcaaaaaaaaaaaagaaaaaaaaaaaaatttgggggcgcgccgagagtttaaaattctgggggggccaggaagaagggacggtcagaacggggggggggtgttccaaaaggggggggaggaacacagtggttgtaagggaacaagga

SEQ ID NO: 662165 - DNA, 1800 bp, Homo sapiens
  misc_feature (68)..(68): n is a, c, g, or t
  misc_feature (1609)..(1609): n is a, c, g, or t
  misc_feature (1615)..(1615): n is a, c, g, or t
  misc_feature (1628)..(1631): n is a, c, g, or t
  misc_feature (1800)..(1800): n is a, c, g, or t
ggggtcgaagggtcaggggccgaagcaccggccacaacttgaagccggaccggcctcttcgccccagnggctcgcggacgtagatgcatccagcgtgcgactatcccagcgcctaacggcagctggacttcgctcccgggacctccaatgggctaccaccttcgcccgcagaccccagcccccgccacgcccacacgtcgcactaggttggcccgcgcctcactggttacggggtcgacccccctagggggcggagctagagaggccacggccaatgaacgccgggggtaagcgggttagtacgacgagaagagtgacagacaggctccataaccagtagacgtagaaggcagaactgagtggcgggtacggcacccgatggctattcgagctctcgatctcggagactggagcgggccattcagaggcgcggggccgggcccggcggacgcttgttgttgtccggccgggggaggcggaggtcgctcgctcgctcgctcggctcgctgactcgccggagcgctctgtggcggtcggcggcaggtcggtcgcgagagcgggctctgtggaagggggcgaggctatgtcgcggtggcagcccggatgggccggcagggccgggagtaacgggacgtcgccgcggagcttcttcccccggatacagtgcggcccgagcggaggccgcggcgccgccctccgatcttgaagagcccgcgctgcgcggagcccgcccccgcctgcgcaccggcaccgacgcggagcgaccagcccagccagacccggcccggcgcggcctgatctaacccagccaggcaggcaatactagcccctctggagcacggagctccttccccaaagacatgaagctattggagaactcgagctttgaagccatcaactcacagctgactgtggagaccggagatgcccacatcattggcaggattgagagctactcatgtaagatggcaggagacgacaaacacatgttcaagcagttctgccaggagggccagccccacgtgctggaggcactttctccaccccagacttcaggactgagccccagcagactcagcaaaagccaaggcggtgaggaggagggccccctcagtgacaagtgcagccgcaagaccctcttctacctgattgccacgctcaatgagtccttcaggcctgactatgacttcagcacagcccgcagccatgagttcagccgggagcccagccttagctgggtggtgaatgcagtcaactgcagtctgttctcagctgtgcgggaggacttcaaggatctgaaaccacagctgtggaacgcggtggacgaggagatctgcctggctgaatgtgacatctacacagctggaccgcagagtttatttttgtatttctactgggcctgcacactccagcccaaagggtctgtggccggaggccccacgagcaggccccagcagtcaccggctctggtcttgggccggccccggtgcccacctgtacccccacctcgcccatttggccgcgtgcactgagtgtcactttgctgcagctcgtttctttccaataaaagtttctgtgacttaaaaaaaaaaaaaacaaaaaaaaaaanaaaaancccgggggccctnnnntgcgggggggggaaaaaagggtgattgcacatgggccatcgggtcaaaagggggttcctcgagcccacagttttctgtccacaacgggggaagacttgcgcggggtccccctatataggaggggcggcgataatttgccagaaagcccgggtaacccggattatgaggn

SEQ ID NO: 662166 - DNA, 690 bp, Homo sapiens
cgagcagcgcgctactgcagctttcttcctgccttaggaaggtggtggccaggtaattgaggatggcccctaagcaagtgcggaatggagccggggggcgtagatgccagcctcactttgcatggtctccagaaccgctcccacggcaagataaagctgcgactagagaatcttctagccttgtacttcaacacccaggagaatagcgccaggcgccgcggggcatcttctctggagaagaactattgtatctgctctctgttctaccaatagcgtttacagaatattaaactggctttgttagctgcagacaagatccttgttccagcatggacatcactggcgagttctctgtgaacgttttcagcatcaccattggtttatcagatgtcattgagttacttgtcgagccattgaggaacatgtgaccgatgagaagaactgcacggagttgtacatctttattctccttgagatcttgtggcaaggcaatgttagcagaggaattcgttgcactcatgtctgtaggggcaagagcatagctgtctcagcttgctgatcttggattcctagacttggccctaagcacttctgtctgctgtagcagatgtgagactttactcattaatgaagcaactagaagaagtcaggaagtggcaagatgggtgttgtttatgccagttgtgctcc

SEQ ID NO: 662167 - DNA, 2000 bp, Homo sapiens
  misc_feature (68)..(68): n is a, c, g, or t
  misc_feature (1239)..(1239): n is a, c, g, or t
ggggtcgaagggtcaggggccgaagcaccggccacaacttgaagccggaccggcctcttcgccccagnggctcgcggacgtagatgcatccagcgtgcgactatcccagcgcctaacggcagctggacttcgctcccgggacctccaatgggctaccaccttcgcccgcagaccccagcccccgccacgcccacacgtcgcactaggttggcccgcgcctcactggttacggggtcgacccccctagggggcggagctagagaggccacggccaatgaacgccgggggtaagcgggttagtacgacgagaagagtgacagacaggctccataaccagtagacgtagaaggcagaactgagtggcgggtacggcacccgatggctattcgagctctcgatctcggagactggagcgggccattcagaggcgcggggccgggcccggcggacgcttgttgttgtccggccgggggaggcggaggtcgctcgctcgctcgctcggctcgctgactcgccggagcgctctgtggcggtcggcggcaggtcggtcgcgagagcgggctctgtggaagggggcgaggctatgtcgcggtggcagcccggatgggccggcagggccgggagtaacgggacgtcgccgcggagcttcttcccccggatacagtgcggcccgagcggaggccgcggcgccgccctccgatcttgaagagcccgcgctgcgcggagcccgcccccgcctgcgcaccggcaccgacgcggagcgaccagcccagccagacccggcccggcgcggcctgatctaacccagccaggcaggcaatactagcccctctggagcacggagctccttccccaaagacatgaagctattggagaactcgagctttgaagccatcaactcacagctgactgtggagaccggagatgcccacatcattggcaggattgagagctactcatgtaagatggcaggagacgacaaacacatgttcaagcagttctgccaggagggccagccccacgtgctggaggcactttctccaccccagacttcaggactgagccccagcagactcagcaaaagccaaggcggtgaggaggagggccccctcagtgacaagtgcagccgcaagaccctcttctacctgattgccacgctcaatgagtccttcaggcctgactatgacttcagcacagcccgcagccatgagttcagccgggagcccagccttagctggntgagggtcaggtggagggaagggacccacagccaccccactgtccttccccactttgggtagccctggctcctgtcaccctgactgtgacctgccctaggtggtgaatgcagtcaactgcagtctgttctcagctgtgcgggaggacttcaaggatctgaaaccacagctgtggaacgcggtggacgaggagatctgcctggctgaatgtgacatctacaggtgggccggcatccctgcagatggcctccaggcctccaggtttgtggggcacttggcgcctcacaccacctgtcaccctatactccccagctataacccagacttggactcagatcccttcggggaggatggtagcctctggtccttcaactacttcttctacaacaagcggctcaagcgaatcgtcttctttagctgccgttccatcagtggctccacccccccgctcctccccaactcccggttgggcgatacaactccccagtgtgcatctcaccagtttgcctcctgaacatctcctggggcagagaggctgggcagggtcctgaactgttcctgctcctcagtgatcactaaaacctcaaaggaggaagacctggattgactggaagccgcgcgccgaaagccaacggctggcagacacctgcaggcagggaagcggaacgaccaaccaggaacgcgccctcgggcggacaacgggaccacgatgttagcagacagaagggagagcaggtccacgatgcacacgaggacccagtt

SEQ ID NO: 662168 - DNA, 1425 bp, Homo sapiens
  misc_feature (68)..(68): n is a, c, g, or t
ggggtcgaagggtcaggggccgaagcaccggccacaacttgaagccggaccggcctcttcgccccagnggctcgcggacgtagatgcatccagcgtgcgactatcccagcgcctaacggcagctggacttcgctcccgggacctccaatgggctaccaccttcgcccgcagaccccagcccccgccacgcccacacgtcgcactaggttggcccgcgcctcactggttacggggtcgacccccctagggggcggagctagagaggccacggccaatgaacgccgggggtaagcgggttagtacgacgagaagagtgacagacaggctccataaccagtagacgtagaaggcagaactgagtggcgggtacggcacccgatggctattcgagctctcgatctcggagactggagcgggccattcagaggcgcggggccgggcccggcggacgcttgttgttgtccggccgggggaggcggaggtcgctcgctcgctcgctcggctcgctgactcgccggagcgctctgtggcggtcggcggcaggtcggtcgcgagagcgggctctgtggaagggggcgaggctatgtcgcggtggcagcccggatgggccggcagggccgggagtaacgggacgtcgccgcggagcttcttcccccggatacagtgcggcccgagcggaggccgcggcgccgccctccgatcttgaagagcccgcgctgcgcggagcccgcccccgcctgcgcaccggcaccgacgcggagcgaccagcccagccagacccggcccggcgcggcctgatctaacccagccaggcaggcaatactagcccctctggagcacggagctccttccccaaagacatgaagctattggagaactcgagctttgaagccatcaactcacagctgactgtggagaccggagatgcccacatcattggcaggattgagagctactcatgtaagatggcaggagacgacaaacacatgttcaagcagttctgccaggagggccagccccacgtgctggaggcactttctccaccccagacttcaggactgagccccagcagactcagcaaaagccaaggcggtgaggaggagggccccctcagtgacaagtgcagccgcaagaccctcttctacctgattgccacgctcaatgagtccttcaggcctgactatgacttcagcacagcccgagcatgagtcagcggagccgcttactggtgggaatgccgcactgcgctgtctcgtgtgcggagggctccggtccaacccgtgtgaccgtggcaagaacgccggggagtgactcagtaaccctggcccacccgggggggaccgggcctcctttacaaggcgaaatttttggccggccccccggaacgatggggggggcaagggccaaacaagctggccacccacc

SEQ ID NO: 662169 - DNA, 663 bp, Homo sapiens
gttgtccaaacgccaacacactttatttcccttgggacgcatttgcaggcttctgccacacctgaacccacggccgggcaccaacgctaccataactcccaagaggtaaatcctgggggctggggagctgcaatttcccttttttcctgaaaattaaaagaactgagactaattgaaaaaacctcactgccattcctaactcagaagtctcagcaggtctgaaatggggctgggggaagttcccattttgggaaggcgtttattctctgcggctacagggattgcctgctttaaaaatccccttacgctgattaactaaaaagtcccttcaaagtcaaaaaccaacctttcatgggccaaaaaagggggatttctggtttccggaacaggaggcttgcaaacctaaaaatgtttttccttccaaaacctaactaacctgaagtttaaaacctcagacgggagaattttatattttggaaaagctggctgcaatttgtttttgggacacaagggaggcaagcccttgtgggagagaaccaatgggcccctccgccttttgtttgtggaagccaccccaccaaccccaggaagaaaaatcccccaagcccttggagaacatctttctttaaaaagagaacccccgcgggtttcgcgaaaaaaaaa

SEQ ID NO: 662170 - DNA, 112 bp, Homo sapiens
ttgaaaaagaaaaaaacaacacagcatgtattatcttactgttgtaggtcagaagtctgatgtaagttccactgggcaataatcaggttgctggcaaagccacattcctttt

SEQ ID NO: 662171 - DNA, 206 bp, Homo sapiens
atctggttttttttgagcacggatcttgcctattgcccaggccgagtgatgtgggattcacgctgtggcccacctatgcctggccggaatatcctatatggtaaaattaaaggctgtattttcactgtcttgaagacgtttagatctaattggattttccattttctcctgcagtcaattgggtcacatcctttcaagccgacaat

SEQ ID NO: 662172 - DNA, 945 bp, Homo sapiens
tagctaaacacaacacaccttatctattactcaccttcttaaaactgtttttgctacttttgaagctgtcttatttataagatcagaggtctgacaccttcttcttgcttagcacagctctctactctcatccattctattctctcttctctagcacttactccatctctcctcactcccgtttccgccctctctgctccactctccctggctcggcacctccccactaccctcccaccccacctacctaccactactcctcccaccctctgctctctcctctctccctcctttcctccctctcgctgcagccacccggcgacacccgctccctgcttcccccggcaccccgccccttgctcccccctctccctcccctccccgcctccgcccctccctgccctcggccctccctccgcacccgccccccccccccgcctccctccccccccccagtctccgccctgccctctctccctgctccccgcgcccgcccctcctcccccccctccccccccatgccgccctcgcccgcctcccccctcccatgctccctgccccccccccctccccctgccgccgccccccccctcccctcccccctccccccaccttactcctgcctcatcctcctcccccccccctgccccctccgccccctccccccccccgctcacttgccatgctgccgcgccactgcctctcctcgcctctcccgccgcccctcctttctcgctcgctccacggctgcgctcagaccttccccgcccgctctgcgcgccatgcggccctctcggccccccctcctctcacctcgccccccccctccccgcacctcctccgctccgctcgccccctcctcctccccccgcgcccccctccgcgtccccccctcaccgccccccccccccccccccccccccccccctccctcccctccccctg

SEQ ID NO: 662173 - DNA, 147 bp, Homo sapiens
ggtgagttcgtaggtgacgggcacgatataactttctgagtgacgtctatgttacttgtcttaagtttagtacggatgtgctgagcttgccgcatgcccggtactcggagtgctctctccctggggacagatacggtaaaaccgcag

SEQ ID NO: 662174 - DNA, 201 bp, Homo sapiens
cccacatgggcagattgctgaaggatggcttcctggccttccaaactagccgttacaaactccattactacgagacgcccactgggatcaatatttgtcatgaatactgagcccacatgggcagattgctcgtattgaattcaagtataatattaagtatgcatggacctctagagctaatagcaagtctgcccatgtggg

SEQ ID NO: 662175 - DNA, 349 bp, Homo sapiens
actgctgcccacgttacgtcacgccgcatccggagcacggcaccgagggagccgccacacggtcacctgcaaggacgttttgtgcccctctaaaggattcgtttttttcatccccaattttcagagaccctttggggttccacacttcacgtggactgaggtagaccctgcatgaagatgaaattatagggagtttttcctttcttccccccttttaggagaggaaagggagtcattaacaactagggggttgggttgtattcctagttatggggtagagttttggatggggaggaatatggcaagtgtattattattgtaaccacatgcaaataaaaagaatgggacc

SEQ ID NO: 662176 - DNA, 366 bp, Homo sapiens
cggcacgagggattggcccccccaaaactcatgtggtagatcaattgccaatgtaatagtgttgggagatgtaagaaatacgaggtaattaggttgccaagatggattaacatatttctcgtgacactgagactgggttctcctcgcgaatggctagttcccaagagagtgagttgttataaaacattgctgcctcatatattttgcgctgtgtgtttgcacaaatgcggtccccttgtgtttctaaacgatgtattgatgcagcatgaggcattaatgagaacccaccagatacagctgcgtgatcttgaatttccctactcaacggaacctaagtgataaatgaaaactatttttaatatgtta

SEQ ID NO: 662177 - DNA, 443 bp, Homo sapiens
gtgatggggcacatattttcttcttggccttgggtgtgtgcaattgcccaaaaaggcaaaaaataattcccccaatggctcgcacgtgttgaaagatttcgcacggggcaattccgtcctcatgatgtggaaaagctaaatctatcccacctgaatgatatccagtggatttccaaatcaccatcatagcgagggcagagcactcgatgtgccagccgggcctccggggtccccgagggaagaggcccagaaacacctcggggggtgagggccgccttccacgagggcgaagtcatgggcatgaggcttgtcaaagtccgcgggctctccgatggcaccaggacaccacgcggaccaatttggccatatttgtctcccttagatttcagatcgaagtagacttggccttgggccgtggaataagcgtgcccaggagaaatgat

SEQ ID NO: 662178 - DNA, 132 bp, Homo sapiens
aaaaaagaatgtaacttgtaatagtagtagaatgtaattgtaatagaaggtggttgtaatagtctctgggaagaaatggagggaagcccattaacaggaattagcatgtttctggtttgtggaggtagcact

SEQ ID NO: 662179 - DNA, 200 bp, Homo sapiens
cgactccaaagccattgaatgactggataaaattaaccggtgtgtttgctcctcgtccatccaccgttccccacaagttgagagagtgtctccccctcatcatttttcctgaggaccagtcttaagtatgccctacaggagattaagtaaagaagttttcattccagcgtttcattaaaatcgattcgcaagctccctct

SEQ ID NO: 662180 - DNA, 362 bp, Homo sapiens
  misc_feature (158)..(158): n is a, c, g, or t
tggaaaaagtcatggaggccatggggttggtttgaaaccagcttgggggggttcgattccttctcctttttggtctagaacttttatgtattacgggtttctctcgaatgtggtggtggtaggggtggggggcactccattattagctcacctccagngtttatggaggggttctctcatactatttaggactttttcgctttcgaagcgaaggacttctcaaactcatgtgaaaatttatttaattattatacgtggcgtgtttagagaaaatgtgaatgtgagccctaacagattgtattagagagtgtttccacgtggtgggtgtattgcattcggggtatagtctccgagttaaccgt

SEQ ID NO: 662181 - DNA, 505 bp, Homo sapiens
  misc_feature (435)..(435): n is a, c, g, or t
  misc_feature (490)..(490): n is a, c, g, or t
agactgcatagggctcgggggtgtccatgggcatggttaagagagagaaggaaaacaagaagaagggaggtcaggggtttggcttatttcagttcttgtcccattgaattctagggaccctgcctcctcccggacatgagccattgcgcgcgtttccctgtcttgtgactcacccacctgtgattcaggctccttgctttacaccaagtttgagcataaaacctgctaatatttctccgtcaaaaattaaccccgagtaacctcttctttcctctctgagtcacccacatccttaaaactgcccaggataaatcacaagttcctgcataggttgttgtgtgaactgaaagtggttaatatgtatggaaagtgcttaaaacacagaactttaaaacacatgatcttgattaagtacgatcattaccctcaatgttngattttaagcaaaccatattaatcctgggccaaactaccatgacctggagccttnggacttgcacagccg

SEQ ID NO: 662182 - DNA, 692 bp, Homo sapiens
tggctgggcggctgcggttcctggtgctgctcggtgcgcggccagctttcggaacggaacgctcgtgcgtcgctgggcccctgcccgtgaaagttttgccgtgtgagtcgctgacctcttgtgccctgctgctggccctgtgcatgaagctggctgtttgatgtgatgcttgcatgcctgcctgctgttgcctgcatgtcctgtctgacctgccttgccttgagtgatgtgatgcttgcaggcactcgctggtcgccactgccggattgacgtacttgcaatacttgtgtgctgcctccactgactgaagctcagacgttcataagctctgtcgttttgttgctgatgtgactgtggtgctgcctgtgctgccagcacagcacacccggtggctacgctaggccttgcaaggcgacaatctatcattatagctctacacagctaacgacgttggccctttataacccatgactcagttagttctggaacaaaattgttgagacattgatagagataacgacatgattgcacacgcgtacaagacatcaattcagtacgatgccccgaattattagaacaacttgagaagtgtacgcccagcatgcgcttgcactgtcacaaacgacgcattacttcagctcgtgcgcgcgaacactcccgttgcttcgtcgacagcgcctcacttggtgacg

SEQ ID NO: 662183 - DNA, 224 bp, Homo sapiens
tgtctgtagtgcgatgtactgggggtgtatacgccacatctggcctgctgtcagacaccgggatggagggcgttgaatgagtccggggccccggcgaagttggggtactggtggatttattcacagacaaccgaggctttgtaggattgaactccttagcattagggttcaacgttgataactttacttgttcagacaacagggccctcatctttgtcttctcc

SEQ ID NO: 662184 - DNA, 348 bp, Homo sapiens
cagataaagtttttattttcctctgaagggaaagggctcttttcctgctgtttcaaaaataaaagaacacattagatgttactgtgtgaagaataatgccttgtatggtgttgatacgtgtgtgaagtattcttattttatttgtctgacaaactcttgtgtacctaaaaggaaagaaggaaagctttgtccgaaaatggtacccccgtatgtggcatggcagaacgaaaaggagacctagcgaagatcggtagatgccataacaacctggaaaataaatcacccggaagagtaacgaaaaaaagcgtgtacaaattaaacacaataaagcgttggaaataataaaaa

SEQ ID NO: 662185 - DNA, 103 bp, Homo sapiens
tcagtccggagtatcccaggacggtttcttttttccattaaattcctcccagtatgaaaggacaaatccataaggccaaacttttaaaagggccttccccgta

SEQ ID NO: 662186 - DNA, 1225 bp, Homo sapiens
gagcgggaccggggcgtaagggcaccgcccaatgggagtgtgtggatagtgaggggtccacacgcttggagccgagggtctgtgtcaagagcggccaggggctgcgggagataagacgaaacgggctgccgtggggtgtgtgtaggcttcgagatgacatggtgatcacggagagactgacagcacgaaacagtggattaacgacttcctgagcgatagctggcacggccttccccaggatggcagaggtggtgtgctgatgtggccgagattgccacacgagaggagtgtcagcatggggcaagtcggaggatgtcaacaccatatgtcgcccacaagatgattggggattgtcaacaggaaggtgactgagattgacacgctggggaggcccctatgcctcaatcccatcatgcgttctcatcattaaacatgttcgatgtagctctgaaggtgtgggccagctcttctattaactaccacggtggaaagaaagtcccgtcctctaccacaccagcgagcaggcaaacattgcatttgcattcgccttgagcgacgtgacgcgacgcgcacatagaccaagagcgaatgaaactgtccgggacttgggaacgccgggagaagcatgcgctggcacaggagggtgtcatgaaaggggcgacccactatccaagggtgatgagctggaacacggcaaatgaacaggacttcaataggagacatcaaccccatggagtggaaagcgtcacatgcggcacaccaacgacaccggcaaagtgatacacaacacgcataccagaacggagggtcgttgccagaaccccagagagcgccataccacacaggtgtgcctggtgagaacatcgcccacggaagacggcgtacaccagcgtccgaaccccgcacgcatggaggcaagacacgagacccatctgacaaacagcaaaaagcaaacacatcgaaccgggcataggaggaaggacaggaagggccaacaagacgaccacacggacccaaatagaacaataccgcacaagggagaaaccacgacaccaaaacgggccgctgacaccccaggagaacagagcgcagaaaatggcaccccaagagcaaaaagaccagaaacaggaggacaaggcaccacacggggcggaccagcgagcggacaaccgaggaacaaacaaagacacaacaacaacgagcagaagaaggcgaaacaaagaaa

SEQ ID NO: 662187 - DNA, 167 bp, Homo sapiens
tgattgtcaatctgcagaaggacattgggattgtcgactgtggctgtgagaatcttgtcctcaggtcctcaatgtcttgaagtagggactgtagtctttgatctcagcagggcgctggctctggtaccagtcacggatcttcacttccagacgagacctggctggcg

SEQ ID NO: 662188 - DNA, 222 bp, Homo sapiens
  misc_feature (154)..(154): n is a, c, g, or t
  misc_feature (159)..(159): n is a, c, g, or t
  misc_feature (163)..(165): n is a, c, g, or t
tgctttgtccctgtgcaccaggcagcctgcaccagccaccagcctccgacccggattcaggcagccccttcaagccactggctcccttcagcagccccacttccacaagctctcaagaaaaagcagacggattactgatgtgaattggacacgntttcntatnnntgctttctccttttttccatccctttccctaccatcaaaagcatacctgctctaatt

SEQ ID NO: 662189 - DNA, 1048 bp, Homo sapiens
agcggcatagcatttgtatgcactttatactttgcagaggtgagttaaattattaatcatttgcacatgaaagctgtggggcatatcttttttctttttttaggtgaggaagttatgctacgactctaattaattccacgattctattgaaagttgaggaatgctgttttacccctgcgcattataaagaaaactagaattactttagtcttcagattttctccctgttaattctgtatcttgagaggtttctttttttttatattttacttccattttctgtgcaaagtgcatcctttggcatttaaaatggtcccaaggtaaagccctgttggcaaaaccgtggtactttaccttaccagaggaaattaccttagaataagatgtgagaccccagttccccttaaagacaaagaccttgaaattcacacttgggagtcagttatacctattcaatcacagtcctgggatataagaaaggcccttagactctctgtgttaaccctgtaggcttttaatataaatagggtggcattggctcatggcattatacccttctgggcctggaattagacggagtctcaatttcaatgcgtatcttgtgaccacttccagccacagggtacataacttcgagacttaatttgcaaccaggtcacatttaaggctgaaatggggctacgctgaaaatctccggtgtgattgaaaaccccgaggggcggtatttccaagtttctcaaatatattggccagggtgctaacttattaagtaatattcgcgatattgtgcctgaaaattttaagacctatgcgcatttttccctttttaaaggggcccgttatagttgctaagtacatacagtggcaaagtttgggaaatacgtagtgtgtgaaaaaattttctctgtgaaaagaccacgccctagatttacaattagagcacaccgtataattattcccccaatttatacgggtgatcataagcatgtatatacatgtcctggaattaacaaaccattgtgtgtgtactggcacatttagaaacgcg

SEQ ID NO: 662190 - DNA, 410 bp, Homo sapiens
ggagcgggaggctgcagtgagccataattgcaacactgcactccagtctgggtgacggagtgagaccttgtctcagaatttttaaaaaaagagttttagggctgggcgcagtggctcaagcctgtaaccccggcactttcggaggccgaggtgggcagatagcgaggtcgagagttcaagaccagcctgggcaacatggtgaatgaaaccccatgtctactaaaaatacaaaaattagccgggcatggtggcgcgcgcctgtggtcccagctactcaggaggctgaggcaggagaatcacttgaacccgggagacagaggttgcagtgagctgagatagtgccactgtactccagcctggatgacagagcgagactccatctcaaaaaaaaaaagtttaaaaaagacgaa

SEQ ID NO: 662191 - DNA, 937 bp, Homo sapiens
agtaaggtcagctaaataagctatcgggcccataccccgaaaatgtgggttagtacccttcccgtactaattaatcccctgggccaacccgtggatctactctacgcatctttgcaggcagcactcgatcacagcgctaagctcgcagtgatgttgttacctgagtaggcctagaaataaagatgctagcgttcatgccaggttctaaccaacagaataaacctcgtgccacagcagagctgccatcaagtattccctcacgcaaggcagacgcatccataatcctgtctagatagctatcctcttcgaacaagtatactctaccggacaatgaaccataaccaatactaccatatcaagtactcagtcattaataatcatacatggctatagccaatacgaactaggaatagccgccctttcacttctgagtcccagaggttacccaaggcagcccctctgacatccgggcttgcttctttcctccaccattgacaacacacctacgccccccatctccacatcatataccaacatctctcacatcactcaagggtcaagccttctcgctcactctctcaaccttagtccatcacacgcacggcatgtttgaccgcggatgtaacccacacccaagcctaacgcacaactcttacacatactccgtcagtctacacacataggaccgactcatagcacgcctaccgtacacaacctaacatacagcattctacacttaactaaccacactcgttcctaacctagctacgacattctaccaaggcaaccacagacaccagcaacacacacctgacgactaatccccaccgccaagcagctaacacgcataccagcccacatccatcgacaccaacacccaggaagccacgccccggcgtgacgccccagcgcccaggcccacaccacagcaccacaa

SEQ ID NO: 662192 - DNA, 107 bp, Homo sapiens
  misc_feature (20)..(20): n is a, c, g, or t
gtgtgtacgagataagcagncagagatgataggtactaccccacaaccaccgttatcattatcatcaccatcattattatcatcttcattttcatcaccttcattat

SEQ ID NO: 662193 - DNA, 876 bp, Homo sapiens
tgagcggagaagaagatctcaccgtctagccaccttacccatgactgatgattctgtagaacaggtttcttctccctctccaaccactgatggggaacagtatctccatcaggtcctcaaaatcagcaagaatcttcagtatcagaggtgccggtgtggtcgcacagtttgcccgcttgagaagctgggacccggtctccctcttgacttaagtcagtggtgtcagaagttacacgcgaccggtgagcctcagattccgtcttgaccagtaatgaatgtcccgaggcagaaaaagaggatacacagatgcgtttccaagatccttcttccaaaagcgaatgagctgatggaagaggagctccagcaggagcaggattgtatcgagaaaacggaataagcaagagtgtggatggaagacgaaaagctcgacagcagttgggttacgagaaaggccggggaatccggaagagaagaggagaagagacgacgacagatcactacagagcaatgacagaagaagaggagaaaggggagatcagaaggtcgtaaggcagcatgactattcagactatgaagacaggtcccctcgaagttttgcggaaaggtgctcttctccacgtaaaatcgaatctgctggggagttctcgtgggttcacgaaagcatgtttacggagaagactacaacctatcagtacccagggcattctatcccgttgatcttagtgggtggaagttgtgtaccatgtgtggctcaacacgactttcattccaaatgtgtaaatggaataaagcactgtagagctgccgcaaaaaaaaaaaatgtggggcggccaaattaaccaccgccgccaaaaaaagcaaacggaaggttcaccc

SEQ ID NO: 662194 - DNA, 121 bp, Homo sapiens
caaaatcaagtgggtcgatgctggcgctgagtacgtcgtgagtccactggcgtcctcaccaccatggagaaggctggggctcattatgcagaggggagccaaaacgggtcatcactctctg

SEQ ID NO: 662195 - DNA, 2188 bp, Homo sapiens
  misc_feature (583)..(583): n is a, c, g, or t
gtggtgagttacaggtggtttacggtcatctgacctttgatttgtagtttgttggttttgatgtgttggtggtgcattaagctctctgctcgatatgtgattagtttggtgtctgtcagtctgttgtttgtccatgctagtgatgagtggatgctatgtcgatagtggacctctcattcattcgctctacttgtaggtgtagatgaacggcttgttccgtctgtgtattgatactgtctctcgagtggttttgctctattgattgatactgctatgtatgaagttgattgtggtcgactcattgtggattgacatgtagctctggatgatagggataatgtgtggtatgatgaagtgttagaggatgtgtgtagatagatgtagtaatgttatgttgttagtgataggtattttttgggtgttatgatgtatagataatataatgtttgtgtggtagttttatattagtagtggtgtagtaggtaagtggaaataaggttgatatagtatgttgtgagtatgagagagagagaggggggagggtattgtgatgagtgtaagtagtgtttagtgagatatagtnattttattacattacacaaaatgtattagtagtattagaagtggtaggattagtgtgtgttggttagaagtagagagttgggtgggtgggtctgttagtgagttagagagagaaaagggatgtatagttagtcgagtgaggtgttggtagaaagataaaacagagttgttgtgtgatagagtaattaggaattgtcgagtgggttggctttatagtatggtttgagttaggttaccggaggcgggggtggttgtgtatttgagtctagatgtgtctgtttcttcacctgtggcgggtgggtgagcattaagtgtagtagtatcgctaggggggagcgctcacttactgagagtgtgataggtgtggtgtcggtcgccacaccccttgcatgtttggcgtttgagctaggagtgaggacactagagtgtattcttactggatgattgtggttgtttgtttagtggtggttagtgtgtttggtgtgtgttcaacgagggcttctgtgttgttgtatgatgatgatggagtattgtggggatgtgtgtcttctgcacgctcttgcgtcgtactgtcgtcttctcgtgggatcgaggatgagatgatgagtaggagcgccgtctcctcgttggtgggtgatgtatattattttctcatcttcggctctatctcctctcttcgtgtggttgatagtagtgggaggtgcgcgtctcattcgtattgagtatagttatgaggattactacgacggcaacggggggtggattctttttgtgtagcgctgccctacgacccacgagtagatggttgttgagtatctgcattcgtctgtgggagagaagatatattatatagatagtagatagtgatgatattgcaccacctcaccctcatctcatcgtcgtctcgtgggatcatcgtattgtttttgtattttttgcggtctctgatcagcttctcatcgtatcgtgggcagagagcacatccaacatgatgagagtggagagaatataagatggcagcatggaatatgatgatagacattagtatagtgtgtcgttggtatacaacacgcactgctgcgagcaggagagtagtagtgtgtgtagtagtgtgtgtgagacgactgtgtgagataaagaagtcatatatagtgaggtgcgtccctgcgatgtagtgtgtgtgtgtgtggtgtcatatatatatatatagtgtgtgtgtttgtgtgtcacacacactctgtgtgtgtgtacacacagcttgtgtgtagagagagtgtgtcgacacacagcatatatatgtcgatcgatagccagcgatcgcacagagtgtgtgtgtccgcgtgtgtgcattcatatagtagtctagttgtcttatataaataacacacacacaatcatattagtctgttctgattatgtgtgcccacacaaaagaatcaggataatagagagatagtcctcacataagactagtagcagagatgagtggggtagtatagacccgcgcacccgatattgggtgtatacaccccagggtgtacgtccctcgcgatttttatctcacccccgatgttgtataaaagagggcgcccaaacctcctgcaga

SEQ ID NO: 662196 - DNA, 805 bp, Homo sapiens
  misc_feature (34)..(34): n is a, c, g, or t
  misc_feature (156)..(156): n is a, c, g, or t
  misc_feature (388)..(388): n is a, c, g, or t
  misc_feature (400)..(400): n is a, c, g, or t
  misc_feature (407)..(407): n is a, c, g, or t
  misc_feature (424)..(424): n is a, c, g, or t
  misc_feature (426)..(426): n is a, c, g, or t
  misc_feature (428)..(429): n is a, c, g, or t
  misc_feature (447)..(447): n is a, c, g, or t
  misc_feature (449)..(449): n is a, c, g, or t
  misc_feature (497)..(497): n is a, c, g, or t
  misc_feature (513)..(513): n is a, c, g, or t
  misc_feature (517)..(517): n is a, c, g, or t
  misc_feature (521)..(522): n is a, c, g, or t
  misc_feature (533)..(533): n is a, c, g, or t
  misc_feature (536)..(536): n is a, c, g, or t
  misc_feature (545)..(545): n is a, c, g, or t
  misc_feature (547)..(547): n is a, c, g, or t
  misc_feature (551)..(552): n is a, c, g, or t
  misc_feature (558)..(558): n is a, c, g, or t
  misc_feature (602)..(602): n is a, c, g, or t
  misc_feature (622)..(622): n is a, c, g, or t
  misc_feature (670)..(670): n is a, c, g, or t
  misc_feature (704)..(704): n is a, c, g, or t
  misc_feature (717)..(717): n is a, c, g, or t
  misc_feature (721)..(721): n is a, c, g, or t
  misc_feature (740)..(740): n is a, c, g, or t
  misc_feature (744)..(744): n is a, c, g, or t
  misc_feature (758)..(758): n is a, c, g, or t
tcttgagtcacattcatatcttataatacacgantattccttttccgtctagtctcagttataggcagctacttcccagactctactttcacttctctctactttttcagacctggttcccatggcactagtgtagaaggttttagggtataagangagggggcaataaggctaccctatcactatgacaaccaagaaggaggctggagcgtgaatccccaacgctgagggtggggagccatccctctctaccaagcgtggcaatgatggagggaacttgcatgctaagcatccaggatgccatgcagcagacaccagggagcactgagccactgctggagcatttcctgcctctgccaggcggcctgcggcaaagtgtttcacatanctaaaaaaagtnaacacantctcatgtatgcaattnanannaagctgtcaaaatataancncaccaagacactggaagctgaaagacaaggtgagtagtgagagccaanctccaggcacacaatngagngctnnttctcagaagntcnttgctttanancacnncagtcntgagtcaagcacggcagggcatgtgaggctgagaaaacctgctnttgaagaacacaagcttctnagtgatgttgctaatgtcccccacaaatgggagcagtgtctccggcgnatgaaaaatttaaagacaaaatttaaaaaactgnttttgattcaggngttncactttcctccccgccagncctntaacatggatgctncacctgaagttctttaaaaggctggactggccgccactccatcatgg

SEQ ID NO: 662197 - DNA, 929 bp, Homo sapiens
  misc_feature (496)..(496): n is a, c, g, or t
ggttcgctgaagaggtcctccatgcgcagtcatgagtcgctgcagagtgtatcgatatgggtatcaactggactgatcctatgtacagagtgaatctataggggggttcacaagcgatcaatgtgttatgatatacaggtgggaatctacaagacagtagagatgcattgatttggcacaagacagatggtatcctcatatttctgttagcaagaaaaaaaaggatttgaagtaatttcgaaggaagtctttgtgaaacacgggtttaggtatgtgacaaggagagttggatgtcatcttacaagatgtggtgatttggaaaagaataaccatgatcttgagtaaaaaggagtggggaaaagtctgtgttgaaaagacaataaggggaaggttgttgggcgcctagggagaatgcgggatctgggatagtatgatccgaatggagtttgtgtactccaaagatgataagtcaatgtcaaatgattttgacaccaancagtgtggaatctgtcagaagggaacaagaattacccaagtgtgtcttcattgtcgaaaagtcacatgctgaatttttgggacgttactgaaagaatgagagatcgggggtgtagggggagtggcgccttccatttggttggtcccatgaagcagcagctgcttgggggactggatgttatataggattacgggtgctcagggaaagcagtagtggaggtgtgagacagtccatgaaaaattatgagtgtgacaagttgcgttgggtgggtcagataccggtggggaaatatttgacggtgttctccaaagaggggggggttaaaaaatggctaataaaagggagagcgggaggacgcaagacaaaaataagtgttgggagaaatccgcgattatgaagtgaattaaaaaaagcgcttggtatttttgtaggg

SEQ ID NO: 662198 - DNA, 197 bp, Homo sapiens
ggatgatgtgggatgtgctggatcttcgctgactcctgagcttgttgtggttgcaggtgagagtgtcgcatctggtgatctggggctagtgtagaaggtggttgatttctcactgtggcccgaagttgtggagctggcagggaagtgtgttgttggagtcgagcctgaactgatgggtgaggtcgtagattctccaa

SEQ ID NO: 662199 - DNA, 208 bp, Homo sapiens
ctgcagctgtactctaggtatttggaggcgagacgggtggatcacctgaggtcaggagttcaggaccagcctggtcaacatggtgaaaccccgtctctactaaaaatgcaagaattggctgggcgtggatggcacacgccctgtacgtcccagactacttgggagcgctgagcgcgggagaaattgctttgaactctgggcaggcaga

SEQ ID NO: 662200 - DNA, 773 bp, Homo sapiens
taccggaggcaggctagtagtggcgacgtactgcatcgacgagtagcgcacggtgtatactctgtcagtatatgacattcggcatcgcactgtgatgggaagaattgccacactatgcttctgggctggaaggaggtcagacccccattgctgcagaaattgaaacattttatccacatcatcacgggtgtggcatgtgttcctgggtgtgtctttacttcatacctttctactcatccttgagtacacctggcttgaggctgtcaatcttcctacatcggtatcatcgtagccaattgtgccggaaggtttgctaggccactagtcacggtactgtactgaccactatactgccaaacgcatggcaaggaaaaactgcttagtgaagaacttagacagctgtggagacctatggggtccacgtccaccatctgctctgatacaactggaactctgactcacaaccggatgacagttcgcccaccatgtggtttcgacaatcaaatccatgaagctgatacgacagagaatcagacgtggtagtctctctagacaagacttcagctacctggcttgctctgtccagaaattgcaggtctttgtaacagggacgctgtttcacggctaaccaggaaaagctacctattacttacgcgggcagttagcaggagatgcctctgagtcagcactccttacagtgcaatagagctgtgctgtggttccgtgaaccgagatgagacgacagataggccacaaaccagacgcaacatccc

SEQ ID NO: 662201 - DNA, 318 bp, Homo sapiens
cgtctcgtctttgtatgcggttagtcgagaactctttagtgattcaaatgacccactcctgtgaaggtttttataactgcgtgatcttcgagacaatactttcagagttcaagacacagattggaaataactgtacaggaagaggcacatacaaagaaaggaatccccgaaagggcggtatgtgatggtcctgccatcgtcaactcacaccattacattctatcccaaacccttgcaacctaggccatatcctagctcccgccttcctccaggaattatcgggggtgaatatgaccaaagaacaacacttccctatgt

SEQ ID NO: 662202 - DNA, 176 bp, Homo sapiens
  misc_feature (34)..(34): n is a, c, g, or t
agcatttgcaggacataactctagaatctgaaanaaaacgaatatttaaagattttatgcatgtgcttgagcatgaatgtcagcatcatcattcaaagaccaagaaacattctaagaaatctaaaaaacatcatagggaacgttcccgctctcgatcggggtcagattcagatgat

SEQ ID NO: 662203 - DNA, 670 bp, Homo sapiens
  misc_feature (94)..(94): n is a, c, g, or t
  misc_feature (193)..(193): n is a, c, g, or t
ttgggtacttagtgctgccagcttcctgaagccagacgcatgggctggttctgaggggtatctgaagcattgtgattcatgatacgtgcagganacaggagaccacacctataaatgacaacgtttcacaatgctgcagcagctcctatgctaacagaagaccatgtttcactgctatgggagtagataccanatatgttcctccaccatttaatcctgatatgttcagctttgatgaaaaattgtgcagtgctcctgctgaagaacgagaagtaggccagatgaaattgctaatcaacctcattaaacgcaagccccagatgacagaagaacaaataaagacaattgctgatggtttcactgccatggttgacaagtgctgcaagcagtcggacatcaatacatgctttggagaagagggtgccaacctaatagtccaaagcagagccacattaggaattggtgcttaagacacggttgccagtgagaaaaatacaaagataaaatgcttctcctgcccattaccttttttcccttgttattgaatcgtggtttcataaatcttcagtgttttgtcaaacaatatgcttttccagaaacttttcaattctattacttgcaaaaaataaaaaataaaaatagaataataaataaaagcctttaaaatctg

SEQ ID NO: 662204 - DNA, 710 bp, Homo sapiens
agagcgctgctgcgccgctttcgcccggctgcagtgagcctattctccgtgttggtgagtggtgatctggggacttgatgcagagaatccagagtgtgtaccccagttcccagtgcaagctgctcctgtgtgctgcaatgcatgttgactggtgccagtgctcctgggtgagcagctggaccaccagaccctcctccagggctgtggttggtgctggagtgagttcttgcaaggagctggactgccattgccttacgtcaagtttcccccacatgatcctctgccagaactgtctcccacagacccctggaatgtgtgcatgtgtcttgatgccaggcaccatgtggctgtgttgtggatgactccgtgtccagcacctcatgacaccccagatgcttgccctcctgcacgtgtgacaactgcctgacacagctcccactcctgtggatggtgtgcttcttgctccctggtgctcactcagttgagacttgcggcattgtttgaccaccaccagactggtgttatcagggaatgtggcattgccagtgttgccaatggagcccaagacagatggctattccagttgcatgcaagtgtccttggggtgccttacttgaggagtgagcttggggttgacagacaggttgatgcacccgagagcgcagaccctccatgtgcttgtgtgctggcccctttcttgtactggccat

SEQ ID NO: 662205 - DNA, 139 bp, Homo sapiens
catctggatctgatcatgccggctgaggatcggcagcagtacgcctctcacgactttgtgaactactacgccgagcaccccaacagctccttcgccgctcaggtctggacgaacaacgcctggatcgccgcgcagatgg

SEQ ID NO: 662206 - DNA, 565 bp, Homo sapiens
tagcccagaacaacttaaaaacttcttcaaacttccacatttgagtcatattatttggaagacccattaaaagaaacataattgaaggaatttgtattaaggtaattaagtgacatggctgtccctcttcgtacctcccctattcaggtacaagcattggctatgcgaaatagaagagaaagcatacgttacaagcacatcctctaataaccaggcttgtgaaaaaatatgtccttagaaggaaaactcggagagccacagatgtaagtaatcagaacagtgtgtcttacatacctgaacatatgacctcaagtggctctccaatccttcctcatggcactgggcaaccacttgaattatgacccttcacaccacaggagtgaatcacagccaagaatatgtaataatggaaacctttcattattatcacagcagtagtagaacaatgatgatgctatcagcacttaggacacaaggagacaaggaattagatggggtgcttacacgtgggatccaagacctttcttaaatattatgttcagcacacagtagcatcccagctaat

SEQ ID NO: 662207 - DNA, 110 bp, Homo sapiens
gaagttcaaggttgcattaagccctggttgcaccactgcactccagcctgggtgacagagtgagactccgtctcaaaaaaaaaaaatcatggatattaataaagtttcag

SEQ ID NO: 662208 - DNA, 914 bp, Homo sapiens
ctcagctacaagattggcaaagaaatgcagaatgcttaaaggctgaatgtaggattcttcagtatgtggaaagacaaggattcaacgtgtggtcatatgataaataagtgatttataaacaagagtgatattttgctagggctttcaaagttaaccggttttctagcctcatggaatactgttgaacctatagcgttgtcttgattcttttgtgttctctgccttgtaattttctgttactgctatatctacgtgtaaatctttttttctttttttttttttttttttggggttaatctctggccacttttacttggtgggtcgacgagagtgatctatcctaagtgacttttcaccggtttacaaacaaaagttcccctagccttgaagccctgctacggttttcacacaccggttttcttggggctttacttggtacccctatccttccaagcacttcgggtacttcagccgcttttatactggttccaccaacacctaaagaggctatgctacagtctctagctaaagggaagacacatttatccttctccctctgagtgtggactcatcattgatggcatctcataactaaatttcctaacagttgggactgggacttcgaggccctttgggagggcacggaacgtgcagttcctccgtgggcaacttggtttttaatccaaagacttgaaccaatttccctgcagtttaaacattgttggtttaacccttccctaatggtccctccatattagtaccttggagtattaacactgtgctttttacaaagtcttaaccccttattttttaacttcacactgtgccgaggggatgacacatacactgaagcctgtaggaaaaaattatcggcaacacgcggaggcataagacatatcactcgttcatcacca

SEQ ID NO: 662209 - DNA, 796 bp, Homo sapiens
cggaggaccagcgtccttcacaagtgcgccgcgcctgggggccaggggccaaaaactcatggccaaaaaactggccgggttgtcaagctaacaaataagccttggttctacgaactgaaagtcccaaatggcttagcatagctcccccctcgcccatatgctctattacaacatgggttttgatttgacattccaaaaccctcaatatcgtcaaactggctgcaagaggttcccagtagctaggcttgctgtgtgcctcgtcaggttccaggcttgtcaagctctagatagcaagatgtctgcccatgggccagggtgtgcccttgagctccttacatcgtagatagtatgtgctgtctcaccgccatagctgtctatggcagcatgggctaagtcctcaggtacgggttctgacccagtctaaaatgtgtcctggctaacagtcaactcctcgcacttgtgtcacatcgagcactgagcacatgtgcgccacagcaagatgggctgtgatgaaacgttcccccctgtgagggactgtgagggtgatttctgagccagaagcgcgtgcctatcctacaacaggtgggtctcgcaagtaatcatattaagcaccggagtatgttttagatcgcgctggccaccagtcattatgagtgtcggtgagtgtatgtcctcggtacgcaagctcatgagcctcggttcgccccagccttcacggcataagccttcggtagaaccaatctcgtcagtgcgctcgagcccctgtcttgaatcaaagctttacgtttagtaaact

SEQ ID NO: 662210 - DNA, 102 bp, Homo sapiens
ccccagacagagtcttgctcttgtcaacccagctgggatgtagtgagctgaggtggtgccactgcccttcaacctgggcaacaagagcaaaattctgtttca

SEQ ID NO: 662211 - DNA, 189 bp, Homo sapiens
gagacaggggccactgagggggagttttcccccatgctttcaccccaagtgagacaggggctactgagggggagttttcccccatgctttcaccccaagtgagacaggggccaccgagggggagttttcccccatgctttcaccccaagtgatacaggggccacttgggcgctcgtgccgggtaccgag

SEQ ID NO: 662212 - DNA, 527 bp, Homo sapiens
ttcagctgccaccggcactgtccatttgcctgtctgtcaagctcagagcatggataagccacaacagcacgggcagattgctaccacttgtgacaacgcatattgctaacgggcacaaggcgaaacggaaattctacagggccccgtcaggaaattgctaacggagggggcctttactggatccaagggggggaacacagggttcacgcagcggacatttccccgttgggcaaagcaaaacccttccgattcccttttaaaatgtggggcacatttaaacttatgagcgagattgattggcgtggcttctctctttgtggcgacgcacggctcaaaggctatttgatcgcgctctagtgataatctccattggggttatttaaccaaggacttggggccttggcgaccttggtaaacgaccaccaccccattgtgactaatacgcaacacacggccaatttatccccatggcgcgtgcaaaatggctccattctccactggtaggggagtcccaaaaaacaacttgg

SEQ ID NO: 662213 - DNA, 395 bp, Homo sapiens
tggatgtgcactgactctagctgggcatggagcgagactcatctcaaaaaaaaaaaaatggtctttatgaaatacaaccaattagtatgacatttacaaaattataatagcttaatcgtactaggccagaagaaagacaattccctccttggggtctaggaaattacggaaaccaggtgtggcccagtaagagtatatgcgtacgtgaatatccggagttaaagttggcagggcgggcagggctgatccttaaaatagtattataaaaatgattaaaagcctcataaaggctcatcccaaggtggtacatcattaggctatttggggctcaagtgggttcacattgggaatacgttttaaccatttatatggggtggcttggtcccaactttgga

SEQ ID NO: 662214 - DNA, 746 bp, Homo sapiens
acagcctgcctagcgtcaccaacgtgacacagcatcatcgaggaggtggaggagaagcggaagcggaagaagaacgcccctcccgagcccgtgccgacaaaaagaaacaaaaaaaaaagaaaaaacgaaaagaacagaaacaagaaacacactaaacaacaaaagacaacaaaacacaacatacacaacgaacaaaaaaaaacagaacaacacaaaaacaaagacaaaacagcaacgacaaaacagacagacacaacaagcacccagcacgcgcagacaccaacaacgagcaacaaagcaacacacaagaaaaaagaaaagacaaaaaacacaagaaacaaaacaatagaaaccaaagaaaaaaagatcgaaaaaaaacaaccagcaaaacaaaacaaacaacaacgaaaaagaaaaaaaccaacacaaaaacacaaacaaacaaaagaaaaaacaacacagaaaaagaaaaaccagacaaacacacgaaaagaaaaaagaagaaaagaaaaatcacacagaaagaaacaaacaaaaaaccagacaagagaacagaagaaagccagaacaaacaacagacccaagaaaagaagaagacgcacaaaagagaagcgaaaacaagaagagaaagaaaaggaaacaacaacagcagacaaacaaaacaacaaacaacccacaacaacaaaaaaaaacgagaaacaaacaaaacaaaccaaaaaccacgcaaccacaacccaaaaccaaaa

SEQ ID NO: 662215 - DNA, 235 bp, Homo sapiens
ccccccccccccccccccccccccttttttttagaatcccctataggggacacccccccaaggctttgttttggggtttgggacccccccgtttttttatttggttagcccggcccctagggccccggggggaaatttttttggggggggggtgaatttttgggggaactttgttttaaggggaccttccccccccccggcccgtttttgtttttataaaacttttgttttttta

SEQ ID NO: 662216 - DNA, 985 bp, Homo sapiens
ccacgcgtgttctgtgccgccgctgtatgcgtgtgcagagaggaccggagccggctgagcctgcggaacgtcttcgcgtaggttcctggaggagttccagtgcggtgccgatgctcccatcttcagtggtgcatgctcaaataatctagtcgcacgactcgagcggctgggtcccgtttgcggtgacaagctggtgtgctcgtgtgtcagcctgtatgctgctggcgccaggcacgaaggggggcagcccgtggtaccatcgcgggaacggtgcgggtgcgtcccgttactgtaagcctgcgccctgcatgtcttgtctgcttgggacctcgctccgacggaggtgttgcgttgaccgtggtacctggttggtctcccagtggttgtggcaagctcaggaggatggccggtgcaacggggagggaggtgtgcttagtggggacaagtgagggggaacccccaggctattctgttcggcgaagaaggccaaggctcgacaaggtaatcgggcacgaacgggcagacaggacgagggaggcatgtgtggtgctactgactgtgatgttcctggtacatcatctcgatgtgtgatgctgaaaagagcacatgggtaagcatccgagcgtgatgaagacaggtgccctgtgtgggagctagtcttgcccggggagaggtgctgtcctgtcgtgtcgctggtggaccggtttatttccgccctgtgggcgactccaaggctggtaagcttttgccaggattgtgggctcccccagctgcgtggtgaatgagagccattcggggattgcatgcacgggaccgcccttggtgtgttgctttgtgggtgacaatctgtggccctgggtgggctgttcctcttacttgggtgcaggcccctacgccgagtcgtaacggtgccgcgttggctgcacgagggtggcaattgcgtctcgattcccatggaggggccttttggcggggtctccggggt

SEQ ID NO: 662217 - DNA, 192 bp, Homo sapiens
agtgaaagactgggaaggggtacaaattatgctatcaaggtgtcagagatgaaggtgcggcccgcctagcacgggccaggactccctccacatgtcacctgctaggtggaggaggccactacccacaacgcgctgacgtcctggaaggtcactcccactttccccatgaccagactacacttctccatgagc

SEQ ID NO: 662218 - DNA, 203 bp, Homo sapiens
cccgtttaggctgcagtgcagtcttcactctgtcattgacaggctgagagcccctggtaaaccactggtgtaagtccaagagtccaaaagctgaagaacttggagtctgatgtttgagggcaggaagcatccagtatgcgagaaagataaaggctggaagaatcagcaagtctgtcctttctatcttcttcttgcctgcttta

SEQ ID NO: 662219 - DNA, 148 bp, Homo sapiens
  misc_feature (93)..(93): n is a, c, g, or t
tcccgagtgctgggattaaaggggtgcaccaccacttctcggctctggttatttctaatttctaaaatttgttagctgcatattatatattgnaagtgattttgttattatctttgtggctaggtttatttcctctataaagaatatt

SEQ ID NO: 662220 - DNA, 591 bp, Homo sapiens
  misc_feature (117)..(117): n is a, c, g, or t
agaagctcgctagacctatgctggttgtgcagcgcggtgtgctgtcccggtaaggtgaggcactgtgtcttagcgtgttgccataggtccatcctgtccgatgactaggtgtctgantgtccgaatctacgtaaaaaacgcttggcggcaagagaattcgtcctgagaacagtgtccgcactggatgatcctgatggtcataatgtgaagtctataaatccggagtccaggcgagcatctgatactcagaattagcgacgcacggctcctgctttgcaggcaagcagctggaagatggccgtactctttctgactacaacatccagaaggagtcgaccctgcaacctggtccctgcgtctgagaggtggtatgcagatcttcgtgaagaccctgaccggcaagaccatcaccctggaaagtggaagcccagtgacaccatcgaaacatgtgaatggccaaagatccagcgatcaacagaaggcaatccctcccggaccaagcaagaggcttcatcttttgcaggccaggctagctggaaagatggccgcaactcttttctgactacaaacatccagaaggagtcgaccctg

SEQ ID NO: 662221 - DNA, 179 bp, Homo sapiens
ggaaacaccccgctacgtggcaggtgggttagaggctgcgtggaagagaggtcagattttcccctggacggtaattggcctttgagggggaactggtggggcatctgtgccatagaggacattcagggtgactgggtcaatgcggttggaactcgctgggtactgtacttcacattcat

SEQ ID NO: 662222 - DNA, 207 bp, Homo sapiens
aactatacatccctatgtacaaaataatagcttcagcatatttaaagcaaagattgataggagtataggaaaatacagatccacacttagtgagagatttaaacataccacttgtgtatgataggacaagcagactgaaaattagtgcagatatgggagacttgaagaaaacaagcaacagccttggccttgtgagtgtagaaattg

SEQ ID NO: 662223 - DNA, 311 bp, Homo sapiens
  misc_feature (12)..(12): n is a, c, g, or t
  misc_feature (45)..(45): n is a, c, g, or t
  misc_feature (62)..(62): n is a, c, g, or t
  misc_feature (66)..(66): n is a, c, g, or t
  misc_feature (72)..(72): n is a, c, g, or t
  misc_feature (100)..(100): n is a, c, g, or t
  misc_feature (130)..(130): n is a, c, g, or t
  misc_feature (145)..(145): n is a, c, g, or t
  misc_feature (155)..(155): n is a, c, g, or t
  misc_feature (166)..(166): n is a, c, g, or t
  misc_feature (183)..(183): n is a, c, g, or t
  misc_feature (194)..(194): n is a, c, g, or t
  misc_feature (197)..(198): n is a, c, g, or t
  misc_feature (214)..(215): n is a, c, g, or t
  misc_feature (225)..(225): n is a, c, g, or t
  misc_feature (229)..(229): n is a, c, g, or t
  misc_feature (236)..(236): n is a, c, g, or t
  misc_feature (250)..(250): n is a, c, g, or t
  misc_feature (268)..(268): n is a, c, g, or t
  misc_feature (299)..(299): n is a, c, g, or t
cacacccatgcncttttttaggttaccatgtacagagattacttngagagcctcatgccgtntttnccttcncacactggtcaagtatcttctgagcttntttgccgcaaggttgcagaaataggctganggtccattggaaganagacacaatnaggcagtaggnggttgggaagataagangacagactttnaanntggaattaggcactgnngagagatcantttncccacanatggagaagaaggnatagttttggaagggggnggccaggagcagaaggaagaagacccaaganggaaagggagcc

SEQ ID NO: 662224 - DNA, 519 bp, Homo sapiens
ggaccgagagacacgctgggtcctgttcggctgctgctcacgcagcccacgcagtgcctggccagcgtgccacccttccctggacagggctgatggagatggctcacaggcggcatgtggggaaagccaaatctgcctaaaactcaagtcacctcagtaccatccaggaggctgggtattgctcctggcatccgccgtgtgttgctgtctcagcgggcagtggacccagagcccacacccccccaagagccctcgatggacagcctcacccaccccactgggctcagcaccaggagccccgcctggcaatcagtatttattgcatccgtcagtgcagtcctgggcaactggcctggcgcctgttcccccaggctctaagtgccaccacccccggcaggccttccctgacccagccaggaactaaaagggaccaagtgcacacagttgatgagagccgtctcctgtgcctcccccgcccaatccccggtcttcgtgtatatctgccagttcaaagcaagg

SEQ ID NO: 662225 - DNA, 182 bp, Homo sapiens
tcgtctcagtctcaactctgtctcactaactttttaattttctgagatagggtctcactctgttgccccagactagaatgcagccagtgtgatgtcaggtcactgcagcctcccatcttcccaggacccaccagtcccaaatacaccatgcctgggcttttttttttggagacagcattatt

SEQ ID NO: 662226 - DNA, 714 bp, Homo sapiens
  misc_feature (50)..(50): n is a, c, g, or t
  misc_feature (89)..(89): n is a, c, g, or t
  misc_feature (91)..(91): n is a, c, g, or t
  misc_feature (103)..(103): n is a, c, g, or t
  misc_feature (156)..(156): n is a, c, g, or t
  misc_feature (201)..(201): n is a, c, g, or t
  misc_feature (239)..(239): n is a, c, g, or t
  misc_feature (282)..(282): n is a, c, g, or t
  misc_feature (343)..(343): n is a, c, g, or t
  misc_feature (468)..(468): n is a, c, g, or t
  misc_feature (547)..(547): n is a, c, g, or t
aagagcatgcgaagagccatagcatcaactgtcatattccctctacttantgaagcaagatatatgactgtacatacgatggataggancnaggtctcattanagcttcttcagagtgtatcagataagaagattatctagagatttctagtcatnttacagatgataacagatgtcagagactatcttgtctgtctctantcaggcccctttctactattactacagataaagtgctnaattactgagtcaattaatacgtactccatactcacttcatcntacttgaagagtcacacacttctttatacagaattccctgagactgggtatcttataaccnaaagaggttcaactgactcacagttctgcatgggtgggaaggcctcaggaaacttacaatcatggcagaaggcaaatgggaagcaaggcacatcttacacggtggcagaagaagagggtgggganaatggccaaacacttttaaagcatcagatattatgagaactcactcactatcacaaggacagcctggggaaaactgtcnccattatccaatcacctcccatcaggtccctccctttacatgtggggattacaattcaagatgagatgcgggtgggtacacagagccaagccatattacttagattttcagttacgcataacggatgttcatagttgtatgtgcctaaatatagctttagagattca

SEQ ID NO: 662227 - DNA, 704 bp, Homo sapiens
tggggaaagggagtctggctctatcgccaggcgggatggcgggggcattgattctcggctcactggcaacattccgcctccggggttcaaggcgattctccgtgcctcagcctccgttgagatagcggggactacgggcgcattgccaccacgcccagcataattttggtattttaggtagagacggggtttcaccatggttgggccaggaggggtctgtgactctctggacctcgtgatcctccggcgctgggtttcccaaggttgctggggattcacgggtggtggagccaccggttcccgggcccagaatcataaatcttaaagatgcgaatggggtcttagagagatcactgtaccctaacctcccagattgggaatctttcttggtgcattctgggcaagataatcatccagcttctggctcagtagttcccaggcagaagaacctcacggtggtggtcgagggggatgctccacatttctaatttccaccttttggaagaaaattcctccgtggtctccctaagtttcgtgtgagcgcaaaacattcgtggtcctccacgtgtagttaagtgacactggaggccctaattgggggcatctcaaggtaccgactgaacccattttcggacaattggatcccctttagcgaccacaatcctggtgtactggcgaaggggggcttaatataaacgcaacgt

SEQ ID NO: 662228 - DNA, 118 bp, Homo sapiens
caggtcgaagtggtcatcaagtacaactttaaacccgtcacttgctggctcagaagatcgaggtgaggatccaaccccactgaacacaatgcggggtgcaggtgatctgcatgaaggg

SEQ ID NO: 662229 - DNA, 876 bp, Homo sapiens
tttttctcaaataatcaattgtcctagaaccatgtgtttctcatttatttgaaaggccatctagtgagagatttctccaaatgtggggtagggaagggaggggaagcactttaaagtctgagcctttagaggtgattcctcaagaccctgcttaatcctaacaattttcctcattagtaaaagtcagcccaaactggggcttgttaagaaccttaacagagcacatactcactactgtagataatgaagtaatcaacagtatcttataactatgtgtgcgctagcactacattctatcttaagtaccgttgggtaggtagggtgatagggaagacagagtctcgcttcggtacacccaggctgggaattgcagtggcgccgatcttcagtccactggaagctccgcctcctgggttcacaccattctcttgcctcagcctcccaagtatctgggactacagtcgcccgccaccacgcccggctaatttttttgtatttttaatagagacggggtttcactttgttagccaggatggtctcaatctcctgacctcatgatccacctgcctcggctcccaaagtgctgggattacaggcaggagccaccgcgcctgggccttttttttaagttttaagtacctataaagaacactgaaaggtgatgtgtgtggatgagctaggaagactgaaataggctctctctaaattatcaaattaatctgaagccattctgcaatactggtcttaatgtatactcactgtatagaagccaggtttttcccctactttggtcactggcactatgtgtatcgtccaactacactggttacattgtgtcaatttatatgtcttagaccggggggggacctgaactgg

SEQ ID NO: 662230 - DNA, 436 bp, Homo sapiens
ggtacctgcgagacggtcagtgaagagtcgaacgtgctctgctccagtccacagcacacggtgtacatgaggcgcggcttccccgaggctggcgaggacatcgatcaaggcgaggtgtccgccctgtcagagcagctcaaagcatgcgggctgcgctactgtgccgagaagtacgagtgggacgtggctgaggcccgcaagatctggtgctttgggcccgacggaccggcccaacatcctcaccgacatcaccaagggtgtgcagtacctcaacgagatcaaaggacagtgtggtggccggattccagttgtggccaccaaggagtggcgcactgtgtgcgtgagaacatgcggggtgtgcgcttcgacgtccacgacgtcaccctgcacgccgacgccatccacctgtggagtggtggccagatcatccccacag

SEQ ID NO: 662231 - DNA, 669 bp, Homo sapiens
  misc_feature (82)..(82): n is a, c, g, or t
  misc_feature (84)..(84): n is a, c, g, or t
  misc_feature (86)..(86): n is a, c, g, or t
  misc_feature (88)..(91): n is a, c, g, or t
  misc_feature (93)..(93): n is a, c, g, or t
  misc_feature (104)..(104): n is a, c, g, or t
  misc_feature (106)..(107): n is a, c, g, or t
  misc_feature (138)..(138): n is a, c, g, or t
  misc_feature (163)..(163): n is a, c, g, or t
  misc_feature (232)..(232): n is a, c, g, or t
  misc_feature (255)..(255): n is a, c, g, or t
  misc_feature (286)..(286): n is a, c, g, or t
  misc_feature (288)..(288): n is a, c, g, or t
  misc_feature (291)..(291): n is a, c, g, or t
  misc_feature (293)..(293): n is a, c, g, or t
  misc_feature (431)..(431): n is a, c, g, or t
gcgggctcagtatgtggcgccttcctcgcgcgctgtgtgtgcacgctgcaaagaccagcaagctctctggaccttggagcangncngnnnncntctgtccactntnntcatcaatcagccccagtatgcgtggctganagagctggggctccgcgaggaaaangagggcgtgtataatggaagctggggaggccggggagaggttattacgacctattgccctgctaacagngagccactagcaagagtccgacnggccagtgtggcagactatgaagaaactgtnanaangnagatgcatagcacgaaagcatgggaagaatcgtgggtcagatcattccatggcatccgaagcacgggaggagaaagatagtagacgacaggaattgggcggatggccttgcaggcgagaaggatcccatacgtcactnagggatagcttgggtgttcttcgcgtagatgggtgggaaagatctttagtgtggaaggtgtagggtgaagtacaggagatacgatgggatatctcggtgcacgtatggctggttggagttgatcagggaatgcatgggcatggaacctgatcttgtccatgtctgaagggatctggtccactgactactcgatagtaggcagtgggcagatccacgaacgcctggatgggcgatcgtc

SEQ ID NO: 662232 - DNA, 684 bp, Homo sapiens
cgatgaaactcgtgacgccgttagctgacacagggtttaccaaagcaccagtcatgtatcagaacatgcttctgagtgcctactgtgtgcacggcatcattctcagtgctgggaacataacgatgagcaagccatgttcctcgcccgagacggagagaacgaatggtctgaaggatagagaggagagccacatttacctcgaaatgtgccagtttagggctagccatgaacgctgctcacatgcatgcatgtgtgatattgagcgcgtgtgtgtgctggttagctgagaatgctctagcgagcgagagcatcctgtgctattgatagaatccagacgacatgtgagaacatgagaggaaccaaggccctgcgaaggacacgtcagacgttttctctttagctacaggcatgtatcactctttcaccttattcaccttgcgtcatttgctcagctgatatagacagatatctcacgaagtgatatagttgcatgtgcgacatttgtgatgttagtgatctccggcagcctagatcagcatcttactgactacgaagccacctaattgctaagctttccactgcccaattaactggaggacactacttactatactgggacctgttccagccacaagttttgcaccttaatccatgcacctaatgccctatggagcttacccttcc

SEQ ID NO: 662233 - DNA, 587 bp, Homo sapiens
  misc_feature (94)..(94): n is a, c, g, or t
  misc_feature (109)..(109): n is a, c, g, or t
  misc_feature (154)..(154): n is a, c, g, or t
  misc_feature (335)..(335): n is a, c, g, or t
  misc_feature (345)..(345): n is a, c, g, or t
  misc_feature (396)..(396): n is a, c, g, or t
  misc_feature (400)..(400): n is a, c, g, or t
  misc_feature (402)..(402): n is a, c, g, or t
  misc_feature (413)..(413): n is a, c, g, or t
  misc_feature (451)..(451): n is a, c, g, or t
  misc_feature (545)..(545): n is a, c, g, or t
  misc_feature (552)..(552): n is a, c, g, or t
gcgggcaattttcccaggtcatttgccgaaatagtgcggcttttcccacaacccttgctggcggttatagaagttctgcgcatagtcaataagngcgttgcgcctgttntcaacctgcggcggcctgagcgatttcttcattgcgatacccggnaagcatcaggtcatactgcgcctgtgccaccgaaacacccgctttcgcctgcatcagggcaatctcatacggcttgtgatccagttcgcccagcacctggcccgctttgatagcatcaccttcgtccaccgccagcgattcaacgggccccccaacacggaaactaagatttaccgtacgnatatccacgntgccatacagcgtcaggccgttatcctggcggctttgataccaccagtagnctcngnaaccacggggnaagtaccactaccgcaatccgtcacgacaggttttttnatcactacaaactcctttgcgataatccttgcaaaatcaggtcgatatgacaggtcaccgtctggttgacagttcggtctttcttcatcgacgnggtccanccggtacgtaacagaattgtttctttgcaaggcgg

SEQ ID NO: 662234 - DNA, 495 bp, Homo sapiens
aaaatttgccaacctttggttgcctatttttttggggtgccggatattgtaaataatgtcctaaatggattggggcctttgtaaaagggcccgggggaagggggccccctccgtcttttgtttttttaaataatttgaaatttgcccctttttttttgggttgtggggggccccttaggaaccttttggttttttggaacaagttgtcctttttaccatcattttgttgaatttaccaaaatttttctccttgaaccggccccggtggtgccttttccttctggtggttttccgtgctctctttcccaaatagatgttggcctttttgacctttaccgaatttttatcctaccggggaaccctggtgggaatttatatttgtggtttacctttggattttcccaaagggaataacttttaaaattttttccaggggaaattttccaagccttgaatttttttctttttcccggataccaacccttttctccttga

SEQ ID NO: 662235 - DNA, 110 bp, Homo sapiens
ttaaggtgattcttccaccttgggctcttaaaatgctgggattgcaaatgtaaggctttatgtctggctttacaattattgtttgtcattcttccataaggaagatttat

SEQ ID NO: 662236 - DNA, 461 bp, Homo sapiens
ttgctgggtctgtacttcgggtgcagtgtgacaggggaaggctgaaataccctaagtgtactccaagagacaggaggctgtcctttcaggaagcattacggacccgaagacaaatggaaaaaagataaagaatattctaacatatgaatctcgcataaaacaattttaggaagactccactaagttcagtgttctgagcctttacattttgcataaaattgtactcaatactttccattatttatccaatcaaagcacaaatgtatcttattttagtttgcttaattttacatttaatctaatctttattgttgtctttcacctgtttaatttgatttattcatcaaatcacccctgttttcaatcgatcgctgtcagactatattgtttccttgagtatgtatggaaaacacatttgtgtttattatattcattaaaattaagattttctgttaatttta

SEQ ID NO: 662237 - DNA, 1679 bp, Homo sapiens
cttgtggtcgttggttctccgcttgtggtggttgctgtgttgtttgtcgttgcgcagcttttcgtttgtttctgttgtttttcctctctctgttttgttgtcttttgttggttgtgcgtttctggtgttcggtcgtttgttttcgtgtcttcgttctcctcctctgtcgtggtggttgtctcgtctctgtgcgttctgctttctgtgcgtcttgtcgttgttttttcttttctagtagttgtgtttggttgtgtctgcctttgcttcgttttcctgtccttcgtcgtgtgtcctcttcttgttgtttagttgtgtcttgtgtgaggttttgttggtttctgtttctttcgctgttctcgtctctgcgtttgttgtgttgttggtgctttttcgcgttgttttgtttctggttggtggtgtttggttgtttgtctgtctttcgtgctgttgggttggtgttttgtgtgttttgtgcttgtttggtctctgtgtgtcgttcttgtttgttcttgttttgtttcggtttgttgttgcttgttctgtgtttctggctgggtgtgcttttttgtgtttgtctttggtgtggtgcggttcgtgtcgctgtgctctagtgtttctgctctttggttgtcgtgctgtttcgttgtgctttcgttgtggtggtgtcggtcgggttttgtgttgcttttggtctgtggtggtgtttgtttttttgtcgtgtttttgtgttcgtgctgcgtgttcgttgttttgtgttgtgtggtttctttgctcgttgtccgctcccgctcgcttgtctggttgtggtgttgttgttgttgttgtgtgtttgggggtcttggtgtggtgtgttttggttcttgctcgttcctccgtctgccgttcttttttctctctatctttctgttttgtgtgtttttgctctctctctctcctcgctctcgctcgtttgttggttgtgttggtgtggctgcgttgctcttgtctctgctcttcttgctttgtcttttttttttgctgtgttttttttttgtctgcgcgttcctttgtgtgcgttctctctctgtgttcctctcctcctctcctctctctgtttgtttcttttctttgttgtttgttttgttgtgtcttttctttgtgttgtgttgttttcttgtgttttttcttctttctttctcttcgtcttggtgttgcgccctggtctggtggtgtgtgtgtgtttgtctttctctgtctgtctgtccccgctccgcgtctcgtctgtgtttgttttcgggtctctctcctctcttcgggttgccgccctcccctccctcctccccgccgctctttttggcgcggcgcgcgcgcgccgccgctctccgcctcgcgcgctagagtagatcacttcctctctcctccttctcgtctgctggttcgttgtgtcgatagagagaaatacattatctatatatattatatatatattatattattattatttgtctctctttctctctcctctcctcctctaatcaatatataataaaataataatacaataatataataacaaacaataatataaattatacataaaatatatataaataaaaaaataataaataaaacaatataaataaaaataaataataattataattatatcaataatataaataatataaaataataaaata

SEQ ID NO: 662238 - DNA, 114 bp, Homo sapiens
ttcgaacaaattatcccaccttggcatcatcacctcaacccaaaaaggcataattaaacttgacttcctctctttcttcttcccactcatcctaaccctacccctaagccgggg

SEQ ID NO: 662239 - DNA, 310 bp, Homo sapiens
  misc_feature (27)..(27): n is a, c, g, or t
  misc_feature (125)..(125): n is a, c, g, or t
  misc_feature (135)..(135): n is a, c, g, or t
ttaaaaattgcttgtgtacgatgctcncgatctggctgacaggatcattcataccccaaacctcagcatcacacaatatacccatatagcaagcctgcacatataccccattaatctaaagtaanagttaaaaanactttttcaaaataacaaaataaataaataaaattgctaaaagagtggtgcatgcctgtaatcccagctactcaggaggctgaggcaacagaatcacttgaacccagcaggttgtggtgagccaagatcatccattgcactccagcctgggcaacagagtgagacgccatctcac

SEQ ID NO: 662240 - DNA, 180 bp, Homo sapiens
gttaggtgactctagcaggatcttttcgaccgaagctggagctgctgaaggataagggctgctcagttgccctgtagccatgaagatatcgtgaacaaggatgccaagagcacactgcgggtgctctatggtctgttctgcaaggcacacgcaggaaggcacacatgggacagagacgcc

SEQ ID NO: 662241 - DNA, 524 bp, Homo sapiens
cgtattgggctgtcgtgctaacagttgttggtaacaagaaaggctgtgaaaccgtttcaaacttgaaaagtatctggtggtcttaggatgatggacgtctcacctgtcgccgtccacatggtcagagtgattgtcatgcctcatactcgtgaatagctgagattacaggcacgtgctaccatgcgcagttaattattgtagttcgagtaaagacggatgatatggttcgtgctgtgatccccaaccagatctcaacttgaattgtatctccgagaatgtaccatgtgttgtggcagggacccgagggggaggcaattgagtcatcgggctggtcttttctgtgctattctcgtggatagatgagctacagtctcatgcgatctgataggattattcggggtgtctgcttttgcgtcctcgtcatttgttctcttgccgctggcatgtaaaaagtggcttgcaccacccggcatgattctgaggcttccccagccatgtggaactgtaagtccaattaaacctct

SEQ ID NO: 662242 - DNA, 305 bp, Homo sapiens
gcccccccccttttttttttggggggggggcccccccttttccccggcccccccggggggggggtgcccctgtttttggggttattttggaaaggccaaatttttttattttccccccccaaccttttttttttgttttttttttgaagaggaggggctgtgggcccccccctccccctttttttttcccccccctttgagggtttgggggtttttgtttcccccggggggggggggggggccccggggtttccctttccctctttttggcccccctttttttagggggccccccttttatttta

SEQ ID NO: 662243 - DNA, 396 bp, Homo sapiens
acgtcgggcagacgctggtcttgatcgagaacgaggggctgggcacccagaaggagcagtacatccgggccacctcggtgtccgcggtcgagcgcaccttcacctacaacaacgaccaggactacaaggccagcgtggtcacggtcgagatcagcgatgccttgcgctacgacttcaccggctcgcccgcaacgcggacgttcacccgcgcgacgaacagcaccaaggtgcgcgacacggtcgtggccgacgctggaacctacgtcggagtggtaccgctgacgcaggctgcctccgtcggcgacttcacgatcaaaggcacctcgatctacacgcagttggtgccgagcgcgcagaccgaaacgccgatctccttcgtccctccctacgcggccg

SEQ ID NO: 662244 - DNA, 292 bp, Homo sapiens
gcaatggctcaatctcagctcactgcatcctccacctcccaggttcaagtgattctcatgtctcagcctcccaagtaactgggattacaggtgcacaccaccccacccagctaatttttgtatttttagtagagatggggtttcaacttgttggccaggctggtcttgaactcctggccccaggtgatccacccactttagcctctcaaagtgttgggattacaggcatgagccactgcgcccagcctggaagttaatttttatggttgtgtatgtgttgcttgtcactaga

SEQ ID NO: 662245 - DNA, 332 bp, Homo sapiens
  misc_feature (52)..(52): n is a, c, g, or t
  misc_feature (74)..(74): n is a, c, g, or t
  misc_feature (214)..(214): n is a, c, g, or t
taaagaaaacccccgaaacccaataattcaagcccgggttattcaatttttntggggtttttttttaccccccnccaagcctcagaggatttggggtctcccttccccatttccgggggcatttagggctcaccattttttgtagccccgggcttccccggactcccgtccattatgggggcaccttccctcaatttttgtttcatccgccaantaatatttccctttacatccaaacatccctttggttttgaaccccccccctgatactggcattttgtaaatgtggtttgactatttttgtatgtccccctctattgatgggggtttta

SEQ ID NO: 662246 - DNA, 453 bp, Homo sapiens
  misc_feature (1)..(1): n is a, c, g, or t
  misc_feature (68)..(68): n is a, c, g, or t
  misc_feature (138)..(138): n is a, c, g, or t
  misc_feature (452)..(452): n is a, c, g, or t
ntcttttttaaggggagtaagaatagtagagataacttttttttcataactttttttttgttggttcngttttgttttgagatggagtctcgctctgttcgcccaggctgggaatgcagtggcacgatctcaggtcanatgcaacctctgcctcccgggttcaagctattctcctgcctcaacctcctgagtagcagggattacaagcacctgccaccgacgcccggctaatttttttatttttagtacagcctggccaacgcagtgagaacctatctctacaaaaaaaatttaaaatttagccaggtgcagtatcacatgcctgtggtcacagctacttgggagctgcttgagaggatcatttgagcccaggagttgaaggctggaatgagctgtggccataccactgtactcgtagtggcgcaatagagactctgcctctttaaaaaaana

SEQ ID NO: 662247 - DNA, 420 bp, Homo sapiens
agggaagcaataggtccatcatgtgtccggcaggaagcgtgcccagcgactgctggccggagtagggcttggccctaagccaggaaagggatgcctggtaccaccttttagacacatgcagcgggagcgacgacacttcaggagtggacacagggtttgagcttagagcaggcctagggcaaagtcaaggctccggaacaaggagatcagtaactagtgggcagacgacttgtacagctcactgcgcagcaccttctgggactctagtcacaactccccataccgggtctcaatggtcttgatcagaaccgtcttccggctgtggctgtcctggggaggctccacctcaggcacagtcgtcttactattaagggaggcaaaagaatggacaggcacggagatccggctctcctcgccctc

SEQ ID NO: 662248 - DNA, 363 bp, Homo sapiens
ctcatcaacacccccccccccaaaatcacaccagtttactagcaatggatccaaacctagaagaaatctctgatttacccaaaaaagaattcaggaagttagttattaagctaatcagggagggaccagcgaaggcaaagcccaattcaataataataaaaaaaaaattcaggaagtgaaggaagaaatagtcaaggaaattggtagcttaaaggtaaaacaattaaaaaatcaggaaattttcaacacactttttgaaatgcaaaatgctctggaaagtctcagcaatggaattgaacaagtagaagaaagaaaaacagacctcaaagacaagttcttcgaattaaccaatccaacaaagta

SEQ ID NO: 662249 - DNA, 460 bp, Homo sapiens
cagaagcagacggcctacgttcaaacgaatcctgctcgggcctcctatgtccatgggtggcatgtcaatgatggggaggcgtgaggtcttctgtgaacggtactcgataacagtcttgcccacttaccggtatgtttcgtgcagccatccttcagggcagtgtacgtgaacctgctattgccctctgcccggatctccacgtcataggagccctggatgagcagggccttcttgaggttgccagctgcttcgtccagataggcaatgctgttctagcagaggtaggtgatgttctgggagccttccgtggacagcaggcgtaggaaggtcatctggacgttggcagtgttgggagccagattgtcatctccatagctgaaatggaagccaccattgatggtttctccaaaccagatgtgtttcttctccttgctcttgaaactccaacaggctctgagga

SEQ ID NO: 662250 - DNA, 496 bp, Homo sapiens
ctacctttcgagactcagaaaccagagtgtgtttaacttctgtgctattccacaggtgatggccgtggccactttggccgcccgttatttacacggcaggtggctttctccctagttttgattctgtaatgtctgttcgtcatgttttgctgtgatgtcacataggtagatttgtatgtagttttaatgtcacctataacaaaatgtgtttggtagcagattgtccagaaagcattttaaatgaagaggtataaacccttaagggccaaaattctgtatattatattactcttaagcgaaaaaccagctgccgcttttatgtacccatattacattcgagtaggcagcagtctttaaacataaaaaggccctaggcatgctcttgttcccaggtgctgtataaagttggttcctgttcgttcacgccccatcgcagttttgtccataggtttggacaaccataacggggttttacttttttttttaaaaaaaaaaa

SEQ ID NO: 662251 - DNA, 773 bp, Homo sapiens
aaagccgagtttacctcttttccatgttcattattgaggcaaaaacaaaaggccccaaggaaaaaaaaggagtggacggggtaaaaaaaaaggatgccaaaaaaaaactcctggaaaattcctccttgaaaatcaggttcaatcaagagaagagacagggatcttgctggtactggcccagcctgggagtgcaatggcccacaatcatgggcttacagcagcctcaaactactggggctcaagtgatccttccaccaccgtcttccaaggagctgggtactataggtacatgccaccatgtccagctaatttttcaattttttgggtagagacagggcctgggtatattggcctaggctagtcttgaactactgggcctcaaccgatcctcccacctcagcctcccaaagtgctaagattacaagcatgagccattggacctgggcttcttttactttttaatggcagttaaaacattacatattttgttttacatctgtggcccacattataattccatggaaagaggtgtgagatataatatggactattattctccatcatagaaactgtggaccattttctcttactgtagaaactgctattttatcatacctgtgatctatacttccaagatagtaagtacgtactccataagaggcatttgtcacagtttctataatgggctgcaactggggcattattgatctctacggctgcaggggcctgttccctcctaggttcacctctcttgtaccccggttgtttggcgt

SEQ ID NO: 662252 - DNA, 584 bp, Homo sapiens
caggctgatgcataggaggaaagaaggcaccgtaaaggaacatatgggaaagaaatcccctcggaaaccaaagcccagccatcggagattttaagatttttcaggctttccttataatcttccttacatttgtctctttaaacacatttaagtcgacctttgagaagttgctgataagcagttatcaaacaagagttagagtaacaaaccctcccacctcgctgtgttggttggtagcttccaaggccactgtaaatgtgtatcagtgtgaacctgatccagaaacagccaggaagggagcaaagtttagtttagtctgtgaggaaactggcggctgctggtagttccatgctgtctgtccagacttcagcttggtgtaagtagttttttttaaaaaaaactattatgacattttcatataaaaaggatggtaagattaattcccatcaaagattaaatcaagtttctacctggctctaaatcttagggataagaactactgaaaagaaagtttcagcactcagcagtagttttatttttttttaatggaaaagaaagccgtgaggtgcatcagcctgttcggg

SEQ ID NO: 662253 - DNA, 273 bp, Homo sapiens
atgaatttcagctgtcgtcccaccccacttcttccaccccactttgttccttcaccaacttgcattttcttcccttccctgccagccagatagattgactgatgggaaaggcaggcgcggccttcgttgtcggtatttctttgatgtgaaaggggcagcacagtcttttaaacttaatccaccctctttgcatcttacaaagttgaccagctaaaagaagtaaaataagacggcaatgcttgtgaaatgtacagtgcatttgggctgcaccct

SEQ ID NO: 662254 - DNA, 1371 bp, Homo sapiens
gattgccatcctgaagctgagagacatgcgggccagagtatgtcgtcgctaccggtggcctgtaagctcgtgctctgcgcgtactctcttcattatctgggcccgtaggaggctgatccgaagtcgtgactcgctaaagaattcagtgttatgactctaccgtacatccaaggcaacatcaatggaatagtcgaaatttaccttggaattgctaatggcgtcggggtccccatccattccgacgattgggaagttgtgacgttactcggagaaaatcgtgccgcacgagcaatcggcataacctggtgggcggccatctcgaggacattcgtgctttaagcagctactgggactctgctcttatctatatccacttggtacctcagacttgtactttcagtcccctcaattggccaccgcgatggagtaattgccttgacctggggttgcaaccccattggtggagcataggtcctagccagcccaatagatgagtttagaaattggaggaatcgtagcatattgttaaagcaagctattcaattgggactggtctgagaagtaattgcacgcataatggggctttggactgaaaggttaaccagggatggactcggctatcacgttcgcctttcaaaagtaattggattattggcttacttagccatctaaaggactgacactgtcagccaacatagtgttaggggttaaataagatcacgtggtattaggccaatggggaccctggatgtcctaccgtgtgagtaagttgcctaccttcatggagcattgctgcgagtccccagcgattcttgaacaggtactcctgagagacaacgattgagtgcccaatcacggggtaggacctcctacggaaggggactgaggacatctcccacgacggctagagaagaagcttggaggaaataggctgtctgagtcccagtgatctcacaacgtgctttggtttccaaaatgatggacaggctactgtccagagagcacctgtggccacgttgcacaaaggcgtcgggagcaaagcaataggggtaaaaaggacgattggcaattaggtttggaaatccttttcacaagatgttacgaggtggcttctggaacgtgagccaaattatgtggggcgcaaacacatttgtgctgaaacagttgcttcaagtctggcaataacggacagttatcttcgtgggaaccaacttgttgtcttacatagcgtggtccgtgcagaaaaccgcgatcatagagacccgatataacacagacatccgaaagtcgagcagtcacgacgaaccacattgggaagtcgccacgctcacggacatgcgcggaagggcgcacactctcgggcctacaagg

SEQ ID NO: 662255 - DNA, 174 bp, Homo sapiens
ggaggctggggacgctgagagcgggtcttctacctgaagatgaagggtgacgtactacacgctacctggccgaggtggacaccggtgacgaccagaagcgcctccttgactcagcccggtcagactaccagtgaaggccatggacatcagcaagaaggagaaaccacggacaaa

SEQ ID NO: 662256 - DNA, 132 bp, Homo sapiens
ttcattttctacacacaccaatgtcccattccaaaatattgcacaacattctgaatacaaaaaccttgattgtacaaggagtgagagtgaatgagtgaagatgtcaatggaacagagtgtagaaacttgaat

SEQ ID NO: 662257 - DNA, 159 bp, Homo sapiens
cacgaggagaactgctttgaaaagatgtcatgtacaacaccctcatccttgcccttcacccgttcagtgtaaaggaagaaatagaatctctttccagattgactgattgaaaccaagttgatcaatactctcccagcaccttttaaattttccttgtca

SEQ ID NO: 662258 - DNA, 813 bp, Homo sapiens
  misc_feature (136)..(136): n is a, c, g, or t
  misc_feature (147)..(147): n is a, c, g, or t
  misc_feature (153)..(153): n is a, c, g, or t
  misc_feature (277)..(277): n is a, c, g, or t
  misc_feature (359)..(359): n is a, c, g, or t
  misc_feature (373)..(373): n is a, c, g, or t
aagctagtacgagctgtgcttaaatcgagacgagggagagaactagtctcgagtaatttttttttttaacaaatgaggcaattaattaacccagcatggtttgttctaatgcttctatgtgggacagatgccaccntgtccgggatntgtcanatctctttgtcctgaggtgtagttgcggccgccatcttggtccttttccaccattttcagcccctccagggcttggaggacccggcgggccacactcttggagcctcggctgaagtgctgggcntgacccgtttctgacgtcccccatagatcttggtcatggaccaaccccagcgccacccggaggtacagtccgcgctgtggancagctcgcgtgtanaaccagttctcatcgtagggagcaagctcttgtgtgcttgtgccagcttgacggtatccacccattctggtggacttacagattccccggactattaagaggaaggctgccaaaactctgacaaactcctgctgggtcacacgtctttaacagtaaccccaggcatcagtgcggctaggactagagcattggcttttctgtgatcaacctgatgattaacactgtgttttaacaagggacgccgggtgaaactctgaagatcccaaggaaacaaagagacgacgagaaaaaaacgagagaaaagaaaaataagtaaaggcaggaagaaaagaaagaagagaggtggaatcaacaaaaaaaaggggaaagaaaagagagaagagcaaaggaaaagaacacgcaacaccagagcacgaaagaaaaataaaagccgagccatt

SEQ ID NO: 662259 - DNA, 188 bp, Homo sapiens
  misc_feature (40)..(40): n is a, c, g, or t
ccgtcatactctaaatttagcatactacgatgtagataanggggatttgccacctctgtagaattcattctctgtaactaaactgctagaagaaatctatttaaaaactcattaacattccagtatcttatccgctagtgctagaaaatattgtcacacgtttctctttgttccttttccccaggggc

SEQ ID NO: 662260 - DNA, 592 bp, Homo sapiens
  misc_feature (136)..(136): n is a, c, g, or t
  misc_feature (147)..(147): n is a, c, g, or t
  misc_feature (153)..(153): n is a, c, g, or t
  misc_feature (277)..(277): n is a, c, g, or t
  misc_feature (359)..(359): n is a, c, g, or t
  misc_feature (373)..(373): n is a, c, g, or t
  misc_feature (541)..(543): n is a, c, g, or t
  misc_feature (560)..(560): n is a, c, g, or t
  misc_feature (566)..(566): n is a, c, g, or t
  misc_feature (568)..(569): n is a, c, g, or t
aagctagtacgagctgtgcttaaatcgagacgagggagagaactagtctcgagtaatttttttttttaacaaatgaggcaattaattaacccagcatggtttgttctaatgcttctatgtgggacagatgccaccntgtccgggatntgtcanatctctttgtcctgaggtgtagttgcggccgccatcttggtccttttccaccattttcagcccctccagggcttggaggacccggcgggccacactcttggagcctcggctgaagtgctgggcntgacccgtttctgacgtcccccatagatcttggtcatggaccaaccccagcgccacccggaggtacagtccgcgctgtggancagctcgcgtgtanaaccagttctcatcgtagggagcaagctcttgtgctgccagctgacggatcaccattcgggacttcagctcccgacttttgagagctgccagagctctgacgactctgtgttcactcttacagactcagcatcgcgctcgcgctgcatccgatcgacgacactctttnnntaaaccacagcgtgggnttcatnanngtgtcacctcataaaagggcttt

SEQ ID NO: 662261 - DNA, 1062 bp, Homo sapiens
acgctccaactccctgcggagagacagtccgtccgccgcccgaccgtgcccgcctaggtaaaatgggatgccagtaggagaccgggccaccacggaccagaggggggcccagggtaaggcaggcatgccgagtgccggttcgtccggatcatcagcgaggctgggtggcggcgagttggtgacacggcgacgggcggggccagagaaagaggcccaaggtcgttccagggcatgggctcagggtggtcccctaggagtcctcgcctgggacgcatatctgcgcgccctcttcgcgggtcgctgcatgtcgtgcacccccgcatggcctgtcgtggtcttggtccatgttggggtcgggaatacctgtgcaagcttgggtcctggcacacgtttaaacaagctcgtagcaccgaagtgggcttgatcgacggtgaacctagctccattcgctcgagggttgccccatgggtggatgcctccatgtacagttggcgcctcatatatcgggaccgattgcagctggtgggtggcccttgtgccattctcctcgccatggtccttgcgctctcttccctcccttctactggtacttcctctatccccgtaagcccctggaggggtgactcaccaaggtcatgcgtgggtgctgcgagagaccctctatcagcactttcatagaacggtactgaaggttaggtgaaccgggatttgtcgcaattgcaccaggtcctgggcacacacccaagggggatcccctctattggaccaccgtggctccgtatacaacgcccccttccttccttggccagcttcaccgaccctttgacaacaacacagtggccgccctaagcttcccaccggggacactttccgtttaacgccttttctttggtccttgcgttatcctaggaaacacgactgcacaaccacgcctggggctacacgttctccggtgaaacttaagcggctgggttagacatacactgttcattacgccctcataccaagtggtccctgggccccacattacaacccggcctcaccgcactgtgccggggtccg

SEQ ID NO: 662262 - DNA, 126 bp, Homo sapiens
ggccatttggggttctggcatgaagtgggcaggggggagctggcatgtgtccccactgtggttattgaggaggtgctccctggaggctggtatctgacgttgtggggtggctgcaggaagcccatg

SEQ ID NO: 662263 - DNA, 96 bp, Homo sapiens
tcaagcttctaacgatgtacggggacatgtaccccaccctccaccccttccttttgcgcggaccccattacaataaatttttaataaaaaaaaaaa

SEQ ID NO: 662264 - DNA, 160 bp, Homo sapiens
cggttgagagaggcgcagccccttctcgcctctagaggaggtcctccccctcctggtgctccctctgggtccccctgagttgtagtagcagcttaactgtaatctaggagccaggacctgaactcgcacctcctaacctcttcatgtatacatacatacc

SEQ ID NO: 662265 - DNA, 1057 bp, Homo sapiens
  misc_feature (1003)..(1003): n is a, c, g, or t
ctctacaaagcagcaaagacagttggattagcactatagcctataattcggcgcatgagctggagtcctaggcacagctctaaggcctccttattcgagccgagctgggccagccaggcaaccttcgtaggtaactgaccacatctaccaacgttatcgtgcacagcccatgcatttgtaataatcttcttcgatagtaatagcccatcactaactcggagcgctttgcgcaatcctgaactaggtatccccgtaactaagtccggtgcccccccgatattggcgatttccccggcgataccaacgaaccagtaaagctatctgacgtctataccatgccgctcgtcatccattaacatcgctggctccgccattctagcataataggctggagagaccgggaaacaaggaaccacggattagaagcaggtctaactccatcgcacctattaaggcaacggggacagcgtaacttgcgcccaacgcgcagtgcgaatgacgcaatcccgtgtagaaaacgataaagccaattcgtttactctctattaagcaggcgcgtaagtccaagggatggttcgtcgcatgcggtaactacccttataaagcgggagacccaaaggtcgagatggtactgtcgaggtgtcaaacgagaactgcaaaaaaggtcgatacttccacaatgttaacttacgcacaacagaacccgccacacattgagccgccaaagtaagaggcacgcccagaaaagttacaccaccgaggaatgaggcgggcgacagcgacccatataccaggatgattacagggcgtaccatttgaggacaacatccccctggggggtaaccgccagttaaaaaagcttcgggaaagccagagtggaatatacaggcctattcacacgatgctaacacacgctgtggtaatttcgatgttgaccacgtgtatgaaaattatcgattatccctatagcggcgcctaaagaggggtggcacccaataataanggaccacgtatagtgggccgatgggggagacccgcacaatgttccgaacacggt

SEQ ID NO: 662266 - DNA, 444 bp, Homo sapiens
aatcgaggttctctgtattattatatatttctagttattccatgtagtctgaaaggacttgatattatcttaattttaaaatttgtgggatttatttgggggcaaaatatgggctatcctggagaaggttctgtgctgacagaaaatgtattctgcagtgttggttctaatgttctcttgtatagcactgaactttgtttaatacacatttatttaaaaattctttttttggggcctttcatggtattagctttttcattcaaaccctgttcctagagaattactgtgtaccttcagaggcattctgtttccttgctttttcatgtttcttatatccttacactcatatttgtgcatctggtgtaactgtctcttctttcaattttatggattggctttcataggaaaagacttttcctgatagatgtatctaattgtatcggt

SEQ ID NO: 662267 - DNA, 230 bp, Homo sapiens
agacagtgtagacaatctgctctttctctccatagacatacccttatctcagagagctggaaataagaggacaaagcctccacctggtcggacatactctgagggtaagacggatctctgagttctctcctggtccctgtagtccaaattggttgcagggaaagcccagaatgaccagaccgaatggtgcacgctcatcgtgtagtgcattacagttaatgtactagtcc

SEQ ID NO: 662268 - DNA, 101 bp, Homo sapiens
ggatccctgtggcagtacaatgaagcagagagtgtttggtggatgacaaggaggctgatgtagaccgcaggtgggtctcagaggtgatcggcgatcagagg

SEQ ID NO: 662269 - DNA, 375 bp, Homo sapiens
catcctcctggacttcaaagtagcagcgtctatcatatttggtgttgatgattcatcaggatcataagtgagttggattgctttgatcagctgtttgacttctgatgttccggtttcaacttgatgtgacatgtcttccaaagactgtagatccttgtctactgtggtttgataagtagacaggaaatctgcaatgccacaggtagttgggcaataacagccagatctttcatgtaagatgcagcagttgtctctggtatcaacatatgctacacatgttgaagagagagatcacagagcatacaagtagagtatcatactccgggggcgcaaggaccaacacatgatgtctgagtgaccgaagctccgagccat

SEQ ID NO: 662270 - DNA, 310 bp, Homo sapiens
tatgtaaaaacagcagttctgttcagaaggacggagatctaatagtcactaggtgtgatgagcacaagccaaattctagcagaaagatgtgaaatggccatctacgtgtaaagaatataagatctttcttacactgctgttatattagaactaccactacaatacattatactttggatgacacactcttagaaaacgcaagacaccagcagctatttgcataaacctcagcccaggtgtggtctccagccccaggaaacttctccaccacccctcccatcctcccaccagtggttcctccctcggtggc

SEQ ID NO: 662271 - DNA, 244 bp, Homo sapiens
  misc_feature (11)..(11): n is a, c, g, or t
  misc_feature (13)..(13): n is a, c, g, or t
cggcacgagtnanccacggcgcccggcaaaaaaacagctataattattgttgagcataattcctccccttgcctccttcatatgcctcccaaaattctgaagtgccccctgggcggttcccagtgtcgcctgaccttggcctcctggactgcaggttcatcttgctctaaccgcccgctgcccggtgtcccgtcccttcccagcttccttctcccaccactagatggcagtatgagtccagcat

SEQ ID NO: 662272 - DNA, 357 bp, Homo sapiens
cctaaaagctacctacatggcctacaggagtcacaccgacaggaagaggcagcaggagagagaggggcccgagagagattgagaagagcctggagaccctaccgaccagcgtggtgtccccatgtccccagaatgcagaagacccaggactggggtatggcggggatgtgtggagtctgagatgcctgtggggtgactggccctggatggtccagtgtgcaggtcctgccctggggcaactgtaaacagccgccccctccgttctcccaggggaacatactgttgctttttttttttcttttggccccggcttctcgctctgtcccccaagctgaattgcagcggcgtgaccctggc

SEQ ID NO: 662273 - DNA, 430 bp, Homo sapiens
  misc_feature (26)..(26): n is a, c, g, or t
  misc_feature (36)..(36): n is a, c, g, or t
  misc_feature (48)..(48): n is a, c, g, or t
  misc_feature (96)..(96): n is a, c, g, or t
  misc_feature (103)..(103): n is a, c, g, or t
  misc_feature (123)..(123): n is a, c, g, or t
  misc_feature (133)..(133): n is a, c, g, or t
  misc_feature (152)..(152): n is a, c, g, or t
  misc_feature (167)..(167): n is a, c, g, or t
  misc_feature (169)..(169): n is a, c, g, or t
  misc_feature (197)..(197): n is a, c, g, or t
  misc_feature (232)..(232): n is a, c, g, or t
  misc_feature (297)..(297): n is a, c, g, or t
  misc_feature (312)..(312): n is a, c, g, or t
  misc_feature (361)..(361): n is a, c, g, or t
  misc_feature (364)..(364): n is a, c, g, or t
  misc_feature (368)..(368): n is a, c, g, or t
  misc_feature (397)..(397): n is a, c, g, or t
cagagagaacccaccatggtggtgtntcctgccganaagaccaacgtnaaggccgactggggtaaggtcggcgcgcacgctgggcgagtatggtgnggaggcnctggagaggatgttcctgtncttccccagnaccaagacctacttcccgnacttcgacctgagcnangggtctgccgcaggttaagggccagggnaagaaggtggccgaggcgctgaccaacgccgtggngtcacgtggacgagcatagcccaacgcgctgtccgccctgagcgacctgcacgcgcacaagcttngggtaggacccggtnaacttcaagctcctaagccactggctgctggtgaccctggccgcccacntgnccgncgagttcacccctgcggtgcacgcctccntggaaaagttgctggcttgctgtgagcaccgtg

SEQ ID NO: 662274 - DNA, 346 bp, Homo sapiens
  misc_feature (42)..(42): n is a, c, g, or t
  misc_feature (147)..(147): n is a, c, g, or t
  misc_feature (164)..(164): n is a, c, g, or t
  misc_feature (187)..(187): n is a, c, g, or t
  misc_feature (218)..(218): n is a, c, g, or t
  misc_feature (264)..(264): n is a, c, g, or t
  misc_feature (267)..(267): n is a, c, g, or t
  misc_feature (330)..(330): n is a, c, g, or t
  misc_feature (341)..(341): n is a, c, g, or t
gatcttattttttaattttgagtgccactattaatgtaaaanggggggggctctacagcagtcgtgatgaaacttaaatatatatcctttgtcctcgagattttaggaagggtgtagggtgagtagggccatttttaatttcctgangtgctaagtgttttttntacagcaacaaaaagtcaatttncccttttccaccagtgcgagagagggatgtntacttttcagggtgttgcctattttcccgtttgcagggcccgtagntgngccatgggggcctggtccaggggctaaatttgggttgattatggccctgttaccggtttggcncaggttccctngtaaa

SEQ ID NO: 662275 - DNA, 790 bp, Homo sapiens
tggcctaagggacaatctcaagaggtcctgagaccacgtacccatgatttttttctgtgctcgggtgatacccaataactccttcacctaagcccggttggtgtgactttggaaggtgcttcctagggccagtgtgatttgtagctttcgtgccagcgtgctttggccagtagaatttaacggtgttttatttttttcaaacctccggtgttttccataacggtgggaggtgtagtgggctctaagagaagccgtgttggtcctcccgggctcttccactctgtggagaggaggtctgggacgctatcagcaggggccagggcaggtcgcaaaatctcccagtctagaagaccacacctgaaacggttgaagccagtttgcacaagggtctgctgtccctcgtggggcaggcaaagctggggggggcaggggtcacagagcagtcatagaccaccagggcaccagtgcaggaaaagggcagatgggcacaggggcacaacagggcctggtccttaaagcacgggggggtcatggctgggaggggcatggcaggggctggaatccctgtaaagccagaggggccacccaggggcagtgacattccagatttgtggggctcacctcatccttgctgtgaaactgggagtcccagggggcacatgaagtcagtaccaccgaaagctgtctcacgtgtctacctctcgctgacttttgggtggccatatacatttctttcaattagcatttattccagtttaattaaagcttttgggccgtactgtgacccttt

SEQ ID NO: 662276 - DNA, 390 bp, Homo sapiens
  misc_feature (111)..(112): n is a, c, g, or t
  misc_feature (114)..(114): n is a, c, g, or t
  misc_feature (140)..(140): n is a, c, g, or t
  misc_feature (151)..(152): n is a, c, g, or t
gatagaatcgagctcgctaccgttatctcctagcacggcgtcgtctaaaggcaggacgggctgattactggtttcatcactacttgattcatcgtcactaggctgagatgnnantactattaagaaaaaagttgacattnagctattcaannatcttggagaaagctttcccacgtaaaaattatttagaactaatcaatcgccatcccgttacatcgcctttctcacataagatagccacaaaacacaaaaccacaacacacataaacacaaaacacgcggttttcaagctcatctaacataaaagccaaacacataaacgcatttcacaatgtgatacacaacgaatctgtgtaatcactactatttaggtgctaggacgagccaggg

SEQ ID NO: 662277 - DNA, 142 bp, Homo sapiens
caacgcaccttccattatgccatgatggaaactccaatagaaacaatttctatttgtctcctaagaggaacaaagcagagaagggcaagaagagagggagagcttaacaaggacacaagcggatacggggtgcgttgctgat

SEQ ID NO: 662278 - DNA, 109 bp, Homo sapiens
ggtacctgtgctgattctgatcttggaggtgtgtgatagcgaatgtgccccttcctttaatcttccgtccagactttgatacagatggtttctgatcacttacaatggg

SEQ ID NO: 662279 - DNA, 253 bp, Homo sapiens
tctaaaaagaaagcctggctcaagtggccatccagcctcagccttcctgagtagctgggattgcaggcatgcgcaccatgcccagctaatttttgtatttttagtggagatggggttcactatgttggtgaggctggtgtcgaactcctgacctcatgatccacccgcctcggcctcccaaagtgctgggatgacaggcatgagccaccgtgtctggcctctctgcctgttttttaagacttttgtctttgga

SEQ ID NO: 662280 - DNA, 320 bp, Homo sapiens
ttggtcctactaaaagcatttttttggacatgaatacaaagatgtcagggtacccaatcatttgctagctagatcctaacaatatcacctataggacaactgaacgtagcccttaaacattaagctgatgataatcggatttggccgggcgcggttgcccgtaatccccacactgagaggctgaggtgggtggatcacttgaggccaggacaggacccgcatggcccacatggtgaaaccccgtctctacaacaaggaaaaaatacacaaaattagctgggtgttgtggtgtatgcctgtaatcccagctatttgggtgg

SEQ ID NO: 662281 - DNA, 95 bp, Homo sapiens
ccggcattgcccctctgcccctgcaccattccagaactgcccaccttccacactgaggtagccgagcctctcaagacctacaagatggggtacta

SEQ ID NO: 662282 - DNA, 399 bp, Homo sapiens
aatctcagaagcagtagaatggaattataaagtaattttattatgaaccaaaatgctgggattgcaggtgtgagccacctcgaccagactcaaaaatgttttaaaaaatccggaaaaatctgcaactggacattttgatagattaattgactttttaaaaatagttacttcttttcctagtaattgactttcttaatggtgaactttcacatggtggtcctggaagagaattcactcatttactctatatgttaagccaaaggctttaatttcatttgttaggctgggtgcagtagcttatgctataatctcaacagttcgggaggctgaggagggaggatcacttgaggccaggagtttgaaatcaacctaggcaacagagtgagaccctgtctttac

SEQ ID NO: 662283 - DNA, 264 bp, Homo sapiens
  misc_feature (16)..(16): n is a, c, g, or t
  misc_feature (25)..(25): n is a, c, g, or t
tgtggggattacaggngtgagccantgcacccagccatttcctagtaattgactttcttaatggtgaactttcacatggtggtcctggaagagaattcactcatttactctatatgttaagccaaaggctttaatttcatttgttaggctgggtgcagtagcttatgctataatctcaacagttcgggaggctgaggagggaggatcacttgaggccaggagtttgaaatcaacctaggcaacagagtgagaccctgtctttac

SEQ ID NO: 662284 - DNA, 444 bp, Homo sapiens
  misc_feature (10)..(10): n is a, c, g, or t
  misc_feature (66)..(66): n is a, c, g, or t
  misc_feature (130)..(130): n is a, c, g, or t
cccccccccntttttttgaatccctgtttttttaaaacccgagagagagaaaaaataaaaaaaaanccccccggccccagccccggggggtggtgtctttagttttaaggaaaggggggggacccccccnccccatctctttcaggtgggctgggtgccctgcccaccaaaggaaacagggggagtgtgtcttcccgaaaggcccagccggggggtagatttggggcagattttattcccaacccaaccctgggtctatacattgggatatgtgcaggttcccattcgtttcctggggagccatgtgtccctgaggccagagagtctcctcacccagctcagactgaatgcttttgtttttgtttcagggcatttgcacgccaaaggcaaagaagaaaaaatgtccaaatcattaaagaactacattactattaaaaaaaaaaa

SEQ ID NO: 662285 - DNA, 904 bp, Homo sapiens
aatacgcataggtacgatgcctgatgttactcgagtttttgactgttttttcctagttgtttatggttttttaattgggggtgggggaggaaaaaggaaggaaataccaggtaagaaaaaagggctggagaaacaggtgaccttttggttttatattttttctcaaacagcaagtacgtgggggtctgataccaggttcacctgaagggtacatcttaacagcactccagaaaggctttcttttgacaaatcacacgcaccaccgcatcagggtgggaggggctctggccatgcggtctcaaggtgtccagggtggagatgaatgtgatggactcccgcaggcctgaacctccacccaggaaagtggcttggcaaggatgggccggtgtggggacagaggagggctcatcccaggccccacaagcagccgcttgcagtggggagaaggaaaagcagacaagaaagctcaggtagggaatgcctggaactgtcgggtgggcagccccgtggggaagggactcaagcataaaggctgtgggataaagagggaaaagaccaggtgagggcaggaggggagctgctgaaagatgcggtgaacagtaaagcacctttcagtaaaattgccctttcccaggcagtctggggtgggcgctgttggtaaggaggccgtatctccccgcttccttaaaattggtgagactgtcagaaagtttccttcaggcagttccctaaatgctccttcccgatggtctactttaacacagagtttaaagccaagctgaaagatctctgacccgtgaaactaaggcactctgtggggggtatccccggccctctaggtttaacacccttggggaggagaacgcacgaccaaacaggaagaagtgccctgtaaaaggagcat

SEQ ID NO: 662286 - DNA, 910 bp, Homo sapiens
  misc_feature (707)..(707): n is a, c, g, or t
catcctgcgtctgacctggtgccgggactgaccgatacctcatgaagatcctcatgagcgaggtacagttcaccaccacggcgagggaaaatcgtgcgcgaatcaaggagaaagctgtgcaagtcgcccgtggattccgagcaggagatgccaccgcagaatccttcctcttctctgaagaagagctagagtggcccgattgcccaggtcatcaccatgtgccaatgagcggtcgggtgtccggagccgctgtacccagctttccttccgtgctatggaatctgggcgggcatccaggagaccacctttcaattccaatcatgaagtgttgccgttggaccactcgcgaaaaaggaccgttgtaacggcccaaacagcggtgtggcttgtccgggggggcacccaacacaatgttatccgggccatttgttgaccaggattgcaaaagcggagatcacgcgccttgggcccaagcacccaattggaaggcatcaggatcattgggaccccaagaggcgcaaggaactcgcgggtgactcgggtggctccatccggtgctcattgtccaccctcccagcaagatgtggattacccacgcaggattacgagagtcgggccctcattcgtccagcggaaagtgttcttaaagggactcagcaggatggtagatgtggctggtggtaatggaaatttaggatttgggccgntggaagtgaaaacctatgtggctaaagaatggaataccttgaaaagaatggctgaagtggttgatatcagctggtgaaactgtgtgttgccttttagataaggcctggaaacggcagggggggggttctaagggagacagttgtcggggtagggaagacgcgagcagctttttttgcaccgcggtgtggggggcgacaaaatg

SEQ ID NO: 662287 - DNA, 1162 bp, Homo sapiens
taacagttggtacccccgggctttatggatatcgtcgacccaggcgctacgagtgacttctgtgccggaagaaagctgagcgaacgctgctactggcggcgagtgagccggactccccaactccggacgatcagcccaggactgagagccccgaagtccccaaccacaagtaagcggccccagaaggacaagtctaggtacgcacgtccagaagacgaccataggcacgacgaccacgacacctaacgaaatagtagcacaacatacgaccattaccaacggtagccacgaccgggaaacaaaaaaccctaagaccacaggaaaaccaagaacagacagaccatactatacgagcataacccaagacacaccctgagaatatacagacagagagcaagagtaggcaacagagaataggagaaggacaagcctaagacacacaatgaacgagcaaaagcagagacggcaaacaaccagagaatccataataaccaagagcaagcaacaccgtaaagagacgcaagccaagagggcactcaatgagaagcaaggcaccaggacatgcaaacacggagaaacaaaggagacaaatccccatggaccggacatcaacctgagcaccagaaaagaaacacccaaaagaaacggacacgaacgcaaaacaaaccccgaaggcatagcgcacatcatcaaggaaaccggcaaggcagtgcacgagagaacaccgggaccacagtggtatcagcccaaggcccgcaaaaagccccaagagggggaaaaagcacccaaggagaccacaagaatcagaaccacagagggagacacgttaggacgacgaaaacggataatgacacgcacaagtgacatccaccacagattacacacgccggacaatgagacgaacaatgagcatgccccacgtcgatgacaaacaggaccaggcccaatgcgagggcaaatggcacccaagacacacacgaacgtgattaaaacccgaaccaacgagaatgcagaacaaaccaaaaggacaacactaccagtgaccaccactcgaaccccaaagtagaccccaaaattacaccaataactaaagaaaacagaagcacaaacacggaaagtggcaccaatagagacaacgactcggccggtaaccagtagagga

SEQ ID NO: 662288 - DNA, 457 bp, Homo sapiens
tgaaacatactcctggaggtagagccaccatggacgtgaacacagctccagcaaccacaaagatatgcaacagctgatgagagtgaacccagatgtcatcttatgccaggaacaaagcgtacggggctccgggccgcatacagggcagctcctgtgatgtagcggctggccatcagcatcaaccagcctatctgccctatggtggcggacttaaggcacccctccgagatggcatagtgcaaggtcggaatgattccactcaggcctagagcccaaacacactcctgctcttactccccgctactgcggggtggcaaacatgtccccctgggagactctaatggctgcaatgcccagcacacagatgccaatcacgtagatgtcgtcagttatgtctcacatgccacgcaacaacggctacagaatcttgtagagaaaatatcagaaacagctcagc

SEQ ID NO: 662289 - DNA, 690 bp, Homo sapiens
  misc_feature (2)..(2): n is a, c, g, or t
  misc_feature (85)..(85): n is a, c, g, or t
  misc_feature (327)..(327): n is a, c, g, or t
  misc_feature (335)..(335): n is a, c, g, or t
  misc_feature (349)..(349): n is a, c, g, or t
  misc_feature (386)..(387): n is a, c, g, or t
  misc_feature (483)..(483): n is a, c, g, or t
  misc_feature (487)..(487): n is a, c, g, or t
  misc_feature (530)..(530): n is a, c, g, or t
  misc_feature (541)..(541): n is a, c, g, or t
  misc_feature (598)..(599): n is a, c, g, or t
  misc_feature (667)..(667): n is a, c, g, or t
gntagaaaaatacagtccacagggtaaattgtcaataaataatggtgtttaatcattaaacataaaaatcccactctttggcatntgacaggattctatttcttgtcaaactaatgactgtatagatatagctaatcttagtgatcattcgtcaatacaatatgttacaaaggtgcaatttactttaaaatatacaacagcgaaacatttccagcccaacgagaaatctgatcaacttagtaagatatgggccaacttccccaaggctctttcacgtagtttgccttaatgaaagtgtaataaacgttgattaagagttcctagggntttctaanacttactttgatanaaatagagtttgccaatacatctggaaaaagaccacnnaaacatgaccacgagaatgccccaatccttcattcacaggagttcttatattatccgacagcttgatactcactaagcccctcccacgaccccacnacanccacgccgttatgtgctagcccgacacactacccacttcagtnctaccacttgnaccctttcagcgtgccacatgcgggccccccgccctggcccgaatacacccggtccnntaactccctatattatattccccatctacatcccgcctagttgcgcagtcaatattcctcaccccagngccttctatatatagaaacaact

SEQ ID NO: 662290 - DNA, 177 bp, Homo sapiens
tatagacaaattccagaagtcatattatccagcctcgaatatcatcctcatatccatcccagccatgccccggtggcatcctcactctccaaatatcaggccatcctttcaggatgacaggtcgcattgtaaagcatcggtcagtgcagataacagccattttgattatttccacga

SEQ ID NO: 662291 - DNA, 470 bp, Homo sapiens
gccaagatcaggaaagtggcgaacaccaaaggctggtgaagcggtgaagcacacagaaacttttatgcactgctgaaggggtaaaaaaatggtacaaccactcttgaagacagtttggaagttgcaaaaataaactctcagaaaactaaaaatactcttaccacaggttccagctatcgcattcctggatatttatcaaaaggaatagaaaacttatatccacaaaaaacttgcacacagatgttcccagaagctttattcacagtcttcataacttggaagcaaccaagatgtccttcagtaggttaatgggtaaactgaggtaggtccagacaatggaatattattctgtgctaaaaggaaataagctatcaagttatgagaaggcatggaggaatattaaatgcatactactacatgaaagaagccaatctggaaaagctacatattgcattattccaactacagga

SEQ ID NO: 662292 - DNA, 255 bp, Homo sapiens
atgctgcggtatctagaggacccggtcgctcggacaacaccacttcttcgacccgctcggacgaggagaccccattctataccaacacctattctgatttttcggtcacccgtgaagtttatattctttattctaccaggcttcgggaataattcttcccattattggtaacttactacttcgggaaaaaaagaaccatttggatacataggtatgggccgagcggaaccttgaataggaggctcctaatttcag

SEQ ID NO: 662293 - DNA, 1122 bp, Homo sapiens
aagccccacattccgggcgagcgtgagcacgagcgggaagggatgctgacccgtggacctgatggtcgcctgcgcgatgcggccctgcagaccaagcgtgatgcgccgcacaggccgagtgcggaccgtggcgccggccaggcctgttggcggcgggagcgtgcgtgcgtgcagtcctctcctctgctctcgtgcgtcctgggaagcatgttggcctgcggacggctccctccggggtgcaaacccagtcgtccgccagcagatcggccgagcgttgcggaggggagcaaggggtcctttctcgggctgccaggccccgtcccccgggtcttccggggggaagcacgcggcttcatgcaacgatttggaccccgggggcaccgggtgggcactgaagccctctggcccttcggcccaaggggggcccggtcggggagaggacggcagctcgtagggggggtcccagggagaggaagagaccagcccctttctgagcttccaatgcagcagccaactccgggggaggggggccaatgagggccaaccgggcaggcccacccaacgggcaccctcggtcgcccttcccctcgggccggggaagcttccagcacaaggtctgcagcaccaaggacggaaggcgcctgaagctccccttcgaggacggagtcaaaccggcagtaaggagggtggaggggcagaaagaagagggctggaccccgaccgatgcccggggcagtaggaggaccccaatgagggaggcgactggcaccggccgggtgagaagaaccgagagattacacagtcaagggaccccactggggggacaagaaagtatcaccgtgcaccacacacgcataagaggaaagggagcccaacacgctcaggaaaacgaagcatctggagagaaagcaaagcacaaagagaggcagcaagaggagggaacagggaagcccacggggaggaggaaagagacccccccagaaaggagaacgagaccacacgacgagaggggggtagaagaataagggagcaagcggaacgagaccaatactaggacgacgaagacgcagagggccagcggacagaggacgaaccacagagaaagaagagggaacagaagag

SEQ ID NO: 662294 - DNA, 361 bp, Homo sapiens
  misc_feature (40)..(40): n is a, c, g, or t
  misc_feature (162)..(162): n is a, c, g, or t
  misc_feature (263)..(263): n is a, c, g, or t
  misc_feature (297)..(297): n is a, c, g, or t
  misc_feature (315)..(315): n is a, c, g, or t
ctttataaatgaccaaaaacaggtaaaattttgttcagtntaacttcagtgaagaagttttttgacacagaactacatatatttttaaattggtaatccacataagatatacacaaaaccttcaagtgactacattgttcaataaataaaactctacattgntttggttttacagcctagtgagcttataattcagtaacacccttttaagaaattctaggctacagaaaggccatggtcccaaaatggttgggcctaattanatttctttaggcaaaaaccttccaatttcctttnataattaaattccttccncataatcaatcttttggaaggggcctggacttaataaaattaccaa

SEQ ID NO: 662295 - DNA, 244 bp, Homo sapiens
ccgcgcatcgccgtgccagctgtgtgtcccggtcgcagtaatactaccatgtgtgtcttcagtgtagttagcaacttcttggtctcaaacagcaggggatatccagaatcacgtagcggtaatccccggagacaagtacttaaacgtctccttcatcatctccttgcgaatctcgagggtgggtaatggtgtagagcagctagcgacggtcatgggtggttaaaagatcaggtccccccaggac

SEQ ID NO: 662296 - DNA, 915 bp, Homo sapiens
  misc_feature (6)..(6): n is a, c, g, or t
  misc_feature (73)..(73): n is a, c, g, or t
  misc_feature (86)..(86): n is a, c, g, or t
  misc_feature (123)..(123): n is a, c, g, or t
  misc_feature (126)..(126): n is a, c, g, or t
  misc_feature (135)..(135): n is a, c, g, or t
  misc_feature (145)..(145): n is a, c, g, or t
  misc_feature (216)..(216): n is a, c, g, or t
  misc_feature (260)..(260): n is a, c, g, or t
  misc_feature (284)..(284): n is a, c, g, or t
  misc_feature (326)..(326): n is a, c, g, or t
  misc_feature (352)..(352): n is a, c, g, or t
  misc_feature (360)..(360): n is a, c, g, or t
  misc_feature (377)..(377): n is a, c, g, or t
  misc_feature (391)..(391): n is a, c, g, or t
  misc_feature (393)..(393): n is a, c, g, or t
  misc_feature (416)..(416): n is a, c, g, or t
  misc_feature (428)..(428): n is a, c, g, or t
  misc_feature (444)..(444): n is a, c, g, or t
  misc_feature (448)..(448): n is a, c, g, or t
  misc_feature (519)..(519): n is a, c, g, or t
  misc_feature (536)..(536): n is a, c, g, or t
  misc_feature (539)..(539): n is a, c, g, or t
  misc_feature (542)..(542): n is a, c, g, or t
  misc_feature (603)..(603): n is a, c, g, or t
  misc_feature (621)..(621): n is a, c, g, or t
  misc_feature (637)..(637): n is a, c, g, or t
  misc_feature (714)..(714): n is a, c, g, or t
  misc_feature (728)..(728): n is a, c, g, or t
  misc_feature (731)..(731): n is a, c, g, or t
  misc_feature (733)..(733): n is a, c, g, or t
  misc_feature (740)..(740): n is a, c, g, or t
  misc_feature (796)..(796): n is a, c, g, or t
  misc_feature (877)..(877): n is a, c, g, or t
cggganggcgggtgaaaggacacggaggcaggtcaacctggagattgagaaggcacagattcaccgtccacanctcacaacaagangcaccagcaggagtccacatcagaaagacatcatcanggnactaccacnaaaaatgacnaggagttaaactattggagatgtgcccgtgatgttggaccacaaggacatatagaggccaaaatccacccnttgaaaaatagaagaaaagaaaatcgcaggaaaatctgggaaancaataaaaaaatgaggataacgtnaaaagcgcgcctccacagtcccggctctcccggtgccgaacngaggcgttttttctttaattgtttanatgccttnttgtggtgttcgtcgtntcattcgtcatacngngtccagaccggcaggcagtacanaaagaatgtggnagagaatagaacatanagtnccgctgttatctatgactttctggatgtggatgatataaacggggaaaggatccaagatgttcttttcttnataaaaacaccaacagnagnaanaatttcagccgatcctgtggacgaaggcttttcctctccctgcacctttgcagctgctgtntcgggggccaacggcagnacgctctgggagaganctgtggcccaagacgtggccctcgtggagtgtgctgtgccccagccaagaggcagtgaggcaccttctgcctgcatnctggtgggcagacncantnctttcantgcagtcaacttgttcacaggggaaacctgtggaaccacagcagcagcttcagcgngaatgcgtccatcctgagccctctgctgcaggtgcctgatgtggacggcgatggggcccagacctgctggttctcacccangagcgggaggaggttagtggcacctctactcgggagcc

SEQ ID NO: 662297 - DNA, 670 bp, Homo sapiens
  misc_feature (321)..(321): n is a, c, g, or t
gggctgaggaattcgcacgaggtgagcttagctcttggttttggtaattttcatatgattgcaatgtctgaacgtggtcatgtggaaagtgaacctaatggcatggggaattatccaattggaaagagtgttgtatggtcaaactcaatgacttttcggtgggttaaacatagccataggttgactttccggccagtaatgacattcaacaaattttattgattatgaatatcggagtgcaagattcatcaatgattattgttatggaacaaaagattattttaaaaataaggataaataatgtttggtactggatagagntatatattttgaggaaatacatactgtagcagaaaatatgtgtaattacccaaaagtgggtttatataaaagattttattttacaagaattttaactattagtgataagcgccgtggaactgcaattcactttgggtgaaattggcgctggggtcaaatttggttataatctctttaacaacatttttaaaaaaaatatggcgggtaaaaaaaaataggaatatttttttttttttccggggggcaactcctcccacttttgggaaggttgaaaaaaaaatgtgtttttaaagggggggaaacaaaaaacaccttttttaaaaaattgtgttcccccgaaagggtgcgg

SEQ ID NO: 662298 - DNA, 216 bp, Homo sapiens
acacttaggcgttcgaaatcagccgacgatgtcttcggtgatcagggcgatcttgtagtagccgccgtcctgaagcttgttcacgacgttcatgaaggcgaggtacttcacttccgtatcggcgcggatgaagacgatctcttccttcgggtcggggcggccgatcacggccggcaggtcgttggtgaggttgtcgagcggctcggggtgcgtgtt

SEQ ID NO: 662299 - DNA, 243 bp, Homo sapiens
tcctgctaacttttccccaacagcaccgtaatcctctcccaaatcatcacaatcctccactatacaatccctctcctgctttcgttctctttctctctccaaccacccagcttctgattctgattcctccccatctccacctcatacccgctctcagactcagcatgctctacactctctctcccttacttctccacttttcagttgccatgtagaccctttgaagaggtgaggggcctaggg

SEQ ID NO: 662300 - DNA, 845 bp, Homo sapiens
  misc_feature (28)..(28): n is a, c, g, or t
  misc_feature (31)..(31): n is a, c, g, or t
  misc_feature (33)..(33): n is a, c, g, or t
  misc_feature (36)..(36): n is a, c, g, or t
  misc_feature (40)..(41): n is a, c, g, or t
  misc_feature (44)..(44): n is a, c, g, or t
  misc_feature (47)..(48): n is a, c, g, or t
  misc_feature (65)..(65): n is a, c, g, or t
  misc_feature (82)..(82): n is a, c, g, or t
  misc_feature (85)..(85): n is a, c, g, or t
  misc_feature (430)..(430): n is a, c, g, or t
  misc_feature (511)..(511): n is a, c, g, or t
  misc_feature (622)..(622): n is a, c, g, or t
  misc_feature (625)..(625): n is a, c, g, or t
  misc_feature (631)..(631): n is a, c, g, or t
  misc_feature (641)..(641): n is a, c, g, or t
  misc_feature (664)..(664): n is a, c, g, or t
  misc_feature (672)..(672): n is a, c, g, or t
  misc_feature (747)..(747): n is a, c, g, or t
  misc_feature (759)..(759): n is a, c, g, or t
  misc_feature (771)..(771): n is a, c, g, or t
  misc_feature (780)..(780): n is a, c, g, or t
  misc_feature (822)..(822): n is a, c, g, or t
tggaacaccctggagttgaaatatttantancnaangggnntgnggnngggctcctgcccccaanggggatgcaggtggatnccnggtggggagggctgcagggttggctcctggcctctgtcctggcttcatggtcctgacagctctgggccagcctcaggcgctgggagcgtactgtagcaccagcctgtcaaagtcgttctccttggcctggtactccttgatgaagggatgggacctgtgggcatccttcagctgggacaggtatcggtttgtcacctcagggggcttgcccaggtgctgggacaggacgatgaggttgaccagcgtctccgggtagccactatccttgtctagcgcctcctgcagcaggccctcagcggcctcccagcggccctgggccatgtggcaggccgcctgcccattgancagcagcagggtgggcgagcacttgtcagccatctcctggaagatgtagtaggcatcctgcagcttctcaccacccgtggncaggctgacccaggcagtggcgagctgggtgagggtggatcctcgtccaggtcctgcattctctttagctccttccgggcgatgtttcaggcggtccagtttagcaggatntgnatgttntggctgtgcnctccaggctgtccccctggtgcngcgccgcngggcggcctccgggttctggtcgtggcgctcgctggcggcggccctgcgccggcccgtggtgttggtcccgtccncgctcctgctcntctctcggtccngctcggccncgatgctgtccctccgactctcgtgggcgaggtagtcagcanacatgcgcacgggcctggagctc

SEQ ID NO: 662301 - DNA, 516 bp, Homo sapiens
  misc_feature (83)..(83): n is a, c, g, or t
  misc_feature (105)..(106): n is a, c, g, or t
  misc_feature (111)..(112): n is a, c, g, or t
  misc_feature (130)..(130): n is a, c, g, or t
  misc_feature (295)..(295): n is a, c, g, or t
  misc_feature (325)..(325): n is a, c, g, or t
  misc_feature (351)..(351): n is a, c, g, or t
  misc_feature (365)..(365): n is a, c, g, or t
  misc_feature (433)..(433): n is a, c, g, or t
  misc_feature (479)..(479): n is a, c, g, or t
tggtggtggttcgagccccacctcattcttttaaaaagtgcaaggtaacgggtgggggggcgcacctcttttcgccttcctgngggaggccctgccagctcccanngaagnncccccgcggttatgaccnccccaagctcatcacctggtttccggtgtgtcgcaacaatgttgcctggaacttttaaaagttcctggtgggccctgacggtgtgcccctacgcaggtacaacccccgcttccagaccattgacattgagcctgacattaaagccctgctgtttcaagggcccanttgtgcctagggggcccctcctaccccggntgcttggcagttgcagtgctgctgtntcgggggggttttnatttataagggtgtttcctttaaacctacgagggaggaacccctgtttttacaaaaaatacccccccnaaatgggggctggtcctgttgatcccagtttttgccagaccaaggngagtttcccccctaataaagggccgggggtcagcaga

SEQ ID NO: 662302 - DNA, 618 bp, Homo sapiens
  misc_feature (31)..(31): n is a, c, g, or t
  misc_feature (62)..(62): n is a, c, g, or t
  misc_feature (65)..(65): n is a, c, g, or t
  misc_feature (69)..(69): n is a, c, g, or t
  misc_feature (99)..(99): n is a, c, g, or t
  misc_feature (104)..(105): n is a, c, g, or t
  misc_feature (111)..(113): n is a, c, g, or t
  misc_feature (124)..(124): n is a, c, g, or t
  misc_feature (132)..(132): n is a, c, g, or t
  misc_feature (142)..(142): n is a, c, g, or t
  misc_feature (165)..(165): n is a, c, g, or t
  misc_feature (167)..(167): n is a, c, g, or t
  misc_feature (174)..(174): n is a, c, g, or t
  misc_feature (184)..(184): n is a, c, g, or t
  misc_feature (191)..(191): n is a, c, g, or t
  misc_feature (210)..(210): n is a, c, g, or t
  misc_feature (214)..(214): n is a, c, g, or t
  misc_feature (229)..(229): n is a, c, g, or t
  misc_feature (234)..(234): n is a, c, g, or t
  misc_feature (242)..(242): n is a, c, g, or t
  misc_feature (271)..(272): n is a, c, g, or t
  misc_feature (274)..(274): n is a, c, g, or t
  misc_feature (283)..(283): n is a, c, g, or t
  misc_feature (301)..(301): n is a, c, g, or t
  misc_feature (308)..(308): n is a, c, g, or t
  misc_feature (326)..(326): n is a, c, g, or t
  misc_feature (332)..(332): n is a, c, g, or t
  misc_feature (337)..(337): n is a, c, g, or t
  misc_feature (377)..(377): n is a, c, g, or t
  misc_feature (402)..(402): n is a, c, g, or t
  misc_feature (416)..(416): n is a, c, g, or t
  misc_feature (447)..(447): n is a, c, g, or t
  misc_feature (455)..(455): n is a, c, g, or t
  misc_feature (463)..(463): n is a, c, g, or t
  misc_feature (477)..(477): n is a, c, g, or t
  misc_feature (488)..(488): n is a, c, g, or t
  misc_feature (514)..(514): n is a, c, g, or t
  misc_feature (519)..(519): n is a, c, g, or t
  misc_feature (545)..(545): n is a, c, g, or t
  misc_feature (589)..(589): n is a, c, g, or t
tccaatgaataataaattaacaacgaaagangagcaaaaattattccatttgcttgaaaatngtnaaanatctttctataataaatcatgagtaaagtnaaaannaaaaannnaatgtataaanaaattggngctgaaaganaaggggaacaagatttataggangnggtcaangcaatgaaanggaaggnttccctgattccccttggngggngtgggaaaggggtgngggtnaccgtgtncagtagccccctctgcagaaaccccttgnnanaaggggagnacgcagatgggcaagtgnagaggcnggggtgagggctttgggntctggntctgnggtagcgtctagaggtgggtgcctgaaaccccagtgttanaaagctctttcagcttggccaccanagaaagctggagtnttaaccagctcaatggaccttctgctttttnaaaagggnaaaggacnaggggaaagctttntgtattccganctcttttccagaatccaggaaaaatngggtnaaaaaaggaattgaaggatgaatganaggatttattgagtggtggaaatagatttaagcaggatggaagnggagctggaagggtggggatggatgaagt

SEQ ID NO: 662303 - DNA, 252 bp, Homo sapiens
gtgttcgtgtgtatgtgtgagatggggtctcgctctgtcacccaggactggcgtgcaggagcacaatcatggactcgctgcgagcctcaaacttactgggctcaagcggtcctcccaccatcagacctcccacagtagactggtaccacagaccacacaccacatatgtcagctaacttaaccacaaaaactttacagagatgcagccgtgggcaccctagtgagtgagacctcaaatctctgccaaaaaca

SEQ ID NO: 662304 - DNA, 694 bp, Homo sapiens
cagaaagaagcaagggccttcaggttcctcacactcagtcctggagtgatcttttccattcagcctcgcctagcctcgcatagtgcatcctgtgtacgcaaacatctagcagatcttcatgtacccactagcaggtcagcttggaattcaaatcctgtcccagagctcccgaagcacctgggtgcgctcgtacatcaccgtagagtttgcccccgagagtgactggacatggtcaggcagaagcggctctatgcactcaccacgtctgggaacatcaggcataatcatgtgcggagcaggtggctttggctgtttagttcttatcagagtgctccacaaagtgcatgggacttacaatgactgctgatgcgcatccgctgcgcatagtacaaaggtagtgaagaactgttcatacaagttactggttctaaaaggtttctggtgctctagatggattcaggaacgaacagtaggttacggacaggctatgtgaaagaaggtcactggaggagatccgaagggtgcacttcgactggccatcttggtccaacttggcacgctgcacactggatccacttgaattgtcctaggccccacgtctttgaacgcaaagtattgagctcagcttagttgaccatgcactaggaactcactacattctactaccccctaccaatcggaccctttctgaaat

SEQ ID NO: 662305 - DNA, 244 bp, Homo sapiens
ccggctctgaacttaggccctaatatacaaagttatcacattaagatatcaatggtctaaatacaccaactgttatacagagattcgcataagtcgattgtacaatacaatgactcatagtacgtgctagtctacagagcaactcacttcaaactataccacgatcggcaaggttgcacacagtaaaacgcatggacaaagcatcgtcatccatgtgaacagttaatcaacaggaaagcaggga

SEQ ID NO: 662306 - DNA, 403 bp, Homo sapiens
tgtgcctgatcttgagcacacagtgcgctctgcccctagagagcactgtgtcctgatctactctgccactggtgccacccactggctggagacatgggtactctgccaggagtgcccaaccctcccttatcaactcatcctccagctctgctacaaaccggaggggtgaccgcctatgcctaaggtcgtgactactgtgatctgtgcgcctggcctggctgcatggactgtagtgtgtgcaccatgtggccctggccatggctgcatcccagaccttcctgtggatcctgctcccaggctgtgtcactgggcagacgctcaccctctctgagcaaggacacagggagaggctgtgtgtggtgtgagaagtcttcctacactgggtgcctcgtcctgtagagac

SEQ ID NO: 662307 - DNA, 491 bp, Homo sapiens
tcgcggggcgctcagaggatccgatatgcgtctcatagttatatttattttaggaaaacaggggtcactggatacattctcactagttaaatcaccattcaccttatagttaattaacttatgttccaaggatagtcctttcctggtatataatttcattttcttaaaaaggcaaacactttccggaggaaaaatttacctatggaaggccaaaaccattatttccggcaaaatgggaatccaccaccggatcttttctcgagttcttcggaagaactattccttcaatcctgacttgtctatgtgattaaataatgcacggtgcaactggttggatgccagaaccattctaagcgctttccatgtgtaacttagcagacagtgggaaccccatcaagacagtactataggtcagccagtctgaagagcccacctgcattctccgggaaacctggaacttatcacattagagtaacagtgaattccttcct

SEQ ID NO: 662308 - DNA, 438 bp, Homo sapiens
  misc_feature (8)..(8): n is a, c, g, or t
  misc_feature (209)..(209): n is a, c, g, or t
  misc_feature (318)..(318): n is a, c, g, or t
gtttggantggtatcttttacttgcttattagcttgataataattagtaattatgtagctatgatttttgtattatgaatcaattagggtgagagttacttttagtatgggggtgagggctagggtgttgtggaagagggggatgcagtctatgaagagggtgtggtgggtgctggggcttgctcagggggaggtgctccttatgtggnttttgttttttggccatcaggagtctgttgatggtgcagtgtgggtatttggtgctgtgtagcaccattttgcagtaggcttgggtggtcagtttcaccccgggcatgntgacccgggagggccccggaggcccctgggcgcgcggctgaggcctggacccgctgcctggccgcgcggcgcctcagccgagaagcgggacgaggcggcggcgattgatggcgcggccgc

SEQ ID NO: 662309 - DNA, 361 bp, Homo sapiens
taatgatgagggacaaacactcagaacaaagcagcagtgttctggaatcctctgattaaaagacaaacactcagatcccagcatcagtgttctgacaccctatgttagggacaaacactcagaacccagccactgtgttctgaaatcctatctgaaggacaaacaattcggagccgtcgtagaacttgatccttggaatccctactctgtgggacaaacacatcagaaatcctatagcagtgttctggaatcctttgtgactggacaaacgaacagagcccagcagccgtgtatcggaatcccctctggcggacaaacactcagaactcagaagcagtgttctggaatcctttgtgatgga

SEQ ID NO: 662310 - DNA, 549 bp, Homo sapiens
ggtcatttaactcactgagtcactaagacataattctcctaagccagaggttaaagaaagtgcttactcttcttgtgagggcagcactgcctccgtggccaaggcaggactccaagaatcagtggttgagttgtctcctaccaccagccgcctccccaggtactgggtccatgccccctgtgcccaccctccccagtgtgggtccatgctgttgaaccaacttatttaaaggtggtcctgagattgctctcagcaaactcacatattgggaataggatctcccgtgtgcctaacgcagtagctattggtttgaacaatgtccagacaagactgtacctttgagaatataactgtgtttggcacctgcatagcaccatgaagaagaccagccaccaatggaagcggggtcactgcccacagactggatgcaatgaggggctcacaggagggccagcagccgattgtgggctgaggggtctgcattcaagcacgatgttctagaataggagtttaacgtgtctacgtaacctagaatgtggttattaggaa

SEQ ID NO: 662311 - DNA, 959 bp, Homo sapiens
ggaagaacaaaggtgtctaataggaagagatgttagagaagtagctaatttgagaaaaacaaaatttgaatctggacaagctgaagttcacataccatcagaattactgaagtacaggtaaacagagatctcaagttctgaataaaaaaaaaaaaaatagaatccagggtctaaattaccctgttttaggaagtcagttctctctctctctctctcacaattctctcctcccaaaaaattactcaaaagattataaagggtcttcttaaattgaaaaccaacttttttagacagacattactcagcatttattatccgggggtgatattcccatttacggagttattaagataacaaaccgttctgaaatacattacaagccgtaccctaggggttaaaacaaaattttttcatcaggactctagtcccaaattgttcaaactgttcacactttcgggtgaaccagaaccttatttatggaagggttccttggctagagattacccagaaaaatcctaatactcattaatccttctttaatcaaaaccacattggtgcactgaattcctacagaaattgccattagccaaaagattctttcccatccttggcttgtaatatccccaaggcttactcgtggctaagtccttccctatggtcccgtggatttacaaatccagtgtgtgttgtgtgctgtgtgatgtgtgtcgtgtgtgtcttcaaactcaggcacttattacaaagtggttgcggagtcaagaataacctgcgggcaaagaaaaactacaagtggttacacaaggattccacccgactctgttattaataatgttgcgtggcccaaatacactgctggcgccaggagtaaataagccccttctctataataaacggaccaactccatgatgtcggtgacataacacgcgtgtgtaccacaccacatggattggggtgcacc

SEQ ID NO: 662312 - DNA, 129 bp, Homo sapiens
ggtttgccgccagaacacaggagtcgtgaaaactacccctaaagagccaaaatggggaagggaaaggctctcatatcgtccattgtcggtcattggacaggtggattcgggcaaggtccacacttctag

SEQ ID NO: 662313 - DNA, 704 bp, Homo sapiens
agcgggctgagagacagtagcctagagagagagagacagttaaaaaaacaacaacaacactggaatgaggccaggcgcagtggctcgcgcctgtagtcccagcactctgggaggccgaggtgggcagataacctgaggtcagaagtttgagaccagcctggtcaacatggtgaaaccccatctctactaaaaatacaaaaaaaaaaaaaaaaatttagcgggttctggtgcgggggtggcccacttggtgtgaatcccagtttactcgaggagaacggtgaggcaggagaaattcctggaacccaggaaacgggaggttgggcgggtgagctgagaatcatactactgcactccagccgggcggcaacagaagcaagaagttcccgctctcaagaaaaaacaacaaacaaacggaaggggttggggcaggggggctctccaaggctgtggagtaaatcccaccagggcatttgggagagaggagtcaaaggagcaggcgcaaagattaggcctagagggtcaggagagtgtccgaaagacccaggccgtgggtccaacctgtggggtagaacccccggtgtctcttacaaaaagattacgcaactctcaggcggggagtgggggggggtggtgagggcttggagagccatagtaaccgcagaagggtggaggcgggaaactttggttgagccctggaaggggag

SEQ ID NO: 662314 - DNA, 323 bp, Homo sapiens
gggttttgggcaaattccccttttttgcaaccccaaagtgggggcggaacttgggggcaggtcctgggaatgggaaaccttttccttgtgtttttcgccccccttttagctcatcgccccaaaattgcagacttggaaggaagcataagcttccccttttccaaaagggaaaattaggggcgggggggcgggcctgggggcggccgtcccatgggttccattttaacccccccggggccccaggggtcctggggccctttttttattgcttggcctaaaacaggtccccgggggttaattttttcccaaaaagtgttgcccca

SEQ ID NO: 662315 - DNA, 163 bp, Homo sapiens
ccctgctgtcttctatcatgtgcctcagcctgtttttttccttgccaggctgcaggccgtgatatcagactaacaggagcacaacatggcacggtctaaagacactacatatagggtgaaatttggttcttctatcttccccccttgcatggagaggaccctc

SEQ ID NO: 662316 - DNA, 778 bp, Homo sapiens
taactattaaacaccttgtttacagacagatgaaataggatttattccaaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaagaaagaaaaagagaagagggagcgcgcgcgcgagcgcccacgataacatccacaaggagttgagacagacagaacaccaccagccccagcgacacttaacaagggcgagggcgcaccgcacgaccctgcggagcacatataacaacaagcacaccacagagagagcgcgcccacgcggccccatccaccccgaaccacacgcgcactaccaggagcacaggaagcacgcagcaccacagaaccaccagccagcagacaccacaaaacaacactgagcacgacacgaggacgcggcccaaacaccagccactcaagtgtgagagcgccgagcgagaaagcagaaccgcaacgagacgcagagcagacgcgcaggagccgaaccgacgcacagcatacgcaacgaacaagaaagagatgaaccagacgacgagaagcgcgcgcgaggtcagagagaggataaaaaaaaataaacttaaaagagtagcacacaggagagacaaggagaacgaggtcgagtcgacagcagagacgacaagagacgaaacagccgaataagcgagcgatatgggcgcagggggcgggccaa

SEQ ID NO: 662317 - DNA, 301 bp, Homo sapiens
gtttatgatctatttgtagattaggattaaaatggatttaacccctttttaaggcggggtgaatttttttaaacaaaaaccatttgcaatatggattttttaaagattaaaccaattataacttattaccagtcgcgagcccatgttcaaatagtcaatgtaaaaatcccctaatgagtttttggtaaatcccagtaggcttttccccttagcaaaattttgtgttggccaattaagttacaattacatctctaattttggataaaattcattggttaccaataaagtgccaaaagcccca

SEQ ID NO: 662318 - DNA, 432 bp, Homo sapiens
ttcaaaaaaatttgcgataccccagaggaagaatttggaatttttccaaataaatttaacaaagagtttgaaatcttgaaaaaaaatcaagcaacaattgtggccatataaagtagaaggatggtttccaaagcctgggaagggtagtaggggactgtggcaaaggtagggtggttaatgggtgcagaaaaaatagaaagaatgaattcaccttactttttgccagcacatcagggttgactatagtcaataaaaacttagttataaacctttaaacaactcgaaaaggggaactagattgtttggaactcaaagaataaatgcttgaggggatggaaatcccattccccataatgtggttatttcatatcacagggctgggtcaaaacatttcatggcccccttaaatatatgccccccctatgtccccct

SEQ ID NO: 662319 - DNA, 320 bp, Homo sapiens
ttaataaaaaaaaatcccgttaaaaaagttttggggaatttaaaataaaaggcggtgaggtaaaggctggggatggggggtcccatttttaaaaccagctttttctggcaaccctggcccagggggggctggagccccccccctaaggggccctgttttttcccctgctggccctggggctttgcccctgctgaaaacttttttggaaaggggttttttggaagtgaaatctccccgtccgggggcccagggtggggcaaaaactcccccagggcccccttttgcccccctttggggaaaaaaacaagggccggttttca

SEQ ID NO: 662320 - DNA, 537 bp, Homo sapiens
gaaatatacaaagacatgtggataggccagatcacagccattgagaagacttttgattgatgcccagaaatcaatctcacagcattacagcaaaccccgagatcacaccggtggaggtcatgcactgtcttcccagactttaatgatgtggatcaatccatgtgctcatggtgatctttgactcagacccagcccctcaaggacactgagtggtgcagcatgcgttggagatgatgtcatcatggccatgatcaggggcatgatggatgaggaagggaaccaagattgtggccttatttcctgacctgattgcaagacgactgtatgaacgaccatgacaaggcgggacccaggagcgaggaacgactggcctcatgcaccagactgcactgctgtctgacctaccaaacactcggcccgtggagctacaaactggaacgtgaacgaacaaagcttacacaaggcgactcctgaggaaaaccaacggccatcaatcctcaccgaagagcggtcacggggtcaactaacaactcagaa

SEQ ID NO: 662321 - DNA, 933 bp, Homo sapiens
  misc_feature (143)..(143): n is a, c, g, or t
  misc_feature (145)..(145): n is a, c, g, or t
  misc_feature (156)..(156): n is a, c, g, or t
  misc_feature (166)..(166): n is a, c, g, or t
  misc_feature (170)..(170): n is a, c, g, or t
  misc_feature (174)..(174): n is a, c, g, or t
  misc_feature (191)..(191): n is a, c, g, or t
  misc_feature (195)..(195): n is a, c, g, or t
  misc_feature (198)..(198): n is a, c, g, or t
  misc_feature (203)..(203): n is a, c, g, or t
  misc_feature (210)..(210): n is a, c, g, or t
  misc_feature (213)..(213): n is a, c, g, or t
  misc_feature (229)..(229): n is a, c, g, or t
  misc_feature (252)..(252): n is a, c, g, or t
  misc_feature (258)..(258): n is a, c, g, or t
  misc_feature (262)..(262): n is a, c, g, or t
  misc_feature (264)..(264): n is a, c, g, or t
  misc_feature (267)..(267): n is a, c, g, or t
  misc_feature (269)..(269): n is a, c, g, or t
  misc_feature (273)..(274): n is a, c, g, or t
  misc_feature (278)..(278): n is a, c, g, or t
  misc_feature (289)..(289): n is a, c, g, or t
  misc_feature (293)..(293): n is a, c, g, or t
  misc_feature (295)..(297): n is a, c, g, or t
  misc_feature (330)..(330): n is a, c, g, or t
  misc_feature (382)..(382): n is a, c, g, or t
  misc_feature (440)..(440): n is a, c, g, or t
  misc_feature (511)..(511): n is a, c, g, or t
  misc_feature (869)..(869): n is a, c, g, or t
  misc_feature (927)..(927): n is a, c, g, or t
tgggcgccacagcccgcgcgtcccgctgcgccccgcgcgccccggggtctatggagctgcccctccgcgccgcccggccggccccacgccgcgcccggagcctgctctgcggccaagtaatcggactggcggtcctgcggganantcggggctcgnagcccgcctnaacnaacnccccggaaatggcggcncccnatnccggnagtgganagnaaaaacaaaaaaaaanacgtggaaggccgcggcgccacntaaaanaaananttnanaaannggangaagaaaaaanagcngnnngaaaaatgcataaaggagaaaaaaaaaaaaaanaaaaaaaaacaaaaaaaaacaaaaaaaagaaaaaaaaaaaaaaaaaataaanaaaaataaaaaaacttataccaataaaaaaaaaaaaaaaaaaaaaaaaaaaaaaagantacataaaaaacctcagcgtcacctacctccgcctgcgccggttcgccgcgctgggtggcgccgccctggngggctgagagccgcggggccgccagctggcctcgccccaggccgccgcggccccgcagcgctggtctccgaagtcttcgagcagcacctgggaggtcacatcttgcagtccctggatggctttgtgttcgccttgaaccaggaaggaaaattcctctacatctcagagacagtctccatctatctgggtctctcacaggtggagatgacgggcagcagcgtcttcgactacattcaccctggggaccactcagaggtgctggagcaactgggggctgcggacgccgacgcccggccccccaaccccgccctccgtctcctcttcctcctcctcttcctcttcgcttgcagataccccngagatcgaggccagcctcaccaaggtgcccccctcctccctggtcaagagcgctcttntttgtc

SEQ ID NO: 662322 - DNA, 593 bp, Homo sapiens
aaaagacaggcaaatcgtgattgggggaaaaatgtccccagacaaaatgaagggtggatgataaattatgccaggtaaatgaacctgactgcgtccaaagatgcatcaatccatactgcgtggcaacactgaaaatgcttgctcgactattgccaaagacgcagtcttatacctatacctgtgaataaaagcttacaaccctggcaatagctacggcgatacgttgtggattcaaacaaggttgatatcagagcttgtcgtaacccaggcactaagctatcgctaggttattagaagtctcctatgtaccctgttatttgcagctgtgtgtaaacagagctcttgatgtgcatacctaaggaaacattttacgtaaggaaggagtcatggggtgatatttgcatataaaacagtgcttaaagcgctaggcggtggggacctcaaacacattatttaaaggccagtgccttctatctctggatgagactgtcatgactgatggtcttagaacacgaaagacgctcgactctcttagcttatgtaatatgcatactatgctgtatggacgctagaaagtcatctctttcagaaga

SEQ ID NO: 662323 - DNA, 424 bp, Homo sapiens
  misc_feature (118)..(118): n is a, c, g, or t
gcgggcaaagcccctttttgggggcaccccttttttttttaaccgccaccggggggggggccgccccccccaaaagccccgggggcccccccagggggggcccccgggggaatccccngcccccgccccccgttccgcagttcgcagggcccttgcctgccgaacccgctgctgtccttccaccctggatttggggccctcccatgctggacccggtgctgggcgtcatggacccggcgcgcccggaggcggcttcccccaagcccgacgcggaaccccgccccgggacgcagccccccagggccgcttccgccccaacgcggacctcgagctgaacgacgtcatcggcctttaggttccctcattccccgcgccctttccgcccggccccccccttttgtatacataaacggccaaggtgtga

SEQ ID NO: 662324 - DNA, 1624 bp, Homo sapiens
  misc_feature (12)..(12): n is a, c, g, or t
  misc_feature (729)..(729): n is a, c, g, or t
  misc_feature (916)..(916): n is a, c, g, or t
  misc_feature (983)..(983): n is a, c, g, or t
  misc_feature (1003)..(1003): n is a, c, g, or t
  misc_feature (1008)..(1008): n is a, c, g, or t
  misc_feature (1109)..(1109): n is a, c, g, or t
  misc_feature (1214)..(1214): n is a, c, g, or t
  misc_feature (1279)..(1279): n is a, c, g, or t
ggcaaaaagccnttgcttcggcccctaaccctaaaatgccctcccagcccctcccatctttggacgaggcctccttcctcaggttcctcctgctcctgacctcccagtgtgatgtccgggtcctttatcatcctattcatcctggagaggaaaagtgtcgggcaaagggggatctggggggagctcagcagtgactggggagctggtctgcctcagagacagagtagggggtgggagcagagcctcggtgagggtcttggccacagggcagtgccttcctgaacgtggcaggctttactaccaggaacgcactcggtggtggaggccccatgttcccaggagccaagattcgtagcatccttgaggccatcctgataaaattcggcgctattgcccccgtagctctggagctctaaaccgtctatctgcttctgtgctgaacgcctttcccatctgctgacgtaggcccagggctgccctgcccctgctgccagtgtaccgtgagcggggctccagccagttcaagctcagagccagagctggacgggccagaactgcgctgcacacttcctggactgaggcggggactttgggtcccacccggtttctcctgattatggctgctgtggggtgaggggagggaggggcagccccgaggcagtctcttccctttgagaagatattttcccacaaaggggtgggaagccaggagtgagaaggaattcaggnagagcaaaggagccagtgctgagatgctgctgtgttggttgaggaaaacctcgggcctgagggccaggccggagcccaggtctctgctgacaatgggggttcaaggaagacgtcgttatctcccctccccacttactcgaggagagaggtgagggggggatgacttgcgggttctgatcaggccccngggccaggctgggccccccggagtcccatcaagcgacgctcgggggctcttcccccgcctgcacacngggctcagaaggccagggcnacacngggcacgatgtgacagcacatccagcacacccaagaccccagatggtggacactcctctcaggagataaagtctgagacctcatccaatcccagctctccngaaatctgccccaacaaggagaagcccttcatgaagttgaaggaaaacggccgtgccatctcccgctcctcctccagcaccagcagcgtcagcagcactgcaggngagggcgaggccatggaggagggcgacagtgggggcagccagccgtccacgacctcacccttcangcaggaggtgtttgtctacagcccgtccccgagcagcgagagccccagcctgggggcagctgccaccccgatcatcatgagccggagtcccacagatgccaaaagcagaaactccccgagatcgaacctgaaattccgctttgacaagctcagccatgccagctctggtgcgggtcactacctgtgcaccggtggagtcccttccgccttgtcccaagggaacttcccgctcattcgtgtccctgtcacacatgtgctcctggtaccaggcaggtccgcgccagttgctgtccaccgacgcctggatcatgtcccaagccctgttgccccattggccccgtgccg

SEQ ID NO: 662325 - DNA, 111 bp, Homo sapiens
acatactgagtcatctttgtctgcaaccagtttcactggttgccacctcatttcacctttatttcagcaacacaaatggcctgcccaactggaagtgcaactttatttttt

SEQ ID NO: 662326 - DNA, 200 bp, Homo sapiens
tgaagaaaagatccacccaagcaagtcagcatgtttaataattttgagggggatctcaaatgtggaaggattgttatataagacacccacatgatgacatgagacattaaatgctataggattatggaggattattagctatctatttctcggttagggaagagatataattagttgtagaggtatcactatctcctaca

SEQ ID NO: 662327 - DNA, 1302 bp, Homo sapiens
  misc_feature (12)..(12): n is a, c, g, or t
  misc_feature (729)..(729): n is a, c, g, or t
  misc_feature (916)..(916): n is a, c, g, or t
  misc_feature (1106)..(1106): n is a, c, g, or t
ggcaaaaagccnttgcttcggcccctaaccctaaaatgccctcccagcccctcccatctttggacgaggcctccttcctcaggttcctcctgctcctgacctcccagtgtgatgtccgggtcctttatcatcctattcatcctggagaggaaaagtgtcgggcaaagggggatctggggggagctcagcagtgactggggagctggtctgcctcagagacagagtagggggtgggagcagagcctcggtgagggtcttggccacagggcagtgccttcctgaacgtggcaggctttactaccaggaacgcactcggtggtggaggccccatgttcccaggagccaagattcgtagcatccttgaggccatcctgataaaattcggcgctattgcccccgtagctctggagctctaaaccgtctatctgcttctgtgctgaacgcctttcccatctgctgacgtaggcccagggctgccctgcccctgctgccagtgtaccgtgagcggggctccagccagttcaagctcagagccagagctggacgggccagaactgcgctgcacacttcctggactgaggcggggactttgggtcccacccggtttctcctgattatggctgctgtggggtgaggggagggaggggcagccccgaggcagtctcttccctttgagaagatattttcccacaaaggggtgggaagccaggagtgagaaggaattcaggnagagcaaaggagccagtgctgagatgctgctgtgttggttgaggaaaacctcgggcctgagggccaggccggagcccaggtctctgctgacaatgggggttcaaggaagacgtcgttatctcccctccccacttactcgaggagagaggtgagggggggatgacttgcgggttctgatcaggccccngggtggggaaggggcacagtgtccctcagcagcttacgcccctggagtcttggggggcccagcctggccctggggccttttccagctactgtgcccttgggcagctgcgtctggggctcaacccccaatcctgttcccctctccagctgcgggtctgtaggcagctgtcacatctgaagggtttctgcanactggaccccatctgggtagtgggtcagacccatgtgcaccacatagccagcacccagcctacgacagagcccgcattgctgggacagacaagtcaactccgaaggacatatccccatcctgagatttctacaccacttacaagagtcatgccagccgccgtgggcttctctgccagatggggaccagagaatagg

SEQ ID NO: 662328 - DNA, 248 bp, Homo sapiens
aaagccccttttttgcctttcccctgggggttttttgtcccccaaggaaaagccttttatgagggctgggaactttttaagggccttcccggttgttttccttgttttcagcgggtccctgggccccaaaaattccttgcccttttgaacaagggacctttttttccatttttggggaatttgccaggggggccaatggggggtgaggcaaccccttttccggtccaaaaaaaaaatgttttccaata

SEQ ID NO: 662329 - DNA, 1781 bp, Homo sapiens
tctattcctcccctccccgaccccctgatctgttttaaccacggggtgagaggctctctgcctttctcagaatcggacttcttgagaagtccactcccagacatattaacgcgactagtgaactgcggtccccaccccccaactccaaccccggaccgagaacagtggaggagtcgtccaccatcactcctacagcgagacctacaaacacaccgcgcagagaccgaaagccgacaggcccagaacaacggcacgcactgaccacaggatatacatactcaacagaggatccacaattggcgcgcgcactgctacgcaccagcacgaggaaacggagacatagccgcaccactaagacctacagagcaaccggaacacacccgcaacgcgccacagactgcacagctgccgcataaacccactagacaccccaccaagaaggctacccaccagacaaaccacgccaggcacggacccgagaaacacgcgctgcacggccgccagcggccggacacttacacagaggcggaacaagggaacagatacaaccaacacacacaaacaaacaaccagagcaagcatataccacgccaaaacaacagcagagcaccaacccgggacaacagccacaagctagagcacagcaccgcgatacgcgcggacagccacaccactaaaccaacaacaggatactcgccccacaccatgcggcatcagcactaaacatacaggacacaaaaggcaggaccgacacgcggaacgagacgacataagaacacccccacaagacaccacgcaatcaggaccaacacacagacccccacacaaaagaccagggagctcaacacacatcggccaccgcccccacgcaggcgcaccgcgcacaatatagacgaccacagcgggaacacacgcacccacaccactgcgtcacacaccgcaccccacgacacatcgtcgatagccacgagaatcgacgagaggacaaacaattcgacgagcacactagacacgccagcaggaacgcggttgcataacccgcacccagacgccacacgcaccacaccggcgtcccgcacacaccagctaccagcatcccacatctaccagaagggagagcacaccccgcaacgagggacaaagacatacacacaagaggcgcaacagcaagataacgaggcggaaacctgcccacagaggcaacaacgccgacaacgaagcccaaagtataacataggaacgacagacaacaggacacgagcacagtccccagcagagcagtacaacgaccgaccccgaggcaaaatagagaaacaacaaccaggaggaacgaacagaagacggacaaccgacgaacacaaacaacaggagcagagagaaacaacaagaacggggaacacacacacagagcccccacgacaacaccaaacagaagcacacacacacgcgaccagcaacctgggcgacgcggccgcaccagtcgcacacagagcgccgcaaagatgcaccgcagaaccatcgcacaagcacgacacacagaacagagacgcagcacagaccgacaggacagcacagaagaacgaacaaacgcagcagcacacacctgacgaagagcaggccggacacaagacgcgacagagcgcgcagagccacacagaacgacagcagaaaaacggtacagcacaaaccatcaccaagcatgacacgcaggaggagaaagagagaacgctaacgacacacgagaggcgccacacaacgacaccgacgcgaaccaaagcccg

SEQ ID NO: 662330 - DNA, 300 bp, Homo sapiens
ctactggagaatcttcccagtaggcggcgcgggagggaaaagaggattgaggggctaggccgggcggatcccgtcctcccccgatgtgagcagttctccgaaaccccgtcaggcgaaggctgcccatagaggtggagtcggtcgcggggccgtgatcatgaggtagtttctcctattcctgaggtgagtgactcctttcgtgctggctccgcgacctccggttgacccgggcttcggcccccaccagagacgtgctttctttttttacttttacatgttactgtcttctactcttttgga

SEQ ID NO: 662331 - DNA, 140 bp, Homo sapiens
  misc_feature (140)..(140): n is a, c, g, or t
tggaggaaaaaaggatgtttacgcctgggcacttacggtagccccactgcctcttcacagagctttgccacaaacatggttatccaccggtcccagtcatggtttcccacaaaatttctaaaatgaggctcagcgattgn

SEQ ID NO: 662332 - DNA, 664 bp, Homo sapiens
ctgctttttgtgtgtggtcaaaaaattgcccccccccccgcttggtgggggccaagggggggaacctctctttgtgaaaccccagaaagcgccacaagtttgggagggtgtgaatactagccttctgcctctggggaatatgggtgtgtgtgtggaaataggaaccatctgtgtgtgtgcgcccatctgtctgtgtggggggcactcttgtgacagaccccacgccacgcaccacgaggcctcgtacaacagtgggttgagagagagagtggtctttcacaagcgtgagaatgagaagccccacagcctaggcacccactgtggcgcacgccacgcacattcgggaagatttcccctcacgttgagcacgccttcaccctgaggtcacccttcccaagttgttcacatgggctccatggctctggactgtggccaacacttctccacattccgccccatctgtaccggatgctggcagggaggtggcagagagctcactgggactgaggggctgggcacccaacaccttttcacacctgtgcttatcccctggatttatcattccgcaaaaacctggttttttgtgctggctggcaggccctgtggctctggctgagggttttctgtcctgggccaccccctttaagtcccgttccctccggga

SEQ ID NO: 662333 - DNA, 180 bp, Homo sapiens
aaacttgacccaaaattccttttttaaaaaaaaagggggggtttttggaaaaaaaatttaaaaaggttaaaattttgggaggggtaccagtttttttcccaacccggaatttggggggttttcccgaaaaaatttttccaggaattttttgttgggaaaaatttgggggcctttttttta

SEQ ID NO: 662334 - DNA, 410 bp, Homo sapiens
catcccatgcatgatcggtacacgtgtgctgtgggctttctggtatctccagtgattctcacagatgcttcgatagtgagttttttttaattgtggtaagataaacattagatttaccattttaacaatttttaagtgcacagttcggtggcaataagtacattgcaattgttatgcagccatcaccaccgtccatctccagagctttaccatcatcccaaacagagctctggcaccattaaacactaacttcccatttcccctctccccagcctcccattctccgttctgtctctctgaatgtgactactctaggttccttaggtaagtggaatcatacagtgcttgtccttttgtacctagctcatttcacttagtatagtgtcttcgaggtccatccatgttgtagc

SEQ ID NO: 662335 - DNA, 439 bp, Homo sapiens
tcgtactaagagtaactaaagttgaccttgacctatgcaataggggaccacaggcatttccataacctgtacacttcagtacagtgatatagtttctctctgagtcagctactatatttctgtacagctaaaagtctacttatttgctttgtagaaggagtacttaattactggctctgctgacatctaacaaactgtatttcttcttatttagaagatagtatccttctgtgcactctaaaatgttacaatttactgaaagctacgtgccaggcactatgcttttctaacactataccactcactttatatgttatgtagctacattcaatcgtgactctaaagccggcatcattgtacgcattttatcgaacaggaaatgggagggttggagatatccgataccacgtatacttaaaacgcgatttatattccatcc

SEQ ID NO: 662336 - DNA, 555 bp, Homo sapiens
  misc_feature (261)..(261): n is a, c, g, or t
tcgagctcggacccactcatctgccagtagagagtagaataattcctcaaagcgacgagagcacgtatgttttattatagaatcgtgttatcaaataaattttgcaagaaaaatggcaaggttttatgtttctgagaatgttaggctaggttagactaccttctactcccccaccctccaccccagaaaaacagccacaattgttagatgaaaaaacataaataaaagaactgacaaaaaagcaggaaacttttggatcanaatctaactgaaaataacgcagaaaggtaatttaaacaccatagaatggggtctgcttttgtcctgagggcatttgctcatgtggacaaagtggggctttgagtttagaggatttgtgaaaagaacagtagttaagctcgattcctctcaaggtaaatagcctaaaggagaccctccccacaccgatggaactctgaagggctctatcctcaaggtgtgagggcagactagaggcacatgtgcctcacaccgttccttgccctcatctggttgtctttttactaaatgtagcac

SEQ ID NO: 662337 - DNA, 247 bp, Homo sapiens
gtgcggcctgcaagaagccttttgggaacagcctctttacacatggaagacgggggagccctactgcgagaaagactacatcaatctgttcagcaccaagtgccattgctgccatttgccccctgaggctggcgacaaggttatcgaagccctggccacacttggcacgacacccctcttatttgcgcagtcttgccatgtgaatctgtgaggggcagccgttcttcttccaggagggcaaacccct

SEQ ID NO: 662338 - DNA, 157 bp, Homo sapiens
cgggacgtatcagtcggagagcagcgcgtacgggccagcagtgatgcccacgatggggatggtgggctgggaagacggctcccatctcagggtgagggtgacagcagtcggttggagcgagcatcccccaaagttcacaatgttgccgaagcttgat

SEQ ID NO: 662339 - DNA, 289 bp, Homo sapiens
acagaaactcagaaaacaaatcttcttatcctcattcatttccttttactcaaagacatcggcgaggtaatatgtgccctattagtcacaggcactaaggaagtagggaagttctccttcatcatcgtcagcaggcttggcttgtctagtcttgtcatcacgtctggcgtatttgtgaaacatgtcgatcatgcctattatggacctctctttttgagtgttgctcatctttgctttcaaaaagccagagctgggaagcgtcacgagtagaaggatgagtgagatgtgt

SEQ ID NO: 662340 - DNA, 430 bp, Homo sapiens
  misc_feature (238)..(238): n is a, c, g, or t
  misc_feature (403)..(403): n is a, c, g, or t
gggacaaatggcctacctgatactcaagccaagttccatattatgtttttattctttgctgcagctatgttttctgtcagcttgtcttctctgtttggctatcattttggctagtcagcaaaaataaatctacattagaggcattcagaagtccagtatttcgacatggaacagataagaatggattcagcttgggtttcagtaaaaacatgcgacaagtttttgggtgatgagaagnaagtactggttgctacccattttttcaagtctagggtgatgggctgctcctttccaacttgccttgttaaccagggtcctggaacaagcatctactcctggcaggggctgaattccacaggttaaaaatcttcggaaaacccttcagttttcctggcaaagcccnttgaggaggagttcccagaggccacct

SEQ ID NO: 662341 - DNA, 315 bp, Homo sapiens
  misc_feature (235)..(235): n is a, c, g, or t
actctacaggatccccatcatgagggttcctgacctcatggggttccaaagtttctcatcaaatggtagagggtgccccatccctgctgcgtgtgacccatgcacgcttcttcctgtccgctcgtacacgctctttgcccttcttctgagatacacgctgcgtaaatgaagttccgtggctgttgttttcactgtcagctctcactttctgacgcacaagggcctctctggtatngtggttccttcattttcgtccggtcagagtgctccacgcttggacctgcagtatccctggactctcgaagcggctccttc

SEQ ID NO: 662342 - DNA, 536 bp, Homo sapiens
  misc_feature (3)..(3): n is a, c, g, or t
  misc_feature (73)..(73): n is a, c, g, or t
  misc_feature (104)..(104): n is a, c, g, or t
  misc_feature (114)..(114): n is a, c, g, or t
  misc_feature (133)..(133): n is a, c, g, or t
  misc_feature (135)..(135): n is a, c, g, or t
  misc_feature (139)..(139): n is a, c, g, or t
  misc_feature (148)..(148): n is a, c, g, or t
  misc_feature (157)..(157): n is a, c, g, or t
  misc_feature (179)..(179): n is a, c, g, or t
  misc_feature (266)..(266): n is a, c, g, or t
  misc_feature (327)..(327): n is a, c, g, or t
  misc_feature (337)..(338): n is a, c, g, or t
  misc_feature (341)..(341): n is a, c, g, or t
  misc_feature (411)..(411): n is a, c, g, or t
  misc_feature (440)..(440): n is a, c, g, or t
  misc_feature (452)..(452): n is a, c, g, or t
  misc_feature (458)..(458): n is a, c, g, or t
  misc_feature (466)..(466): n is a, c, g, or t
  misc_feature (468)..(468): n is a, c, g, or t
  misc_feature (476)..(476): n is a, c, g, or t
ttnttgtgtaatgttaaggtgtggctcctaggcccctcccctcttcaaggggtctacatggcaactgtgaggnggggagatttagtgtggtgggggattgagtntggcagggantcccctagcagtgagggtntntttnttcctcttntgctcttgntggggctggtggtccaggggtnttactccttggaggccatgtgggccatgaggtccaccaccctgttgctgtagccaaattcgttgtcataccaggaaatgagcttganaaagtggtcgttgagggcaatgccagccccagcgtcaaaggtggaggagtgggtgtcgctnttgaagtgannggngaccacctggtgctcagtttagcccaggatgccctttagggggccctccgacgcctgcttcaccaccttnttgatgtcatcatatttggcaggtttttntagacggcaggncaggtncaccattnanacgttggnagtggggaaaaggaaggccatgccagtaagcttcccgttcagctcagggatgaccttgcc

SEQ ID NO: 662343 - DNA, 688 bp, Homo sapiens
  misc_feature (38)..(38): n is a, c, g, or t
agtgccatgcctttatttttggtgtaaacaatctgggnagacactttggcaaataacctttccccactatttagtgtgtaagggatgatccaacctggtgccttttcccttgctcatacactgcctgcaggatagcaaagcagcctgtctggacttcattcattaagcccaaatagagagtattcagtcctagagaattcctaactttgttcagatctcatagatgacccccaggtattgtcttttggcatccggcagtcaacggtcttcacacctatactgcacagtaaagtctctctctataattcagaccgtcagctttgcagaatgagcatctatctcaagagcgtggtagtttccactagaatacttcttatgtaagggtcatcaagcaaatgtcttgaagtagacatggggtttatgaatggttcttcatcatagctccacagcctttttggtctcctggcttccttccagtcggaggtcctggagtaacattctgtgaacccccaggccacctcgtaagtgggctctttaccgcatgtacactccaagtaagatccatcatccgctgtctaataatacacattacatacgtacatgccttaggcaatttatccgccgcagtgaagctgctataagtagctgtggcatgacatttacagcaagccaccctctattaaggagc

SEQ ID NO: 662344 - DNA, 450 bp, Homo sapiens
  misc_feature (67)..(67): n is a, c, g, or t
  misc_feature (121)..(121): n is a, c, g, or t
  misc_feature (287)..(287): n is a, c, g, or t
  misc_feature (322)..(322): n is a, c, g, or t
gtatcccctcttgtatgctgcagaaacacaaactcttctcattaaaaaaaatgcttagctggctttnggaacataattctttcattagtggtagtgatcctttgaaggttttagctatgtntaatttttctaatttcttttgcagataaattactttttagtaaaatcatttgtagccattcgtgttgatacgattactcgtggctattaccatttttttttctgggaaatgagggtatcctctctagttcataaaatttactctccttcagaaaaagaagaagtanatggagaaggatgagaggatcaaagagaccccaanccattcattaatttcattcattcttttataaagctgcataatactccactcagacaccatctgatatagctactcctctattgatggctacttatttcatttccaatcttttttattatttgagacaa

SEQ ID NO: 662345 - DNA, 123 bp, Homo sapiens
  misc_feature (76)..(76): n is a, c, g, or t
  misc_feature (92)..(92): n is a, c, g, or t
  misc_feature (104)..(104): n is a, c, g, or t
agcctgggaaacacagtagggctccacctctacaaaaaacacaaaaattagccaggcatgtggcgtcatagtaganttaatcaaaagcaagnaaatggctggangagctgtcttgttggcagg

SEQ ID NO: 662346 - DNA, 207 bp, Homo sapiens
aatcctggagttctatggtgattacatagctcggctgaagctggcccagaaagtaaagatgtccacccatgccaggcccatctgcctaccctgcacgatggaggccaatctggctctgcggagaacctccaagcagcacctgtagggaccatgagaatgaactgctgaacaaacagaagtgtacctgctcatttaggccgcatgaat

SEQ ID NO: 662347 - DNA, 880 bp, Homo sapiens
tggaaacaaaaatctcactctgtcaacccaggttgggagtgcaggggcgccatctcggctcattgcaacctccccctcccaggttcaggcaattctaatgcctcagcctccctagtacctgggactacaggcgcccgccaccaaacccggctcattatttggggtattttaaatagagatggggtgttccaccattgttgggccaggctgggtcttgaactcctgacctcaaggttgatccacccacctcgacctcccaaagtggctggggatatacagggcgtagagccatttggtgcccagaccaagttgttatgtatactgtaaaaggggtcttatggtaaaatcctaaatatttaggtgaaagctttttaaacgtgataaacctctgcgtggttattcgagggacgcgtaaatacacacaaaatgaagactctcagtaggcctccattggatacgggggcgcaggaaaaaccagtagtgttcaactaagtacaacagggtccacatgcagattctcgcgacccaacgtttttggtcagcataagtgggtcatgcgtctgccggggcccctattccgggcgtcgaatgaaaatattttgtcgacaaacgccatgtttaaccccaggggataattacgtggggcacgcaaccagtggtagggcacattactatatgtacatcacattatatattttacaacaaggggtccatgcagttgcttcccccaggatttgagccagacaggtagtgaatattacgcctaactacagacctaaaccaccgtggctaaaattaccccgggacccagcctatgaaatgctggcacaaatgtggccaccaccacatttggtaatttgcaattctgaacacagtgtcc

SEQ ID NO: 662348 - DNA, 326 bp, Homo sapiens
tgccagagaaaatggtcatctgctgtatgatcaattgatatgaacacattttttatgtgtcttcccatagagggacactggagtaaccaatgggatcaggggacatgggtggcaactgctaaggggcatgggatttttcctcttggtgtgatgaaaatgtgtggaggtggttaccagtaacagttgcagaaatctgaaaatattctgaatcccctactgctgttataacccaagttatctaacaccccggaccccttagcctagaagagatttgaatgatgtgaatgcatgttctacctcatgactttgggaagcttccgtcgacg

SEQ ID NO: 662349 - DNA, 755 bp, Homo sapiens
aaaactaaggctagatacgagcccgcggttaactcggccgagggcttgccagcaaagatcagtctctgctgatcaggaggaagatggacgtactttgtctgactataatatttcaggacagccagcttaaccttcttactcttgtgcttattcttcttgggagtggaaaacaccaaatggcggatgactgccgagtgcatgcggggtgggccctggtgggccctgtgtgtgccctgggcatgggtgaacctgcggtgtgcttccgctgtgagtgtttctggcagtgtgcatcctgggtgcctggtggtcgctggcctgtgtgactggggcctggtggcctgagtgcctgcagtgagctcgcagtgaggtgcaaagtgcacgatggaataatggatgttggatttgccctgatcaccaacgtttgggccgcatatgtgtcaaatggaacattgaaagatacaatgtcccatgtgatgtggatgaatctatactctattctcccctgccccaattaaccggaaatcaagcagatacatttgaattttctatacctgtgagaggaccatcatactctaactggcatcgacgtgtcttcatgacagcattatcgaccatgtagcatgaacgcaagaaccctgttgaccgagcacatgctgacacgcagagtctcacagagacattatgattagcatcatcaggaggcactaacacataggaccaccgtcagcgtcatgggcgtgctaaatgttagctca

SEQ ID NO: 662350 - DNA, 206 bp, Homo sapiens
gcacagatgagcaggtgcctgttattccatgctaggagggaggctgaggtaggctgattgcttgagcccaggagttctcgacaagcgtgggtaacacggtgaaactgtctctacaaaaaatacaaaatttcgccagttctattggcgcgtacctgtagtcccagctacttgggaggctgaggcagtagaatcacttgaactctgga

SEQ ID NO: 662351 - DNA, 329 bp, Homo sapiens
agagagtgtgtgaggggagggagggagaggataataaaaaaaaaaagaaaaagttggtagggttggaaaacaaaaaaggaccacctcaagttcagggaaaagagaagggagggtatgaaaccgcgactaaagattagtgttgacatggggatcaagaaggcattatgtataatacgtggcccagtaaaaaatcagccgcacagatcactgctggtgaatgggccatcgggacaacacaacaaaagcatgatgaaaacaaggccttgtgttgtgtcactcaaacatccactccagaaccctgatgctccatggggttactgttaatgccc

SEQ ID NO: 662352 - DNA, 946 bp, Homo sapiens
gtagatgccgtggtaatcggcgagggcgcgacctgcaggattcgtaagagcgctgggactagagtgcagagctccgggaccgtggatcggagccggctgcgatgtggcggagagcagtgaggaggagcggttcgacggcatgttgctggccatggctcagacagcacgagggcggtgtgcaggagcttgtgaacaccttcttcagacttccttcgacgcaaaacagactttttcattggaggagaagaagggatggcgaggagaagcttatcacacatgactttcatgccaccacaatcagcttgtgcacatgaaagaccctggctgtggagaatgagagcccggcttggatggcctgagctgggtgggagaaagtgctggagctgtggctgtgacaagaactggccaaggaagccaatgtcaagagacctcatgtggcccccagatcaaggagctaactgatgaagaggcagagaggtgcagctaagagatttgacagaaacatgtgatgcaagaagacatcatgagtgcccagctcaagaacgtgcagccttgatccccagtggcaagcagtgatacttgaaggaaggactgagtgaggaacgctgagaagtgacaatggaaaaacttgaagcccaaactagtgcaatggtgtgcagaactgcccaattacctgtgtgaccagacccttgtacggaagcttggaagcttggatgggacccttttcttgtagtgaaactatcctggttgaaagggaaaggcaattggtaggttggacatccaaaggagggaacctcacgagttagggctcaaaggaggagcagcagatcatttgattgggaaactctaacaattgaagtacagtggtggcagagaactcgtgagtcattaagacggaaagtggtgatgtcatcttggaaaaaaaataaataatagaaacaattga

SEQ ID NO: 662353 - DNA, 138 bp, Homo sapiens
attgtcccagacgcttgtatcggtggactgaggtgtgtcaaccactatggaggatacctctgacttccgaaaacagcccagattattgtcaataatgaacagactcagcaggaaacaaaaccagcagaaggaacctca

SEQ ID NO: 662354 - DNA, 434 bp, Homo sapiens
cccccttggggccccccgggttttccctttttttttccggggcggtttttggggggaaatttgaacggaaaacaattttcccccgggaaaagttttggccctggtttcccccagcccgaaattaaccccccccaaaggggacaaaaaaggggggtcccccccgggggggggccctttaaaaaaagggggtccccccgggggccggaatttgggcccagggggaaccttttttacccccccaaaattggtgggttttgggggggttttttaaaaaaaaattcaaagggggtttcccctttttgaaacccttcctttaaaacggggttttagggggaaaaaaaaaattttttttccattttttcccccctaagggcaacggtcccccccccttttttttttggggtaaaaatcctttaaaaaaagggggtttttta

SEQ ID NO: 662355 - DNA, 618 bp, Homo sapiens
cgcagtggcccacacctgtaatcccagcactttaggaggccaaggtacatggatcacctgaggtcaggagttcacgaccagcctggccaacatgatgaaaccccgtctctactaaaaatacaaaaaattagctgggcttgccagctactctggaggctgaggcaggagaatcgcttgaaccagggaggtggaggctgaagtgagccaagatcacaccattacactccagcctgggcaacaaaagcagaactccgtctcaaaaaaaaaagaaacattttataattgaattagaatttctacccgttatgggatcaaggacaaacctacgtgcctgaattcctaggcaccaaaaaggaatttacttataccgggcaagcaacatttatattgctcatagctctgcacagctgctcattttacctttataggctttaattattctattaacgcccaatttttccactttgggaccacaacacttttaattaggccaggaaaacaaatttttcgaaattacttctttcactcctttattcaaatgggatatctccttaacattacaggttactgaacaaatttcacccttggttcccacatattgggaacctggtggtcatg

SEQ ID NO: 662356 - DNA, 146 bp, Homo sapiens
tcctggtttcgggccgtgaattgaatggacaggtggcgcagatcgtcctccgagagtcagtcgaagcagaagttatggtcaaaggagaccctgcggctgcgccccgccacagtggtgcattaccgaagcgcggtgccctgcggccg

SEQ ID NO: 662357 - DNA, 329 bp, Homo sapiens
accccgggcagtagagccagactccatctcaaaaaaaaaaaaagggaaatccattggccacctttaaatgcctaccgtttttgaaaagggatcattgccttgggggccaggattggtttttagacttgccctggggggttggttttaggaatccggggccaaaaaaagggtggaattttttcccccaaaggcaaaggggattttttggtttcccacctttaaaaaggtgttaaaatttggggtcccttttaggtttttaaatttgggcccaagatttttttaaattttttccctaagtttttggattcccccggggaccccggcctaaa

SEQ ID NO: 662358 - DNA, 229 bp, Homo sapiens
aagtatagtagacaaaagctcaactttgtaacacattctgtacttgtatgatgtatgtaacatcctatctttctgaggatatcaatcattaattaaaagttatctgttccctgcctagtctctacctccaagttgttttttccctatttatctttttcttttcttcttcttctttttaatgtatgttttagtctctctctttcaggcttttctacagatgtccactaat

SEQ ID NO: 662359 - DNA, 196 bp, Homo sapiens
  misc_feature (57)..(57): n is a, c, g, or t
  misc_feature (64)..(64): n is a, c, g, or t
  misc_feature (94)..(94): n is a, c, g, or t
  misc_feature (136)..(136): n is a, c, g, or t
  misc_feature (157)..(157): n is a, c, g, or t
ggttggcggcttgtgcagcaatggccaagatcaaggctcggatcttcgcgggagaangaaggangagctgctgaaacagctggacgacctgaangtggagctgtcccagctgcgctcgccttgacaggcgtgcggncttccaagctctctaagatcngagttcgtccggtccattgccctggttctccacagtttt

SEQ ID NO: 662360 - DNA, 1019 bp, Homo sapiens
ttacacaatgggaagaccccagaagtcaaggtcaattaaatgaaaagcccttacctgcaaggcttgggaaatgagattcacagctggactggaattccatacttttgtggaccacaatagaagaactaccacctactatagatccccgcacaggaaaactctgccctagacaatggacctcagatagcctatgctcgggcacttcaaagcaaacgcgcttcagtatttccggcttctggtgtcagccaactggccatgccacagccacatacaagcattacagctgcacaagaaaacacatcgctccgcaggcacttccttatcaacagataatgagccttcagctccccaagcatctgcgcaagcaccctacggctggcgctgcaccttcctaccagcgcaccaccgcaacgcgtcccaccacctcactgcgacgcgctgctacccaccgacgcaactgcgcccccctcccctctcccgccacaccactgaaccctgcttccacaccccaaacttggtactatgcacctggttaatgacactaacttgcatagcgcgcacacgcgcactcacccctaacacttgccacttctcgcccacaattaaacaccccccccgcatactcccttaaccaatccaaatccccaacgaattccaaccctggacaacaagtaaataactataccagctaacatacattctcgtcgcaacgaacttttcaacttttcgcaccctaccatgagcacacatccttcgcgtatccccacatacggagccaaacgcactctctccactcacagcaacccacccgcacgccaccatatccacctccactctctcagcccaacctttccccctaccttaaccgacccgacttaatccaccatgggcaaacaccaaacacatcccccacgccatcgtcgaaacccttcccaaagcagcacacatccatacaaccaaccttccacaactccgtccactccccaaccaccacttccttactacacacacacacttcc

SEQ ID NO: 662361 - DNA, 187 bp, Homo sapiens
acaaatatatgatctaagagggccatacaagttaccacttacttgaaaggacactacttactaggacccatatttgattccaacactttatcaccatacttggctcagcagcagcacgtcatataggtagttactcatggaggcagaagcaggggggaagaaggagggtgtctctctaaaacgcctc

SEQ ID NO: 662362 - DNA, 1459 bp, Homo sapiens
ggggaaataatagggaaggggagagatgggatgaagggggcctacagcgggtcgtctacctgtgtatagcagggtcgttctagcagcgtactctagggagataggcgtaccctagggagccctacaggtacgcccctacccgctgcggggtagctttcctaggcgtcacggccttgacctatttcccgaaggaggagaaggaagtgaaactctacctacttacccccacccggctaggaatagcgagtacaggaagcctaggggctccagcctgctaccggctagcccgggtcggggatggggaggggcgtaggccggagcgcaaagcccaaaaaaaacgacgaaccatgacgacgggaagtggaacacgcgagtgacaaggacacaacaacaaacaacaaaagcggacagaaaaaagcacaacagcacaagaaacaataggaggacaacaaacacacgacaacaccgaggggtacacagacgacagcgacatagaagacaagagaagccagaaggagcaggccaccacacaccggcagcccaggaaacacgacagaaagagaagaaaacaacagcaccagtacacaaagagaggagaaaggagcagggaggagaaagagaaaggagaaggggacacagaaacgccacaccagaagaaagaacaacacgacaggaagcacaacataaagagaagagaaacagacgcaagaaaaacgacagaaggacagagaaggacaagaataagagaagacggtcgacgagcacacgagcacaaacaagacaacaacaaaaggaggaggagagagaagaacgaggaacgaacaaaaaacaaaaaaggaacaacaaacagagagagcagaaaaagagaaagacacagcaacgagcaaaagtaagcaaaggcacagaaaagaaccacaggagaggagagggaagcagacgagacaggaaagcagaacacacagaaccaaggacgggagcaacaagcagaggaagacggggtgaacgagagaataagaaacaacacagcgaggacagaaagaagacaaaggcaagagcaggagagcaagcagaagaagaagtagcagacagcgcgcagagaacagaggagagggagagcaggaaagactacaacggcaagacgaacagacaagaaaaagcaaacgaaaaaacagacgaagacgccgaatgatgaatgacgaagcagacaaaggacagacaaagagcgaaagcgaaaacaacgaagaagagagagaacacaagaaaacagagaacaaagagagacgactacagaaaggaagacgaagagaccgaacaacagggaagaagagagtacgagacacgacacaagaagacgaagagatgaaggaaacgaagagaagaaaagtgaaaagaagcaaaagaagagaggaacaagaccgggggagcggcgagattgataaaacaggacaagcagctgaaa

SEQ ID NO: 662363 - DNA, 87 bp, Homo sapiens
tctctccggtttcggggcgcgtgcgggcggtcgctttcttattcatggattcatagacaaacacacaacaaaactcgctcgcggctc

SEQ ID NO: 662364 - DNA, 1102 bp, Homo sapiens
tttaaaagcaaaaaaaaaaaaaatgcatttatattaacagttttcctctatgaaagtccttacttatatgatacaagcactgtgtttggtgcttaaactcttcagcggggttagcatcaaagttctgggggaaggatcgtatatgtgggtcccttccctagaaagaatggtggctgatatggctacggcttctacatcttgagttttttaaatttactttttttacactgttagcatttgagaacgtgctggactccaagttcgtgggtgcttgtgccagaagtgtattcaattcccattaaatgtgcttgtgtgacgttgggcttaacaattgacagattccacttgggcaaaaacactggcagcttacagtcctggtggttcactaatctggtaatggagtaatgtacacacgtaaaaatggctatgtgaatttatccataatttggcactaatgaagggtatagggtcaaaatacaaagactttcacagatttaagggccctttcttccaacagctttcatagttagcagccattcttaatttcctggatagccaggtttaatcacgcttctagtcaggatgctcgtattccttctaaacaataacggctgactagtgagcacagtctgaattctctccaaaagtcctaaatacttctctagggtaagacactgtggagaatgaagacgggaaggccttgtcaagaacgatttcctgcaaaggggcgatgtcgcaaaagcggtaacaacaacaggaggtctcagacacagaattcagcgccaaccggtacagaaacccgtgaggtagagggaccaggaaacagtgaaaagagcacccactggacacgaacgctcacaaaaacacactgagcgacggcgcacaggaaaaaagagggggataaacctgaacaacctacggacgacacgggacagggaggccgagagcagctaatcgagacatacagatcacgcagggcaacacaacgtggataacgtatgaacgaagaagaaaaacaagacgatagctgtcgagatcacaaacatgagagaaaacagatagacaagagaataacgtctcggcgccgtccctcgtcaacgga

SEQ ID NO: 662365 - DNA, 507 bp, Homo sapiens
tacggcgcagtatgctaggaattcggcttctgcagtccacgcatagaggaggtcagccctaagctggtgtgcagcatgctgcacctctaggtctggaacgcggatagctgcactagaccgttcacgtgactcagccaaaggacggtggcttctgcgaagtgtgcaagaagctggtgggttattaggatcgcaacctggagaaaaacagcaccaagcaggagatcctggctgctcttgagaaaggctgcagcttcctgccagatccttaccagaagcagtgtgatacagttagtggcagagtacgagcccgtgcttgatcgagatcctggtggcggtgatggatccttccttcgtgtgcttcaaatttggagcctgcccctcggcccataagccctatttgggaactgagaagtgtatatggggcccaagctactggtgccagaacacagagacagcagcccagtgcaatgctgtcgagcattgcaaacgccatgcgtggattgccag

SEQ ID NO: 662366 - DNA, 515 bp, Homo sapiens
  misc_feature (19)..(19): n is a, c, g, or t
aaaaagcacaaaggagaangtgaaagacatctgcaacaccctttgaaggccgtggaaaaaccccggcgatattgagcaggtacccgggaacacgaccattatgaccgttggcaagaactgacctacagtgcctcaggtccagcgccatggcgccctccaggaagctcttcgctgggggaaaccggaagatgaacggccggaaagcagaagactgcgggagctcatcgcgactctgaacgcggtcaaggggccggccgacaccgaggcggctcgagctccccctactgcctatatcgactccgaccgcgagaagctagatcccaagaccgccgaggctgggcagaaacgctacaaagcgactaaaggggcctctactggggagaccagccctggcatgaacagactgcggagccacgcgggcggtcctggggcaccaagagagaaggcaagtcgtcggggagtcagaagagccgatggggcaggcggcccatgcactggaagagggacccgggtcc

SEQ ID NO: 662367 - DNA, 384 bp, Homo sapiens
tcaattttattaatttttttaattggatcattctggggtgttcctcgcaaagggggattgggcagtgaagggacctcaatcttgggaggagtcactaaagctctcttcaggccccaagatagggttgggaacaaaacatacccacctcctgctttctgtcttctgtcttcctccagcctttaagtcccagaaaaaaatacccttccaaaaagcttttcccaattccctcaggcccagcttagaagcacttaagcttgggtgtctgggtggtacagaataaaggtggcacatcagctgagcaacacaaggagggtagatgttgtgatcagcccctttttctaggtgcaaaacctgaggtccagagagtttgcggggcctcaccaa

SEQ ID NO: 662368 - DNA, 679 bp, Homo sapiens
ggtgtgctgatgctctcccatctgcgccgggaaaagcccttgggccctgactggcttgtcgcgtctggtgagcgactccctgttcgtcatctgcgctgctgtctcttgctgccgaggcctctgtactcgatcgccaggcgggcgccctccactagcaatctacctggaggccaaggggagcagtgtgtgccaggcggcgagatgggtggcgccatggtcctgctctatgccagccgggtctgctagaatctgacagactggcttgggcccccagagccggttggacaccttcgattacgactggtacaatgtgtctgaccaggcggacctgttgaatgacctggggaacaaaggctacctggtattcggctcatacctcttcgtgtgagggagctactggcccaccaccctgttaggtgtgagcttcttccgggtgcaccggtcccgcacagtgacactgagcaaccacggacacatcctcaatgtggcaaggtctattgccatcattcggtcctacttcttgtgaccgggctgggcgactgtgaagatgagggctgctcctgggagcacagcgcggggtgagagcaccagtatgtacgggcagtctaggctctgggagctggtatggttgccatcgggcgtgatgccgggctggtatggggggcaagcaggagaagac

SEQ ID NO: 662369 - DNA, 121 bp, Homo sapiens
agtactagttctcgtggtctgtagtgacgaatatatatctctaaagagcgcgataatataaaggctcttatttgccccgggtatcttcacagacgactccatgatatgatgcctaaatacc

SEQ ID NO: 662370 - DNA, 172 bp, Homo sapiens
gccggtggtcgcagcatggccggttggccatgtcaccacggtccagttgccactgccatcagtggtttggtcagcatctgcacttgtcaagccagttccatcagcacagctgcgtccaatcactccaagcacatcttgccaagcaccagttcattcaacaccattccatcag

SEQ ID NO: 662371 - DNA, 104 bp, Homo sapiens
atgtgataaagctgcttgtcctctatcatggctgtgtaatattcccactgtgtaggatggacattatataactccctatcatctacagatacggggtatagagg

SEQ ID NO: 662372 - DNA, 908 bp, Homo sapiens
  misc_feature (908)..(908): n is a, c, g, or t
tttccggtatctgccctcttggactgaagtgcccgctgccgggcgcgggcctcagataatacaatggtgggtgaagagaagatgtctctaagaacaaccggctgtcagagtccagggaaaatcctgaggaagatgaagaccagagaaaagccgtgtcaggagggagtcccgtagagacgacctagtaatggtcgaaattgagaggtaaaacaggttgagtagcaaagaagataagagttgacgagcagaggcatgaggaattgaagccagttttgttatgagatggaaggttgggagtcacttgtgatgattttagtgaccgaatctcattgacaaagtcagcatcattagcataattggtgggtgcagctctcacaagcttattctgttcttgaaaggacgagaaaaacaacccatagagcgaaggatttgagagcacctccagaagcaagggaaagatttgtatatgcgaagggaggaatctcgtcgtttagaatgatactggcgttgaaaagtaggagccacaatcaaggaaccaaagtagtaatcacagtggttagagtaggcaccgtaccatcaaatatacatcgtatatagtccgtacaagcagcacctgtgataagtacggacttaagcatttggattaggcaagagggaatggaggtttagggtaggatattagaaagattatcaaggcacattcctttggatacatataagtagacttatatttggggaaaaaagattattcccataaaagcgggttagagtatatagaggaagccatgggttggagaattcaatagtaatcacattagatcgtaaaggaatttaattcagggttatcccctaaatttatatatgggtgatacagagtaaatgtggggaggcgacgttggggttatatn

SEQ ID NO: 662373 - DNA, 550 bp, Homo sapiens
acgtcacctcacctccgtaagactgacggtgaccaacacaagtcaacccgtcatgaccaacacctccatgggacaatgacggaccgaccgccaaagacacatctgacggacacacctaccgcatgacacagaccgcgtgacgcccggacgacccacggacgacggcaggtgtcagacggcgcgacggacacggggaaactgggactctgacaagaaatacccacctacatggcaatgtttcaccgtgcgcaagcgtagcggaggcgggcagaggactactacagatgcaaaatcaccccttctgcacgaaagcctcttagcaaccgggtcagactggtggcagtggagcatcgtcatacttcaggcttgccctactggccctacctcacagctgacaactttcgaaaaggggatggggcaccagccagcatcctccaactcaacaacattctctaatggcgcactccctgagcctcaagaccccttccgagcgtcggctctatccccttccaccctcagcggctgctactctcccgagacctcccgagtg

SEQ ID NO: 662374 - DNA, 320 bp, Homo sapiens
  misc_feature (37)..(37): n is a, c, g, or t
  misc_feature (91)..(91): n is a, c, g, or t
  misc_feature (287)..(287): n is a, c, g, or t
acacactctaaaagtgaccagacaattggaaataaancaatctccaaacaaacacttaaaaacttgaaatcatactaaccacactcttggntcacagtgcaataaaaataggaatcagtactaagaaagtccctgaaaacctataattacacagaaattaaacaacttgacccagaataactttttggtaaataatgaaatcaaggcagaaatcaagaaattctttgaaactaatgagaacaaagatataacataccagaatctgggacacagctaaggtgacaagngggaaatttatagcacttaaacatcaacattaa

SEQ ID NO: 662375 - DNA, 617 bp, Homo sapiens
cagagtgtcggttcatgcacaagagcccctcaccccagtgtcctgatgaaaacgggcattcctcggtgtgggattctggggtgcacagtgctctagaattgctccttcggtggccctggaagcactgtctttatgtgcgtgccttttgctggtgtgtcctctgcctgcccagtgagtgcatgcacacatgatgtgctcgggcccagccccagtatgaatgaacatgcatgagcctctgcacttacaatgggacagacgtgatgtgatgtgccccatgtggattccacgtcccgttcgtctgcccctgaggtgtagcttgtgtcccactccatagctggatgtactgtgcactggtggcccaatttggctctgcggagtgccagttttgtctcccctgtccttccgttgttcctccgcacaaccacaggcccagccttgttgcacccagtttgttctccagtacctatgcacccttgagacccaagcagtccccagcgataggcccacgccagtggactggccgcgggcatcaacgggcctatccgctcactacttcacccttggttccccagttcctccagactttccatgccccatctggtcggtcccctgggcgg

SEQ ID NO: 662376 - DNA, 121 bp, Homo sapiens
ggggcccccccccccctttttttttccccctttaaaaacccggggggggttccccccccgggttttttttttggggggggggggggggtaattttttcccccggaaaccctttttcccttt

SEQ ID NO: 662377 - DNA, 981 bp, Homo sapiens
  misc_feature (2)..(3): n is a, c, g, or t
  misc_feature (7)..(7): n is a, c, g, or t
  misc_feature (25)..(26): n is a, c, g, or t
  misc_feature (31)..(31): n is a, c, g, or t
  misc_feature (36)..(36): n is a, c, g, or t
  misc_feature (38)..(38): n is a, c, g, or t
  misc_feature (42)..(44): n is a, c, g, or t
  misc_feature (57)..(57): n is a, c, g, or t
  misc_feature (109)..(109): n is a, c, g, or t
  misc_feature (115)..(115): n is a, c, g, or t
  misc_feature (131)..(131): n is a, c, g, or t
  misc_feature (134)..(134): n is a, c, g, or t
  misc_feature (180)..(180): n is a, c, g, or t
  misc_feature (182)..(183): n is a, c, g, or t
  misc_feature (194)..(194): n is a, c, g, or t
  misc_feature (198)..(198): n is a, c, g, or t
  misc_feature (279)..(279): n is a, c, g, or t
  misc_feature (298)..(298): n is a, c, g, or t
  misc_feature (339)..(339): n is a, c, g, or t
  misc_feature (355)..(355): n is a, c, g, or t
gnnaaangatttaaatttgaggaanntttgntacangnaatnnnaggagaatttatntactgagcaatatttccctttagaacttcaagatttctacattgaaaatgtnaatatnatttatggacctctgnccnaatggaacatgtactggaagtggataaccagtatcactaacacacncnnaaataactttntcanatttgtggagttaggtggaagccagattttaaaagttgccaacaggagatttaacaggtacagttacccgtttcaatgtanttaagaagggagatgtggnacctttgaattctacatcctgtttctccagaatgagaattngtgtacaaagatattngtattcactttctttaaaaaatccaagtaaaagtgccaaaactacacttctgtaaatctctggcattattcatatgtgtatctatatctgcataatgtcggttaactgtctactaaaatggctactttttcacttgggattgttttggcaacaattttagtctaaacagacatctaaatttccgagacttagaataacattcactaaagttctgataatgtcttttttacatattttcttagtgctttatagtgacttcgattggttctgtgtgttttggcctaaatactagtaacatatcagtgaaaacccctaatttttttctcttcaatgtcactagtcagagaggggctaatttttacactctgaaattgcatctggtacacgggtgtccagctctgtgagctgcgttccctcatcaacaaatcacatgcatctgtctctctcaaactctatacccttgcattcttggacttcccccccaagtgcattaatttggcattgtcagtatccaggtgacatggtcacaccttgtactcgccgtgaagtgcccttatgttgccaatggtaatccctaaataagaacggaggtgcttgccccaccggctcggatttacccacgacaa

SEQ ID NO: 662378 - DNA, 362 bp, Homo sapiens
ccaggagactccaggaagagcatcccaactgccacgcagataaaggccatcaagctacaaatggccttacaaatggaacctcaaatgaatttaactcaagcttctaccgaggaccccaggatcagcccactggtctcttaactggcctagaaagttcccctctggaggacaatacaacagcagggccccatcgtcgcccctaaccagcaggaagtagctagagcagtcatcgcccagttcccaacagcagttggggtgtcctgtttgggggggggactgagaggtgatgccagctgagcttcctgggttgagtaggggcttggaaagctgtaaaactcactcatttcctgcatcaggactta

SEQ ID NO: 662379 - DNA, 487 bp, Homo sapiens
aaaacacgtaacgccatcttctggtgctagccagagactgtccctgttggagacagaccccacccagagctgcactcagacggtgctgatgggccagtgaccagcagagcttaatcaggaagcttcagaagagaggaaggcccagtgacggggttacacctatagtgacacagcattctaaagtgaatgactccaacgaattaggtggactgactaccagtggctctgcagaggtccacaaggcgattacaatttgcagtcccctaaccacagacctgactgcagagctgtctggtggtccaaagaatgtatcagtgcaacctgaaatatcagagggtcttgctactacgcccagcactcaacaagtaaaaagttctgagaaaacccagattgctgtcccccagccagtggttccctcctacagttatgctacccctaccccccaggcctttttccagagcacctcagcaccatacccagttataaa

SEQ ID NO: 662380 - DNA, 681 bp, Homo sapiens
  misc_feature (2)..(2): n is a, c, g, or t
  misc_feature (336)..(336): n is a, c, g, or t
  misc_feature (468)..(468): n is a, c, g, or t
  misc_feature (479)..(479): n is a, c, g, or t
  misc_feature (484)..(484): n is a, c, g, or t
  misc_feature (486)..(486): n is a, c, g, or t
  misc_feature (490)..(490): n is a, c, g, or t
  misc_feature (495)..(495): n is a, c, g, or t
  misc_feature (497)..(497): n is a, c, g, or t
  misc_feature (500)..(502): n is a, c, g, or t
  misc_feature (506)..(508): n is a, c, g, or t
  misc_feature (513)..(513): n is a, c, g, or t
  misc_feature (516)..(519): n is a, c, g, or t
  misc_feature (522)..(522): n is a, c, g, or t
  misc_feature (527)..(527): n is a, c, g, or t
  misc_feature (530)..(530): n is a, c, g, or t
  misc_feature (532)..(532): n is a, c, g, or t
  misc_feature (537)..(537): n is a, c, g, or t
  misc_feature (540)..(540): n is a, c, g, or t
  misc_feature (543)..(543): n is a, c, g, or t
  misc_feature (547)..(548): n is a, c, g, or t
  misc_feature (551)..(551): n is a, c, g, or t
  misc_feature (586)..(586): n is a, c, g, or t
  misc_feature (591)..(591): n is a, c, g, or t
  misc_feature (594)..(594): n is a, c, g, or t
  misc_feature (599)..(599): n is a, c, g, or t
  misc_feature (607)..(607): n is a, c, g, or t
  misc_feature (612)..(612): n is a, c, g, or t
  misc_feature (618)..(618): n is a, c, g, or t
  misc_feature (677)..(677): n is a, c, g, or t
ancccgctggtcttgctgtcgcctttgctctttgggggcttgagaggaaaggcagagggaggaccaacttatctgggagagagaaggcccatctttggggctaagaccaggtggtgcggaagcagatttagggaggggagggcctacttaggggctggaaggggatggggctgcctcctggagtgtggtggtcacagagtgttggctttgtgggagggaaaggaaagggaggcacacaagaagtcaggaagagtggatgggcggtgcttcctgggcactgaacatgtgcactgcccagggcacgagggccaggactaggcatggccagagggtgtncttgagggaattgaaaatgtagaagaggctgatctgaggggggtggcccagccagtcccgggggcccagcagccccatggccagcccaaggcaggctatcttctggccatttcccagctgtgcccgacgcanctgggcatagnagggngngtgncaggncntgnnnaggnnncgggncgnnnntgngtaanggntnagggnggnaangggnnggntataaaagtgtataaaataaggaagataaaaaaanttggnggntaggntggtgggnaaagnaagatnaaggaaaagtgttaagagggtaaaatagatgaggatggtgaatagaatgagggaaagtnaagt

SEQ ID NO: 662381 - DNA, 177 bp, Homo sapiens
acgcgcgtgcatgggaacatggtcgagcttaatagctgtcctcacttggcagtggtcaatacgcgacatgggacctggctgtagtacagctaggacttagtagcaagtgagcacgtcatttccactttcaaaaaaattttttttgggcaaaaaaggaaatccattggatgaacagcg

SEQ ID NO: 662382 - DNA, 158 bp, Homo sapiens
cggaaacacgggatttggttcgtttgctctttgattttcctccctttctatacacacaagaggatccaggcaaatccggtgatcacactgtaaatcctcgccgccgtggaaccttgggcatagtcagccccgtcgccgccgtgatcacagccggtgca

SEQ ID NO: 662383 - DNA, 256 bp, Homo sapiens
  misc_feature (111)..(111): n is a, c, g, or t
  misc_feature (117)..(117): n is a, c, g, or t
  misc_feature (127)..(127): n is a, c, g, or t
ctgaatctgaaccctggtgctggatacacaggcagcggccagctctgagcatctgagagcccggtcatggaagggatagtctcctgctgtgctgtgcctggcagctagagncccagntgtgctaggnagggtgagcagggctcagtgcatttgttctgcagagcaatgcgggagtagtcagtgaagctgaagatgcatatgtgccctgtgatctaggaattccgcttacggaaagacagacttttgatccatgcaa

SEQ ID NO: 662384 - DNA, 439 bp, Homo sapiens
atttaggtgtgctgccagaagaaggcagtgattacaggcccatacaatcagataggacagtgggttttttcttgtgatacaaagtggcccatttctgctgtactcatctcagacttagaaaaataaatttccaaaccttctaataaaaaacacttgtcggccgggcgcggtggctcacgcctgtaatcctagcactttgggaggccgagacgggcggatcacgaggtcaggagatcgagaccatcttggctaacatggtgaaaccccgtttctactaaaaatacaaaaaattagccgggcgtgttggcgggcgcctgtagtcccagctacttgggaggctgaggcaggagaatggcatgaacctgggaggcggagcttgcagtgagccgagatcgcgccactgcactccaacctgggagacacagcgagactccgtctc

SEQ ID NO: 662385 - DNA, 282 bp, Homo sapiens
cgacgagtatcgcggggcagagtatgtgcaaacatggaacatagctgacgggattgacttgtccatgatcgtgttcaaacgttcaaacggcgagccgattcatccgaccacggttcgaccttgatggaaagtagtagcgattcccgcccatgtggcgggaaaggcgctgttttctttttcattcgtcaaaaatggaccttccccaaaaggtgtacgtgacttttagaaaaacaaacatgatagaagtttcgctcaatcgatttgaatgatctcccacctacg

SEQ ID NO: 662386 - DNA, 194 bp, Homo sapiens
tgctgtcctgaggattccacggtgggaggacagtggggaatggggtgacgagaagctactcactaccccaagtaaccattgcgtatttatggtagggccaggtgcatgcccatattgatatgacagggtctcactgtgttgcccaagctggacgtgaactcctgggctccagccatcctactgtcccagccata

SEQ ID NO: 662387 - DNA, 665 bp, Homo sapiens
ggccgcgggatgtctccagagggaagatgggggatctgtaggaatagaatgtctgatgaagataaggtgtgtatagacaccgaaagtactatcattcaatgcgcctctctggtagcagattaattatgaggattagctagtgactgtacggtgtgtactgggtccaagtaatgacgaatccttcatcgagggaatcgagcaggccgcatgcgatttctcgcacagttactcaccttggcaccagtttcacatctcacggttgaaacattgaaggggtttattcgatatagatcaatggtagttcgactgaccaggacacgcatgtggttgacttttggcggaagagtgagaacaaggtattggagggaatctcaagagaaaggagatggatgcggtgtgttacacattgttgactacatctataggcgaaagagtagtgcttgactgactctgaagaagccatgtgtaagctagtagaaaagtggcagggctggagagtccgatgtgaagaaaactctccagttaggatgagctgagtgcaggaagtagctgtacgtaagaaagaaagcgttttagaccgaatattggtaagatctgacatgtgttgatactgtgcgatagacaatagtatgggacagacgaaatgagtattgcgtgcgatagag

SEQ ID NO: 662388 - DNA, 861 bp, Homo sapiens
ggcacccggccgaaagccgctgtcgggagccggcgtggggctgacgcaggtgcactgacatgggtgaaccccaggatcatgcggattctagtgacagggggctctgggctgtaggcaaacgccatccagaaggtgtgtagcagatggagctgacttcctggagaggactggtgtggtctcctctaaagaggccgatctcacggatacagcaagaccggcgcctgtttgagaggtcaacccaacacgtcatcatcttgctgcatggtggggggcctgttccgggatatcaacatacacttgtgacttctggaggaaacacaggtgcacatgaacgacaaggtcttgcactcggcctttggaggtgggcgcccgcagggtggtgtctgcctgtccactgtatcttccctgacaagatgacctacccgatagatgagaccatgatcaacatggctcccaaaaaagccattggggtactcgtatgcaagaggattgctcgaggtgcaagacacgggcctactttccagcaagtacggtggcaccttcacccgcgtgtattcccaaacaaatgtcttcgcggcccccacgaagcactttcaccatcagaggattggccagtggtggctgggctcatcacaggtggcaccttggcaagacaaagcgggtcggccttgggggtggggacagggaatccggggaggaggcaaatactcgtggactggccaggcttatcagggcgccggaggaaacagaggggaggcaccatcttccggggaagaaaagaggctccacaaggagaccacggagagagggcagagcacagggagccttgtgaaacacgcgtgggtagaaaaccacacagag

SEQ ID NO: 662389 - DNA, 848 bp, Homo sapiens
agcgtgtacacatgtgcggaagaacgattcaaggacgccgttgagtttcttaagaaatcacatgcggacaccgatagagtggcatagatcggtgggccagaagcaaagactgctagcctacaggctatggcagcaggtagtccaacgacggagtcaacggagggtcgtccaggtgcacgcgggccgcagagcatcatgccatcgtccgttacgaagagagtcatgcagtggcttatgtggcgttccgtatttcggcagaataatagaaagtgctaatttgagcgacctgacaaaggtgcgaaaaccaacatgaaactgctttctgagtcaccagcagcgcgcagacaggactctctcgacaaggagggaactgccagatcctcgagggaggacgtaccatgacaggtgtgtacaagcgttgtagaccataaatctctaccctgagaacgtggaagaaagccttgtcaaggatggctaattccctacagtgatcggatctcggtttggacgcaatgcgttgccagtgacgtgtggacagcctttgtggcgttatccaccaaaggcgaaagaacacggtatgcacaataatatgacgctaaacgcaacgcttgtaaaggggtacacctacagacggaggctagaaggacaaaagggtgaatgcagagcccggaacgaaacccggaacaggaaattgcagatggatttccctggagcatagggtgaagacatatgggaaggcaccgaggcgagaataaaaaggggacaggtatgatggcgcacaagcacacttcatcaggcaaaagaacgaaacggaaggcaaagttgccaaaaaaccaacagtcggcaac

SEQ ID NO: 662390 - DNA, 1127 bp, Homo sapiens
gtagatctgaaggcaatccatgtactttaatgactgatggaagattacaatcaatggatgggcagcaaaccattcagtccttgtaagtctagtcagacagcaacacatcaagcacgtttcggaagggggaataaatcccagtttgagatatctcaagttttaataatagtaggatggacatagtacgcacacaacatccagtagcacaactggcaacgtgtgacctggcatagaggtgaccataatctgaagtcatggcgagtgacacaattgcctctacaggaacaacacgcagagactgaatctcagaacaggactggatggacgaactcgcagtagcagaagaaacagacacatggtcgcacttccggcagcaaacagcacgaaggagtgtcaggaccaggcagcggctccaagaaccgaaaggctgcacgcagaaaccacgcaagacaagatcaaggacagactcttcaagtctatggtgtcgtttcccgagtgctcaacgactacagcatgcaagagtggaatatcaacatgcacaagagattaaggagcaagccagtccataacagagtcacaatgtatgcgacttcttctatagcgcacacgcagagaccagacatagcgattggacctccttgacagctacaacccggaacgaaatggtacaagctctctagcaatcgactactagccacatttaggacacgtccgctcacaacagccgacctcatatctggcgcttaagagctacataactgagcatttagagatacatttgcaacaagtgatctaggatttcaatcttgatatatgagaacagctgatgacaacttaatagatgagtagatctcaagagtgtaaacagtacctccagccgctatgtcgatgtagtaagtctcctgcatacgagctagtcgacgctctcctgcatgctcgtgcgtagacgccgcaaagcacgagccggctgcactaccagcggcgagcatcacggtgctctctaccgctcgattgctacgccgcacggtgccacatctataaatagcggtgagcgcctccgaagagcgcatctcttcactgatatagcaggacgatagaatatatacagagaacgcgacagaatcacg

SEQ ID NO: 662391 - DNA, 623 bp, Homo sapiens
attatacattattttttttactaactcttttcttttcctttatttctcttttttgcggggagaaaaaaaccatttattgccaaaaaaaaggcggacgccaaacaccatatcaaaaacccccacggagcaattaaaagacaccctccggctaaaaaaaaaaccacctgaaacccaaatgggggcagctcggtcccaagctcccaaaaacacttcaaaagttaacacccacccctcccccccttataaaaagagggctaccttccctctctcaattaaaaaaaaaaacaacgcaccccacaaaaaaacaccctcctaacccctctcacaaacggccctccaaataccagcaaacactctagagcgaccccacaaacacatactccaaaaaaagaccacctaactgttctcccataccaaaacccatctaacgtcaatacaacgcggaggaaacaacaaatccctgggcaccattctacacttccacacaacaggcatggccccaaaaccacaacactactacctccttccaatcatcccacacctcagtcaacacagcagaacttcaccagaccaccaacaacaccgccggcctctccccaacaaaacaacaacacacctccccg

SEQ ID NO: 662392 - DNA, 672 bp, Homo sapiens
tcccctaaaagtcatatagtttggcctacccaccaacagtgattgacagtgtgtctccctatagccttgcctaacagaaatgtgtcgtcctttcctatcaccagactgagagatgataaatggtatctcagaattatctcaataaacattcctctaatgagttagtttgaatatttcaatttaaagcgccattttaatatattaacgtgagtatgtttatgtcatttcccagtttttctatcaagttgttggtcctttgtcccttaatttctaattccttatatagtaagaacactagctgtttgtctattatataggctggataaatttttctcccagtcatttgatttaaaggtgtttcttgtgtcctcatgtaaagtgtacatgctgctggtagaaagatcacctcttcaaaactttctggagtggatttcttagagaaagatcttacactgcagttgggtttagtgcaccagttaagaaggatgtgatgactgtgttcccacttaggtgcactggatagtctccatgctcttttttgctatttcaacatcaacattattgtgatcgctcgtgtgcaactttgatttgtcggcggtgctaccacgttgtattcctcctacggctttgggcctccttttttccagggagacccggggcccggtcgtctgc

SEQ ID NO: 662393 - DNA, 217 bp, Homo sapiens
actccacactctctctccacaccggcttttaacactctctctcctcactcctctctccacactggctctctccacactggacctacttcagaatggcctggctttaccaaaggtgatataccactagaaaatgagggtcttgatacaactctagacatggactatgtccggttgtacagttactcccgtcactcttcttttactaaatatgcatgta

SEQ ID NO: 662394 - DNA, 1103 bp, Homo sapiens
  misc_feature (91)..(91): n is a, c, g, or t
  misc_feature (417)..(417): n is a, c, g, or t
  misc_feature (437)..(437): n is a, c, g, or t
  misc_feature (440)..(440): n is a, c, g, or t
  misc_feature (446)..(446): n is a, c, g, or t
  misc_feature (451)..(451): n is a, c, g, or t
  misc_feature (457)..(458): n is a, c, g, or t
  misc_feature (464)..(464): n is a, c, g, or t
  misc_feature (469)..(472): n is a, c, g, or t
  misc_feature (552)..(552): n is a, c, g, or t
  misc_feature (554)..(556): n is a, c, g, or t
  misc_feature (568)..(568): n is a, c, g, or t
  misc_feature (603)..(603): n is a, c, g, or t
  misc_feature (621)..(621): n is a, c, g, or t
  misc_feature (627)..(628): n is a, c, g, or t
  misc_feature (630)..(630): n is a, c, g, or t
  misc_feature (647)..(647): n is a, c, g, or t
  misc_feature (653)..(654): n is a, c, g, or t
  misc_feature (658)..(658): n is a, c, g, or t
  misc_feature (677)..(677): n is a, c, g, or t
  misc_feature (680)..(681): n is a, c, g, or t
  misc_feature (683)..(684): n is a, c, g, or t
  misc_feature (704)..(704): n is a, c, g, or t
  misc_feature (706)..(707): n is a, c, g, or t
  misc_feature (709)..(709): n is a, c, g, or t
  misc_feature (713)..(713): n is a, c, g, or t
  misc_feature (728)..(728): n is a, c, g, or t
  misc_feature (730)..(730): n is a, c, g, or t
  misc_feature (736)..(736): n is a, c, g, or t
  misc_feature (740)..(740): n is a, c, g, or t
  misc_feature (744)..(744): n is a, c, g, or t
  misc_feature (753)..(753): n is a, c, g, or t
  misc_feature (757)..(757): n is a, c, g, or t
  misc_feature (763)..(763): n is a, c, g, or t
  misc_feature (769)..(769): n is a, c, g, or t
  misc_feature (772)..(773): n is a, c, g, or t
aggtgatcttagagcgaacatggttataggcggaccaccacgcccacaacggacacccaccataaggcataagccaaagtaacatacccgncgaatgtaggacaagaagctctctctcagacaaccatctcatgggccccattccaggacacttctgagtacatcatttcatgtcatcctgttggcactgatgaagaacccttacagttcagggttcctggaacttctaccaatgccactctgacaggcctcaccagaggtgccacctacaacatcatggtggaggcactggaagaccagcagaggcataaggttcggtaagaggttgttaccgtgggcaactctgtcaacgaaggcttgaaccaacctacggatgactcgtgctttgacccctacacagtttcccgttatgccgtnggagatgagtgggaacgaangtntgaatnaggcnttctgnngtgccngtgcnnnngctttggaagtggtcatttcagatgtgattcatctagatggtgccatgacaatggtgtgaactacaagattggagagaantnnnaccgtcggggantggccagatgatgagctgcacatgtcttgggaacnggacataccacgtagganaacagnngnagaaggaatatctcggngccatnngctnctgcacatgctttggaggncanngnngctggcgctgtgacaactgncnnanaccngggggtgacccagtncngaggcnctantggncatcctacnccgnattctnagagtnccnncagagaacaaacgctaatgttaattgctcaattgagtgcttcatgcctttagatgtacaggctgacagagatgattcctgagagtcaatcatcttttcaatttagaggaacaagcatgtctatctgccgagatccatgtaaactggactgatgttagcagacccagcttagagctcttctttctatgttaagccattcgatctgcaggaagttcttcagcttcagattaactcacagcttctccaagcacactcatgggagttatctgagggttatctcataaatgagggctgcacattgccttgattgtatgcagtattcaatacctgt

SEQ ID NO: 662395 - DNA, 886 bp, Homo sapiens
gaggttttgttaaaagactatcttgcttaataaatgacaacttgttaacagattcacacattacaagtaggacagtataacaggagattggtgtgtgaatgctacaaaacagtcagcaaaaggaatcatgtttgcttgtgacaacttcagaaggtaccctgaaagttcattttcctaaagctaagtgcatgttgaattctttttcttggaattgtgcagaataattggattgagggcaacatatttcgaggagtagccaggtggaatggtcatacatgactacagaggaaaattatcttggcaatattcgcaagggaaggaggaaacaaagttttttctttcttaccacgttttatttggttggactaaattggggtcacaatttggctggtggaaccttaattcaagaagaatcctgcttttgctggccccaggggccaaaaggaacttgggttaactggaggttccttcaaaaagcggttttacacttataattcagaattaacgttatggaagtgtgccttagatgtattgtcactccataccttttccagttctttattcttaaattaaccccatttttactttctggaaataattcatctgggtagtggctttatgaccagctttaaatttcaatttgaggaataataacaaagcctagagattcataggaaaagagcattgaaatacatgataggcataaagataactagaagcatcttaccagccttaggggttgaactggaatttctgtgaaataaattggattgtagatactaatttattttagaatggttaaatacttaagaagaatgttctcagtttcaaaagattacaatagggaggagtatacgttaaaagagctaatagatgggaagatata

SEQ ID NO: 662396 - DNA, 186 bp, Homo sapiens
agaggctccccacaatttcaaaatgtcagatcagagatctttggcgattaatccacgtctccattttatgcgtgggacaaccaaggccctgactgttgtccctggcccaagtccagtgcctttcacatttgaggcttttggctcttcccctctgaggtggggcagtgcatcactgtggtggaaggg

SEQ ID NO: 662397 - DNA, 807 bp, Homo sapiens
taaacttaggctaggtacgaggcctgggtgtcacagcccatgaccctaactagggccctctcagccctcctaatgacctccggcctagccatgtgatttcacttccactccataacgctcctcatactaggcctagctaaccaacacactaaccatataccaatgatggcgcgatgtaacacgaaaacagcacataccaaggccaccacacaccagctgtccaaaaaggccttcgatacgggataatcctatttattacctcagaagtcttgtttcttcgcaggatttcttctgagccttttaccacgtccagcctagcccctatcccccaatcaggagtggcacgtggtccccaacaggcgatcgacccgcgactaatatccccttagaaaggtccctactccgtaagagcacgatccagtattactcgacatccgtgagtatcaatcatcgctgagctcgccatagtctaagtagaaaacaacctgaaagccaaataagttcaagcatctgcttattacaaatgttactgggtctctatattaccctcctacgagcctcagagtacttcgagtcgtccctgtcaccatcttccgagcggcatctaacggctcaacgattctttggtagccacgaggcttccacggacttcacgtccttatcggctcaactttacctcactatctgcttcatccgtcaactaatatttcactttacatcccaaggatcactttggcttcgaagcgcgcctgatatgcattggtggagatggttggactatctggtgtctcctccatgataggctaa

SEQ ID NO: 662398 - DNA, 416 bp, Homo sapiens
aaatccgagcagcgatctgctcacaaaaggtgatctataggcgtattgcaacacgcatgaaggtaaattgctggacaaaggaattcatccattgactcagtcggattcactggacgggcacagtgctatcacttggaacaccctgttgattctgaaaggtgtcagcaagttaccatttgctgtgagcaatccgtatcctctgctactggtgaacattggtgcaggggttagcatcctcacagtactagttccaacgataaatacagagggggtcacaggtactagtcttggaggagagaacgttctgcggtctcgtgctgtctgcttatcgggcccggcgttatacagaagaagctcttgaaatggcatctcgtggagatagcaccaaagtggataacctagtacggtgtcgctat

SEQ ID NO: 662399 - DNA, 110 bp, Homo sapiens
  misc_feature (2)..(2): n is a, c, g, or t
cnggagatcagtaagcggagcattagtaagcggagctcaacacaacatacccccagcaggcgtgaccgctccgcttactgatgctccgtaactgatgctccgcttactga

SEQ ID NO: 662400 - DNA, 1610 bp, Homo sapiens
tctggtttcacccttttttttttgtgtttgtgaacttctcccattgttttaaaaattttgtagaaaaaaactccctgtggagtataaacaatctcccttagaagcacgtgacattgtgcgtggtggctccagaggtttcaccaggaaacaggtgccgtgtgtgccctgtgccaaatgtgggggggttctcctttataagcccttctgtggtgtgaatgaaaggtgtgttctcgaggggaaagagagagaggacactgggagggcgccccgtgaaagagagacaccccagccacatgtgtgtgtgtgccacacctctgtggccctctctgtgtctctcgtgtgtgtgtctcacaggaggtgagatacgcaaatactatctctgtgtgggagagtgcgcgccccccttctctctcacaccacagcgcgctctgtggagagcgccgggggtctgtgtgagacgcctgtgcgcccccttctcgagggggcgcccttgtgcgttttttctcagcagcggtgtgatgaccccccctgtgttgtggcaccagagagaatgtgtcgtgtctgtggcagagtataacgcccccggtttgagacccacacactatctcctcaagatagtcttcttctgtctccctatttctctcacagagccaacagcatagtgtcttcatatgagagagagtctcacagctgtgtagtatgcggctctcccgcagcgctgctactctctctcccaactctgtgttgtctcatctctcagaggagaaatcgcccacatttcttttgagagacacatgttgttctcttttgcgaccccaccaccagagatgagaccccccccattttctgcggcccattgttgtgtgtgagaggtggctccccccctgaatatagaggaagggtgctctcttccccccccaaatcgcagcgcagcattttttgcccccccttttgtgcggcgtatagtggcgcgctcctctccaaagagtcttttgtcttgtgcgggcaccctgcttttactacccccgcagacgaggtggtctctctccgtccaaccgaccccacccaagagggaaccgtgcgctgtgtctttccctgctgctgcggttgcaggaccaccgtgggcttggcttgtgtcttctcttctcccggctgtgttgtggcccccctttaataaaatatcctccccccctttgaggggagagtaaaaacaaacccccgattcctcgttttcagtcttcttgtaaccgaagctctcttcctcagtcgtgcgttaccgcttcttacgaaccccagcgaagattgttttgttctcacattattctacgccggggtgttgggcgaccaccaccactttttcccaccactactacgggtcggcgagtaaataacatgtttgctcttcccccgagggaagtattattatctcccctcaaatgggtcccccgcgcagacacacatcatctttcatcaacccgggggcgcaacagtgtgttgcatacctatgtgcgaacccacaccgctgtttgttgctacacccacaaagcgagcgtgcataattaatctccactcgctaccgagacgagtattgtacgtcgtgtgaggcatcc

SEQ ID NO: 662401 - DNA, 107 bp, Homo sapiens
tacccgggtatcccacccaaagaaatgaagctggatggagtcagcacaacatctctacccgtggggctggactattaaaacacagtgacttcctctgcctgcctcac

SEQ ID NO: 662402 - DNA, 272 bp, Homo sapiens
gcagtttcgacggtatgactctccttacttgagtaggtgtctcctactatgccaaaactcagagagtaagtcagaagtacaacctcccaaggttgaaaactagagctggcacgtattacatggtctgtagatgtttataggtgtgctggatgagtgaaggaatgagtgagtgagtgaatccaggatcgatctggaaacacaccagggctcagacctcttgggctaagtgccagtctcagtcctcttgggctgtgtaacaccaaagagaacac

SEQ ID NO: 662403 - DNA, 154 bp, Homo sapiens
  misc_feature (13)..(13): n is a, c, g, or t
aggatccttgtgngagacggggtctcaggtgatcatatctcaaggtaagggcacgattgccaggacaggcggaaggtccaaagcagctcttgcccagccctaccccagcacagccctggaaagtgcacagtcacgaaagcacagcaccttggtt

SEQ ID NO: 662404 - DNA, 273 bp, Homo sapiens
ctactgacttcaagtgatctacgacctcggctcccaatgtgctgggattataggcatgagccactgcagccacccagacgtgaatactcctcatttttttctctggcctgatttccttggcctgaacttccaatcctatgttgaataagagtgatgagagaggacatccttgtactgtgacagttttcaaggagaatgcttcctgctttggcgcattcagtatgatactggctgtgggtttgtcataaatagctcttattatttcgagatatg

SEQ ID NO: 662405 - DNA, 223 bp, Homo sapiens
  misc_feature (68)..(68): n is a, c, g, or t
  misc_feature (71)..(71): n is a, c, g, or t
  misc_feature (77)..(77): n is a, c, g, or t
tgggtcgttcttatccaacatcgaggtcgtaaaccctattgttgatatggactctagaataggattanggnggaatntgaagtagatagaaaccgacctggattactccggtctgctaagacttcaccagtcaaagcgaacgttgatcactcgatccttcaataactggtgcaacggaacaaggtaccctatcaacatcgaggtcgtaaaccctattgttgat

SEQ ID NO: 662406 - DNA, 802 bp, Homo sapiens
  misc_feature (468)..(468): n is a, c, g, or t
  misc_feature (503)..(503): n is a, c, g, or t
agcggaaccttctcctctctgagtgacctggcgttgggcatgtcccagcttcgtacgggtgactgaaagtccacatcgacgtaacagtctgaaatgggaaagcacgcggagagccacccggatacccgccccacggcgtttccaatacgttctccgtcctggcgtgctgcgttgtcctgcgtgctcgtgtctcatcgtctgacggtgcgacggtcgatgccttcgaagtctgatctagaagcgctccgatcgtgctggatcactcatctcaatgcaaagcccaatcgaatcggtatataattagattgcgaacacacatgcccgtcacactgagaacgtccagttgcacgagaacttattgcgtacatcactacgttagtattgccttggcgtccctatgttaaagttacttgggaggtctgcgaggttgcgagacgttgtagccgagtacatggcttggacttcttnaccatggaagagcaagaccttacttgcaagactancttttgttgcagaagtactaacttcatattgcgacactccgcttttgtcccgctgtggatgggaacgttgtttcgaaccctgcgaggtaccgcctaccaggtacttgagtggacttaaagaggcgtggtcgcccaatagagtgagtatatttggtcaacattttgttcgcaattaacgaggacgctttttttgcattgagtcgcgaagccacccttaactgttgttcccttgcttggtgccggggctaccgagttgccaccttggggaatttcgccaaacgaagcctttgtccaacttg

SEQ ID NO: 662407 - DNA, 239 bp, Homo sapiens
gcataaaatttgtttgtcaaagttcatcccttcatgataaaaattctcaacaaattaggtacagaatgaatgtacctcaatacagtaaaagacatatatgacaatcctacagctaacaccatactaaatggtgaatagttgaaaatatttcctccaaaatcagggataagacaaggatgtccatttttaacacttctgtttaacatagtactggaagttttatccagagaaattattca

SEQ ID NO: 662408 - DNA, 302 bp, Homo sapiens
gcgtcgacaccggttgctgatgcaagcgatgtgcaagtcgacaacgtcgggcgcacgataccggtcgagttgattgcgaatgtcgatgagtgcttgcacgacgtgagatcaacgtagttgacagcgctgaagtcgagaatgatggccttgacggtcggcagatcctcttttccagcgttgaggttgatgttgcctgctgctgctttcttgagctgacgcttggtggggcccggatcgttccaaggccggtcaccagggtcgaggtaggatgtgaggtttgtgcgtcaggtctggctgaaaat

SEQ ID NO: 662409 - DNA, 158 bp, Homo sapiens
ttttccccccccccccccccccccccggggtttttgtttttgggaaaccccttgggaaaatttccccccccccgggttttttttttggcccaaggggaaccccaaaaagggggggccctttttttttttccggggaaaaaaagggttttttcccttta

SEQ ID NO: 662410 - DNA, 1000 bp, Homo sapiens
ctctgtgtgtgcgcccccataatggcagctgatgtcgcccttttccgtatatcaactataaatttttccccttattcttttttatttttgggaacggagtcttgctctgtcacccaggctggagtgcagtggttcaatatgggctacatcgcaacctccgcctcccgggttcgagacagtactccctgcttccaagaagtctcctgagatagctgggattataggacacccaccacccacagcatctgtggataaaatcgtgtacttttctctgtagagacggggttctcaccatgttgcccagagtggcgtcattgaactccatgagttcaggaccaatccgcccacctcagccctcccaaagtgatagattacaggcctttatctttaaacctaaacttgtcctaggactgtccttgataacgtgtgaaatcacagtcaatatatctttacctatacaataacatatttcaattcaccataaactcttcttctctccgtagtatctattagtctctctctctctctccagtggccaccagatatacgaacagtcacatctgtgtgtatagcatggtgtaagagtatagcacaaggtaccttgacaaactggttgtactccctaaaaatgctcgcaggatcagccaatggcccaggttaagttatcctgccagaagcgtgtgtacccacaggggagagaagtcgtctagacagtcctgatgacaatcatttagcaacatacatcaagtgggataggaagtagcccaccacacaagggcgtgaggcgaaaacatgggcacaagattagaaccgggccaaccatagcaagaacagctgaaaggaggggaagacaaccagggtcggactacaaagagaccaccccactccagggatataggttacacgacagaagcaacacaacagagaagttcaggaagacaaaaccaatagatgcacggagagggcggccacgcaccacgcaagggaagtctcaccggat

SEQ ID NO: 662411 - DNA, 331 bp, Homo sapiens
  misc_feature (64)..(64): n is a, c, g, or t
  misc_feature (66)..(67): n is a, c, g, or t
aaaaaacatggttggaaccacttttctcaataagaaactttgtataggccggccgtggtggctnanncctgtaatcccagcacttttggaggccgaggcgggcggatcacaaggtcaggagttcaagaccagcctgaccaatacagtgaaaccccgtctctacttaaaatacaaaaacaaaattagcttgggcgtggtggcgcatgcctgtaatcccagctactcgagaggctgaggcaggagaactgcttgaacccgggtggcggaggttgcagtgagcctagatcgctccactgcactccagcctgggtgacagagcgagactctgctc

SEQ ID NO: 662412 - DNA, 136 bp, Homo sapiens
gcggccgcctactactactactactactgctcgaattcaagcttctaacgatgtacggggacatgcctagctggattgcagagttaagtttatgattatgaaataaaaactaaataacaattgccaaaaaaaaaaa

SEQ ID NO: 662413 - DNA, 272 bp, Homo sapiens
  misc_feature (195)..(195): n is a, c, g, or t
tccccagcaactatgggtcgacagtcaggccaggggttgcacaatgtgggtactttccgtgagcaactcataagggtagttgggcaatttctagcatctgatgcacagtgggcaaacagtactgccatgcattcttcagcgcaccaggctccttctccctccagcagaaaactgccccctcatagagctgggtancaagggcaagccccgaaggcgaaactgcaaccatccgccagccagctccaggctgcccatggaccgctcagttttca

SEQ ID NO: 662414 - DNA, 119 bp, Homo sapiens
atatctctagaacctaagcccttaactgaacccatcttataccacaatcaaacacccaaggtcatcaaataggataaaagaatgaaagaagaaaatagccaaaggacagcaactttaaa

SEQ ID NO: 662415 - DNA, 87 bp, Homo sapiens
ttttttcaacccccccccccccccccctttgtgggtgggggtttcccctgtgtgtcccgggccaataaaattttcctgcccctgcca

SEQ ID NO: 662416 - DNA, 396 bp, Homo sapiens
gaatgcatccaattgcctgccttcatgctcgtggacatacaggcgctggttcctgcacggggtctaccagtgaagccagtggtctgcctgcgcctccagcaggagcgcagccgttgtggctctacagcaggccccggcgcatggcctcgtagatggacaccttctccttggtgtcctccaggtagatgccggcgaggcagccactgccctgcagcagctgtcctgcactggagcccagctccgaaaggtccttgaccgtcgtcttgccgtccttgagctgctcaaactgggccctgctgaggaccctgcggtgttggatgcagtcgactgcaacatattcacagcaaaagaatcccggttgctgtcgtgatgtgaacccagcaccagttcttgctg

SEQ ID NO: 662417 - DNA, 1038 bp, Homo sapiens
catctgaacatcacaagcccacgtagatccgatgtctcacgcgcccctggaaagccgtggcgagaccgcgcagaactggaattacgaccaaccgcgcgttgcttcacccgcgtggggcgaagaaaaaaagtcaacgggaaatcgaagtgaaccggtgtctccatacgaggattagaagcgtaaaaaagaacgggtccaaaaggctatccaagaacgtctagtagagaaaatatagaaccgtgcactttggtaagaccctccaagagcattcatccaagtttcagttgtgcaggtgtgatggttattatagatatttaaagtatagcaagcggctgtgacacaggagagacctgctgttttacttactgtactgaagggtatactgctgcccgcgctagttaaatcagcattggtcctttcctgtcggcatgatcaattgcggtaccggtagcttcctgctcgtgatcatgtttacctaatttgtgtcaatgtacatctgtagtaagccacatgtgaaagtgcctttctattgttagaggagttttagccactgctcttgtaccgttgccaccgactctgtggccccacccccaccctccctcgctgcccgaattcctgcctgcccactcgagtgtttcgaagcttgccttccctgtcccccaccttccccatcaccgccttcctgtgcctcggtgctcagtaattgtccacatccttcaccaatccctgtcggtcctcagactgtctgcgtgtttccatatgtagacgttgattgtgcctttctcacccctgtgtcctcccatcccaccgcatccgtcccccgctcatgtgctgccatgacagcatcgcattcgcccgtgctctgtactgcctctcaccatttcattccctcctctctgaggtgaaaataaagggggatgcttttacagtctggaaagaaaaaaaatgttttgttaatctgttgtgacaatgcacttttatgtatagtactgtacatttttggcatgtaccattaacaggcttcggagtatacagtca

SEQ ID NO: 662418 - DNA, 83 bp, Homo sapiens
tgctgggcctgctggaggagctggcctggaacctgcccccgggacccttcagccccgctcccgaccttctcggagatggcttc

SEQ ID NO: 662419 - DNA, 169 bp, Homo sapiens
agggtaggcgccgggcgtctgcgatgttcttcgagaaagcgcatcccgcccctcacgcgtcagatggccaggcagggcgaggtggcgccgcagcacatcgaagaaccggcggtccgctctggccgcccacaagccgatcgcgtgggcgacggcccaccacagaaggccg

SEQ ID NO: 662420 - DNA, 140 bp, Homo sapiens
gtgtctccttctacatccggctctgcgccggctgccacccggcggttccctcggcggcggccggcctttgcttgcttgcttcaaagctgctgccggcccctttggggttaaaaagggttttcaaaattggaacgattttg

SEQ ID NO: 662421 - DNA, 323 bp, Homo sapiens
attgcccactgcaaacgccgcccggactcgtcgttggggcacaggaaactgtccttgtcggaatcgaaggcggcggtttcgtcgaaattcaggtcgcgcacgtcatagatcgacagcttgtcgtcgagactcaggctgtaggcgtgtcgaatttcatggggctcgggtccgtgagaggtttcgctattaatagcgggatattgcgcaaatatcagcagaaatcacgtacgcaccgtcacccgccggccactcaagaaacacagggtaccgcccactgccgtcagcccgctcaatacatagaacatcgaggcgggcggtcgacg

SEQ ID NO: 662422 - DNA, 286 bp, Homo sapiens
atttacctggcttcaggagttggctagctcaagtggccaaggttgagaaaagatgcaaaggaattaaaccctaagatccttctttaaaaccagcaatcaatgaaatcactccaggtgaaggttctagaacctagatcagtggtttgcctggctttcggattgtaaggaccctaacgttcactgctcttccctccaaactggagaaccagcaaagggctgacaatttttttaatgtcatatcagggcgttaaaggaaaaaaaacccccaaccccattcagcctctgt

SEQ ID NO: 662423 - DNA, 122 bp, Homo sapiens
cctcctcagcctcccaagtaggtggggctacaggtgtgcaccaccacacccagccaattttttttttcattttgggtagacagggggtctggctatgtggcccacgctagtctcaaaccccg

SEQ ID NO: 662424 - DNA, 343 bp, Homo sapiens
  misc_feature (201)..(201): n is a, c, g, or t
  misc_feature (224)..(224): n is a, c, g, or t
gggtgctctagaggatcgcggcgagtgcatggtggggaggctcaggaaacttacataatggtgggaggtgaaggagaagcaaggtgtcttctttacaaggtggcaggaaggagaagggctgagtgaagggggaagagcgcttataaaaacatcagatcttgtgagaactcagtatcatgagaacagcatggggtaaactgnccccataattcaattacctccanctggtctctacctttgacacgtgggggatgataggcattatggggtttacaattcatgatgagatttgggtgggaagacaaagcctacccatatcaatggctcactgcagccttcaatc

SEQ ID NO: 662425 - DNA, 305 bp, Homo sapiens
aagaagctccggcaactccagaggctccgacaaaattttgggttgagcctggctttcctctccagcaagggtttcgcttaagccccaagggcatcgggactggtgactcacctatgaatgggggccgggaagacaggacacacaaaaaatgagtttgtgggccacccttaagccccgcgcccaattttcgcgggcccaaaaaagcccgccgcagcctcccccattttgcagccaggggagccattcacacaatccccttttgttaattctatctgcaacatcaattaaattgtttgtagaaacta

SEQ ID NO: 662426 - DNA, 163 bp, Homo sapiens
attggaaaaaagataatataacaatggactagaaataggtgagcaatctgttatagggattgtgtgattgacttgtatgatagtcgatgctagtgggtagtaacttatcatactcctaccatatttagattcatacatggctatattatatagttatatagtt

SEQ ID NO: 662427 - DNA, 221 bp, Homo sapiens
gggctcgcaccgttagtagtcaaaagtataggcgctagaattgagagctggcgcaatagatatagtgagcgcaagggaaagatgaggacagattatagacgcaagtgataatatagcaaggactaacccctataccttctgcataactgaattaactagcaaataactttgcaagagagagccacaagctaagagccccagaaaccgagacgaagctacgc

SEQ ID NO: 662428 - DNA, 917 bp, Homo sapiens
ggctggagccagcggtgacctaaactggtgataattgttgcgtcccacctctctccctagtaggtgacctcatacagacaatgctttcgtgctcctacagcatcctggttgtatagctatgaaacatcagagggtgatcgtgcgatggatcgcttcacgatcgatcgggaacatgctgcagaggctctcggcattccatgtgctgctattggacaagttgtaggagcactgagaagcagaagaaattattatattttacagcctttttaaagcataactttcgagtctccgattaaagaggagaatacggaaatgcgtgttgaagatgataggaagaacgagaaatggggagacaaagatgaggagtaagtgacagaattatgcatatggaggagctagaaagaggaagggacaacagcacaaagaattgtgacttgtaatgataatgtggaagagaaggatacatgatgccattttggatcgcagaagtaggttcaggatacgaggctgggaaaaggcaaggaggttgagcagaacgaatatctagcattacttgaagaggaaaagcaaggttgtgagtcagtgaaaagtacgtcagggaattgggcaagtgttgatcggaattgttacatcacaggaagaagtaggttgtgcaagacaacggatgccgattttttagcacctttagccccggaattaaaacaggtcacgtaaagtttgtagagttgggaatacatacacgacccaaaggatagacccgcagggaactccgtgtcagggtctggagacctcaaggcctgtctcgaactggggacatcaggcgtcagagaacgatacacatattggggccatgggtaacacagtgccctgcagagcttcgagacaactggcaacacccatcgaggtcagaataggga

SEQ ID NO: 662429 - DNA, 202 bp, Homo sapiens
gacatactgaacctgctgcctgttacatgtcataaagcctacagagacttatcttactgcagtcacgcgagctcagcaccgcagctctgggagatctcaccaaagaacatctcatttatagctataagaaccagtttaaatgtaggcagcctcagtgctacacgaccaaccagatggatcatgatgttacttattgagtcca

SEQ ID NO: 662430 - DNA, 179 bp, Homo sapiens
tgaggatcccaagcttctcaaccggtatatatgttacctgtacagcactctatgctaactacaccagtttaagctagggcctcatctccaccttgtttttcatgtccagcagcaataccgtgcttgctggtgtgccggacccacgcgtactctgtgatccccagcttcgttgctctata

SEQ ID NO: 662431 - DNA, 633 bp, Homo sapiens
ggctgtgggataaactgataggtggaagtttcagtgggagagtaggtgggagtgaccgatgtgaaggagaaaaactggatgtgagggacagaagttggaacgctagctgcttctttagctaccttatcagtgtaagcgttgccctgagcgatgggatctgatgccttttggtggcccttgcagtgaaggactccagcttcctttggaagtaaagcggccttgagcagagtttttattaaagaggcattaatgatggaggacccttacatagtgaggaaacctctttcaccccatgtaacagcatggtggtgcaggatatggaaggcatatttagagtcagtataaatattgacgcataattcctttgcaaaagtgagggcttgagttaaggcaacgagtttggcttgctgggaggtagttggggggtagagcgatagcctcaatgatagatgtggaagatactatagcatagcctgcctttgctggtgtgtggcaattaggcctggtggaactgccatcaataaaccaagtgtgatcagggtgaggaacaggagagaaggaaatatggggaaatggagtgaatgtcaggtgtatcagagataaacagtcatgggggtcaagtgtggtatcagg

SEQ ID NO: 662432 - DNA, 699 bp, Homo sapiens
  misc_feature (49)..(49): n is a, c, g, or t
cctaccactatttcgtatttttatagagatggatttcacatttgccagnctgtctcgaactcctgacctcaggtgatccccctgcctcgcctcccaaagtgctaggattacaggcgtgacccccatgcccactgggagcgttctttccaccaaaagtctaattcagagactccaccttccatcctggccactaaaccatagtactagaggtaagatctcccagaatttctctcacttaacccggatacttacctttaaatataattagcccagacttatttgagtacttgcctaattgtatttaattagaactatgctggatgctgtagaccgaagaaataaaatactccacttggtccctatcttccagccggttagaggcctttagggaagaaaagcctgtgtgccgggaaagagaacctcccccagaaagtattccataaaatgcccgaagtgatcttaccagaaccgtgcctgtgaccacccgaggggattgttctgtctttgtgagtgaacataccaatgatggggataactggtcctcataccaagcaggtcccctttctgatcacccccctggcaggaccattcaccgttcttgagccaactgagttagggagggtatgctaacgacagaacctatgccagttcttagaaatattttttgtttgctgaaataaagctccatccaacccccta

SEQ ID NO: 662433 - DNA, 337 bp, Homo sapiens
ctgtatagagtgaccaaaatcagtggacttcatgctgacagagtccgtgatgctgttcaatacactcgtccattgatatcatacaatacacgatacaacaaacgtgactgcactcgtgaacacgcactttttttcatcgtgcacacggactgatcagacaagactctaccccaaacagatggacaccacaggaaacacagaagaagaagacacagaaccaccaccatcaaccccacgaacagatacacacaacttcgacacaaatcaggacagacataaccaaacaaacagaaacgagacatagaccacacatacaacaaccaaaacgatcacaact

SEQ ID NO: 662434 - DNA, 147 bp, Homo sapiens
cactcgagtagtaggtggtatagtcatcaaaaccattcatccccttcttgatgtatcttaatctctggctctaaggcgacatctgagaggtcatgcatccttttttatatcgacatcataagctatcacccgctggttctctgagtt

SEQ ID NO: 662435 - DNA, 531 bp, Homo sapiens
ggggtaaggtgggccttacagacaggctgaggtttgggtggtgtgatctgtcctaattggcccctcaccaatgcatctatctgtctgccaccagcccacccacctgcgccaccctcaccacgcttctgctcattgtctcaatcccacctgaagaggagtaaggctgactccatgggcccattcccctcacccccagcaccaagacgtgggaggctgcttcccaagtaagaatccaggagcaagctttgggtgaatccagatggcactgaggatgggtttcttactggatttgtgagttgatcgtgggaatgttgggtacgggaacgcatgctctaggctctgaaaatgctccgcgctgtattcctcgtggtaccgacgccccgggtggcttgtcgatggcactacagctaagccacctgcctcccaaacttgcacttctccagtagtcaaatcccacctcactcactctggtgctctaccccccggcttactctcccatcgctcctcccataaccacttaccaggccctac

SEQ ID NO: 662436 - DNA, 1034 bp, Homo sapiens
ggcccgagggactggcagctccactgtggtgcacgctcagactacgaggacacaaagcaaagaacaggccaccatggcagctcttcctcctcttgtgcctggtgcttctcagccctcagggggcctcccttcaccggcacgcacccccgggagatgaagaagagagatcagaggaccatcctatgtaggatgcacacggttggcaccgcacagacaagaccagaagggactttagctttgatctctacagggcctttggcattccagcttggcccacagaccgagaacatcttcattctccccatgtgcagcgatctcctatgagccttggccatgctctccctgtggggactgggtccagctagcagaagaatgccatggatctctggaatgggaccgtgggcccatcaaccatccagaagagctcgagacgaagtgagctgcacagaggctttcagcagactccttcaggaactcaaaccagcccagagatggctatccagcatgagcctcggaatgaccttttcaacgagctggtggtagacctgctggactacctatcgtaagtgccatgaagacgctgtacctggcagacactttccccaccaactttagggactctgcaggggccatgaagcagatcaatgattctgtggcaaagcaaacgaagggcaagattgtggacttgcttacgcaaccctcgatagcactgcggacgtgatcatggtgaataccatcttcttcaaaagctaagtgggagacaagcttcaacacaagaggcaacacaagaggcacagcacttactacggatgaacgtccggaagaactgatgtgggcagggtacccccaatgagggaagccgagaaaggatacagggatacacatacacaaccttggagcaggaaagcgtacatacatgaagcgagggtgggcgaacacatacagaggggccatgcacagcggacaagaggcacaatgaatcacacaaggggggacaaaatgcgcagtagaggaaggaacagaggagcagaaac

SEQ ID NO: 662437 - DNA, 286 bp, Homo sapiens
  misc_feature (25)..(25): n is a, c, g, or t
tcacaaagcctgttggtctcttctnacacggatgcacatgaaacctatcatgactgctccagtcatctgaaactgtgagataagaagtggatattgctaaaatctactaaatttgtgggaatttgtaatatagcaatagaaaactaatatacaattattcaagttttactatgagttttaaatctagtggtatctgaatacaatttgaaaccaaaggtaaattctttgcttcatatcagcttggattcaagtaactttaattgggactgagaagctgtggcgggcg

SEQ ID NO: 662438 - DNA, 935 bp, Homo sapiens
  misc_feature (228)..(228): n is a, c, g, or t
  misc_feature (282)..(282): n is a, c, g, or t
  misc_feature (293)..(293): n is a, c, g, or t
  misc_feature (306)..(307): n is a, c, g, or t
ttggtcaggctgtctcgaaatctgacctcatgatctgcccaactcagccctcctaaaaagggtgggattacaggcatgaagccctgcacccagccttgtgcagtctttcttaatctctagttctatgatagaatttaaaaattacaaagcctgaaatttttcctaaataatttgtacctttctgggattattagggaagatatttcaaaaatatttaagaggtcagancttttactgagcaagtgcttatatgagagctagattcttaagcttgccacaaanaatactatgtnattcatgatatannatatatttctgaaagactttaagttaattcattgatttctaagtaaaagtgagtaatgaatggttcttttatcccatctttcagtatacaaatttattattcttggcatctaacttggtggaaaaatgtactgcgagttgaatagctctcagaaagtttattttccaaaagtaagcattactgtattatagaaggaatgcctaaggaagatggcctcaaatatcccttagtggactcatttataagattcataaattgttttgtttggtcattgtatattaactctttcaggtgagtctcctgaaacttaaacatcttaggacgtgtttaagattattagcacacatgttgggaattaagttgaaatcctggtctttttattcaagagcgtatgttcctccctgtgtttgtctatttatggaagtattcagaattagaaacatgacgaaaccctgtctctactaaaattacaaaaattatccaggtgtggtggcacgggcttgtagtcccagctacttgggaggctgaggcacaagaatcacttgaacccaggcggcagaggttgcagtgagccaagattgcaccactgcactccatcctgggcaacagagtgagactctgtctcaaa

SEQ ID NO: 662439 - DNA, 181 bp, Homo sapiens
  misc_feature (126)..(126): n is a, c, g, or t
  misc_feature (146)..(146): n is a, c, g, or t
  misc_feature (156)..(156): n is a, c, g, or t
tttcgtcatcactgttcaggatgatggtctgggttggggtctgggtaggggcccgggctgtaggggtctccctctcattcctgacggccttcatcttcgcctgtttggtcacccacctgacgttgngcgctcagggaagcaacttnctctccactntgaaggagacaccagcaagcgtgct

SEQ ID NO: 662440 - DNA, 1198 bp, Homo sapiens
  misc_feature (1175)..(1175): n is a, c, g, or t
agcggttcaggtcccaattcctccgattcgctgcgcttgggcgccaaggacggctcggatgcgcggcggtctctgctgaccagtataagatggtcgctgggacggatccataaggcagcatggaactgtggaggagcgggaaggcatgcgtcagtcggactccgccaattattatctgtgcataggattgtaagcaactccagactggttggtgcaatgatacacgcagcgcaaataggctctcgggaggcctgacagtgccatcacgtagggatagctgaaacgttacacagttggcttaccaagggtctaccgggccattagttggtcagcgcgaagtggacgacttatctagacatggacgtgtctgaggcagtcccaaggggtctccaccttaggtgtgagtggagacacggtgaagtactctggggccccatggggcaatacaagtagaggaccaatgctcggtccggggctccacccgtttgatcgattccctgtgtgaaaggggttgacccaatttcttgctcgcggtaagccacacgtgcgattaccaaccatagaccctttgcgatccatcccaactgaaattgcttgcaacaaccccccaaaatttttgggccctccgggcggctgaggccttccttccatgggggaacattgcaatcaatggttcaacaaccgtgcctggtccacccaacatgaatttccttgaagccctaaaacaaaaggttttgatgaactcgcaatttcaaggggtgtccaacctgtggaactggtaatggcgctcgtgtcgcctaacacatgttgacgccacgagagtttcaaaaccttctattggagcgacttggcattttgcgtgggggaacttgtgtgagccaaaaccaccttatggaaattcccactcgctgggaggcaattgccggacaaaattggaagatgtctgggaatcccggcaccggtcgtcaggacgctatggtttttaaaaaggaccaatttcgcggttggcaacgacctttcctctcccggaacaggccaatctttggggcgcccaagattttggtcgtcccattgttcccacagacgggggcaacggtcggctttgacattagggtcaatgtggggagccctttacacaaaagagggtttgccttgggtggcacaggtgaaccacntctggatttgtgggggccaccag

SEQ ID NO: 662441 - DNA, 100 bp, Homo sapiens
ttaccttttgggctctttttactctctgatttttatttggaaatatttaattcctacagaaaagttgaacgttaagtatagtgaccacctgtactcctgg

SEQ ID NO: 662442 - DNA, 158 bp, Homo sapiens
aatctagacgaagggtatgcggatattaaatgactttagtatactctcaactgtgctatagctgtgaatgtttttatgttcttaccgaaacaagacatccattgacaccaagccgtgacctggagcggaaccattaagcttaactagacccgccgccc

SEQ ID NO: 662443 - DNA, 332 bp, Homo sapiens
ggaccccaaagtgctgggattacaggcgtgcgacggcgctcggccacttccgtgtttctttccccctctggaaggctgaggcgggcagatcacctgaggtcaggggtttgagaccagcctggacaacatggtgaaacgccgtctctactaaaaatacaaaaatagccaggcgtggtggcacatgcctgtaattccagctactcgggaggcggaggcaggagaatcgcttgaacccaggaggctgaggttgcagtgagccaagatcgtgccactgcgctccagcctgggctacagagcgagactccattaaaaacaaacaaacaaacgtcgac

SEQ ID NO: 662444 - DNA, 295 bp, Homo sapiens
  misc_feature (79)..(79): n is a, c, g, or t
taatatcgactgctcggtggtatctcccatagctgctgcaggtggggaccagatgtctggctgggccatgttgcctaancgaacagcacaggtctggctcctgggaatgagaggtgctgctatccagtatctggagatcctaaatgaagagggaggtgagtcctggtggccccctacccctgggagagctgtccgcaaatccatgatctgtgttgggccctcggggctcagtcatcggccaggttgatgacgtcgtactcgatgccctggtgctgcagctgtagaatggaggagt

SEQ ID NO: 662445 - DNA, 172 bp, Homo sapiens
tcagaccgctgtaactattactgtgtgtgtgtgtgtgtgtgtccccatggtgggagtgtgtgtgtgtccccatggtgggagtgtgtgtgtgtccatggtgggcgcgcgtgtgtgtgtgtccatgatgggcgtgtgtgtgtgtctgcgtgtgtgcacatagttcagcgtctga

SEQ ID NO: 662446 - DNA, 491 bp, Homo sapiens
ctgggtatctaagatccgggcatgggtctgtaagagggtaagacagcagatagtgtgctggaagaaggaggagcataggctcggcagttttaggatggaaggaaggcagcgataggaagacgggacaggaaaaataacgttgacaagaacctgagagggggtggaccagggtttgaggagggggtacaggaaagaccccaaggctttaaagttagcatgtgcattgtgaggtgagaagagggtgcaaatgccacagctggcctccaaccagggaaggcggggattcaggacaggccagtgctaggtggggagtgcacaggaggcctgccctgtgcctctgtgcggacagccgatgctgggcggagactgccacgtgcccggctctcatccttgctttctttccattcctcatccaactattcagagtcacatgatatggctgagaaaagccagaagggtctatagttgaaagataaacccaactctgcaaa

SEQ ID NO: 662447 - DNA, 370 bp, Homo sapiens
  misc_feature (31)..(31): n is a, c, g, or t
gcacgaggggcaaggctggactgtgatcttncaatcatcctgcccatctctggtacccctatatcactcctttttttcaagaatacaatacgttgttgttaactatagtcaccatgctgtacaagatccctgaacttatgcctcctaactgaaattttgtattctttgacacatctgcccagtccctctcctcccagcccatggtaaccagcatttgactctttacttgtataagggcagcttttataggttccacatgtaagtgagatcatgcagtgtttgtctttctgtgcctggcttatttcactcagcataatgtgcaccgggttcacccatgttttcataaatgccccgatttcctcctttaaag

SEQ ID NO: 662448 - DNA, 487 bp, Homo sapiens
  misc_feature (16)..(16): n is a, c, g, or t
  misc_feature (65)..(65): n is a, c, g, or t
  misc_feature (73)..(73): n is a, c, g, or t
  misc_feature (182)..(182): n is a, c, g, or t
  misc_feature (196)..(196): n is a, c, g, or t
  misc_feature (238)..(238): n is a, c, g, or t
  misc_feature (241)..(241): n is a, c, g, or t
  misc_feature (305)..(305): n is a, c, g, or t
  misc_feature (321)..(321): n is a, c, g, or t
  misc_feature (324)..(324): n is a, c, g, or t
  misc_feature (351)..(352): n is a, c, g, or t
  misc_feature (414)..(414): n is a, c, g, or t
tgaatctagaaccgtngccagacatgggactggaggacgagcaaaagatgcttaccgaatccggngatcctgnggaggaggaagaggaagaggaggaattagtggctcccctaacaacagtgttttttgcttgcgagcagttggagatttgtgtgaaggcccgggagcggcttgagctctgngctgagcgtgtctnctctcgatcacattcagaagaggattggacggaggagctctntgncttcttgcctgcgagggaccattgcgtggcccacaaactctctaacaacttgaaattaatgtgnggtcttaattaacccnatncttcatcatctgggcatcataatcttnncttatggttttggatgtaccatttgtttcttatttgggtaactgtaagtccacatgaacctnatgggtttggcttatgctggtagcttctatgtattcgcaatgattccatctaaataaaagttctatgatctgc

SEQ ID NO: 662449 - DNA, 701 bp, Homo sapiens
  misc_feature (169)..(169): n is a, c, g, or t
taggtttggagggggaatgctggaaattgtaatggggtatggagacttgtcatataagtaatgctagggtgagtggtaggaagtttttccataggaggtgtatgagtgggccgtagcgggaaccgggggttatgctgtccgatattctataagaacacgagggaaggtntaaaagatagggccttggtgcaccaacatattattgttcgttgtcagagtcccagggcgagagtcgcgtccattattgtgggtctcctaggaagtatttgtagtggggtgaggggtgttaattcatcaataatggttgtggggtatcccggctatgaaagaataggcgccgaatgggcgcctggcggctgtatccgattgttagaacgcctggagacatagtccggagactccccttctggcaaggtcagaagtgggtgtccaggttgggccctctgctaggtggttggagatccacctcattcttagtggccccagggtctcctgagtggcgagggagttaactcaggaggggtgtccctcgtgttcgctcgacacggggtgggcaggagggttcaagggagccccctttttcagtaactgtcgatccgtagaaatggtggcctaggggtggctctcctttggaccattgttggggcaacctgtccccatggcgccgaatcaagggggaactgggagttcgttcccccctg

SEQ ID NO: 662450 - DNA, 241 bp, Homo sapiens
taccattacacagcttcttctatctgactatcctctgtcctaaagagttacatggactggatcctttacgatgattttaaaaataatattacattaagttttcctggtctaataaccaactatgagaagtacagtggaagggtatagaacttcctatatcttctatacttttaatgccaatttgatttttattgtgatgtgatatttaacagtatgctaaaaataaaatggggtaccggag

SEQ ID NO: 662451 - DNA, 890 bp, Homo sapiens
tgtagaatgatgacttttgtatcgcggtgccatatatcacataaacttaggtcacctatgggttcctgtaagcaggataccgtggggcactagactagcgctaagatatagccttcatccttgtctgacccttgtcctatcgccttggtctcgccccctgctttatgtgttgcttcgtttgtcctctttgtcttcttttataccgaggcgtctatctgtggtctatattctattttttcctcccgttttgtcatttctccctatcacctaactctacttctctgttgtatttgttgtatctggtaactggtcagtagtactgtatttattctcttccttctctctgttggttttttctctgtctcagttatttattcttttagtttgtcccttttctctttccctctttaattttattccccgccgtctgtcttcctttatttatctccctaccctttcatttcttttttttttttcttggggaaagggacctctcgccttgtgccccaggggggaagtgccagggttggtgcccctttgccccccgggtcagggagatccccctgttaagccccggggtttttggaattaaggggcggcacctccccgcccgctattttggttttcggcgagacggggtttcccacggtgtggccgggtgctcgatcccctggcctgtgattccgcgcctggcgcccccaggtggtttttggggtgacccggtccggccccttttttccctatcaacctgtccaactggtccacaaccctggtgcccacgggggatataggcctgcccaaatccctttgttcccaggtcctatttacgcggtccggggggaaacccgttactcttggggcgcccgcgtgtcccgtcatctcaacgctga

SEQ ID NO: 662452 - DNA, 458 bp, Homo sapiens
ctaataatatattaaacttaacttggatattctatgcacttctctgcatttgtggttttctctcactctttaaaaaaagttttaaaatacctatatatgatgcatacatgatacatacaagtgtacattcatacatatgtgtgtaaacagtggtgataaagatacttgtccttggacagaatggttctgctaaatgtgctgggctctctgctttggcagaatgtcttgctactcctaattaaggtagtctaagcctcctatatatttgttttcagctacttgatttcagtcaaattgcgacaagacattatctgcacaccttcacatcgagacatttacgccggcagtgcatgtacgcccgtcatcccagcactttcagcgccccagccagacggattgctcgcgccagcagttcaagaccaacgcggccaccacaccaagaccctctctcacaaaac

SEQ ID NO: 662453 - DNA, 257 bp, Homo sapiens
ataaaacaaaactctaggacttttttagatttctgaatcccccgcagggctccatggctcatgcctgcaatcccaccactcctggaccccacgctgcgtagactccctgagcccaagggtccaagaccagcctggccaacatggtcaaaccttgtctctaccaacgatacacaattagctgggtgtggtggcatgtgcctgtaatcccagctcctcaggatgtgacgctggagcatagcttgaggctgcagtgagcc

SEQ ID NO: 662454 - DNA, 799 bp, Homo sapiens
gtggacgtgactgccggaacgtgggagtatttgctgggccgggtcaccagggacgtgggcgaaattctgagctatcgaaggagggtcatgcgaggagcagtagaggctgtcgcgtgcgagatgtcgtatccagtatccacataggctgtgattgcttgaacatgtgactagtctgaagtgagaaagtactgcgtctctctggtgtcaccgagactggaatacagatggtaatgacttggattactggtaagcctcctgtggctcaagtgatcctctcacctcagtctcctgagtagtagggactacagtccaataggggcagaagacgtccccgggatgctgaagacggaggagcagaagatgcgtcggaacacgaactggtagtcgagaacgcgtgacgttgatcgggacagaagatgatgactgtggtggaggaagcggcatgatgatagaaataaggctgcatggagattattgagagagatggggaagaggaagaggagagaggaggtagccgaatggagtgatggctgagtgtaggatcatgattccgtcatcattctcgtgaatgcttatcacaactaagagggcaaggaatggcgccacaaagtcatcctcgaggagaacaccaagagtaggtccatggaagtccgaaggacgaagcagaaactgaatgccctccagggagctcgcggcgtccgtggcacactcagtgccagacctgtgggcaaccttctgttggaagctgcctgggtggacaagccgaacagcgaatttgcgcggacacgataaatcccga

SEQ ID NO: 662455 - DNA, 1159 bp, Homo sapiens
taaaaatttaatgtaatggttaattttttaaattcccatcctaacttgggcttaatccttacctctcatttccattcttttcttggaaatccaatctaaaaaaaaaaaaaaaaaaaaaaaaaaaaaaaaaaaaaaaaaaaaaaaaaaaaaaaaaaaaaaaaaaaaaaaaaaaacaaaaaaaaaaaggggggcggggcggcgcacaacaatctcccatgcgggggcgcccccccgaccgcgccccacccactagttgttgtgtacaagggggcggccacatagggagggggcactactatacacacgccacgagcgcggcgccgcgcaaaaaaacaagagagagaggggagaaaaacagtgcccccggaggacctaggaggggaagccacccaaccaccggggggaggcgaacaacaagcggggcgacaaacacacacacccacacggcaaacgaccaggccccgagggagcacaaacacacaaccgaccccaaggggaaccgaggggggaggaaaaaccccaccagaacaccagggcggcgcccgcccaaagagaacacgtcccaccccacggccgccacaccaccggcaggagacacatatccaccagcccgggggatgcacgcaacaaaagcgagcacagaagaacaaacaaaagaaaacaaaacgagcgcaaagaacaaaaacaaagagaacacaagcaagaacaccgaaaaaacaaaaacacaaaaacacgaaagacaaagacaaacaaaagaaaaaagaaaaaaaaaaaaacgaaaaagaaacagaacaataaaaagaaacacacgacagagagacacaaacgagacagcaaaaaaaagaaaggggagagagaaaaaaaaaaacaaaacagcaaaacaaaaaaaaagaaaggaaacaacaaaaagcaagaaggagcaacagacagggacacggacacaaccagcggccgccaggggccagagggacagaaggcgacgaaagcagcgaggcgagagccagtgaacagacgcgcgagcaacgagaaagagcaacaggagcaacaagacgaggacacgagagagaagcgcgaaaaggagccacccccgagacaagggcgcaacccaaacaagagagggaggggacagggcgccaagagcgcaggacgccgacggaca

SEQ ID NO: 662456 - DNA, 593 bp, Homo sapiens
ttgttggagttgcattgtatttgaggcctcttcttccttctgcctatttatctccagcaacatctttgatcgtttggacctgaaactcttctgcaaagcatcacagcagatggaagcttctttaatctctttcttgtctgaaaaccccttccaaataggcttgaatcaagcatgctgcttgatgtagtttctgctcttctacttcctgatagaccattgggcttaaaaggccaacaagctgtctaagttcttgactgaattcagtcccagtttcctgtttacttagtagacgtctgagtcctttgtagcaggtactttgtctcagtaaaatcaaaatttcctgatgggattcagccatcaacagtaggagttttgtagcagtacttcttataactggactaggagttgaaaaaagcttgaaaataacttcatctaaaattgaatacagggcttttcttcctattctgagtaaatcaccactgttgatctgtaatatattctgtagcatcatcatgactgcagatcctatttggacattgtcagcttgcagtaaatgtaagaaatgatcactttgtagtacattctgaataagt

SEQ ID NO: 662457 - DNA, 130 bp, Homo sapiens
ttcggcggctacaagacgacagcaggatcgtcaagcagcagcacagcaagcagctgctgctaaggcgtctggcgacaaagcatcattggcggtcatcataagtagtaaaggatcttcttgacctgctgtc

SEQ ID NO: 662458 - DNA, 118 bp, Homo sapiens
  misc_feature (20)..(21): n is a, c, g, or t
  misc_feature (30)..(30): n is a, c, g, or t
  misc_feature (43)..(43): n is a, c, g, or t
  misc_feature (45)..(45): n is a, c, g, or t
caggcgcgcccgtatcactnntgcactgtngctcaggactgananacactggaggagccagacccggggtactcacttggaggagccagatggatcacgtagccatctcctatataca

SEQ ID NO: 662459 - DNA, 406 bp, Homo sapiens
  misc_feature (37)..(37): n is a, c, g, or t
aaccatatggttggacgagagtgagactccgtctcanaaaaaaaaaaaaaattaattactgggggacatgggctctttaatctcttttaatgaccagcccccggccttttggttggttactggtggcttggtttttctggacattatcatccgttaagagtacaggccagtcacttggtagaatgtccctcagggtgaggttggtgcaatggttcactcattattagattagggtcaaacattttgggcaaaagtaccacatgggagaggtggtggcctccccgttgcatcggtcccagaggttcagggtgccagcttgtcccagtatggctgtcctaagtggtccgcttgatgtctctacagttttcccattttaaagatatatcttactcttcataattaaggg

SEQ ID NO: 662460 - DNA, 806 bp, Homo sapiens
ttggttctccttctctcagtatccttgttcttctgcggtattccttgcttgtttctgctgggcattgtgcagtaggttgaatcaatgtcttgggttgctttgtttgtgtggtctatatataggtgttctcgtgttccttctccaatttatacgtccgttgtacttatcggtgtctattcacaactcgtctgattttcacatgtcgtatgaaatcttatttctgttgatgccttgggctattttccttgtcttagattttggttgccactcctctaaactttattgttgttatctgaacctctactctcttctgctctgatactattgagcattctgccctcaaatcgacagggttcaaagacactggaggaagggactggaatcaatggtatgtctcagcatctgattgctcaccattggagcacttgctagaaagttctgctgacctcggctgcaacctgtcagtcatgtgaatcaggattcttgctccaggtatcaagcgcatccagctgcaactttgactgcttgctaaggagccctccaagaggtctgggacccactgctcagtaatggctgacaaggtaactttgataagccaaacagatgagttctgggaaggaagggctcctcctcaggctgctgccaacccacgtggaggccacctccctccaggagatcccagggtgcaaagatggcattgagacagcagcaacagctcaagagattactctccctgcctaacgtgcccctctattccagcccggctctaagagaaaggcccatctactcaggtagagggccgttat

SEQ ID NO: 662461 - DNA, 206 bp, Homo sapiens
gaatacactagtgattatacccggtacctgggtaatataggtgaaaacccgtctctaactacaaatacaaaaaattagccaggcataggtggcacacacctgtagtatcacctaactacgggaggctagaagcaggagaatcacttgaacccaggcggtggcggttgccgtgagccacacttgcatctaacctcggtgacagagca

SEQ ID NO: 662462 - DNA, 554 bp, Homo sapiens
  misc_feature (499)..(499): n is a, c, g, or t
aaagtagggattacattaatatttcagaatccttactctgtagataagtatattttaattttccccatgtatactttgatttacttggggaaggagcttttaaagggggtggtttgctatctctttagctaccagaacagtgtgcctttgatctcacacatcctacttttatggacacagtagccatgcttcctgggaggacagagctgggcaccgtcattcctgcccgactgaggttatgacatccttagactttgttgtatgctgcttcgaatgaaccagagatacccggccctttgcagcatgagaaagcccccaaagctctggaatttacctccacatcaataataagtgaatgttttcagggttacattgtgttgtgtcatttgaattcaatttgactacgcttgggctttggagaggactgttgagtagacgcaggtactttctgagcttgatagctgacaattctaaagcgcatgtggttacacaagttttnaccagtcaggagatttttacatagccagtgatagaacctttaaggtttggaaaaa

SEQ ID NO: 662463 - DNA, 429 bp, Homo sapiens
  misc_feature (428)..(428): n is a, c, g, or t
tctgggcaattcaaagaattctcaagggtaattttagtcgtctataatttttacatgttgtatgaaatccagctccatattattgaactcttactgtgtactagatgctttacaaacatgatcttatttaatcctcatgctcattcattttacagaagagggatctaaggctcacggtggttaatcaacttgtccaaggtcacatagctagaaaaataaagatgttcaaaccagaatagtttgattcccaattctctgacagtccatccctattgactgatctggtctgtaggataataggtattcccccattgaaaagtggccagtggtcaacaagggaaatgggcaactggccatccctgaaaatatggccttgtcatttggctccacgggaacttgtccagtttcatactctagggcactacacna

SEQ ID NO: 662464 - DNA, 437 bp, Homo sapiens
caacctcatttctttgatttccaatttcaattttaatttcatcactttgacaaggtttttcattggaaagaataagagtttgctttttttattttttgggaatttttatttatttatttattttttttttacctctttcaatttattcacttttccaaaatatttttcaatttccaaaatatttttttcttttttttcctcttccaaaatatcctcaattctttgttcgttttttttcatcatttccaattgttctttcaatttctcagttttttcaaaagagaaatcatcaatcgaattcaataaaaattgttttcttttttcaagtttttccaaaatttgtttaaaattcaaaataatttcttctctcatttgatctttatttttggaaatttttatcatcatttcattgatctccttttcaatttccagaattt

SEQ ID NO: 662465 - DNA, 285 bp, Homo sapiens
atatatacatatataggtagagatgagttctcacatactgtagctaggcctcgaactcctaagctctagatggatctcctgcctctgcctcccaaagtgctgggattacaggtgtgagccaccacgcctggctaatttgtgtatatttaatagagatggggtttcaccatgttggccaggctggtctcgaactcctgacctcaggtgatctgcctgcctcggccttccaaagtgctgggatggccgagtctctgattttaaagaccaacatgattacattgtgcc

SEQ ID NO: 662466 - DNA, 209 bp, Homo sapiens
ctatgactgggacacgctgcccgtgtctgagagtctgacgagaagcaccgaactagagagacatagacagagacacagatagacattgggggccttaaccagatacacagatagacacagagagacatagacagatacacagatagacttagagagacatagacggagaccaagatagacttacatagacatagacagagacacagata

SEQ ID NO: 662467 - DNA, 974 bp, Homo sapiens
  misc_feature (216)..(216): n is a, c, g, or t
  misc_feature (224)..(224): n is a, c, g, or t
  misc_feature (246)..(246): n is a, c, g, or t
  misc_feature (276)..(276): n is a, c, g, or t
  misc_feature (296)..(296): n is a, c, g, or t
  misc_feature (330)..(330): n is a, c, g, or t
  misc_feature (356)..(356): n is a, c, g, or t
  misc_feature (359)..(359): n is a, c, g, or t
  misc_feature (419)..(419): n is a, c, g, or t
  misc_feature (451)..(452): n is a, c, g, or t
  misc_feature (462)..(462): n is a, c, g, or t
  misc_feature (472)..(472): n is a, c, g, or t
  misc_feature (513)..(513): n is a, c, g, or t
  misc_feature (518)..(519): n is a, c, g, or t
  misc_feature (525)..(525): n is a, c, g, or t
  misc_feature (556)..(556): n is a, c, g, or t
  misc_feature (569)..(569): n is a, c, g, or t
  misc_feature (581)..(581): n is a, c, g, or t
  misc_feature (622)..(622): n is a, c, g, or t
  misc_feature (657)..(657): n is a, c, g, or t
  misc_feature (681)..(681): n is a, c, g, or t
aggtaaggaaagtatttttttaaaatagccacgggaagggacaccgccttttttcgcgcacaagtggtgttctcccaaagtgggggccacattcctggccttagctttcagacccggtttttatagtctcggcgtaagttacaatcgattaatcctcatcttcatagtcagtgagcacgcgcttgatacacggaaagattccagcttatgaacagntttcatcncgtgaaccgcatattgacgccntagcatttgtcggcccctgagttttttttntggatctaagccagcagatntatgaattgacagatcttaatgactctgcacccntcctttgtgagtagatccatgacagntanatatcttgattactgcttagatgctagcaacgtgaagtgcttagatgctagccacgtganatcaagaaagtaggtactagctttacattttnntaaaggtaanagcatgaccntatctgcttaatgcaagtagcactattaggtctctgcaganccagnnataganaatctttatcaaactacggataaacttaaanatatctgatcccnatgatttggtcntgctggaatcagtaaattaaataccggaagcagaatgatanaatcaggggcattaaacattcctaatgacatgccnagctattttagagacagcggcaanagcttctctacaggtgggtttgatgtaacgctccggcagcaagaatccgtatgtgcccgtatctcgaagttcaattgtaaacgaatatttgatgcccaaatcatagatccaatcgtccccacctccaggagctaggtataaggtttctgagccatggccatgtgtatacctggtatttttactagttttctcaatagcacgaactgcttcactggctactagagacagttcctcatggtctttgcttttacttcgtgtataggaatatggaaacactatatgctggctcgtgc

SEQ ID NO: 662468 - DNA, 119 bp, Homo sapiens
ggaggcggaggtggtgtgggagccactcctggagaccagagtggggacacgggaggttactggtggggaggatgaggacttgactgcgggttcggaagccacgtccaagccatcaaagg

SEQ ID NO: 662469 - DNA, 106 bp, Homo sapiens
ccatgcatatggctttggtaaatcatgtgaaatgtttagttatgtatgtagtcgaaatgtaaaatgtatttctcactgtgagctactgataaaaaaatgtttgaga

SEQ ID NO: 662470 - DNA, 276 bp, Homo sapiens
  misc_feature (126)..(126): n is a, c, g, or t
  misc_feature (128)..(128): n is a, c, g, or t
  misc_feature (195)..(195): n is a, c, g, or t
  misc_feature (215)..(215): n is a, c, g, or t
  misc_feature (233)..(233): n is a, c, g, or t
gaccggatattggcgctgctccccgaatcccggacctgcgctgaggaggctgttcatctgtggccagcggtgcttcgggggccgcgctgggggaaccctggcgacggggcctggcctgctatatgngngggcctcggctggagtgagcggcgtggacgcttctttcctccggctcttcccttgttgctgcgagangagagggccgcgggccgganggcagcggggccgggatngaggacgttaactctaacgtgaacgcggaccaggaggtgcgga

SEQ ID NO: 662471 - DNA, 115 bp, Homo sapiens
agatcaggtcaacgactcgatcgtgacgtgtcagcaccctgtggcggggcatgccctgtgaccaggcagggatgggctatgtcgctgttggggaccacgagggatggccagtgag

SEQ ID NO: 662472 - DNA, 492 bp, Homo sapiens
ctcacgacgatccccctaggtggccgcgacgttgcaatactcaaggcaggcaacatggtaaccatttccaatgcaatagcagctgctcacttgcaaaaacacagctttccctgtgcccagtgcatctctggatgagatgtctccctcatatgtaaattttttaaagtccagcaaacaatttaaattctcatttcctctcaggtagctactctgctagaaatagcacaaccacaccagttcaccaattatgcaattcacacatcattgggttcaggcagatgatgccacagatgcgatcatcactttaaaattctcaggtgcctggcaaaggatgctgctttcagagactgccctccatcagggtggctgcgggcgccctgcacagcacactcggatagcggcagcggtgaagggaccggcacaagggcttactggcccttccatttaaacgcagcctcaatgaacacaaaaacggagaaatgagacaaggct

SEQ ID NO: 662473 - DNA, 103 bp, Homo sapiens
gcctgcatgagacctgccaatgatgtgctatcagaggatgccatttccactagagagcaccatcttgagcaaggaggatagcattagaaaaggaaggtaaggg

SEQ ID NO: 662474 - DNA, 487 bp, Homo sapiens
  misc_feature (20)..(20): n is a, c, g, or t
  misc_feature (63)..(63): n is a, c, g, or t
  misc_feature (78)..(78): n is a, c, g, or t
  misc_feature (80)..(80): n is a, c, g, or t
  misc_feature (82)..(82): n is a, c, g, or t
  misc_feature (86)..(87): n is a, c, g, or t
  misc_feature (89)..(89): n is a, c, g, or t
  misc_feature (91)..(91): n is a, c, g, or t
  misc_feature (99)..(99): n is a, c, g, or t
  misc_feature (155)..(155): n is a, c, g, or t
  misc_feature (157)..(157): n is a, c, g, or t
  misc_feature (162)..(162): n is a, c, g, or t
  misc_feature (165)..(165): n is a, c, g, or t
  misc_feature (172)..(172): n is a, c, g, or t
  misc_feature (185)..(185): n is a, c, g, or t
  misc_feature (200)..(200): n is a, c, g, or t
  misc_feature (242)..(242): n is a, c, g, or t
  misc_feature (300)..(300): n is a, c, g, or t
  misc_feature (305)..(305): n is a, c, g, or t
  misc_feature (308)..(308): n is a, c, g, or t
  misc_feature (349)..(349): n is a, c, g, or t
  misc_feature (351)..(351): n is a, c, g, or t
  misc_feature (356)..(356): n is a, c, g, or t
  misc_feature (364)..(364): n is a, c, g, or t
  misc_feature (399)..(399): n is a, c, g, or t
  misc_feature (413)..(413): n is a, c, g, or t
  misc_feature (486)..(486): n is a, c, g, or t
aaaactaacacacgagattntaggctagagataccaagaaatactacttcagtaaagtgcgantgtagccaacatgtntngntggnnantncctaaatnaatttctgaaataataagctagatctaatgttagctactggatattataatgatgngncacangtnctctganggttttgccagtnatcataactcataangcattctgcaaattaaatttcactcaggatcaacatatatgngaataaatacatgttagcattaactatacatttgtctagttaaatgattcatatcatntattnggngatttcactatttcaatatctcaggaaaattggatccaaananaatgntaactctntacaaattagttaccctaaaatttgagctgttttncattaggaaatggnctaaattccaggtatatttccagaaaatgaactggatgttaatctaaaagaactactagtaaagccagataant

SEQ ID NO: 662475 - DNA, 300 bp, Homo sapiens
caatcatcattaatcagcttaaaaagctctggtactaaagattgtacattaggcattgcagttgcctgttaatcacatagtgctcatgtagaggaaatgctagctagagagtgattcggggagttccatcattaagtccagcggtctggcctgcggggttcggtctggacggcgtgccatgtgttgaggagactgggaataacccgtggtgcatttaaaagatttggggaacaaaaaatctgacttgtaaaaatctctctatagcccttattttgtggcattttatcaaaatgctatgaa

SEQ ID NO: 662476 - DNA, 1475 bp, Homo sapiens
  misc_feature (1475)..(1475): n is a, c, g, or t
ccgggcgtgatggtgggcgcctgtggtcccggctactcggggggctggggcaggagggtggcgtgaacccgggaggtggagcttgcagtgagccgagatcgcgccactgcactccagcctgggggacagagcgagactctgtctcaaaaaaaaaaaaaaaaaaaaagttgggaccttttttttttagggaaacctgactgtgctttgtgagcatttttcttcgtgttttaagccccacggttggccggttgttgggcgggattgttgagcttcctttgacccgggaagagccaggcacccgggtttccttgttcaccagggagggagggttagggctcctttgccagtctcaggttgcccagggttcttgagcagagggggccctgtggcattcttgagaagggaggttcccctgtgccggccacccttccagcccttctgtggtcccaaggtttcccccaaggaaatttccggccaaaaagggggacagcgccaacgagagaatatgggaatgtgaaccacggttgcataaatcagcgagaggacagatatcaccgcccaaataagaggaccaccacaaatagagataaaacgctcgaaaaaaaaaagacatatagggggagaaaagaatatattattgattggaagaaagagatcaaatagataataaataaaagacagatacgggaggtcaggagaggaaggggaaacgaggggaaaagttgaacatctaggggagggccaaataaccccccagggaattagagaacaaagaggagatgaggaagacaggtaagggcaatgaggagacacccgaccgacaacacataaagagggagacacacagaaagggagagcagggaagtggaggaccaccacgagagacgaaaaggggaatagggacgcacgagaaggagcagcacacggcagaaggaaataggaaaacaagagaagagcgcagaaatacaagaaaggccacagcaagaatagagcacggaaccgagagcagaaaaaaggacaccaacacaaagggacaacacgacagaaggggcgaagaagagaacacccagaggacaaacaagaaaaaatagggagcgacacaacgacgaagaggagctcaataaaaaacaaacaaaacaaagggcgcggacagcacaaaagaaaactcaggatgaaagacgaaaaagtatggacggatgatacgaagataactgattaagaggaagggggcaaagatgagagaaggaacaaaataaaagaagagagcagcgtaataaaaggatgataggagaaagacaataggcaatgaaaagaagaaaactgagtagagcgtaatcgagaagagcaagacaaatcaaaggaagaagataaggacgttgataaagacgtgaaggtatggttaggaaactggatagaggagagaagaaagacgaaataagaatgaagctgtagaaagaaagcatatagaagacagn

SEQ ID NO: 662477 - DNA, 101 bp, Homo sapiens
catggatttgctggtgcagtacaactaggcttaatagggacatgtgggcaaagccttcaatcagggcaagatcttcaagtgaacatctcttgccatcacct

SEQ ID NO: 662478 - DNA, 191 bp, Homo sapiens
cgtgtataattctcaggacagagaaagtgctcggtgtgtctgctgtggagagctcaatcgtcactggagactggtaaagctcagggcaggctgatggattattcaggagaggcttcataggggccaggggctgagctgagctctccaggggtactgcatgggtcccatgggtcaccgaagctcgaattcgt

SEQ ID NO: 662479 - DNA, 308 bp, Homo sapiens
aatgcaggctcagtcagggctgcacataatctccaaacacttcttcattcagagtaaagctagtgtccgcatgtcgctatgatggacaggtccccctcctccattcttgccctctgtgcagaagtggttcctgcagtgtcagcactatgcaacagggtatggtaggcttggggaaaggggagagcagaagcagtagatacactccttatcctccccaaaattttaagctcatatttcatgtgcccatcagtccatcagacacaaccattcagcactccagggcagtttttgtcttgaagacccaggtc

SEQ ID NO: 662480 - DNA, 430 bp, Homo sapiens
ctgtgttgtaaagataaactgacgatatacaggcacattatgtaaacatacacacgcaatgaaaccgaagcttggcggcctgggcgtggtcttgcaaaatgcttccaaagcgaccttagcctgttctattcagcggcaacctcaaagcacatgttaagaatgctgacccacaagtggaatggaagctgcaaggacaccggggacttggtaagcaaagatcttgatgacttccctttatagggcagactgggagggtatacaggaatcggcacctgcccaacgggcgttttcatgctgtacagtgacctaaagttggtaagatgtcataatggaccagtccatgtgatttcagtatatacaactccaccagacccctccaacccatataacaccccacccccgccccaccccgcgcgcctctgccgcctct

SEQ ID NO: 662481 - DNA, 504 bp, Homo sapiens
aaatatattactttcacagtgttacagtttgtacagtaaaccataaaatacttttactaaccaaccccaaacatataaacagtagtgaacagtacatgctttgtgttattccaataaaatcataaatgggcttttaatataacaattaaacacatctgtgtgtataatgtttactgcttcataatgtaaaattacacctgaaagagtctcgtagtgtaacctttaaaaaataaatttgtggctgaaagcattagtcatatttgtgattttcaagtgacaggcgctcttctgaatgtcaggttgagagggtgtcctgctgttcttgacccagacgtgacctgtcaaaagtggtataagtttgtgcctgtctatacgaatggaaatccattatatgtccagataatgtgccccttctcaaagggtacacttactctctttcaatctgactgcaaatttagtttctcatttttttattaaaaggtatttcattatttgtctgctgga

SEQ ID NO: 662482 - DNA, 148 bp, Homo sapiens
gaactgctcactatcacacagcataaaacacgccgcataattaaaacgctgggcacattagagtgacaaactacactccccaatctacagagttaattacacaacctctgaaacttataacggcaatctatttagaaattaggaagct

SEQ ID NO: 662483 - DNA, 650 bp, Homo sapiens
ttcaaagtgggaactgaagaagacaagtacagactgacctatgcctactttattggtggcgaagctggagatgcttttgatggctttaattttggagatgatccaagtgacaaatcctatacctaccataatggcatgcgcttcagcacctttgataatgacaatgacaactttgagggcaactgtgctgagcaagatggatctggatggtggatgaatagatgccatgctggtcacctcaatggacaatattatataggtggtgtgtactctagagatactggtacaaattcatatgacaatggcattatatgggcaacatggcgtgaccgatggtactccatgaagaaaactacaatgaaaatcatcccattcaacagactctcaatagatggacagcagcactcaggaggcctcaagcaggttggagactcataaaggggcaatttaataaagactgatctgaatggagaaaataaatcttttatttgtacgacactgaacttatctcaccttccacaatttggacatcagtgttgtgaaatgtcatcgactataaaatgcacaacagttttccttgagcagcgcttacctctttacatggttattttttctgtacacattcccaataaatttttgattattacaga

SEQ ID NO: 662484 - DNA, 303 bp, Homo sapiens
  misc_feature (9)..(9): n is a, c, g, or t
  misc_feature (153)..(153): n is a, c, g, or t
acaatgtanacaactaactgtccatcaactgatgaatggacaaacaaaatgtgatctatccacacaatggaagcctgttcagcaataaaaaggaacgaagcaccgattcatgccacaacacgtgaggaatcctagagaacattatgccaagtngaaagcaaccaggcacaaaacaccacacattatatgattccatgtatacacaatgtccagaataggcaagctgtaggcttagtaggtcagtggttgcccagggctgggagaagaaggggttagggtgtattgctggaggccacggaggca

SEQ ID NO: 662485 - DNA, 948 bp, Homo sapiens
actcaataccaaacgcgcctctacgtctgatccggtcctactcactagcaggcgctactgtctcctatctctcccagtcctagtctgctggtcgagtcacgtagtacctacgtaacagaccgcaaacttcagaacaccaacgttcgtatacggatcgccgacggagagtaggtagacccacgagttcgtatatcgcaagcagcgctattacgtgatattttcggtgttcaacgctgaaggtttatgtgctttagtcgctacccaggctgtcggcaatcacatcgtccgcatattggtaactgtactacgtccggcaagaaaaagcaacgcgattatgggattacataatggtatggtactgcagcgtagtgatatccaaattggtgcgttccatagcgggtattcatcggtagtgcagcgacaacccatagtagtattcacaaggtagggcaactagcaccgtagaacaacaagcgagcgatatatttcgagccgtccaggtaaccatagactcagtcgcctaatcccacaaccggacgttgaaacggtaatgtgaaggctgaactcgcgcagaacgtcacaacggtagagtcaactcttgcaaattgaagtcctggcatgtcaggtgcgctctgaacgccccccttaaagggcactttcacgtcgttctctcggtgtaattccacgcggtatacggggatgagcctcagtgaaagggatgagtaacacctcggggtaccttcacgccaacacatcttccaattccaatctgttacggaaccaatttcggggtacaccattaaccaacgaaatggcaccggtttaacggttaaacggttcaggataaagggcccccaaagaatgaccccaacacataagtggctctccataagtccaaactcaagtggcaggccataggaacgtatataggcccgaaaatcacattag

SEQ ID NO: 662486 - DNA, 204 bp, Homo sapiens
catggttgaggaagagaacgtatcagcaggagaatatttaagtttaagatatgctatttctgggcttttcttggaaactggtagatgaaggattatggaatggggtacatacaaaatagcaagataattataataaaaataaacggtttggaattggtataatacctcaaaggaaataaaatgtgtttacctgcgaacctatga

SEQ ID NO: 662487 - DNA, 574 bp, Homo sapiens
agatgtcaccaagaccaaagacacagtattatgaaggtttggaaacccctctctctacctcccaccgagaccttgggcaaaccctggctcggagcccagggcagaggcagctcagagtggaggctctaggcaggtttgacaaaggtcagtaatacggcttcccttggggttgaccagatgttccaaaatatctgcatccacctggagatgcagctaagtgggtccttatgtacacaccacgttcacacacacacagagggaccacgtgtgcacgcatgaccgtgtgggtggcggcgttagctgtgaaccatgctcaggccacacagagacacatacttggtttttgagactgagacccaggcctggcaggaccgtgcctacagatacttgaaacgttcctacaggctagaggtgcgttacacacccgaggacacgcactcaggcatttcatgggtgtagtttgccacattggagcaatacctttcccggacttggcatggcaactctgcaacagagcggtgtcccaggcaccattttttaacggggggcttggggggtaagaagaatatttaaa

SEQ ID NO: 662488 - DNA, 685 bp, Homo sapiens
  misc_feature (575)..(575): n is a, c, g, or t
  misc_feature (595)..(595): n is a, c, g, or t
ctgcttacagggacaatttgacttcctcttttcctaattgaataccctttatttctttctcttgcctgattgccctggccagaacttccaacaccatattgaataggagtggtgagagagggcatccttgtcttgtgccagtttgcaaagggaatgcctacaatttttgcccattcagtatggtatcggctgtgggtttctcataaatagctcttactattttgagatatgttccatcaatacctaatttattgagagtttttagcatgaagtggtgttgtttgtccaaggccttatctgcatctattgagataatcatgtggtttttgtcattggttctgattatgagatggattacatttgatgatatgcatatgttgaaccagtcttgaatcccagggatgaagccaacttgatcatggcacataagctgtttgatgtgctgctagattcggtttgacagtatcgtattgaggatctttgcaccagtgctcatcatggatatcgattgacaattccgtctttcgtattatgactatgacagactttggatcaggatgatgcttgcctcatancatcgagtaggggagatccnctctttttctatggatgggaatactgtcagaaggcatgctaccaggttctttatgtacctttgttgatttcgctgtgaatccattgcctg

SEQ ID NO: 662489 - DNA, 158 bp, Homo sapiens
cagagtctctggaacttataccagcgctctgtaacatctaccagttctacagccatttagtgctaaagtgctgtggctgatgagatcagacatggagagagtcctttctgtatctgtctagataccacaatattggctaggaggtcttggtggtaaca

SEQ ID NO: 662490 - DNA, 180 bp, Homo sapiens
acgaattctcctactctgcggtggcgcttgctgtagtcccagctactcgggaggctgaggtgtgaggatcgcttgacgccaggagttctgggctgtagtgcgctatgccgatcgggtgtcggactaagttcgggatcaatattgtgaactcccgggaacgggggaccaccagggttgcta

SEQ ID NO: 662491 - DNA, 146 bp, Homo sapiens
cgactatgtatatactacccatgagtgctacaaggaggatagaaacctgtgctttatgtgggaaaattagaggaggttgagacatgtttagactgtcatgtttttctagaaattatgcgaagactaaaatagatctactcttggaa

SEQ ID NO: 662492 - DNA, 231 bp, Homo sapiens
ccaactgttcgtatattaaaattgaagatagtttttctgcagagaacattagacacctagatggcaatttaaattttttcttcagtacagtcggaaaccctataattgtgttaaatatattttttcccatatggggtctcactatattgtccaggcgggactcaaactcctgagctcaagcaatcctcccaccttggtctccagagcatctggagacaaggtagagccgag

SEQ ID NO: 662493 - DNA, 366 bp, Homo sapiens
gggggaaaaaattttgggttttggtggggattttatttccggggggggcccccccaatttttcgggggaaacgggggctttccccccccgggggtttttcccccttttttccaaaaaatggggggcgggcccggggggggggccccccccttttttttttttagggggggggggtttccggcccccaagtccccccggccgggttttaaaaattttccccaccccaaaataattttttctttccccccccgggttttggggggttgggccaaccccctttttcccccccaggggcccccccccttttttttgggggggggccctttttggggggggcccccaaaaaatttggggggcccccgggta

SEQ ID NO: 662494 - DNA, 144 bp, Homo sapiens
ccggccaggctatcaccacgtgaatctcactggacggtagtgctttcttatactgtaaaatggtgaacttgtgtagcttagactggtagtgagttttaaggtgtggtatagggtggtatagtagtggtatagtggtggtatcag

SEQ ID NO: 662495 - DNA, 1035 bp, Homo sapiens
  misc_feature (1035)..(1035): n is a, c, g, or t
ctgagaactagcatccaaacctttcaatcttatgtctcaagactccacttggcctatcgtactgctaccccaatgtcactgtactaggctgcatataatctctgtggctgtctgccatagatttttgagcgcagcttgtcgaggacatggcacggtgaatacactctggacattgtttctccattggaattcatgacccgtttctgcttctctgccgttatggaagttatacctggtgaactatgatattgccgagagaatggcacggatgcgtacgaggcaccttcagaaccacgatcaagactaggcatatgtagcagctttatgggcgaggacaactgcgcgattcctcattgattagacccagaggtcagtttgtgggcacagacattgttttgtcaaagctcaggaacggccggaactgcgggcccataacccttaagcctgtgggtcgcattaacccatggggtgtagcttcctttgggcactgtgcaccatctttcacttatccaactctttgtcccccagttcttttacccccaggagattgagagcgactccttacaaagtacacctcttttgtgtactcaagaacaattgcgtgagtggacttgcgcacacacggacaggaaccacaaggttacttaggggcctaccaactttattgggaaaggggaaattccccttgtgttaacaagaaggatggttaaggcccaaaatctttaaattacgccacgaaattcgttcacgtgttgcattaccaaaacagttcattcgcaaggcgcaaaacttgaccccgagattagcactggtccccatgcatttcgaacttggccagcccatttcttccatgactttggaactggtggccccgtacagcaactctattggaactccggttgtcaccccatttcacaaacaaacccagaagatttgttgttcccccatatcacttgaatacgggtccacttaattaggcaacctaaaccaacttgaatggcggcctggcttttaaaagtatccaaggtgattccn

SEQ ID NO: 662496 - DNA, 117 bp, Homo sapiens
ggggatctcttgttccctgcttaatgaccacatcacattacttggtttgtacgctagtggctgaaccaaaaaaagtaggagatgatttttttttcttttttcttaaagcagttgccg

SEQ ID NO: 662497 - DNA, 207 bp, Homo sapiens
actcagatcggtgagttcacttacctatcttctcagagcacaaaactgaatgttcacatgtcaaaaacttcaaataccatttctctgcatctcacccaaaatacattagcttatacataacacaagctgtagtcagggcttagggtaaacatttgcttttgttttttactatcttcgcgggcacagattctcggccgggccccccgg

SEQ ID NO: 662498 - DNA, 211 bp, Homo sapiens
  misc_feature (127)..(127): n is a, c, g, or t
tatgggacggcgggaacggaaggctgccttcaagggggattccggaggccccctgctgtgtacactgtggcccacggcatcgtctcctatggaaagtcgtcgagggtactccagaagtcttcaccanggatctcaagtttcctgccctgttattaggacgacaatgagaagcttcaaactgctggatcagattgggaaccccccccgcagt

SEQ ID NO: 662499 - DNA, 307 bp, Homo sapiens
agcgcactagcctcatgaaaacagtctcgcatttgtttccatgctgcactgagttgtgatcatgcgactgcattcctggctggctgacagagcgagaccctatctcaggaaaaaaaaaaaaaaagaaaaaagaaaagaaaccagttctctggggaggggccccaaagggtccccagcctttaaaattgcccccattgagcactcgggacctttacgtgagtcccgcgaatcattaatatggcctcggtttacccacggtggagtgagggaccagttaatgatccccatacaaaacctcgggagccag

SEQ ID NO: 662500 - DNA, 454 bp, Homo sapiens
  misc_feature (150)..(151): n is a, c, g, or t
  misc_feature (154)..(154): n is a, c, g, or t
  misc_feature (164)..(164): n is a, c, g, or t
attatacatcccccccaccttttattaatttaataaaaaaagaatttcagcttttcttcctgaaagatgcaaatgcttcaaaaactgaacaagttgataaattataccgggacgagctcacccaccaggggaggggcaaccataatttanntanctccctacanctgcttaccaccatgctgtggtgcctaggaacagtctgtcataaagaaaagaacaatgcacttggaatataagcaacacgcaatttgcagaagagaagatataattatctacattggaatatgaccaggacaaccataccattcccacaaacaaccaagaaggcaaaaagtaaccaagagaggtttcggtatctggtatctattaagacacgtttggatatctaataattgtttaaatcacaatctaatgtttttatgctaccaaaaaatgaatcaaatttacaaaccct

SEQ ID NO: 662501 - DNA, 120 bp, Homo sapiens
  misc_feature (39)..(39): n is a, c, g, or t
  misc_feature (61)..(61): n is a, c, g, or t
agatgtgagactgcaataatgaatgtccatggtggtcantttgcaaagcactgcttctcgnattttctctggccacatgcctcttaagggttctctagacaccaatttcaggggccggtg

SEQ ID NO: 662502 - DNA, 206 bp, Homo sapiens
  misc_feature (182)..(182): n is a, c, g, or t
gcggccgcgtcgacgggtgtgttggtcaatctgcagctttaataatagacagacagcagggtgaattgcaggcagaaataaccccagtcagtcaattactggcccagtcagggtcttgtctctgtgccattgtttaatgtatctgacagttgccacagtccctggtctccctaaacctgccntggcattcatacccacctatccaa

SEQ ID NO: 662503 - DNA, 228 bp, Homo sapiens
  misc_feature (84)..(84): n is a, c, g, or t
aggcgagttctaaaccaacctgcgccatctgatccgcacgcagtgactgcgtgtaccttctactgtgcgcctcgtttcacaggnctcacccagattcagaggtggggaaactgagtccaccacttgagaagagtagctataaagacatatgagcgaggccagctgagcccagcactgcggccaagtcgaagactttaggagcaataaaagtgcttattgtgtttcagt

SEQ ID NO: 662504 - DNA, 145 bp, Homo sapiens
ccgatgtgcgaagtttccgatggcgaagtttccgatggcgaagtttccgatggcgaagtttccgatgcgaagtttccgatggacgagaccacccagaaggaggggacccaggccagtgaggggtacctcagtcaatcacatggag

SEQ ID NO: 662505 - DNA, 1942 bp, Homo sapiens
agcggctttccctgggtgcccacatgaacagagacaccaggatgctctcctgagaccacagcaactgcagaagctgaagacatttccagaagttcaagcttccaccctctgcaggtccccactgagctgggacccaggtcatccaccccaccccaaatccctggataggaaacccctttctcctcctgctccttgtccccttcatccctgccgcccagcatcctactggcctcagcacctgtggccagaccgtccaagatcctctgaaggcccagctcttgctgtccaccccggcagtaggcaggcagcctggccatgtgccctccggtcagcatgcggtatgaggaagagggcatgtcctacctctacgcctcctggatgtatcagcttcaacatggagatcagctaagcatttgcttcacctgcttcaaggctgcctttctagactttaaagacttgctggagtcagaggactgggaagaagacaactgggaccctgagctgatggagcacactgaggcagagtcagagcaggaggggtcctcagggatggagctgagctgggggcagagcccaggacagcctgtgcaggggggctctgaggcatgggggccagggaccctggcagcagccccagaagggttggaagatgcaggtctggacccccactttgtccccactgaactatggcctcaggaggctgtgcccctgggcctgggccttgaggatgctgactggacccagggtcttccctggagatttgaggagcttcttacctgctcacactggccaagcttctttccttcatagcaggggtttctcaaagtggacctgcccccaggggagcccgtggtgttgaagctgggcattacctgggcagtggaccctgccgaggctgaggcctagttactggccctgcagcttgtctccatggtgggctgctatgataccatctacctacagaagatgaccccagacagggccctgaggaccccagggcagcactggaaattgctgctggagcctggtgaagtgtgggtggtgagactccaagatgcaccccaagagcaggacctgcactggtggatgctgagcattctagaaacatcgttaacaggacacagggcagagctggtccctgcagcctcagccctgcagaagaggattcaccatagtctcttattcaccctggaccaacagggagagcaagaagggagactcagcctgtaagccacagtcctccagccaagaacaggatctcagcacccctgagacacagagcaggggtcctgaggaaagcctggctgttgcaggagcctcggccatgggggagctgccctgtttccagcctcagtccagggccccagaactgagagactaaggctcatgtagctgccattgtcctgggcacaccaggacatcagagactgggaagggccagcaattgctgttccacaacagccaggggagcagttggcaaaggaaacatggggagcaactttaggggctgggagatagggcctgttgtggcctcagagggaagcattacaaatattcataacctggaaacaagttcttaccagttgattgtcacatagttctggatgtgttggcctgaatggctgttgtgctgcttgtgacatggggggcagggcacagaacttgtgcctatttcaccttggccatggggagggacattgcttgtaaaacacatgctctgcagaacacaccagaatctgtggtgacctggatgtgttctcgactttgccaggacaatctcaggggtgccacaagaccctgtcagcagcactaggatctctggtctacagtggagggagagctggttttaaatgttggccgttgatgcaatttaaccatttaattcctgttgctctatatgttgtttttaattttaaaaagtcataaaagctttcaaacaaaa

SEQ ID NO: 662506 - DNA, 1869 bp, Homo sapiens
agcggctttccctgggtgcccacatgaacagagacaccaggatgctctcctgagaccacagcaactgcagaagctgaagacatttccagaagttcaagcttccaccctctgcaggtccccactgagctgggacccaggtcatccaccccaccccaaatccctggataggaaacccctttctcctcctgctccttgtccccttcatccctgccgcccagcatcctactggcctcagcacctgtggccagaccgtccaagatcctctgaaggcccagctcttgctgtccaccccggcagtaggcaggcagcctggccatgtgccctccggtcagcatgcggtatgaggaagagggcatgtcctacctctacgcctcctggatgtatcagcttcaacatggagatcagctaagcatttgcttcacctgcttcaaggctgcctttctagactttaaagacttgctggagtcagaggactgggaagaagacaactgggaccctgagctgatggagcacactgaggcagagtcagagcaggaggggtcctcagggatggagctgagctgggggcagagcccaggacagcctgtgcaggggggctctgaggcatgggggccagggaccctggcagcagccccagaagggttggaagatgcaggtctggacccccactttgtccccactgaactatggcctcaggaggctgtgcccctgggcctgggccttgaggatgctgactggacccagggtcttccctggagatttgaggagcttcttacctgctcacactggccaagcttctttccttcatagcaggggtttctcaaagtggacctgcccccaggggagcccgtggtgttgaagctgggcattacctgggcagtggaccctgccgaggctgaggcctagttactggccctgcagcttgtctccatggtgggctgctatgataccatctacctacagaagatgaccccagacagggccctgaggaccccagggcagcactggaaattgctgctggagcctggtgaagtgtgggtggtgagactccaagatgcaccccaagagcaggacctgcactggtggatgctgagcattctagaaacatcgttaacaggacacagggcagagctggtccctgcagcctcagccctgcagaagaggattcaccatagtctcttattcaccctggaccaacagggagagcaagaagggagactcagcctgtaagccacagtcctccagccaagaacaggatctcagcacccctgagacacagagcaggggtcctgaggaaagcctggctgttgcaggagcctcggccatgggggagctgccctgtttccagcctcagtccagggccccagaactgagagactaaggctcatgtagctgccattgtcctgggcacaccaggacatcagagactgggaagggccagcaattgctgttccacaacagccagggaagcattacaaatattcataacctggaaacaagttcttaccagttgattgtcacatagttctggatgtgttggcctgaatggctgttgtgctgcttgtgacatggggggcagggcacagaacttgtgcctatttcaccttggccatggggagggacattgcttgtaaaacacatgctctgcagaacacaccagaatctgtggtgacctggatgtgttctcgactttgccaggacaatctcaggggtgccacaagaccctgtcagcagcactaggatctctggtctacagtggagggagagctggttttaaatgttggccgttgatgcaatttaaccatttaattcctgttgctctatatgttgtttttaattttaaaaagtcataaaagctttcaaacaaaa

SEQ ID NO: 662507 - DNA, 145 bp, Homo sapiens
accaacgttgtctcagctgctagggtgagggctggaaatgggctggagtcgagtgctgggtggtaccggtggttgctgctggggtgtgggaagtcacctgtggagaggctctagtgattgtgggtgtgtgcccaatgatgccctg

SEQ ID NO: 662508 - DNA, 419 bp, Homo sapiens
ctctatataaatgcagtaggggtatgagttaatgtgtccttggaatgtattgttgagtgagggtgaggggcggtgtgtactgcgcttcagtgtcctgtcaaataagcactctactctcagtttactgctaaatccaccttcgacccttaagtttcataagtggctatcgtagttttcttggggtagaaacatgtatgcccactttctatgccactctcatgtggctacaccgttgacctacacgtctttacgatgggtacgttgctgcttactcttgtagccttcatcaggtgttttgctgaagactggcgtgtatatagtgctgagcaagattgtggtgaggttgcatcggggtttatctgattacatgaacatggctcctactagcaggtgatctgaatgcacctgccagtgtcctt

SEQ ID NO: 662509 - DNA, 657 bp, Homo sapiens
tctttaccctgagccatgtaccacagtataacgtgtaggcgaatgtaaatctgatgtcctgtctacacctagaatatatggtatcgcgagtgatagaattgtaaatagtatctagaaccaaggcactaagcgagtaccaatggagctaagcccctaatagcttatctgacactaatgacatgaaccttagcaagatgacctgttgcaatggacgtagactcagcagtcgtatactaagctcctcgcagagaccaggtagcgcacgacctcagcatagataatagctcgcgtaacaaaaggcacgtcaggcaacgcaacggtgccttagtgctactccaaaataactaagatcgtggggagacgagtctccacttacggcgatagcgatgcgcccgaggcaaaagaaactcttgaccacgcacgacactgtgcactgggagtaaacgagctcgcgacttgtgattgcccacacgcaacttacgtaagaattttccctcatgcgtttacacacgcgtttatctggcacatgtgtcgtccccccaacaagtaaatgtcacgcgtaccttcaaggaattactcgcactttgtgaatgcaaaacgtgtagcacgagtcctagactaaagggtggctcatctgcgccagttggacagccagta

SEQ ID NO: 662510 - DNA, 220 bp, Homo sapiens
agccaattacagtgaggaacgggcagtgcgggcgtcttgagaatccacagtgcacagaaacaagaggggagcggcaagtgccctgacaggaggcccctacttcagaggcaagggccatgtggtcctggccccccagcccatcccttcccacctaggagctccccctccacacagcctccatctcctgggattgggctatcaaggggactccgtcctagag

SEQ ID NO: 662511 - DNA, 169 bp, Homo sapiens
tcacctacatttaatagacagacagacaacaaatgactaaaactacagaccaatatctattgtcagctcctagatgtagaagctcttcaaaagcacttagaatcggacaagtacaggcaagcatatgaaacaagaatgtacaacatggtgcaatttgggacttttccgc

SEQ ID NO: 662512 - DNA, 97 bp, Homo sapiens
aatgggacttgagcacccatggattttgatatcaagttgggttcctggaaccatccccccatggataccaagggatgactgtattgcccttttcaag

SEQ ID NO: 662513 - DNA, 243 bp, Homo sapiens
gctgatccgcttaaggctgatcgcttaagcatatctgaacacacaatagctaagacccaaactgtgattagataccccactatgcttatgcctaaacctcaacagttaaatcaacaaaactgctctgcagaacactacgggccacagcttaaaactcaaaggacctggtggtgcttcatatccctctagaggagcctgttcttgtttgatttaaacttgttgagcgttagcggtaagcatagt

SEQ ID NO: 662514 - DNA, 196 bp, Homo sapiens
actcatctgcccggggtgcttcttcctctcccatccccctgacctcgtgccctgcccggctggtatgtaagatactgggttggtgcaccgtgatttttttcttgtaatttaaacaggcccagcattgctggttctatttaatgcacctgagctaatgttagaggtttgacagtgattcaacgtgcagatcaggtgg

SEQ ID NO: 662515 - DNA, 857 bp, Homo sapiens
gagctctgcgatgggccggagcgcggcggagccatgctgtacccgaccccgggccgggggggcgccgtgggggtgccgtgtacgcgcccacgccgctgctgcaacccgcaccaaccgacgcccttttacatcgaggacatctgtggccgcgggcccgccggcgcacgcagttcccacgctgaccagatccctcaactcctcttttaccagcctcgtgtccccctaccggaccccggtgtacgagtcccatgcctgatcccgctgaggccttactcgcaccatccgaagccgtttggcacgtgccatacgcacccggcagagctgcggggcgccctacttggccccccattcactgcgggacagagatgaaagcgacctaaagcgagcatcgcccctgcattccggcctagtacccccatgttctcaaacctcctattcctggtaagccacatatctttgacaccaagtgtctaacagtgccactagcaccactgcacaggcgcctgctcttggagaagatttctcccaacaggtacatgactacaagttcgacgcctttaacacaaactaaacaatgtcgcgaggaaccgcccgaaaaactaatcattcaacctccggccgccgcaggaggcaaaccaggtcttggacccaacgcatgttctggtgtctcaatcacatctgatgcggtctcaagtacctgggtgatgagacaatcgaagcccatcgtagaaatggctctgtcaaacaaacttcgctttacattccatcccacatcgatatgtcaaactggaatcaccgcaacgtctctgctcactttgatccaatggtcaacgcactcacgttgttctctgggggaa

SEQ ID NO: 662516 - DNA, 397 bp, Homo sapiens
  misc_feature (39)..(39): n is a, c, g, or t
  misc_feature (230)..(230): n is a, c, g, or t
  misc_feature (233)..(233): n is a, c, g, or t
  misc_feature (235)..(235): n is a, c, g, or t
tctcttgaggcccggagttggagaccacctggcccaacntggtgaaaccccgtctcctactaaaaatacaaaaattagctggccatggtggcacacacctgtaatccccagctacctcgcaaagctgaggcaggagaactgcttgacccccaggaggtagaggttgcagtgagcccaagatcctgtcactgcactccagcctgggcaacagagcaagactccatctcaanggngnattaataaataaaaataaaaatattaaccccattttatacaaaggaaaaataaatatgtgccttgtcgaagtgagagtaagaagagagaaaggtcttattactataaattcactgttttttctcagtgaaaaggccacactattacccattttaaaaataca

SEQ ID NO: 662517 - DNA, 487 bp, Homo sapiens
caaatcagcacccgcagagaaaagcacatacttaccagaatttttagcaagtatggttcgggaattcttgtggtttacgttttttaaaaaaaggcccccaggaaaagtaatttacagtttaattgccactgtcaactgatctggaccttgatcgggaccgggacctctggtgatccacagatactggagacttagatctacttgaaagaaccacgtttctggcctcttctacaggccacgggaagacctactaacagaacgtgacttgctccgggtccgggctccgtgatccctgcttcttgaccggctgtaagatttgcgactacgggaacggaatcggctacgagacctagaggaacttctggtccggggatcgaggacctgcttcttgacctactggtgccttaggctgccttcaattcatttaattttactcccataatttcctttccagaaagtttttacatagcattctttaagtcaccat

SEQ ID NO: 662518 - DNA, 494 bp, Homo sapiens
  misc_feature (1)..(1): n is a, c, g, or t
  misc_feature (81)..(81): n is a, c, g, or t
  misc_feature (86)..(86): n is a, c, g, or t
  misc_feature (146)..(146): n is a, c, g, or t
ngggggttttgaacctgtaaaatttgtccatcccattttaaatatttccctttaactgtcctcaagatatacccaaaagcntggtnccattgtggaaatgtgtgcccagtctcaaatgccatgtagctctgtaggatggaaagtcnagttatgaagagagacttctttttcttctgtgtcctgttgattaagaagaatctgtatggccgggcacgggttgtcacgcctgtaatcccagcactttggaaggctgaggggggtggatcacgaggtcaggagttcaagatgaacttggccaagatagtgaaaccctgtctctactaaaaataaaaaaaaaaattagccgggcgtggtggtgggcgcctgtaatctcagctacttgggaggctgagacagagaattgcttgaacccaggaggcggaggttgcagtgagcctagatcgtgccactgcgctccagcctgggcgacagagagagactccatctcaaaaaaa

SEQ ID NO: 662519 - DNA, 410 bp, Homo sapiens
tatagaggctatagggaaaagaacccaggaatggcatagagagaaaaactttcattccaaaattaatctccagacaaaggggatagaaacaaagtagacaacatctccggcaggcttcagagtgagacggggccaaaatagttaccacagactagcagcgtcatggactacggtttaggttctagtgactcagtccagtgtaaaaaatcacctattattaatccacctccattctctatcgaagagtttcttaaagctagtccacagatcacttactataggatcgccgggacagctggttaagaaatgcacattcctggtgtctcacccaaatcaagggacaatacaaattattatttatttatttatttggaggcagaatctcactctgtcgcccatacgggactaca

SEQ ID NO: 662520 - DNA, 286 bp, Homo sapiens
  misc_feature (59)..(59): n is a, c, g, or t
  misc_feature (185)..(185): n is a, c, g, or t
cgcaaagaccttgggatggatgacttgggtatttactcttgcgatgtaacagacactgntggaatagcatcaagctacttaatagatgaggaagaattgaaacgtttacttgctctcagccatgaacacaagttcccaactgtcccagttaaatcagagttggcagttgaaattttggagaaagnccaggtccggttttggatgcaggctgagaaactgtctggcaatgcaaagtcaactacatatttaacggaggaatttttgaaggcccgaaatataaattgca

SEQ ID NO: 662521 - DNA, 738 bp, Homo sapiens
  misc_feature (101)..(101): n is a, c, g, or t
  misc_feature (205)..(205): n is a, c, g, or t
  misc_feature (235)..(235): n is a, c, g, or t
  misc_feature (283)..(284): n is a, c, g, or t
  misc_feature (311)..(311): n is a, c, g, or t
  misc_feature (315)..(315): n is a, c, g, or t
  misc_feature (329)..(329): n is a, c, g, or t
  misc_feature (341)..(341): n is a, c, g, or t
  misc_feature (349)..(349): n is a, c, g, or t
  misc_feature (363)..(363): n is a, c, g, or t
  misc_feature (371)..(371): n is a, c, g, or t
  misc_feature (374)..(374): n is a, c, g, or t
  misc_feature (391)..(392): n is a, c, g, or t
  misc_feature (398)..(398): n is a, c, g, or t
  misc_feature (400)..(401): n is a, c, g, or t
  misc_feature (420)..(420): n is a, c, g, or t
  misc_feature (433)..(433): n is a, c, g, or t
taacttatgtgctaggtacgaggctgggttgtgggaattggcctccgctgcgtgagcctggcggaacccgcttcccgcctccacggggcagtgccagcggnctggtcctttcaccggcagctccgtgccgacgctctcaccgctcttcctatcgccgggagtggcgggccgaccagggggcggccgggctaccgtccgccattcncgtgtctctgcgcccgcggtggccgcccgnagccggccaccatgccgctgggcctgaagcccacctgcagcgtatgcnngaccacgtcgtcctccatgtggaagangggngcgcagggggagancctctgccatcnttgcactnggccggggctggcngcgggcangcngggggcgcaggctccgnnggtgcngnncttggagggactgtggagnctggctggcggcngcttcggcgcggcgaccttcgccagcacctccgccaccccttccgcagagcaacgggggcgggggcggcaagcagagtaagcaggaaattcacaggagatggtctgcttcgtgcatcaggaacatcactaatgtacaaaatctgcatccggctagctgaataacgaaaggtctccaaccaagaaggaaaatgggagaagacactagtactttaaacttgatgaaatcccatcaaatgctcctgagtcagttgccacgatttgtcactgcagaatccaatcttctagcaagggagtatattaccaa

SEQ ID NO: 662522 - DNA, 445 bp, Homo sapiens
ggttgtaacagaataagcagaagtttacagcatgatagtccaagtggtgataactttaaataaaactcaaatttttactgtttgtagacaggaatgctgtcctagagaacctcctcctcaaccagctacgtacatagttttatcctatgcattcctgcactccagcctgggcaacagcgagactccatctcaaaaaaaaaaaaaaaaagataaaaagaatgtagcggccgggcgcggtggctcacgcttgtaatcccagcactttgggaggccaaagcgggcgattcacggggtcaggagatcaagaccatcctggctaacacagtgaaaccctgtccccactaaaaatacaaaaaattggccgggcatggtggtgggcacctgtagtcccagctactcgggaggctaaggcaggagaatggcgtgaacccatgaggtccgtctc

SEQ ID NO: 662523 - DNA, 112 bp, Homo sapiens
  misc_feature (23)..(23): n is a, c, g, or t
  misc_feature (32)..(32): n is a, c, g, or t
cactccccaccgggggggcggtntcccttatntcaatcggcccacccccccgcccaccccacaggcattttcagaccccaccagcacattcctaacagctccagctttccag

SEQ ID NO: 662524 - DNA, 375 bp, Homo sapiens
  misc_feature (233)..(233): n is a, c, g, or t
  misc_feature (280)..(280): n is a, c, g, or t
  misc_feature (310)..(310): n is a, c, g, or t
  misc_feature (326)..(326): n is a, c, g, or t
tgggtggatcacctgaggtcgggagttcgagacccgcctgactgacgtggagagactccgtctttactaagaatgcaaaattggccgggtgtggtggcgcgtgcctgtggtcctagctgctggggaggctgaggcaggggaatcgcttgagcctgggaggcgtaggttgcggtgggccggggtcgcaccactgcactccaccctgagcaacaagagcgaaactccatctccanaaaaaaaaaaaaaaagaaagcaagaaatgcctcaggtacccccagangaaaaagaggtctccaaaagctattaagtncatttatccactccantaagttatctagtaacaaagaaaaaaagtggtatttatcaactagctat

SEQ ID NO: 662525 - DNA, 478 bp, Homo sapiens
  misc_feature (14)..(14): n is a, c, g, or t
  misc_feature (23)..(23): n is a, c, g, or t
  misc_feature (350)..(350): n is a, c, g, or t
cacaatccccctgncctaggtcnaacctaatttttgaccaaagggtgcaaagggcaatttgatggggaagatggatagtcctcctacaacaaatgatacctaaaataattgaattcccatcccacaaaaaaggggggtttaggatctttatctcaagcccataagtgaaacaaattaatttggtcagctacagcggctcacacctgtaatccccagcactctggaaggccaaggtgggcagattgcctgagtcccaggactttgaggccagcctggacaacacggtgaaaccctgtctctacaaaaaaaatacaaaaactttgctgggcatagtggtacacatacattantgggaaaacccagctacttgggaggctgaggcgggagaatcacctgagccaggaagtcaaggctagagtgacatcatgccgctatactctagcctgaatgacagagtaagaccctatctcaaaaatta

SEQ ID NO: 662526 - DNA, 208 bp, Homo sapiens
gcgtgcccagcaagttgattcaggcaaagaaattactaaaacaaaatagcccgcccccctattcatcgagaggatggactattcttagttagacaaactacttcacagacctaattattagcattgaacagcacacgtgtgggaattgggcggcggctagcgaaggaacacccctgcgatggtgatcttgttatccccgtccccgaat

SEQ ID NO: 662527 - DNA, 432 bp, Homo sapiens
tctcaaactcctgacctcaggtgatctacccgcctcggcctcccaaagtgctgggattacaggcgttagccactgcacctggcccatgaaaggtttttacagtgccaaatgattcagagtaaatgacatataattgacatagaatttgtacaatttagtttgagtcatcatagaaacttcggctattaaactggaattttatcgttgacaatttttttaaagtaaaatggaaagtcaggaaaactaatttctttcaggcaaagcaaatatgagccattttattattattttttaatttgttaatttttagtttttgtgggtacttactaggtgtatatatttatgggttgcatgagatgttttgatacaggttgcaatgtgaaataatcacatcatggagaataaagtatccttccttaaacattaaaaaaa

SEQ ID NO: 662528 - DNA, 258 bp, Homo sapiens
atgggaggatcccggtacgagcacagttgctggtgcgggggatggcaccacatggcaccgttcgttcactactggatagatacgaaaacaggtctaaagaacaaaaggtgtcaggaggctgaggaaggcgaagggcatgaacccaggaggtggaggcttcagtgagccgaaatggtgccactgcactcccgcctgggcaacagagtgagactcctatctcaagaaaaaaaaaaagaaaacaggaaccgaaagtgggtg

SEQ ID NO: 662529 - DNA, 869 bp, Homo sapiens
agctttaattttttgtatcggtcactctgatagcagacattgactgaagcaaaaaattaaaagctttatattcaaaatttgcaaaatgaagctgggtgtggtggtgcacgcctatagtcccagctacttgggaggctggggctggaggattgcttgaggtcaagtattggaggctgcagttgtaccatgatgttgcctataggaatggttactgcactccaacctggacaagcgttatcaagaccccatctcttagaaaacatgcaaaattaattgcaaaagaaatgggctgggcatagtgattcatgcctgtaatctcagtaccctgggaggctgagcggtggaaggattgcttgagtgcaggagttcaagaccagtctaggcaacatagtgagaccctgcctgtaaaaaaaaataatacaaaatacgttggatatggtggcatgtgtctgtagtcccagccactctggaggctacggtgggaggatcagtagagcccaggaggtcagggctgcagtggggcatgatcatgtaactgctctcaaactggggaaatcagaccctgtctcagagagaaagcgacgccacatgtcagacagggttttgaaaggtttggagcattatattctacagtttaaggttaattactgactttgatacttgatttccataaaaggcccatttaaagagtaccccaacagggccataggttggcaacgcgttttaggaagttgcaccaggtttacacgtttacgaaggcgcatataaggaaacggggtcccacccacccgggccaatcggtctagaacacccatctgtcgggaaagaaagcctcaaaaggagaaggcctatatagtaattgcataaag

SEQ ID NO: 662530 - DNA, 485 bp, Homo sapiens
gggggccgtattctctctccgggaatccaaaacaccacctttgttgctggggagggggggtcaaacccactggggtggcccttccttttggaaaaaattgtgatccggtccttttgggaacggcccaaatgggcccgtgacaaaaatgccccccttttggggggtttttttgggcccctttccctgaatgggggggggaaaccccccaaaaatttgggggcccccgtgccccctttgggcaaaatgggggggccccattttgggttgggggaattttttttttccaggccccccctggggggcgtgtgtatttgaaaggtaaccccgggggtattttccccaaaccgggggggggttttcccgggtccccagggggggggggggtggtgggggtttcctttcccttttttttaggggggccccaaaccccccctttggtttttttttttggccccttcctttaaataaagaatttggggccccca

SEQ ID NO: 662531 - DNA, 219 bp, Homo sapiens
gtatgttcaatttttatgaaattgaagatgaaccaggaatttatggtgataaaaaatacgatagcccagcgcagtggctcacgcctgtaatcccagcactttgggaggccgaggcgggcggatcatgaggtcaggagattgagaccatcctggctaacccggtgaaaccccgtctctactaaaaatacaaaaaattagctacagcgagactccgtctca

SEQ ID NO: 662532 - DNA, 1020 bp, Homo sapiens
gctggctgctatctctagaggcaagtctgacagtgagagggcactgcaggcgaagcagttgtgcttgctcattgcctcagtgccaagtgtactctacgaaaagaggcagtacagcatgtgcggtgctgatacggtaaagcctcccgcccatccgcgtgcgagctccgccggcccgtctagctggcaccagggggcgtgtatgttgaagtgtggtaacctccccatcttccaaaccatggatatggtctcctttcatgagaagcggaagcttgatctcctagactccctgagtctgaatccgttcaaaggcacatgtaggcagtaattgatgggctcacagtgcagcgtagtggctgtggtgcactactgccgttagcgagtcaacatcattcatcactatggcgcgtttctttaataactgatgcacttgtgtaatttgataacgcaggaaattgaattaaaaggcagtactgataaaggatgcactctggagaaacagtgcggagagcactcatttggttcggtgttgccggcaggacagggagtgcatagtgcaagttgggccaccagtggggtccatgggggtggtataccgtggccgcgcaagggtcttttgtgttcacacgtgttgggtacaaactagtggcgggggaccccgcagtaaatgagtgggagttcggcattgagttgcctggataaatcccgcggttttagccaactgggtgtagcagtagatctcggggaaacacaaatgggaagggactgctgacaaatggaccggggaatcattggaacattgctgaagagcgggggccaaagaaaggaaaagggggaaatgtcactagataatttcgcgtattacgcaaataaagtacacaaggatgggaattggtatagcgagaagaggtttagaagttgaataatagcaacccaaaaaggaatgacattgacaataatttagaattgggagaacggagggacagaaggataaaattggcttagcaattgtggtagaaagat

SEQ ID NO: 662533 - DNA, 823 bp, Homo sapiens
tctggacggagtagctccaagagctctcactgtgacagcccacctcgctcgcagacaccacaagataccaacagagcttctgaaacagatacccatagcattggagagaaaaacagctcacagtctgaggaagatgatattgaaagaaggaaagaagttgaaagcatcttgaagaaaaactcagattggatatgggattggtcaagtcggccggaaaatattccccccaaggagttcctctttaaacacccgaagcgcacggccaccctcagcatgaggaacacgagcgtcatgaagaaagggggcatattctctgcagaatttctgaaagttttccttccatctctgctgctctctcatttgctggccatcggattggggatctatattggaaggcgtctgacaacctccaccagcaccttttgatgaagaactggagtctgacttggttcgttagtggattacttctgagcttgcaacatagctcactgaagagctgttagatcctgggggtggccacgtcacttgtgtctatttgttctgtaaatgctgcgttcctaatttagtacaaatacaagaatagaccacttaaaatcatgtgatctatattacacctaatggaatcaataagcttgtcagactgatttactgtctactgtgcaacattgcgtattaaatttcctttgatttagatatacatatctcgaatttaattatttcaatcatactatcagaagtgggtgggttctacaatttttgcgccctaattcctgaggtcttttttcaggaaataaaaaatggaaaaaacaaataaggggtggca

SEQ ID NO: 662534 - DNA, 210 bp, Homo sapiens
ggtagctcagagagaaaagtaggtctcgcagttgtcctgatgccagtgagctccaccatatcgtgtcccatcctgtcaaagcaaaaaaagagaggctggtctggaatatgtctcaggtgcgctggatgttgggaaaacattcacgaggcgttagatagggacgtgaagctgcgctgtctgtggctatgaggcacaaggaacttgtttgtg

SEQ ID NO: 662535 - DNA, 281 bp, Homo sapiens
tctacagctatagctcactagctcacaggtcttctacgtcttctggtatgtcccacagggctatctgcacttgtccttgagcgtgagcatcctcatcatcctttaacgttctggttgataacgctggattaatccccggagcgttgaggatacatggaaggctcaggaagagttcattctcaatgcgatacatcgcctttaccattgttgacacgggatgaatcctggatggatttgtcacgatggattcaatcggatcgggcagacttaacccgaggcgc

SEQ ID NO: 662536 - DNA, 1158 bp, Homo sapiens
  misc_feature (897)..(897): n is a, c, g, or t
cgccgtactgctggtggtgcgtcggacatgtagggatggggcttgctcgtcgtcccgtcactgccgtcgagccttgtgccttgttcccgtgtccatgactggggggatcgtcgtctgggtatcggctgctgcgctgtggggactgcgggtcacttcttgcagggatactccctctcccgcttcggtcgctatttgtgttgtgccggcgtgttgcggtcgccggtgggcccgtggaggtgttgttgtttgtgggtgggaaaggttggcaaaggggttttatattgtccccttactggtcccgggcatagccttgtaaagaggggccttggttttaattccgcgccgcaggacgcccaccaccaagcggctggggtgacgccggccatacccagggcccaaggggggtggtcccatacgggggtctgtgaagaggaacctagggagaccgggtgtatatgctgtggtacctcaagtacaaatgatagtttttagacttgttgtcgtaagtaaataaatggattatatatgcgagatgactcaaaatagtgtttgaaaggaggggtgatacctttaatttaatgccacacccatctggcacaccatcgggcccgtggccccccacgaacaacctgtgcctgtagaatgtggtgcgtttaacgatatcccaggccccctgcatttgtgtggttgagtctgttggtgtggaacctgttttgggtaaggggggaacgcgaggataaagtatccattggagacaatgtgctgagaggaaaactcttggcttgttgaagaccctgccacccctgtggtgtgggcggtttctttggagaggaaacgtttaatgcacaagaatatgttcacatggagaaggggaccacaccatgttgtatgatgttnattgggggccttcgcgacgtggacctggacccacacagtgggtaatccctggtgaaccatggtaaaccagccacagggatgtggttgaaggccgttcacagtgaatggtggggtgtggaataatgttgactaaccctggtccaagggtgttggtgttaaccctctccctggtaatatgggtggtaccatgaatgtaattggttgggtaattattttgggtaacttttatggatgtaatatgttattaaccagatttttacc

SEQ ID NO: 662537 - DNA, 1454 bp, Homo sapiens
  misc_feature (1153)..(1153): n is a, c, g, or t
aaatggcgcctccggcccccgtgacccggcctccggcggctccggggagtgtatgactgagactgttctgactgtaaatgaactgccttctacatctggcagctaccagcatgtgcataaactgatggctgcagctgtgtgtgaatgcttgtcaagcccagagatgagactgtggatgatggtgactgtccttcctgggtattagatgctgtaccattggctgcaagatgtgaatgttctgggtgttgtgtccttgtgattgatgatcaaatgccactccatcagtgcgcatcttgagcatccaatgtgcccgttgctgcaatttgtatttgcttgaagctaacactctgacaccaactgactgactgtctgagtatgtgtggaccaatggaatactgatggggcactgatcgccattggggaccgtgatggatcgcattgacagccgacgtgaaggctgttgcggacatcgttgaacccaaagcgagcacaataccagttacacgttgcactccatgggggaccacttcaccatacacgaagtacgttagtcatacgcaaagcttgcaccctagtggacatacccacatggtggaatggcccaggcgcccccttggcacggattgacagtgtccttgggccagacccaacgtgtgtcgtggacccaatggcctcttggtgcacgcttggaccaacgaaaggcgcacaatttgaacccaatggttagggcaggcaattgcaccttggactttggcaaagggaccttgagaatccaggcacttggggacccctcctcgacacctgtggaacaacgggggatggcctgtggcagcatggcattgcaacattgggctagagtggaacgccatttgttggcagccacgaacgtggaattgggcacagacagcacgttaaccaagcaccgccaaaagacagtcctggcacccaagagtttatggtcaccttgggcgtggttaccaatgtgaccaccatttgggtggacccacaactgctatcggtcgtatttggacagctcttgggacatcggcaataatacgctgctttgtgggaccagtagcgtgagacactttggggccacttttaactctttctaacccaagaagattaacatgatgataccacccacaaccgncggtgagcaccgtagccacagcatgttgagtgaaccatttgggacaacacaaagacagtaatgggggcagagttcccaggaacgccggcaccaaacacagcgacgaattaggcacgaattggtgcccaagtgcgtgaccaatcaccagacgaacttggtgaggcggaccacaactaggtgacacggaggggcacccgaattggtacaccacacacccaaacattgtggaggcacccacaccaacgagtgggtggccacagcctcagcacctaggtgcgagacaaaagcaggagccaacagg

SEQ ID NO: 662538 - DNA, 1366 bp, Homo sapiens
ggagagagaactagtctcgagtaataaatgatcatttttggaacctttaaaatccctcaaaaccggttatatcataccaagtgagtttggagctcaccatgggctaatcggcgagattccgggtccccgacacgcgggcaccagggccaacacaaacttcgtgggactacgcagacgacaagggtacagatcaccagcagggctaccgcgtacactacgggcatgaggatagtccttggaaacgtcctatctgggaagcctcatcacaacatcataacccgggcacaatagggccaccccagaggacctcacgaggcacaacggccacacgagacggagaaacccatataacgctagggggggcaccagtggagcacccaccgaccccactaacaccacgcggcacaccggcgactaccaacaccacaacaaaaaacagcaccattgccgacacacagcaaaccagcggctccacagccccacctgagacacccgcgtcaacccgtagcggcgcgacaacaaacacatcactcccgcgaggccccgcccacgatatacaccctcgtgagacaacaaaaccccaatgtcgccgcgcgaatcgcgcccgaagagcgcacaccagaacgagtccactcgcacactacctacccgcctcccagaaaaaaacccaagccatccgcaccgtcgacaacccgacaccccccaatgagcagcccagagcaacgtgccccaccaaagaacgccaggagcgcacactacaacacccaccccctcacccctgcagccgacccgctgcaacaacgcacccgagacagctgcaacacgcaaacgcgccagagacccccagccacccgcagaacaccacagaacacacgtgcaaaccaggcacaccacaatgcggaccaatggggcaaataaccaccagacaccacatcccgacacggccgtgcataacaccgcgccaagaagaacccaccacaggcgaccccacctgacacaccacacgacggacggctccgaacactgaccgtcgcccagcacccggagcccgcccacgacgcccaccagcgcctcccaccaacggacacaaccaacgctgatgcaggcgccagcaaccagatgcctggacacgccgagaacaacccacgcgcacaaacgagcaagatggactactgccacaccgctatacccacaccgcagaacacaacaccccacaatacgccccacggaacacaccacagaaccaggcgccacacagactcaacacgccgaaaccccgcccaccgccgcaaacccgcgcccccggcgcagaaaaccacggcagcacgcacacccatgccaaccaccgactgcccacgaagcgaca

SEQ ID NO: 662539 - DNA, 100 bp, Homo sapiens
cgtcccctcccgcagcaccagcggccccggtgtgaggacctcgaagcccagccacggcggcgtgatccgctcgaggttcagcgcgtcggagaagaacgcg

SEQ ID NO: 662540 - DNA, 772 bp, Homo sapiens
gctggaggaaactgcatctgacggactggcctgccagctacgtggaggacctggatgtggcactgggctgccctgacgtgaccatccccgtggatcctgccgtgcccctcgtgcgccccgccccgccgggccgctcccctgtcgggttccccaggccacagccttacctacggtgctcctgactcctgcagaggctatccgagaaagatgcatctgaaccgacctggccgtgggcctcggggcagcagtgagtgggagtgctgtacaggcccccactcagctcttctcctcctgtgccaggggctccccgggggattgagcatggttggtttaccctcgtgagcccccctggactcgggacgtctgagaagatgccggtcactgaggcttgttacccttgcttccttgcagctcctggccgggcttggcgctgactgctgtgccccacccagcagtgggccttgtcttgcatagaggaaacggctcgacagagggtggaaagttggtacccttaccagagacagtgtgaggagccgcaagactacttgccgggcagctgggagaagtgcatgggtggcactgtacgtgatccagaagatatcccccgaggcggagcgttgtcacgcacattgtacaagcaccaattcctgatagtatccactagcatggcgcatgcacaccgagattgatgacgagctaatagagaaatactgacactgtagtgaccgatggagacggcaaaattgtaccaatgaagctccgtacaaatccg

SEQ ID NO: 662541 - DNA, 348 bp, Homo sapiens
  misc_feature (107)..(107): n is a, c, g, or t
aagagtcaccgctaagatcatccaagtgttttcatggtctgagccgccgctccatgttcccatctctcactgcccctcggccctgtgctgagctcttgttctcccanagagggggctcagatggtgcggcctgagtgtgcggccggcgggatatgggatacacccgtagggtgggcggggtgtgtcccaggcctaattccatctttccatccatgacagagatgcccttgttgaggctggcctccttgtgcgcctgtccccacggtccccgcggcgtgagccacgatgctccccatagcccacccattcccgatacgccttacttactgtgtgttggcccttatcgag

SEQ ID NO: 662542 - DNA, 207 bp, Homo sapiens
ccgggttgggaacgcacacgctggtgcctgtcaggagtcggggggctaggggaggaatagcattaggagaaatacctaatgtagatgacaggttgatgggtagcagcaaaccaccgtggcacgtgtatatctatgtaacaaacctgcatgttctgcacatgtactccagaacttgaagtataataataattaaaaaaaaacacacag

SEQ ID NO: 662543 - DNA, 772 bp, Homo sapiens
gattcacccttttatttctttctctctgagaagggatctcactctgtcacccaggctgagtgcagtggcctgtcatggctcactgcagtctcaaatttctgggttcaagtgatcctcagcttcctgagtagctgggactacaggagtgcaccaccacacctagctatattaaaattatttttgtagagaggagggcttgctcctattgaccagtctggactcaaactcctgaactcaagtgatccttctgcctgtggctcccaaagtgctgggattacagatgtgagccacttcgcccagcccaccgtttattttaaagaacatgggagctatcatgtctggaaggtgtgttgcaatctaattttacctattcactctcctccttaaatttttctttgtgacttttctgcaaccagtaagggaaacctcagattatcatgagaatctttctaaatccctccaatttttcgtaacttcaccaggactgtgccaagacatcacaggtgacactttacaacatgtgcttcctcgtgtatgtctgtgagtctaaacggaaccatggatttttattttctcaggaaccaaacatcaaaaaggttcttatcaggagaggatcacatgggacgtgaaacgcaatgattttcattcaccttgttcagcacttaacttcaggggtagctccctctggtgagccctgggggactttacatatcctgttcttttaaaaaccccctgggatcacaatctgggggtgtgcgccacgcaggaacgt

SEQ ID NO: 662544 - DNA, 118 bp, Homo sapiens
gaatctagaggattcccaggaggctccgatctcatctacaggatagagaagcttcctggaggaagcaggtttgagatgaaacctgaagggtagaagataaatagatgaaggaggagga

SEQ ID NO: 662545 - DNA, 1271 bp, Homo sapiens
ggctgggaccctgagtgcggcctgtggttaggctggctccccgtgctggctcctccgcggcggtgacaggcgactgcactcccctgcttccctgtctccacctgctgcctccctcctggccctgtgtgttccctgccatgcactgatgtgcctggctccctgacgctgtctgtgaacgatgcctggcctgtgtccaatgggtggactgggatgctggggcctggcggtcttcatctcgtgcatcatcctgccaacttgtcaacacagtcacacagcacagccagcacacatcaacacacacggcatccacaccaaggcacacttggccaacatcatccagcatcaaacacatttcacacagtgtcgcaccacatggcacgcttgcattggctcatcagtcacacacacaaacagtcacgtcttgcaacgtatggctccttcactcttgtctcccttgcgtcatcgacatttgacttctgtgcacacatcggcggcttgttgacacctgctgagttcaaaccagctacaccggcaccaacgcagcatcggcgtacccttttcatctctgatgtatggctgaactcacaacagttgcgctgatccgcctgactgaacaacgaccatcacagaatgacctggccagccgcagacccaccttcatgggccttggccctgcactgacatcgccagcagtggcgcagccgggagatggcagaggcttcgccggggagatcctaaggtcctcgtagccggagacactatggacagcgtgacgccagaccgcggccttgtgcttggatgcgccttgtacagggacgtcccacgaatctaggccccatgggcgcctggacctcacgagtggtgcaccttgcttcacttcgaccacacttgaggtcgtggacactgccagccactaaggctgatcacaccagtacacgacaaacagaacccaagacagagtaaaagacgccagagactcatgagcagggcctcaggggcaacgacgcaccggcgagggccggccacaccaggacacccaggaggacactaccaaacctgggcccggacccagggccgagcgcaacccccgcggagccgcggagagcggaccaccccaagaccacgggagggcgagcagcggcaccccggcgaccccagcaacgacacaagcagaacacgcgccaccagcagacacagaggaaggcaaaacacaagacgacccgcggggcccagctccgcgcccacccaggagaacaacaacaacagcggcg

SEQ ID NO: 662546 - DNA, 97 bp, Homo sapiens
  misc_feature (87)..(87): n is a, c, g, or t
ttcgttgcgcagtagtgctagctggcttcgcggttcggtcctcgcttcccggcagccgcactggtgctgagctgctaggaagccccntatcgcctga

SEQ ID NO: 662547 - DNA, 257 bp, Homo sapiens
ggcccttaaaaaccccccccttttttccccccctttttttttaaaaaaaggggggggggggtttaccccaaagccccctttccaaaattttttttccgggtttttgggaaaaaccccccaaaaaaagccccttttaaaaaggggggttttttttttttaaaagggagcccccccaaaaaagggggaaattttttttttttttttttttgggccagggccccgggaaaggccccaaaaaattttgggggggggcccca

SEQ ID NO: 662548 - DNA, 228 bp, Homo sapiens
gctatagatcttggcgcggatcttggcgcggatcttggcgcggatcttcggcgcggatcttcggcgcggatcttcggcgcggattcttcggcgcggattctgcttacggatgtggaggtcagacgtgctacagaagcagaacttgtcaggatgcgtgcaccgagggtgactcggggcgtgtgtgtgtgtgtgtgtgtgtgtgtgtgtgtcatagacagtgtctcgctc

SEQ ID NO: 662549 - DNA, 83 bp, Homo sapiens
aggcttggtgtggggctttcatttatcactccatttcagtctctttctcagtgttttgtctctgccccttctgtcgtcttctc

SEQ ID NO: 662550 - DNA, 108 bp, Homo sapiens
ggcacgagtgcccgcaggcattgcccgagccagccgagccgccagagccgcgggccgcgggggtgtcgcgggcccaaccccaggatgctcccctgcgcctcctgccta

SEQ ID NO: 662551 - DNA, 669 bp, Homo sapiens
gtttagcctcccaagtggctgtcactgggggcatagcagccagtcgtgcctggctagttggtgtattctgggtgcgagatggggtttctccatgtatggccgggagattctcgcggctcctgcgtcactcgtggatgatccctcctgtcctcgagtcctcccaagagtgctctgcaatagttgcaggcgtgagccacctcacccggcatgatttagataagactttgaagcttagacttttaagggtgatgctgaaacaaattaagacttcttggggttattaggatggaatgaagatattataggatgtgagaaagatatggattaggggagctaggggagaatgctatggtttgaatgtttttctctatctccaaaaatttatgttgacatgtaactccccattacaatagtattgggaggtggggcctaatgggaggtcatgagggctctgacctcattaatggattaataccaatgtataaacgggcttactgccatgtgaggacacacatttcatccctttgtaccctcatgacattgttgccatgtgaggatccacgccaagaaaagcccttatcacaaccagatgtgggcaccattctgcttggactttccagcctaccagaacagtgagaaaatacatgtctagtactctgtaaaggaccg

SEQ ID NO: 662552 - DNA, 1077 bp, Homo sapiens
  misc_feature (341)..(341): n is a, c, g, or t
  misc_feature (495)..(495): n is a, c, g, or t
ccacgtcgctctggtgattcgtggactgaaggtagtaacagcgcagcccagcatgtccggcgcctgttctggtggtgaccagtgttacagcaggaggacgtgagcgtgcagactccgagattgatcatggcatcactgagggaccgtaagtgtcgctccattcagataacccttgtcagagtagtgctacacgtgaatgcgctacaaccgacgtcactccgatatgactcgcatgcgaaggggtcaggactcatatcctacagcatgagcttcgtgcaaggcgcatggcaccaaaggggatcatcaacgagctattgactgcaagcctagagccctccctntaactctagtgagcggccattcgggttgctctccctagaagggattcctgtgagtgcttggcctgggctggctgtgagaagaagatccgcatgtactcccagaggaataccaagcctagtgcgtgaaaccgttgcgaaccgcctattttgcagngcacaagacgtatacgtgggctaccagcgcagtgctctgagttgtacacttgtatcccccttggttcttgtatacctcatcacgcgtagcctaagtcttcttagatgggagacgtctccgcgtgaaacgcatttgttagaatggggggatgggagaggaaggatataagagggagaccatccccattcggcttaaaaggtcttgttgcatcctatccttgttgacgggtctaaccatatgaggacgcagcataatgactcttaaagttcgtttatcacctctattctccccccttccccacgggttttctcccactgagcgttcgctataccagaagggccttgttcattgccccgcagaagggcggccccttcttttgcccccgtattttccaccatgcatttgtgcgtcgccatgaccttaaattacttgaaagggggcccaggaggtcttccccatgggttgggctttcctttgcgcgtagggtcgattcagaagttggattggggcctgtgcgcgggcgggagggggactctgggtgggcaacggtcaaagccttttgccttttttccttggcaagcg

SEQ ID NO: 662553 - DNA, 150 bp, Homo sapiens
ttacttaggatttcatttatcctgctatggccaggcaccgaacaatcgaaaccaactccagtgtaaacaggggtgccatcaagtatgcgctggttgtcagccttgctggtggagtcattgtgtcacgatgaagcaactacgagccagtgc

SEQ ID NO: 662554 - DNA, 595 bp, Homo sapiens
aggcagtgactcgtatttggtcatagttgttccagaggatccctgttgagggatcgatatgcatagtcaatatatataggagatgatataaaaagatgttaatatctaattgtcagtggatttgtgaactatctgatggttaatatcagataaaagatagttaaggatagaacatcaaagaatcaaagctaaatctatttttttttttttttggtattaaatgtagagacggaggtaacgccaatgtgggccaggcgggtctcaacctctgggcctcatgtagatcaccccgtctctgcctcccaaggtgccgggattagaggctgtaagccaccacgcccggccgcagttgttcttcatcatcgtcataagggtagtcccaattacgggctcgggatggggtgacaggatgtctcttatctcctaaagctgacaatggtataccgctgactggaccaagcacttcgggaaaacgacagacaccgaattccccaggctgacagatgacctgtgagagcgatccgattgttgtacgattccggcctcacagtattcctcggggttcctgggtaccccttatgtgaccgttcctccc

SEQ ID NO: 662555 - DNA, 311 bp, Homo sapiens
ctgtcgcttgcaaaatactgattgtctgtgtagacgatgcagagaggcacctgcgctcagaactagagatatccaatgacccagacaaaattaaacttcagctttctaagcataacgagattcagaagactcttggtggcaagcagcctgtgtatgataccacaattagaactggcagagcactgaaagaaaagactttgcttcccgaagatagtcagaaacttgacaatttcctaggagaagtcagagacaaatgggatactgtttgtggcaagtctgtggagcggcagcacaagttggaggaagccctg

SEQ ID NO: 662556 - DNA, 133 bp, Homo sapiens
tttacaggacaaatcttaaagtagtattttgcagcttagaatttattccaactctattctggcatgagcttttacgacttgctatggaattcacaaagcacctgttttgttttgttttgtttttgttctgtga

SEQ ID NO: 662557 - DNA, 213 bp, Homo sapiens
tctttagatgtgtcggtacatgtacaggcaggtgatactgaatcgcggtgtacttatcaaaatcccctgcgtttaggatctctgtttccataaaactttccaggtgattctgatgaggacccagggtctaaccacacttccgtttccctttttctttctacaaaaccttgcttttacgttcagactggactgactagacgggactacggaacg

SEQ ID NO: 662558 - DNA, 249 bp, Homo sapiens
agtgtacttcagagcgacggcgccgaatgatgtcgaaagaaactatgaaactgcgctcagccgcccgagaggacaggtgttgcagcaaattaatcaatcaagaaaaaccacaggctcttccccttcccccctgttcgatttaatcagtcggcatttgccacagtagtagattttctagatacgtcttgtagacctcaaagtaccggagaggaagctcccattctaaggaaatttatcttgaagaacact

SEQ ID NO: 662559 - DNA, 114 bp, Homo sapiens
gccccttttttttaattttttgggccccccaaaaatttttttggggggccctttccccccccccccccccccgggggggtttttttttttccccaaaaaaacccccttttttta

SEQ ID NO: 662560 - DNA, 318 bp, Homo sapiens
catgagcagtgcttgactattacagtacggaggtcctgctacaagctgatactcatctagagggcaagggcgtctttcgagggcgggaccaatgtcctgggccacctgctgcagggtggcgctccaaccccctttgaccggaactatgggaccaagctgggggtgaaggccatgctgtggttgtcggagaagctgcgcgaggttaccgcaagggacgggtgttcgccaatgccccagactcggcctgcgtgatcggcctgaagaagaaggcggtggccttcagccccgtcactgagctcaagaaagacactgatttcg

SEQ ID NO: 662561 - DNA, 107 bp, Homo sapiens
atttcactctgactttcttctctttgtctttccaattctttccggtcataatttaacctactcaggcacataattccacactggaaactgtctctgaaaactgtcga

SEQ ID NO: 662562 - DNA, 1201 bp, Homo sapiens
gggagaactgtttgtgacgggcaccatgagggacatacgtgagaacttccacttgaccgtgatgcatctactgtgcccaggacgtgtggtccaatctcacatgacgttgtaccacgactacgcagcatacactgatcattgctttgtcagagggtgtaccacaagcactcacggtggacgtactcggccgcggagccgagtgtctggtgaccattggagtggttcgttccgtagcacatgactcgtgttcaacacaggaaactgaggatgcgttacgctggacagcaggcactagggcgagcattatgagtgagctccagggggagatgagccgaagtctgccgatggactcctggtccatcatgattgctcgtgccatgcttgctctctcgaggaagacagcgtagcaagaggaagaccgctcttggcatcatggaacgcctggcagtgaggaccctgtccaagaaatttaccgcgagaatcaaatccataaagagaggtcgaagaaaggagacaaccagaccaacaagaccaaggtaaagatatgctccatactggaacgagggggcttcgttggggccacactgagattgcaatcgccaactgtgcactctaggcggtaaagtactcctccgagaacctcatgcaaggttgaattgagtgggtgtagattaaccaatcgaaagtaccgatcaatggggcctctggttgtcgctgcttatgtcgggaacagagcttgataggaggggaatggcgtcggtggaacctcccctttgatcactagagagtctggcgtcctctctaagaacgagcatttgcgctggaggaaacaaccccggtggaaattggggttacccaggaaaagtcgtctcggcccccccggtgtgttaaggactgaatcccttgaccagtgggaaacccccggggccgccgagtcctgccttcagtccttgcaaggactgacgtggctcaacgaaccttaaaaggctccaattgtggcacattttacacttgtggggcactgtgggtttgccccttcttaagtaactaactccagaaactcgtgtcaatggagcttgggggcgtcacgtatgggtagccctttgtggctagaggaagaaaacactcttgggccatagcttggcctgacaagagaaccaacccctgagattgtcaggctagggggtagggcataggccac

SEQ ID NO: 662563 - DNA, 1633 bp, Homo sapiens
  misc_feature (335)..(335): n is a, c, g, or t
  misc_feature (655)..(655): n is a, c, g, or t
  misc_feature (1153)..(1153): n is a, c, g, or t
  misc_feature (1219)..(1219): n is a, c, g, or t
  misc_feature (1227)..(1227): n is a, c, g, or t
gcgtgtgctcattgtgttggcctctgtctagaatctgtcgtggcctgtgttaatactgcgtccgagataacgacaagtgtgttataagagagcggtcgtggtattgaccggcgctccttgctgtctagccctggaggctgttcctcataaagatcctcttgggagtgattggggccaacacccctctttcgaagatgtttgtgtgttcgccacacatctgtttttgggggataatgttctttgatagttgacggcacacattggggggtgtctgcggaagtagatttttccacgaaaagggggccttttttaggaagagcaaccctgctgtgtgncccaagaggaagagctcttttttgtctgagcaaagttgttgtttggcgaccacacaagaggcgaaagttggttgtgcgccaaccacacacgttctcgcattattggtggtgttctcctttttttcgggcgcgcaaacttttagcccaccccaccgactttggtgaaaaaattggagcctttatttttgggcaacaaaataaagggattcgtgtgtacatagaatgttgcccttcccgtgtggttaattagcagaaagcgccgaattaggttccgttggaaattgttgttgagcccgttcgggtgagcacccacaagattnaagtgtggttgacaagtggggatcaccagcgggccttggttggccccacagtataagggcgcccaccacgggccgcgcttggctctcgttgtgtttccttctcggttctccaacgaaggggggagaattatagctcttcttgaccccctccggtagaatcctctcctcttctctaggccaattactatctttgcggggaaatatctcctctgtgtccctcggagactcacaccggcgaattaggtggaaaaaataatgttgggttgccccacagatgttctaaaccttcgtgtccccgcttcaacattccacacatgtatattttttaaagcccacatctctggagaatataattatgtatattggttatatatatgcccctcatagagataataaaatgtttccttctcccctttggccacagctgagacttacgaaatttttccaccctcaaaatgttgttccttaaatgtctaatgcgcctctccacgcgcttgngcacagtgtaactcgtgtcttgtgttaaaatgtcccccctcgagaagtctggtctcgctcgtaagngagagacncacagagaaattgtctctttggctcgttctcgtgaattcccctctcggagagtaaagagaaggttaagtggcacattgggtgggaggtggtggtggtttctctttctccccaattctatatatgataggtgttattataacacctcttctcgtagccacaacagagtgggtgggtaagtttctctttggttaactcgaaagtgtgccccttccaccctggcgtatttgaaaaaggagaatgtaccttggaccgtttctctgtaaatctcttgagagtataacctgtttggagaatttaacccacctcttcttgaatgggggacccaactcttatggagaaattgtaaatacgttttatttataaacctggccctgtattccataaacatttttgcagccctttcca

SEQ ID NO: 662564 - DNA, 212 bp, Homo sapiens
  misc_feature (45)..(45): n is a, c, g, or t
  misc_feature (60)..(60): n is a, c, g, or t
  misc_feature (76)..(76): n is a, c, g, or t
  misc_feature (83)..(83): n is a, c, g, or t
  misc_feature (88)..(88): n is a, c, g, or t
gagatcacgcataacgcacccccctcataacccgcccgacaacancctattagtggaccncccaccatgcctggangaggagnaacgnctcaaactcctaggctcaagagatcttcccattctggcctcccaaagagtcaggattacaggcatgagccactgcacctggcccccaacttctcgaataaaatgaaactatgattcttggcctc

SEQ ID NO: 662565 - DNA, 359 bp, Homo sapiens
  misc_feature (27)..(27): n is a, c, g, or t
aaaaaagttgggaggcttccaaccgcngtttggcggccccgcttcttagaaacttagtggattccccccggggcttgcaggaatttcgggcaaccgagggcaactcaattctggcccagtgacattctggagatcggggcccagtggagcatcctgtgcaaagacattccctcctttgagcgctacatggcccaactcaaatgctactactttgattacaaagaacagcttcctgagtcagcctatatgcaccagctcctgggcctcaatctcctcttcctgctatctcagaaccgagtggctgagttccacacagaattagaacgattacctgccaaggacatccagaccaatgtcta

SEQ ID NO: 662566 - DNA, 338 bp, Homo sapiens
  misc_feature (325)..(325): n is a, c, g, or t
aacagcaactagataagcacgatgtcaaatagagtatttaagagagaacacaggaactcagcaggaaagtgacagaaaacctctcaggcatggaaggagaggaaagcaaagcagctggcccagctgagatcggagccaggagagactcctcagtgcaggaaaagggaagggagagagccccatgttccacatttccaccatggactactgcaatcctagctacagagtgccctttggctcttcacagaccctgagactagtataggaaacttcctgggagcccacacgatggcattgtctcagagaggggatttcaccatgggtncacacacataggc

SEQ ID NO: 662567 - DNA, 771 bp, Homo sapiens
  misc_feature (537)..(537): n is a, c, g, or t
ggaggacaaggtgacacgctgaggggggacttgtgttagactggggctcccaatgacccacaatctgcggagtgagatggtctgaatcttgtgaagccctcaggctgttcagctcactctagacctgatcaagcctgatgcagtggtccatgcactgattatggacgctgttgatcagcggatgctaagcaacacgatcctgattgtaccaatgagagaactactgtggacaaaggaagattgccagaggtttcaccgagagtatgaagggcgtgcttgctatcaaacgctgccggagtctatggtcagatggccaccccgagcctacatccttgcgcacgagggagccatccagctctggaggacgcccatgggacccaccagggcgtcccgagcacgccatgtaggcccagactctatggcggggaggctctgtctcactgactcccgaagcaccatccatgggtcgggcgtctgaggctctaaccaactgagagattgcatggctccttgcctaaattcagagaacagcccttngtgtaaggaggaagactcccatttgccctacgggcctttgtgcttatgacctatgggggcgtaccctctgtaggtgggaacagaggtcttggaccagactggtggacgcctttaaaaccacagggggtgggcagccccgtgtgtagatttaagcaaaaacattttctaaggacaaggaaaacccgtttaacgagccccctccataacggttttttgaagtaatgggggccagga

SEQ ID NO: 662568 - DNA, 1384 bp, Homo sapiens
agcggactgtgcacttgccagccatttcgcccgctccggagcccggctcgctgtgtgcagcctggcgcgtggtcgccgcgtgctctgtggtggtccgtcgggcctgcgtggggcgtcgagccttgttgcgtgctgcgtgcgtgctcggtgcgtgtgtcgcgcacgcccctccgcagctctgcagcatcgttgccgcgtggacaggagccaccgctggtgctaagcgcagcgatctccgtcccttggctgcacactgccgctcctcgccgcttccggcgcgtgcggtgccccgaggttgaggccggcgctggggggcggtgcatgtgagccttgcgcgcgaggctgcttggtcggcactccttggcttggaatgtgcgcgagccgttccctcgaacgctgtggtcgcctgcgttgccgacgagccgctaggcaggcttgacgcgattcaggctgcgcgtcgcgttcgtggatgacaggcattgcttggcagccgtctaggggagctgcccagcgcggcataattcttagcatcgcagtgctcctaggcgccctggcacgcaccgaagcaccggacggcgcccttggccatgcggccatgcattcggcatcggggggctttcttgacttccgcccgccgccggctctgtggcacactcgtatgagcgggcaccttcttggccaagcgctccaaggcggcttggtccccccctcggcgggctccctgtatcaccccaggtccttgtcggtgcactgacttccccgtcactcgcctgtgcgccccaagcgtaactacaccgacactggaatcgtgccctcgcgccgccagcgctccgacgcatgccctgcaggcgatggccccagtcgttgcaaccaagcgccttcgcaacgaacagtttggggaccacgcaacgaaaataagagcccacaggagacgctacacctaacgagcgaagaaagggaacagcgaaacaaaaacagctggccagaagaacaaacacagacgcgacaactccccgaagggagaagaacggggaaacacacaaccacaccgatacacgcgggactgtccaacgacacctaccgacaacaacgacacaggttcacaaaccacagacgacagaccagagcgaccccctaaagacaccgacagcactccaccaaacgaaagagcgacggataaaacaaaacggaaacgcaccgccacacggagaatccaagaacatcaccgcccaaacgaacacaaccctagtggacaccccacgacagagggactacgagaaaacaccaaccctggcaacaaacccacacacctgaaaccacaactaacgcacgggactacccaagcgaacccgacacggacagacccacaacacacacgcacaac

SEQ ID NO: 662569 - DNA, 871 bp, Homo sapiens
  misc_feature (8)..(8): n is a, c, g, or t
  misc_feature (73)..(73): n is a, c, g, or t
  misc_feature (77)..(77): n is a, c, g, or t
  misc_feature (249)..(249): n is a, c, g, or t
  misc_feature (389)..(389): n is a, c, g, or t
  misc_feature (460)..(460): n is a, c, g, or t
  misc_feature (472)..(472): n is a, c, g, or t
  misc_feature (481)..(481): n is a, c, g, or t
  misc_feature (509)..(509): n is a, c, g, or t
  misc_feature (520)..(520): n is a, c, g, or t
  misc_feature (524)..(524): n is a, c, g, or t
  misc_feature (526)..(526): n is a, c, g, or t
  misc_feature (551)..(551): n is a, c, g, or t
  misc_feature (556)..(556): n is a, c, g, or t
  misc_feature (558)..(558): n is a, c, g, or t
  misc_feature (583)..(583): n is a, c, g, or t
  misc_feature (621)..(621): n is a, c, g, or t
  misc_feature (626)..(626): n is a, c, g, or t
  misc_feature (651)..(651): n is a, c, g, or t
  misc_feature (668)..(668): n is a, c, g, or t
  misc_feature (688)..(688): n is a, c, g, or t
  misc_feature (733)..(733): n is a, c, g, or t
  misc_feature (748)..(748): n is a, c, g, or t
  misc_feature (757)..(757): n is a, c, g, or t
  misc_feature (762)..(762): n is a, c, g, or t
  misc_feature (771)..(771): n is a, c, g, or t
  misc_feature (774)..(774): n is a, c, g, or t
  misc_feature (797)..(797): n is a, c, g, or t
  misc_feature (841)..(841): n is a, c, g, or t
  misc_feature (846)..(846): n is a, c, g, or t
  misc_feature (868)..(868): n is a, c, g, or t
cagtggtngtgccaataagacaacagggattctccagaagccagccttcagacctctcactgtgttttgagancatnattatcaatttggatttaaaaaacaagggtgctgtaaaacccttgaagtcttcctcacctcagggtttagggatgccacttgcataaaaatgagttgtttacaagggcactgctctcttgaagcagggactggaaagaaacaggcagcccttcattatcccaagcagaaccnctgtgaacttgcccatggaggggttccatttgcctgggcttggaatcccaaaggggaagaaccacctgaaccggagtaacagttcaaagcctggggctgcagttgggggggcaactcttcactgtgcttgcacctgggcnggggcaggatcctgaacctctcgggggcgtacgcggaacgtggtcggcttgttggtgaaggggtgccactngccccggatgcnagggttgtnggtgtggaagggcttgcggatgcggatnacgttcaagcncgantngtcggccagcttctgcaccagcgtngagancncctcgaccgacttgcagttgatgcncttctcgcgcacagccccgttaaggtatttggccactnctctnggcacgcagcacggacgcgagtttncatatattacgaccccnggattccgttgggcgaagtngaacaccttccgctccacgaactccctggcgccgcgagaagaggngccgtcgcggcttangctgaagcncaaangctgcagcngcngcacaaagcgacccagttcgttnttgagaacgctggccaagaagcggcttggagttccgcgcgccgncatanctacagcttggagggcgcgganctt

SEQ ID NO: 662570 - DNA, 635 bp, Homo sapiens
tggtatcctatgtgagggacaaacattcagacgacagcaggaatgttctgaaatccttagtgaggaacaaacatttagaccacagcaggagttttctggaatcctatgtgagggataaacattcagacattgacaagagtgttctgcaatcctatgtgacgtacattcagaccctcgtagcagtgttctggaagtcctatgtgagggagaaacattcagaacccagcaacagtgttctggaatcttatgtgagggacaatcattcagaccacaggtggggtgttctggattcctacgtgtggggcaaacgtccagaccctcggataattgttctggaatcctatgtgagggacatttagaacaaagcaggagtgttgtggagtcctatgtgaggaaaaactttcagaccctcgtagcaatattctggaatcctatgtgagggacgaaacattccgaccctcctagcaggtgttctggaatcctaggtgaggtacaatcattcagaacctcgtagcagtgttctggaatccaatgtgagggagaaacaggtcagaacccacaagcagtgttctggaatcctactgagagggacgagtctttccagaccaatactggggtgctctgaaatcctatcc

SEQ ID NO: 662571 - DNA, 529 bp, Homo sapiens
cacgaaagcttcagctcctgctactccgtccctgtactcgcacgaatacttcacctcttactacttcgtccctgtactgcaagaaacttcacctcttccgaatctcaccaatgacagtgtcctcagcgtttatataagatatctaacagaggcgagacaaaacaattcccttccttttctgatggtaaaatactgcaatacaatttgtttgcaatgccggtagttaaaattagtaacattcctgttccttttatttgattgagtttcactcctgttgcccaggctggagtacaatggcacgatctcggctcactgcagcctcgtcctcccgggcccaggcaatcctcccatctcagcccactctgtagctgggactgtaggcactggccaccatgtccgcctagtttttgtattttttgtagagacagggttcaagagatctgcctgcctcggccccagaaagtgctgggattgcaggcgtgagcccctattcccagccattaacatcttacaggattccccagtggtg

SEQ ID NO: 662572 - DNA, 1254 bp, Homo sapiens
tctctttggtagatctaggcagggaatgagcgaggcgcggacacttccagatgctgaccggcagacccgcatggagggcagcagaaatcaacaagagtctcttagccctgaaggagtgcatcagggcccatgggaccacgacacacggctcacaccccgctaccgtgagagcaagcctgacacaggctgcctgcagggactcccttcactcggggacgaactctaggacctctgcatgacttgccacgcactctcaccaggcactaacgctcctgctgactatactcttaaacacccctgagcatatgcacgaccagggctcaaaggcacgctgagccccccaccagcggcgcccagtgcgcacgcagcagctcgattcaacaccggacaacagaagaccatgcgaacgccgtgcctcctaacgcgggcgcctgattccaggcacgtttagtccaaaggaacgaggacggaactgctcctccccagactgtccagcctccacaccgaagccactgacctcagactcacccgcagctggcagcgcagcacggccaccgcgcaccgagccacccccgccgcatccataccacccacggcacccagcactggccctcgcagcctcgtctgcaccacgcacgcgcacccacccccagaactcactgcacctcggcacgccccctgccgcaccccacagccgcgccactctggcccctggccccaagcgccagccccaagccgctccccctcaacgcccctggcgacacacgcccactcacacgggccttgcccccctcgccccacgccaccgccgccaacaccccgcgcctcagccagagaccaactacaccccggccagcaacaccgcccccgcaagtcgggacgcaacctggcacgaactagcgaacctcgcgggcccgcgcgcgaacaaccaccaccgcaccatccctggcgcccccccccccgcacacactccggccgataccacggcgcgcacgcaccacgcccagccccgaacccacgcacaagggcttcggctcgcctcccccgacacgcgcccccctccgccccccggacgaccgcaaccacgggcaccacgcgcacgcgccacactccccgaggacgccccccaccgccggcccagacacgcagcggcgacaacccacggtccccgtacacacaggaactacgcccccatgcaccccaccgcgcgcgcaccaccgccccccgccacccaccacgcccccccacgccatg

SEQ ID NO: 662573 - DNA, 359 bp, Homo sapiens
gtgcagaacagtgactaaagtacgacaggctggaagcccagaccctgtggacttggatgtagggtgggctcaggaccctgtccctggtgcctgaattccatgtgtctagcgtgggagcgagcgggagggcttgggcatctcacccgtggccagcgagcacgtctccagatctcctctgatgaggtagccactctcgctgcctcctgcttcatcgaggcgagtcgaggaacatgggcttgtgggggcagtgaggaaagtggctgctccaccagtggtctggaatgatgcttgtgctggggccttgctgctggtgtggatgaggggtaggagctgcaggttgtgtcttgtgtcttgatcct

SEQ ID NO: 662574 - DNA, 282 bp, Homo sapiens
  misc_feature (15)..(15): n is a, c, g, or t
  misc_feature (27)..(27): n is a, c, g, or t
  misc_feature (155)..(155): n is a, c, g, or t
  misc_feature (241)..(241): n is a, c, g, or t
  misc_feature (272)..(272): n is a, c, g, or t
tcagggatttatgangtggtggttttnggatggtgttacatattatatgttctagtaaacatgtaatcctaaatttaccctctcgaatataatccctggtatgatatttccatatcatcaaatgcagaataatcaaatacatcagtaagcaagtnaagtgtcctccatcaattctgtatcccagacttggctaggatgtacagttgctgtggtgtgtaatcaaacatgtctctgtgtagtnccagcaactcaagctgagctttgaaaaagtngggccttagt

SEQ ID NO: 662575 - DNA, 873 bp, Homo sapiens
agcggggcgggcaacgggttctacgctgcaggcagttcgaggatccgctgcccctgccccggctcggcctggcagatagcagaggcagcaggccgtgccgtgggggcatgttgctgtaaccagtggccatgggatgttacggtgtacagtgcacctggatggcgggccccgcagggtgaaccatgctgctgtggctgtcgggcattgggtatactccttcgggggttactgctctggttgatcgactatgacgacactgcgtcagatagattgtgcacatttgcaatgcaagtgtccttgcgttgtgacaaagcgttgcccccggtagaatgtctgtcatctctgtgggcaatgcgtccctgttggtagccctacatgcgctatggacacgtcaaccgtcctcatcgatgacacagtcctcctttgtgggcgggcttgtaatgacgccgataggggtcctgcaatgtgctctatgcctttgacgtcaatacgcacaattggttcaaaccccgatgtgtcagggacatgttcctggggtcccggggatggcacgattcatggctgtgtcctaggcgaagatcatgtacatttttggtgggctacgagcaggcaggtcggactgtattgtccagatgactattgcgacgaagctagataccagcacccatgacggtggtagctcttgatctagtacagagggcagacccgtgcaactgctggaatggacttccacctcaggcacaatgctgggaagtcacattgtatgtctgtggggggccgtgcccgaccgctttgggccatttccattccaatcagtgagatttactgcaaccgggttccgagtctttgaaccccagaaactgaggctgggtg

SEQ ID NO: 662576 - DNA, 179 bp, Homo sapiens
ttgatgctgtggtcactctagacgatcccctatcttcgtcccttctaaaatcaaataattaacaggcatgtgtgctgcgcctatgtcccagcggttcatggtctgtaggcgggaaatcgcctgaacccgggaggcaggggttgcagtgaaccaagaccaagccattgcactccagcctg

SEQ ID NO: 662577 - DNA, 387 bp, Homo sapiens
agggtctgcctgtacagagaacacggtttctctttcttgcctgacacacaggggcacgaatagattcactcttgcagagagtacatcccttcctgttactgaaaatcactttccaaaaaaaaaagcaacagatacacacatactcaccacacacacaggtggatcagagacaaaaaaccacgtaccaaatggcttagggacttgagaagtgtggccctaacttacgctgaaagggaccctattaactttacccctcacctctgggtcagagagcgttggccctctagggcctgccttgaagcttaacctattggaaccaaagggactgcttggaaagctattttaggccaggtgcggtggctcaagcctagatcgttgtaaatggcg

SEQ ID NO: 662578 - DNA, 252 bp, Homo sapiens
caaagtgtagttatctgcaagagcactaccacattgtaaacacatttatggtcatgtagctatttcaatattccggggagtggggggcaattagccggtctatggcttaggatctgtttccaggctggcttcctgaggcttcttctacctcgtgagaggtttttcatcatttttccaagtgttggcgtgaagttcaggggatggttactaagaaagaaacatggaaactggtttccggtctacaattccgag

SEQ ID NO: 662579 - DNA, 368 bp, Homo sapiens
  misc_feature (271)..(271): n is a, c, g, or t
  misc_feature (347)..(347): n is a, c, g, or t
  misc_feature (349)..(349): n is a, c, g, or t
  misc_feature (351)..(351): n is a, c, g, or t
tgaccagccgaccagccagcagctccccacgtctgcccggggtgagacaggagaatacggtctggaggcagggaacataagactgattcatgctgacttcctagaactaaatcaaatggaaatacttcagctattacaggaaatatcctcaccattgacacaaggcgtaaacccagtaaatgtctttgtaactttacttgatcctcttcatttacacagggcgtacaccaagtaaccaatggaaacctctagagggtatttaaaccccagnaaattctgtaacagggctcttgagcccctatgctcggggccactcccaccttattttcaataaatctctgcttatntngnctgccgtaattcggtaa

SEQ ID NO: 662580 - DNA, 236 bp, Homo sapiens
ggcctccaactcctgtgctcaagccaaccttccatttcagccaatcaagtagctatgactcccggcatgtgccaccatgcccagataattttttggagtttttttgaagacattggtctcactcctgtcaaccaggctggagtgcagtggcatgatctcagctcactgcaaaccatgcctcccaagctcaaaaaatcctcccatctcagcctcccgagtaactgaaactacagaca

SEQ ID NO: 662581 - DNA, 186 bp, Homo sapiens
cggccggcactgaggccaagatctggcacgaggccgagatctcataccaggccagatcttacctccttagacatggacagacccggatcctcataccaggacccgatcccacctcctcagatactgatggacacagatcctcatacttgtacccagcctcacttccccagacactagaagactcag

SEQ ID NO: 662582 - DNA, 933 bp, Homo sapiens
atattgtgcctattgccatactagtctttgccgctgcgaagcagtggtaggcctagccctactagtctcattctccaacacatatggctaccactacgtagtatgacctatacgcgtactccaatgctactactaatcgtcccaacaattatattactaccagtgactatgatctccaaataacacatatttgaatcatcacaagccacccacattactaattattagtcatcatccctcactactattttttaaccaaatcaacaacaacctatttaactgttccccaagcttttcctccgaccccctaacaatccccctcctaatactaatctacctgactcctacccctcacaatcatggcaagccaacgccattatccagtgaaccactatcacgaaaaaaactctacctctctatactaatctccctacaaatctccttaattataacattcacaggcacagaactaatcatattttatatcttcttcgaaaccacacttatccccaccttggctatcatcacccgatgaggcaaccagccagaacgcctgaacgcaggcacatacttcctattctacaccctagtaggctccttcccctactcatcgcactaattacactcacaacaccctaggctcactaaaatttatactcatctcactgccaagaatatcaaactctgagccaacaattatatgactaggttaacaatagctttatatgtaagatactctttacggatcagtatgagtcctaagccatgtgaagcccatgtggtcataatattggcgagtatctaaatagggttttaaaaaaaatttaacacaccaaaaagaaaaaaaggggggttaactggggcaataccgttttaaggtgggtaaaagggcaacggaaattgtggactggtgccaagttttttgtggctagc

SEQ ID NO: 662583 - DNA, 129 bp, Homo sapiens
ttagggccctgggcagcccctgggggaaagactaaaaaacacaaaaggaaacagcccagggagaccccctttgtgatttgcatgtgtgaccctgattttttggaaataaaaagtggaagctgcaggtga

SEQ ID NO: 662584 - DNA, 418 bp, Homo sapiens
cgtacctgcgtgggatatccagcatgagccaccacacctggccaagaaaatccttttaaatcctttattacccaacattagccatgccaagcagccaatatttctggcttctgaacattaccaaaggtaacctcccaggtgttcagagaaaggaaaatttaaggtggttcatgaaggggaagagaatcaacaaatgataaaggtcacaaagatatcaagccagaaaggactcattccctaagccaggattgaacccgggctgccactgtaaaatggcagaagctgaaacaaagcactgccatgtggttacaggtcacgcttccaaggacgtaaaaccagatggaggcctgcagcaaagtttgccactggccagtttgctgggcttgcttcaacagcaggcctatggagtcctagaccc

SEQ ID NO: 662585 - DNA, 165 bp, Homo sapiens
tcttcgcgatctaacgtacacctaatctcgagaaatgagtcattcagatggtcgggcaactctagatgattcggcagacatttgccagtcaatgagaagacataccgacctctaaatgatgtacagcatcaaggacataagattcatggcaaccccttatccact

SEQ ID NO: 662586 - DNA, 140 bp, Homo sapiens
agagcatggtctgaaaggcaacgacatcacagatgaggttctggatgggctcaacccatccagacagatgtggaaagaattaaggacacctgtgggaggacacagaacgaagacttcaaacaaggctctgactagatgca

SEQ ID NO: 662587 - DNA, 324 bp, Homo sapiens
ataaactcaggtccactctatttactctacacctcgagcttagcaccagtctccatccagtaccacagtccatccagtccacaccccatcaagatcactcctccatccagtccacactccatcctgtcatacacccatccagtccacaccccggtccagtccagaccctgctccagtacacaccccatccagtccacaccccatccagaacacagcccaatcctgtacagcaccccatccagtccacagcccttctagtctacactccatccagaacaaaccccatacagtccaaagagctgaagataggcccaaacggggatc

SEQ ID NO: 662588 - DNA, 453 bp, Homo sapiens
gttacccaaattgtaacgccccatcttccactgcactggtcctcagaatccgtcgtagctttccaaaagtttaagcatgcaatctgtttcaaaaagcaacggaccccaaggtacccccctttcgttaatccgtaaggccacttaatgatggtaagaacttggtgcaaccgcctaaaatttatccataaactaggtggcaaatctgcgtcagagcgggccataacccagcttgcgtaagctttaagcttggtcaactcataaaggcttgtaatcacctgcctgtgaaccacattactgtgttccttagctttagcagtccataaatgtcggtccacagttttcatagccgccctaagctcattcattactggtcctttcagagcatcagtgcaattcccatgctagtcaaggtcccagccttaacagcatactggatatactaccaacaattcc

SEQ ID NO: 662589 - DNA, 158 bp, Homo sapiens
gctgcccacagcctgaccgtgatgtcatcaaccgagcccccgccgcgacaccccattaccaccccccgcaggctaccgcggctgcagcctgagcgccgcgtccccgccccgacccacgtgcgcccggcttatgaggatgatgaggtcggcggcggccg

SEQ ID NO: 662590 - DNA, 684 bp, Homo sapiens
cgggccgaggttcccccgctttgcccttctggagttccgctggggaaggtcccgccccatggccctttttccaccgccgttgttttgcgcgcctggtccatggggggccacccccgaagcttgccggttcctttttcaaggagccttccccagggtttgggacaatagcagaaaccctattgggaaaattatgaacggccggcgccccaagctgctgcccagagaatctcttaatgctctggggaaaactatgatgccggcccccaaaggaccttggggtgttcttgggcgttgctaaacatctatcgaagcccttcccgggtcttatttttccggggtttattatgacgtactaatttaatttgtgaagcacagcaagcaccgttatattggaggggaactcgagaagtcccacgcagaaacatttaaggaatgggggcccgatagtggcacacaagagcccccgcccctgtcataagcgctggcggcctgtcccttatagaatatctgaggcgttctctggtccctctgcctctcacagggaaaactgtggctgttgagccccacacgttcttccccgccccagcacagggagaccaacacagggtcgctgaagctttttgtcccccgggactggtttagggcccccaaaggggttccaaaaaattttttccaatcgaaaaa

SEQ ID NO: 662591 - DNA, 277 bp, Homo sapiens
  misc_feature (4)..(4): n is a, c, g, or t
ttancgtatgtctcgatcgtgataacgtttcttttgtctgggagacagagcctcactctgtcacccaggctggagtgtactgacgcaatctcggctcactgtgacctccgcctcgggggttcaagcaatcctccttcctcagcttcccgagtagctgggaatacaggcatgtgccaccatgcctagctaatttttttggtattttttttggcagagagggggttcaccatgtaagcccagcgtggtctgaactccgtgacctcaagtgatccaccgg

SEQ ID NO: 662592 - DNA, 208 bp, Homo sapiens
  misc_feature (122)..(122): n is a, c, g, or t
  misc_feature (163)..(163): n is a, c, g, or t
ggagaaaaaatcgttcaagaccaaaactccaaatgcatcggactgacctaacaggaattttaatgcttcatggactccattcctaacaccaatgacccatgtgcagatactatcgggctctnacagagtccgagaagagacgaaagcttcactaatttcattngaggccacctgattgaatcagggtttacatcaccttccattccta

SEQ ID NO: 662593 - DNA, 219 bp, Homo sapiens
gtggatcacttgaggtcaggagtccgagaccagtccgaacaacacggcgaaaccccctatctaccaaaaaatacaagctagccaggtgtggtggcacatgcccgacatcccaaacacttgggaggttgaggcgggaggactgcctgaactcgggacagcagaggctgcagtgagccaagatcgtgccagtgcactccagcctgggtgacagagtcagac

SEQ ID NO: 662594 - DNA, 902 bp, Homo sapiens
  misc_feature (32)..(32): n is a, c, g, or t
  misc_feature (48)..(48): n is a, c, g, or t
  misc_feature (76)..(76): n is a, c, g, or t
  misc_feature (106)..(106): n is a, c, g, or t
  misc_feature (112)..(112): n is a, c, g, or t
  misc_feature (114)..(114): n is a, c, g, or t
  misc_feature (117)..(117): n is a, c, g, or t
  misc_feature (122)..(122): n is a, c, g, or t
  misc_feature (145)..(145): n is a, c, g, or t
  misc_feature (159)..(159): n is a, c, g, or t
  misc_feature (163)..(163): n is a, c, g, or t
  misc_feature (166)..(166): n is a, c, g, or t
  misc_feature (174)..(174): n is a, c, g, or t
  misc_feature (181)..(181): n is a, c, g, or t
  misc_feature (193)..(193): n is a, c, g, or t
  misc_feature (195)..(195): n is a, c, g, or t
  misc_feature (204)..(204): n is a, c, g, or t
  misc_feature (210)..(210): n is a, c, g, or t
  misc_feature (218)..(218): n is a, c, g, or t
  misc_feature (229)..(229): n is a, c, g, or t
  misc_feature (251)..(251): n is a, c, g, or t
  misc_feature (267)..(267): n is a, c, g, or t
  misc_feature (274)..(274): n is a, c, g, or t
  misc_feature (277)..(277): n is a, c, g, or t
  misc_feature (280)..(280): n is a, c, g, or t
  misc_feature (282)..(282): n is a, c, g, or t
  misc_feature (292)..(292): n is a, c, g, or t
  misc_feature (407)..(407): n is a, c, g, or t
  misc_feature (434)..(434): n is a, c, g, or t
  misc_feature (618)..(618): n is a, c, g, or t
  misc_feature (655)..(655): n is a, c, g, or t
  misc_feature (732)..(732): n is a, c, g, or t
cagggattttcaggaatttttgccctccccangtcaagtggaccactntccactccacgaggatgtgaaacggttntttaaaatgggattttagagcctcgggaangcatgngngtngcatntttcatattatgggtcaggatanattcatttcttgcnacanagnggaaaaanataagcngcagtaatttgntntttgaatgnccgtcncccccagnataggatatgnttgtatccccccgtcactcctncgcctgttttttaaanttttccnccnccngngtccaaaaanaatgttatagcgagtgctcttaaatgttgaacctgcgtgttgcttccgggccagtctgcgtggctccatgaaaagctcactgctgccccagccgggcttcttagaggaggtcagntgtcctatgtatcatcatttactctgngaatcctactgtgaaatcatgtctggatttttctggagcagttcacatagagtagaatgtggaatttcccgtgaacgtctcccttcttccccgtatctgccgcctgcggacttcgcaccgtgctagaatactcgtgtgtctaagatgactaactttaaaagaacctgcgctcgaacgctcttgnaacgcattgaaagggagaacttgtctttaccagtttntccttgaggatggaaagtttaaaagccagacgttgcatggctgtccttggggtctatcctgtacgtgagatagctgngctgttacaagaacgaaagtttatgctttgtacaccgattgctagaaagtccgacgtaaaatgcctaatctagggtttcagattctgttaccgggtggcactttaacagccgttggtgcctaataaacttgggctttttggaggctccgatgaaggctaattccttctct

SEQ ID NO: 662595 - DNA, 364 bp, Homo sapiens
  misc_feature (32)..(32): n is a, c, g, or t
  misc_feature (48)..(48): n is a, c, g, or t
  misc_feature (76)..(76): n is a, c, g, or t
  misc_feature (106)..(106): n is a, c, g, or t
  misc_feature (112)..(112): n is a, c, g, or t
  misc_feature (114)..(114): n is a, c, g, or t
  misc_feature (117)..(117): n is a, c, g, or t
  misc_feature (122)..(122): n is a, c, g, or t
  misc_feature (145)..(145): n is a, c, g, or t
  misc_feature (159)..(159): n is a, c, g, or t
  misc_feature (163)..(163): n is a, c, g, or t
  misc_feature (166)..(166): n is a, c, g, or t
  misc_feature (174)..(174): n is a, c, g, or t
  misc_feature (181)..(181): n is a, c, g, or t
  misc_feature (193)..(193): n is a, c, g, or t
  misc_feature (195)..(195): n is a, c, g, or t
  misc_feature (204)..(204): n is a, c, g, or t
  misc_feature (210)..(210): n is a, c, g, or t
  misc_feature (218)..(218): n is a, c, g, or t
  misc_feature (229)..(229): n is a, c, g, or t
  misc_feature (251)..(251): n is a, c, g, or t
  misc_feature (267)..(267): n is a, c, g, or t
  misc_feature (274)..(274): n is a, c, g, or t
  misc_feature (277)..(277): n is a, c, g, or t
  misc_feature (280)..(280): n is a, c, g, or t
  misc_feature (282)..(282): n is a, c, g, or t
  misc_feature (292)..(292): n is a, c, g, or t
cagggattttcaggaatttttgccctccccangtcaagtggaccactntccactccacgaggatgtgaaacggttntttaaaatgggattttagagcctcgggaangcatgngngtngcatntttcatattatgggtcaggatanattcatttcttgcnacanagnggaaaaanataagcngcagtaatttgntntttgaatgnccgtcncccccagnataggatatgnttgtatccccccgtcactcctncgcctgttttttaaanttttccnccnccngngtccaaaaanaatgttaaagggaatgttttttgttggttttgcagtccaatatgtaaccaataaagctccctggtttcggta

SEQ ID NO: 662596 - DNA, 285 bp, Homo sapiens
gagcttctgcacagcaaaagaaactaccatcagagtgaacaggcaacctacagaatgggagaaaatttttgcaatctactcatctgacaaagggctaatatccccaatctacaaagaactcaaacaaatttacaagaaaaaaacaaacagccccatcaacaagtgggcgaaggatatgaacagacacttctcaaaagaagacatttatgccaacctagacacctcatgcttctgtctcccccaccccactctgttttacatcttttataaatgtgccaaactgaa

SEQ ID NO: 662597 - DNA, 191 bp, Homo sapiens
  misc_feature (43)..(43): n is a, c, g, or t
  misc_feature (52)..(52): n is a, c, g, or t
  misc_feature (60)..(60): n is a, c, g, or t
  misc_feature (75)..(75): n is a, c, g, or t
  misc_feature (84)..(84): n is a, c, g, or t
  misc_feature (144)..(144): n is a, c, g, or t
gctcaattccagctcccccggggctggctgcattggggggggnatggttcanatggcaanaagtggctatgccangtggccggnctctgaaaaacgtaacttatcattggtattttcacacaggcactgaaaaggggtcagctnttctttttttttttttttttttttttttttttttttttttttttttt

SEQ ID NO: 662598 - DNA, 757 bp, Homo sapiens
gagtctccgtgcagcgaactcaggctccggagctgtggctacaacatagggtattgcctacgcgaaatagtaaagatgaattatagcgtgtagactgttctaaagaccaaagaagataaaaacttaatgccacaagaattcctcccgtatcagagaagccatggagtgcaatccttgtgttacaatgcattgtcttaattgtgcgagagagctctacacgtgtcttacaaactgctggttgaaacaaatttgcccaaccgtgaattggggttaccacaaacttgagggagtagcatattcttctaaggaaagaaaaacacccctggggggaaactttaaacaatgggtcttggaggcaagtagcggggaacacgatttagaaggaaacctgtgggatgggtccctacaacttggatgtgagaaagtggaaacgtggatccacaatattcgacgaacacttggggaggatttctctaaacatgttctatataaccgtggtaaaaagactgcggctgagatttgtgaaagctggcagaaactgccatgccttcgaagaactggtgtttgtaggcaatcccttggacagagaaacattctgtgagaaataactgggattgaagaagcaaccaagaagagtggccaagatgaaaaaggtggatgggtactccagtaattaaaaggggatgagggagcaagacactaatgccacagtttcactgtgtgttacttatttacatgtcatagaacatagattaat

SEQ ID NO: 662599 - DNA, 107 bp, Homo sapiens
ttacgtaattagggttcaagaacttaatgaccatcagtccgataaatcacacccacataactaaaaattatcaacaagcgcattcattgacctcgtaattcgggttt

SEQ ID NO: 662600 - DNA, 367 bp, Homo sapiens
gcagcccccagtcacgtaccccatttgatcaatcgatcagaccctctcacacggacccccttagagttgtgagcccttaaaagggacaggaattgcttacttggggacacggctcttgagacaggaggcttgccgatgctcccggccgagtgaaccccttccttctttaactcggtgtctgaggagttttgtctgcggctcgtcctgctacacagggagccgagaccataccactgcactccagcctgggtgacagagcaagtctctgtctcaaaaaaaaaaaatttttttaataaaaaaaattaaaaaaataaaaataaaatgtttctcattttacttgttttctagagatgcagtcttgctgtgt

SEQ ID NO: 662601 - DNA, 219 bp, Homo sapiens
ctatcacactatcgtccgcgtcgtatggctgtgacctccatcacagaggtacctggaagagcaccttccatgacagacccttaaagacctactgggtgaattcgggcttgttgtcattctgatacggttaccggtgatcaagaatctccattggatcctacaacggtctatcacattgatacccacttgtattcatgtgcctaccccgagtgaaacaga

SEQ ID NO: 662602 - DNA, 279 bp, Homo sapiens
caattaaatgtatacggcagtatgaagttgaaacctggcgcaatatatttttaccgctaggtgaaagataaataacttatatccaaacattatatagcaaggactatcccctataccttctgcatattgaattaactagaactcatctttgctaggatatccatagctcagagccccgaaaccagacgagctatcctaaaaacagcttaaatagcacacccgtctatgtcgcataatagtgggaagatttataggttgaggctacaaacctaccgagcc

SEQ ID NO: 662603 - DNA, 181 bp, Homo sapiens
ctgtaggctcattcatttgtctaccagcagtaatattaattcttttcatgatttggggagccttcggtttgaagcgaaaagtcctaatagtagggggaccctccatgaacctggagtgctctatatggatgccccccaccctaccacacattcgaagaacccgtatacataaaatctagac

SEQ ID NO: 662604 - DNA, 103 bp, Homo sapiens
cagaggagcgtctatacaccacatttctgtttctgttgttggatgcaggtcttctttgtctgtttcttctctgctcttttcacaggtccagttggggtatcag

SEQ ID NO: 662605 - DNA, 289 bp, Homo sapiens
cagtacttgtccatgtggacccatgagcaccgagaccagccgaaagagcgggtaggagtaagacctggatcgcggtgactcatgcagcgaggtttgcctaccagttgccgaaagatcagctggcggcctcgatttatgccctgtgaaagcgcgagctgccttacccgtcctaccggccacactggctcacctgccgtcttgaagactggcagacaggtgcaggcgtagagatatgatctgaaacggcaccatgcccagataatgccggtaccttgtccgacatcgtgct

SEQ ID NO: 662606 - DNA, 379 bp, Homo sapiens
caggaacaacagtggcatcttcaggccagtcagataacttggccaggcaaatacagaggaaaggcagggaacaccctgatttcaaaccacactctggactaggtgaggtggctcacgcctgtaatcccagcactttgggaggccgaggcaggcagatcacgaggtcaggagttcgagaccagcctggccaacatggggagaccctgtctctactaaaaatacaaagaattagctgggcgtggtggcgcatgcctattatcccagctacttggggggctagaggtaggagaatagacttgaaactgggaggtggaggttgcagtgaagctagatcaagccactggattccagcctgggcaacagagcgagactccatctt

SEQ ID NO: 662607 - DNA, 634 bp, Homo sapiens
  misc_feature (31)..(31): n is a, c, g, or t
  misc_feature (94)..(94): n is a, c, g, or t
  misc_feature (108)..(108): n is a, c, g, or t
  misc_feature (113)..(113): n is a, c, g, or t
  misc_feature (145)..(145): n is a, c, g, or t
  misc_feature (154)..(154): n is a, c, g, or t
  misc_feature (160)..(160): n is a, c, g, or t
  misc_feature (168)..(168): n is a, c, g, or t
  misc_feature (194)..(194): n is a, c, g, or t
  misc_feature (223)..(223): n is a, c, g, or t
  misc_feature (235)..(235): n is a, c, g, or t
  misc_feature (308)..(308): n is a, c, g, or t
  misc_feature (342)..(342): n is a, c, g, or t
  misc_feature (344)..(344): n is a, c, g, or t
  misc_feature (361)..(361): n is a, c, g, or t
  misc_feature (421)..(421): n is a, c, g, or t
  misc_feature (497)..(497): n is a, c, g, or t
  misc_feature (515)..(515): n is a, c, g, or t
  misc_feature (526)..(526): n is a, c, g, or t
  misc_feature (544)..(544): n is a, c, g, or t
  misc_feature (547)..(547): n is a, c, g, or t
  misc_feature (550)..(550): n is a, c, g, or t
  misc_feature (555)..(555): n is a, c, g, or t
  misc_feature (563)..(563): n is a, c, g, or t
  misc_feature (574)..(574): n is a, c, g, or t
  misc_feature (596)..(596): n is a, c, g, or t
tgggtgtggcagggtaagcgggatggctgcngccaaggagctgggggagggccgggctcagggctagccctctccgctcttactgttgatctgncggggtcgtccgtngcctntcatgccggcctgggaggcccctcttttgctncccatctgnaggccnatgtcatnctttccctcctgccgctggctctctntgaattccctcttatgctcctgcgctttnttcataaaccanttgggatctccacggtagtgcccatcattcttggtcactgccaagctgccctaagccatccgggtcctctgcnctgctgccatgtctttgccttcaaagaggtcaanantttggaacatgtcagtnttgatgaccccatagtcctcagccgccttcaggaactgagccacctgctccatctgcttnaagaccatggagggtgggttctcgggcaccttcaccggcttggagccatcagggtacagggctgttcaccagcttnctcagaatcacgccattnttcagccaganctggaagcccaagcgccnaangtntgggnggccacancaggggcacantgcactatgatcactccaccanccgctcctccagctcctcgtcatacttcttctcgattt

SEQ ID NO: 662608 - DNA, 419 bp, Homo sapiens
ttatatggttgggctgtgtccccattcaaatctaatccttgattgtagctcccacaattctcacgtgctgtctgagggacctggtgggaggtggttgaattacggggacaggtctttcccgtgctgttcttgtgatagtgaatgaatctcgtgagatctgatggttttataaaaaggagttcctctgtacaagttctctcttcactgccaccacgtgggatgtgacttgctcctttttgccttctaccatgattgtgaggcctccccagccaagtggaactgtgagtccattaaacctatttttctttataaattacccagtcttgggtatgtctttaccagcagtgtgaaaacagactaatacatctgttaagtactaaaaatgtatgttattatcatcaatatgactatacaagtat

SEQ ID NO: 662609 - DNA, 862 bp, Homo sapiens
ggaataaacttataaattactgttccttgttttgattttcttatccggtctgctcccctatcatatcctcatctatttgagaattttatttttgtttacctccctccattcattcacatgctcatctgcatgaagacttaagttcttccaggcttcggacaagtaactggcttctgtagacaagctgtgaaaggtgaagttacacaagagaagcagattgcccaagaacgtcacgtaatttgttatcagaatagaaatggagctgtgtgtcttttgtggcccaaagtcttgactctaactgggttttgagagtaaaaccattgtcctcacctggatccttgcagtgctggacgaaagtcatctgacgggcgagacgggagactggcatgcgtccagttgtcacttgtccattaggagtatgcgcagttaattctatgcaggatccagttcgttgtttgtagggccttctcagctgttagacgaattctgaggttgcactgatactgcgttatgctccctaactgcatcgctggctcggcggaatttgcgaatccgaatttatagtcggtctcagttcagaacgacgcaatagctgtggaattggtaagtatgtctactgcccctgtttcttattagaccggaaattgaacgcctagtagcgttggtttgcgtagcaaagtagggacattggggaccacttctgtgcacaccgcgccaagaactccaccctttttgggtgatttcgcaaaatataagggggtcctctagaaaccaatttgtttgtgaaagaactctgcagttctcaaacaagttggcttacgggaaggggcttggggagcctaatgtaagttctaactcctat

SEQ ID NO: 662610 - DNA, 256 bp, Homo sapiens
  misc_feature (93)..(93): n is a, c, g, or t
  misc_feature (111)..(111): n is a, c, g, or t
  misc_feature (115)..(115): n is a, c, g, or t
  misc_feature (141)..(141): n is a, c, g, or t
  misc_feature (160)..(160): n is a, c, g, or t
  misc_feature (186)..(186): n is a, c, g, or t
  misc_feature (203)..(204): n is a, c, g, or t
  misc_feature (220)..(220): n is a, c, g, or t
  misc_feature (224)..(224): n is a, c, g, or t
  misc_feature (229)..(229): n is a, c, g, or t
  misc_feature (232)..(232): n is a, c, g, or t
accacccctgttaccccaggatccatttgccctcataaaagtgttcaggtacagcagctgaggctgcccttaggaatcaaggggccctttccnaggggcaggaaaaggatntgtnaaaggtggccttcatggtaaagcttnacccaaaaactactccccntttggatgggccagactgactccatnccctgactttccctttnncttccccctgtttgtnaatnaaacnatnaaatggaaggtgctgtgggctgga

SEQ ID NO: 662611 - DNA, 345 bp, Homo sapiens
tgcagaatataattcctcgactctacagatagtatgcctaaacatgaatgtgcccagaatagctatacgtatggtatcttattatcacaaattaaaagttacacatgaggctgggcggaggcggcacacccctgtaatcccagacactttgtgtaggcccaggtccacggagtctgacaccaacctggccaacatggtgacaacccccatctgctactaagaaaaaaatacaataagttagcccggctatgatacgcaggcgcctatttattccagctatcacgggatggcatcaggcaggagaatacgcttgaaaccctgcatggcggaggtcgcaggtgagct

SEQ ID NO: 662612 - DNA, 1149 bp, Homo sapiens
agcggggccggaggaggcgagcgaagctattgagccagcgtaggagtgaacgctgagcctggcctcagcacgctcctaggagagaccaggcctcctgagagtagttctttctacccccatcttctttctccgaatgctcgcgctccgtgctctccatccctgcccaatacaatgcattcttgagatggcagcgtctggactccaggcaagcaccagagaaccgaagccaagccggaagagaggactggagccacacatactggtggcgggagacttgggatgcctggcttctctttgaggagcatcgttctggagcgaggggtgggctttggggtgggggcttgtgctgtcagggaagtacaggcaggtccccaagatggacacattcgtggggcacattccagtgacgtcgcgggtgtggcgggacgttggcatgatagcatccgctagagtgcgcccgtggtccatcgcgtcgtggaggatgagtcagacacgacagtcagtcgagcagcagccagacagtcagcaggcaggccatgcattcgccggagcgcctaacaagcgagctccggccagcgagcgcctggagagccatcgctggcagcttgctcaggctcccgaagccttcaagggagcacgcggccagcagcaggcagcgaagcgaggacggagacgcagacaggcggccgcacgacgacggagcagaagaaacaacgagagtaacctcccctgagtgacatgcatagacacccacaggacacaacatacgaagacgccacgcggccgcgaagcacccgcgggggcacctgcctggcacgtccgtccctcccccaagggcccaacgcagggccccccccccaagttagcgacaccaccaaagaacaccaaaacagaggacaacgcccaaccgaaaacacagccgcagcagcacaacgccaacggggggacagaaacaagacccatcaaaaacccgattagagagcagacacccacggatggtgacctgggcgcacgaacaacacccagaggacaccaagcaacgcgacacacacaaggacggcacccatcggccaacacacggcccgcaccacgagtcaccacgggaaccaggcgccgaagcagccacacagcagagcgcggacgccgagc

SEQ ID NO: 662613 - DNA, 881 bp, Homo sapiens
ggacaaacactgagcttcagcgcctcggtccgtgcgccatggtgccctccaggaagttcttacgttgagggaaactggaatatgagactgggcggaaccagcagtctgggggagctcgatcggcactcgtgaagctgcggacaaggttgccaggactcgacgatccgaggtgtctttgtgtggtcctcctcatacctgcacgtatgatcgacgttgccgctcggataataagctagatcccaaggattggtgtggtgcgcagaactgctacaaagtgactaatggggcttttactggggagatcagcctggcatgatcaaagactgcggagccacgtgggtggtcctggggcactcagagagaaggcatgtcttggggagtcagatgagctgatgtgggcagaaagtggccatgctctggcagagggactcggagtaatcgctgcatggggagaagctagatgaaagggaagctggcatcactgagaaggttgttttcgagcagacaaaggtcatcgagataacgtgaaggactggagcaaggtcgtcctggctatgagcctgtgtgggccattggtactggaagatggaaaccaaaaggccaggaagtaacgagaagtcgaggatggtggagtccaacgttctgatggggggttcagagaccggtttattaatgggggtctgggatggggacctgaatgaagtggcagcagtgattgatggttctggggtgggttccttagcgattgggattataggcaatgagcatcttttttactttgagagattaagcgaaccaatggctcgatgtgaggggggtgggcacaggtttgttccgggggcgaccatagggaaagtgaaggggaaaaataggcgaatgaa

SEQ ID NO: 662614 - DNA, 217 bp, Homo sapiens
gtactaagagatgtatctccagcatacctcctcctcagcctctttctggtgcttcagcttctggtgcttcttattcctcatgatcacatcttccattgggtcagccatctcttcatcttcgccatttgagacgttccctctttcctccatcttgttgccgactgcctcctcccttattatcagaccggcacatcgaagcccaccttgaagcccgtta

SEQ ID NO: 662615 - DNA, 1003 bp, Homo sapiens
acagtgtctcgcacccgaacatgggctccatcaagtcgcatcctgccccgtcggtcgccgcatgggagctcgcccacacgctcagttatcctgagccccaggtccagatctggctctcagaaccgtagcatccatggcgcagtcaggcgcaccaagcttgccctaacgcccaggatgcgatcctcgaattctggcctcggccttctgcctggcccacccagggttagctacaaacctcatgagcccacacctgccaggtccccacccgtacccgagcgacctccacacccgttccctcggtccatagtaatcgttctagagatctgtaaccagtttgctatcccttacctgctgattctcttgctcgttctcctgcgtccgttcctcagtccacccctccccatctggaccagtaatagacgaccggtgacggactccaaattggtaaaaagcaataatcggacaagaagacattatccggttaagagtctgtcgctggttgccacccaagagagatactagttgtccaggatgctggctgtgtggaactaacctgctggcccgagaacaaggctgccaggctgtggatacctgagaaggactacttggtatcaaatacttgttgagatggctacagtcagctagctggacagcccatgctgaactggggacatacacttgcatctttgttgaaagcagaagaagtacagacccgtgtccccatccttgccttacctcctgcttcccccatttaaggcagctaatcgcaagcttcgtagtttcaactgaatacaatgagtagacattggtggacctcgacaagattatttcaagttcttaagatgtgtagaccttgatggtaggtgtgacatgttagtttattctgaatggcatttatttaagacactgttacagagataatgttgtcaccttctggggcacggtctttggggagaggggagtgcatttagacttatgtgtaacctgcacaggttgtatgtgg

SEQ ID NO: 662616 - DNA, 982 bp, Homo sapiens
gagagagaactagtctcgagtttcgatattattttcactttccatttttttaaaaagctacgaaaaatgagcaggtggactgtggtttccaggaattggtggcgtctcacgcttcttgtgcttttcccttgggggcctccgagcggctggggttgggggactgggcaggaggctcccgtgtaaatcattgggacttgggctggggcaggggctggtgttgggcaaagctggggtggtccatggctgggaagaacgcatgggtgccccttccagacgcagccttgtggagactcagctttgtgcccccactcccctcatcacaagaacaaagacaatgggttaaaaaccagaacataatgcccagaatggggtgtacatggccattaccagaatctcaaacaatgggcaggcttcaaacagggaggcctgtggaaccctctcccctacgtctggagctgaggggacagggggagctgaagaacaaagagaggaaagacggaaaaaaaaggcggaggggaaaccagagagggaagccggtgaacataagtaagcaccgacatagtatacataaagggagatagagaaggaaaccaaagtcagagatgaagcacacatcaccgacagagaccacgaaagaccctcaaaaagaaaggccaagcaaggaccataacaggaaggcaactagagagagacagagaacatccggataacagggaggaaaaaaaacaaagaaccgtggcaacgcaccctagggaatacaaaggggacgacacaatgaaacgacgccggggacaagaaccatgcactaagaaaggcgtcataatagcagactaaaatacaaaggagtcccaaaaaaagtcaaccacactgggacagaacgcacgcgtagcaacaaaaaacatatagtaaggcccatggtggaaacaaggggggagaagaaagaatgggcacgggagaactgaagaaaaaacatagcccgcaa

SEQ ID NO: 662617 - DNA, 182 bp, Homo sapiens
tgtatatctctccagctgtactgtagtgccctgcaggctgtttatatgttcacagttacttttacctttttctaaataacagtcatttaatgtagaatactgctaatgggactctccgtattttcattttgttgaagggctgattgggatttccatgttcttattaaaaatctaacaaatca

SEQ ID NO: 662618 - DNA, 116 bp, Homo sapiens
aagatgcccagtactgggagaatctgcacatgtccccaggtggttttcaccaaggggttttcaaagacaacactgggagtacagaatataaagcccccagagggatttaatatata

SEQ ID NO: 662619 - DNA, 156 bp, Homo sapiens
cttttggagttgatttccagtttattccactgtggtctgagagagtgcttgatataattttaattttcttaaaatttattgaggctcattttgtggctatcatatggtctatcttacagaagagttcatgtgctatatgaaacttctaaaactagg

SEQ ID NO: 662620 - DNA, 84 bp, Homo sapiens
cttcagagccaggacacagctcagcagtctgtcatgactctccatgtcttcccattttcctgcggcctgatccagggaaggagg

SEQ ID NO: 662621 - DNA, 518 bp, Homo sapiens
ggtatatcaggagactcccaattccctccatctccagctaacaactccaaccccgtgaaggacacggatgctgtgaccttcacctgtgaacctgaagacgcagaacacaacctacctgtggtagagtaaatggtcagagtctcccggtcagtcccaggctgcagctgtccaatggcaacaggaccctcactctactcagtgtcacaaggactgacgtaggaccctatgaatgtgaaatacagaacccagcgagtgcaaacttcagtgacccagtcaccctgaatgtcctctatggcccagatgcccccaccatttccccttcagacacctattaccatgcaggggtaaatctcaacctctcctgccatgcggcctctaatccaccctcacagtattcttggtctgacaatggcacataccagcaatacacacaaaagctctttatccccaacatcactacaaagaacagcggatcctatgcctgccacaacaataactcagccactggccgcaacagg

SEQ ID NO: 662622 - DNA, 502 bp, Homo sapiens
  misc_feature (107)..(107): n is a, c, g, or t
gactttgggtagagggtatgggggatgatttttttctttggagtttggggagaaatattggtttaagtaacttctaattggccatcgagtaaaccgataagtaatgnaaggactccagggtgccccacgtttctgccaagtgaacaggggctggataataccaagtatggtggtaatttataaaatggaaggcaacccccgctccggccgcccccaatctccccatggccatagagcgctgcacatggaccccagctctgacttctcattacggggctgaaagtcagcccacgtcggagcggtgaggaggagccacagcacagggggtgccacctcgaggtcggcacaggaggactgggcgctgccatttcctaccccggccatttcccaccccggcttcagcgaaagggactctctaacagggcagtcacggtggactctattctgaatttcctccctgggggaagaagggaaccaacatttatacctgactagagtggcc

SEQ ID NO: 662623 - DNA, 124 bp, Homo sapiens
atggtctggggatgagatgtccctcatgggtgctgagaacttagctagaggtactctctggcacgactgcatcggcctgcctcagtcgagaatgtgggagtgctagggggcgggtacgagtcga

SEQ ID NO: 662624 - DNA, 969 bp, Homo sapiens
  misc_feature (119)..(119): n is a, c, g, or t
  misc_feature (225)..(225): n is a, c, g, or t
  misc_feature (227)..(227): n is a, c, g, or t
  misc_feature (289)..(289): n is a, c, g, or t
  misc_feature (303)..(304): n is a, c, g, or t
  misc_feature (315)..(316): n is a, c, g, or t
  misc_feature (320)..(320): n is a, c, g, or t
  misc_feature (323)..(323): n is a, c, g, or t
ggagttccgagcgaccgatggagatggcggctgcggtgagtgacggacggtggaggcccagagcccgggctgaagggggggacaaacctgggtgcccgcaggagcccggcaggtactgngctaaaccctggggagacggcgaagtgaaaacatatagagtctgtgccctcccagattttacagtcttacttggtcacttcacgtatgtacctgcggtttataaantngagatgagtgctgtgaaggagaagtccattctgatgctctgagtgtcttacaagtatcaagnaacttactatatgnnggttgaataanncaantcnaaggataccggaggcattcaagtgtaacaacatcttctcgcttgtgattaagctacttcagcaccacttcccccagttggcctgtaacgtgtggccattatgaacttactgaagctcggatcatttggaatgaatgtaggagaattgccaatgggctcctccgtactccagcagcaggaaacctcgatccagggccaatgaagccacttcctcaccatctgtgtgctgcttaagctaatgctgcgggaaccgtggttccttgggaggaatcaagctgaatcttggcatgagattcctgccttcctagggtctgagagcggtgctgccatgtgttctctggactacccagggacgtgacggagggctacctctgacgttgtgactgaaggaattgcagtggtccaatgaggttcagtcacattagaagggagacgtcgggggaggacgggatcgccagggcattcgcgtctgttcgacggtcaaggcagagcagtggaacaacgggaaccgcacactggacaaggaactttcctaggggcacctgggacgcgtggaaaacaccaacacagaacgtggcactcacgtctatttttcttctcgtctctcctcatcatgccataagagaagagagaaaggagaaagaacg

SEQ ID NO: 662625 - DNA, 804 bp, Homo sapiens
  misc_feature (119)..(119): n is a, c, g, or t
  misc_feature (225)..(225): n is a, c, g, or t
  misc_feature (227)..(227): n is a, c, g, or t
  misc_feature (289)..(289): n is a, c, g, or t
  misc_feature (303)..(304): n is a, c, g, or t
  misc_feature (315)..(316): n is a, c, g, or t
  misc_feature (320)..(320): n is a, c, g, or t
  misc_feature (323)..(323): n is a, c, g, or t
ggagttccgagcgaccgatggagatggcggctgcggtgagtgacggacggtggaggcccagagcccgggctgaagggggggacaaacctgggtgcccgcaggagcccggcaggtactgngctaaaccctggggagacggcgaagtgaaaacatatagagtctgtgccctcccagattttacagtcttacttggtcacttcacgtatgtacctgcggtttataaantngagatgagtgctgtgaaggagaagtccattctgatgctctgagtgtcttacaagtatcaagnaacttactatatgnnggttgaataanncaantcnaaggtacaagagcatcaatgtaaaaaacttctgctgtgtgggataaggtacttcagacatttcccccagtggctgaagtggcacatgatttatgaagtgggctcattgtgccacccaaaaacaaacacacaaacaaataaaacattttggggggcggcctggggcccctgggagaaaaaatctttttctgaaaccacatttctggtgggggcgcgcagcgggcagtccgaagaacgtatggacactgcaaaactgtggcgccgaaagcgttgcgtccccaaggaggacccctgggggccaagcgcaagcgggcgtggggcttctcccacgcaataaaaaaaaaggccgcggggggacccacagaggtgtttcgagcaccgactcccagagggaggtccgacagcactacggagtccttcacaccgggggccaaggaagcgagtacgtacgagaccgggtgagacggaaacgcagccagggc

SEQ ID NO: 662626 - DNA, 117 bp, Homo sapiens
agcttcacctggtcctagtcaaggaaagaaagtctcaaggagttggcagtggacaagatgaggctgatgtagaccctcaaagccctccaaggccagaagtaaaaattaccagtccag

SEQ ID NO: 662627 - DNA, 542 bp, Homo sapiens
cgcaaagggaggatacgtcaggagtctgtgctatgaatacgaggggacagcactggagagagaggtctcgggctggctccccgagggcaggtcttttcggtgtgttaggaaggatgtcagagataagcatgaagcatgcgaacatcattacatgtgtgggacagagctcggggtgcatgggcacaagtgaaaaatcaggctgatacatacatcgtgcataataaataacacctatgcccctcctgggtggggattttaccattctaatgaggcaagaggtaaagctcagccgttcttctggtcttgtgcacaatgccagtgatagaggtgactcccgtgagtaaggtttccagtggaacccttgtaagcttggtttctccagggtctatggagacagtgggggtggtggggcgagctcaggtgcttagctgatgtgcatgggaagacacatcagtgggaatgggccaagttcctatgggggccaagtcctgtccttatgctgtctcaagataaactggcaatcttagaggacttcctggaac

SEQ ID NO: 662628 - DNA, 186 bp, Homo sapiens
cccctgtgacactagaaattgtgtatgccttaagtttttgtagagacagggttgtgatctgttgatcaggctggtctggaactcctgacctcaagtgatccgctcacctcggctcccaaagtgctgggattacagttgtgagccaccgcgcaccgccaagacttttcttttgccatttcccaatcg

SEQ ID NO: 662629 - DNA, 423 bp, Homo sapiens
tgtgcgaagacgtgtttgcgtacgtgcttgtcctcccggcgtagcccaccagtacttggcgttcagaaactctaaggctcataacccatttgctgggagcagagacgagccaggagctggatgttggagaagtatggtctggatgtcggagcagagagactcatcctcaaatgtaggcatatagtttttatcatcctctgcaagagaggagtctggcagggatggctggagaatctcaggtgaagcattaccttcttgttccgtcccctttccagatccctttctcactgagagccactttcataggcaatgaaatcccccacatttaccaccttcaattcgtctgtgagaccttattcctcctggactccagaccaaaactccgtgtgccacaagagtgggcaccaaatccccggggtaccg

SEQ ID NO: 662630 - DNA, 119 bp, Homo sapiens
ggttcggatgtaaatgacgtgaggcaggagtcagaggaggttagttgtggcaggcggggagccagtctgcagctgggcctgaaactgggcaagctgctcaaggtgatcttctgcacgat

SEQ ID NO: 662631 - DNA, 186 bp, Homo sapiens
ggagctgcccggaggggaacctaggtcccaggcctgccatccaaatcctgactcctctatactctacatatgcactaataatacctatgaatggagacattattattattagttccgcgcgagtagtctgactcctcagactgggtatctagcctcttctactcttgatatcctcccatgaaactt

SEQ ID NO: 662632 - DNA, 354 bp, Homo sapiens
gccccctccccctccttccctgctccttcgctctgcaggcccgttctccgactgccgcggacctttgcgcgccgctgccaagacatcacacgataccatgcgaagcagacaccataacgcgcctgcagcagacggagcccacatcaatcatgacaaagaaacagaacagagcacacacgagaaaaaaagagaaagacaaacaacacaagaacacaaagaagacaacagacaaccaccaatagaacaaaaacagaacagagagaaacacaaaacagaggagaacaacagcagaggaagaagaaagaaaacaaagaacaacaaaacaacgaaaaaggagaaaaaaaaagaacacaa

SEQ ID NO: 662633 - DNA, 332 bp, Homo sapiens
gccgcccctactgtgaagtgaggagcccctctgtccgggcaccaccccgtgtgtgaggtgtacccaacagctcattgagagcgggcgatgatgacacgtggcggctttgtggagtggaggtggggggaaggttgggaaaagattgtgaaatcgggtggttgccctgtctgtgtataaagaagaagacatgggagacttttcattttgttctgtactaagaaaaattcttaccctataacttaaagtgttataaaaaaaaaaacttcagttttctaattatatttttgtaatcagttttcagacattaagtgactgtatcatgttcgggttat

SEQ ID NO: 662634 - DNA, 433 bp, Homo sapiens
  misc_feature (52)..(52): n is a, c, g, or t
  misc_feature (81)..(81): n is a, c, g, or t
  misc_feature (104)..(104): n is a, c, g, or t
tgcagcgaagtctctgccatcgccaggtcctgattcaccttgcccaaatggngctcgaacacttcggtaaaacccttgggntgcaaggtgctcgacaggtcagncgaggctggcatggcctcgagggcctgagccccatccagtgcgcccattgctgcaatcgattcgatcattgtcctgctccaatttccaatgcgcgggtagccatggcttttgctgcctgcatggctgccacgttggcttcataggctcgcaaagcctggttgatgctcatcatctgctcgaggtgattgatgccaggttgacgcaccatgccgttcgcatcggcatgaggatggccaggctcgtgcacgaggcgcggctgcgtgctcaagtcgggaaccaccgacgcaacgacgcccacttggcccatggctcgggtgaagccctgcgc

SEQ ID NO: 662635 - DNA, 287 bp, Homo sapiens
  misc_feature (53)..(53): n is a, c, g, or t
  misc_feature (73)..(73): n is a, c, g, or t
  misc_feature (81)..(81): n is a, c, g, or t
  misc_feature (113)..(113): n is a, c, g, or t
  misc_feature (118)..(118): n is a, c, g, or t
  misc_feature (128)..(128): n is a, c, g, or t
  misc_feature (130)..(130): n is a, c, g, or t
  misc_feature (132)..(132): n is a, c, g, or t
  misc_feature (142)..(142): n is a, c, g, or t
  misc_feature (162)..(162): n is a, c, g, or t
  misc_feature (164)..(164): n is a, c, g, or t
  misc_feature (213)..(213): n is a, c, g, or t
  misc_feature (271)..(271): n is a, c, g, or t
tctgggcggggctagtctttgcggggggcgggtggaggggggtatatatatanatatatatatatatatacanatacacangtgtatgtgtatatatatatatacacacacanatgtntatatatatntntntgtgcgcgcncccccccacacacacacacncncgcacatgtgtgtgtgcacacacacacgcgcgcgcgcacacacacacanatatgtgcgcacacacacacacacacacacacacacacacacacacacacacacacanacacacacacacacac

SEQ ID NO: 662636 - DNA, 314 bp, Homo sapiens
  misc_feature (146)..(146): n is a, c, g, or t
agtgggagggatgtgcccctgaccattaacgactgtttttttttttaaagaatggagttgttggggcaggacatgcccccaatgtgaaacagacaaaatgcattacccctgtagtgtaaagtggcccctatgaatccctatgtatnaaaggagggaggcaggctgcagcttcagccccagaatgggggctatggaagacagcaggagctcatttcctttgcacattttggctgttagacctgtgtgtgtgtttaaaaaaaaaaaagtcagggctccctttttgtattttaatattaaaaatgattcccactgga

SEQ ID NO: 662637 - DNA, 231 bp, Homo sapiens
tttttctttttctttttttctctcttttttttcccccccccccccccccgggttggttaagcccccgaaaggggttttttttctttaaataaggggaaagggcttaaaaaaattccggggattttccttccgcccctttttgggattccgaaaaaaatttttgggggggaatttgcccccccaaaggttttaagaaggtggtttccaaaaaaaggcccctttttgttttga

SEQ ID NO: 662638 - DNA, 419 bp, Homo sapiens
gccagcttgggctgttcaacctgatgcagaccagagtcaacggcgggttgcattgggtgcaatgcaatggaccataaattctcattttttgaatgctctaaaaatgatgatgcatggatcgtggtccacgagtagcggcgcaagttggaatggcaaagcattttcattcccggtgagcaaaggcagcttgagttccactgcgcagaaggcagatgtgaagtactccggttctgttcattttaccggtgttggcggaagaatggatcttactctcgccgaccctgagattgtcgttaacaatggcgatgatcatgtgattatgtccgtgaagtccaagactatggtcgggcagtcggttgattatggccgtataactttcgttgatatgaccggctctattacgcagggtcaaaacgatg

SEQ ID NO: 662639 - DNA, 190 bp, Homo sapiens
ctaggtaagagtttgttcccgtggtgcgggagggtcaaggccacacccgggaaacctagcggagggtaaaggttcgcgtctttgggttgtaggaccggcaactttctccggtttcctcgggcggatggcggcgtccgggaacgcggtattggcccagaaaacctgtggaacttgcgccaacaacacttca

SEQ ID NO: 662640 - DNA, 225 bp, Homo sapiens
tctgtatatctactaaggctttgtatacgacccagagatacacgatgcgaatttagttttgcaagaaagggtttgtctctgtgccactctataattgttttgctacgataccactgaaactcttcgatcaagctactttatgtaaatcacttcattgttttaaaggaataaacttgattatatcgtttttttatttggcataactgtgattcttgttgggagctt

SEQ ID NO: 662641 - DNA, 181 bp, Homo sapiens
agaaaaaaaaaagtcaatgtgggtagaaaacttgaaattctatttattaagaaattagtgctgccaggccacagtagctcatgcctataatcccagcactttgggaggctgaggcagggattgcttgagcccaggagtttgagaccagcctggggcaacgttgcaaaaaccctgcctacaa

SEQ ID NO: 662642 - DNA, 350 bp, Homo sapiens
gatgacatgatacaatcgagctcgtgtacctgtgggtagcatcaatacggaagggcccagcgttggggagagcccccagttgagaactagtatgaacaattatgtatgaccactgttagagactgctaatcatcaaacaacctgtgtgctcaatgatccccctacacacgtagcacccttcagcaggaccctatgaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 662643 - DNA, 151 bp, Homo sapiens
atgttggatcatgacatcccgatggtgcagccgctattacaggttcgtttgatcaaggattaaagtacctacgtgatcagagtacagatcggagtaatccaggtcggtttctatctactgcaaattcctccctgataccaatgactagaaa

SEQ ID NO: 662644 - DNA, 465 bp, Homo sapiens
tagaggactctcccttagaagtactctgctaatatacagccaacagcccacatgtccacacctacaccatacatcctagctccaaatagtaactcgggggccgataccacctggttacaaactggattgttgttattaaaggctcctattggggctcccaaaagatttggccaggccaaaatctgccagttttagaactccattttcatctagcaacaagtggtttggtttcagatccctatgtaggatccaatgttgatgtaaatattctaatccttgaagagtcatcaacatgtaggcttggatgtgtgatggtgtcagaacaagactattatcctttattataacctctagatcagtttccataaaatcaaagacaaggctaatattagatttatgtccaaaagcatcaaggagcaattatattgggatgacttagctcctgtaataattttacctctctta

SEQ ID NO: 662645 - DNA, 1199 bp, Homo sapiens
ttcgctgaccagtaccatggccggtcggcaagaacaagtcgccttaacgacaatggcggcaagaaagggagccaacgaagcaaagtggttgatccagttctcataagaaaagattagtgtatgatcgtgaacagtcaccgtgcatatgttcagatatagagaatatgattgcgaaatgacgcgtcgctacgagccgaggtacccgaaaggaacccaaaacttgcagtctgcatggtgctcaagaggtcggtgtgtcttggagagtgacgtgcttgcatgatttgccagcacatgcatgcataggttgcgatgttagacacatattcaaagacctggagttcactggacaccatggttccagggctgagaagaacttgcctgcacgtatagctgtccatggaccagtggcaatccttcaccgcggtggactcaaacatgtgcttcctcatggctcgaagagacacactggtcaggacaacatgcagttgcacacgcatcgacagctctggaaatgctcaagagaactgtagcctgagtgcggtatacatatgccatgtcgggtcgtgatatcatagtggtgcggggtctattagcttacaacaaagacgacagaccagagtccaagagtaccgggagaagagccctcgtattacttggcatctagcaaaccaaaaccgaggctcgcgcccgaaaaagttccggaatagaacaggactgactgcggacacacgtcaatcgaaccccggcactaaggggttgcaagaacaaagatgaagcgtgtgaaacacgaacgggtggggtccaagtcgaaacttggagttccaagaaccaaggcactttggggcccccactgaccattagaaacgagggcctatgcccaaaatcttaattttgatgtcccttcctacccgatggaatggtccttggcggatctacgaccgctcatggtcagcccaacatgggcttggacacggacaagaccccccaaagggtttctcgccacatttgggggcaacaaaaggccttccaatgtgggcacgcacctctcccataggcgctgcaagagggcgcacacacgagtctcactaggtgcggcaccaacgggcaactggggtgtgacacagtatcgcaccgaaggtgtgcctcaaaccatgttctggccacctgacaagctctgctatctggcgcttatttgcagc

SEQ ID NO: 662646 - DNA, 1484 bp, Homo sapiens
  misc_feature (1)..(1): n is a, c, g, or t
  misc_feature (977)..(977): n is a, c, g, or t
nccgcaccagatgtggggcgccacacgaaatgtgtgggtggcgccgatagataagggcgcccaccacaaagggtgctgatgcccccgaaccactgtagtggagcggtgcactcccgagaaggtgtaatctccccccccgggtatataggggtagggccgtgtccaacagcaccaaggacggtcccccttctcaaccaggggaatagaccacaggtgtgtgcccccacaggggcaccaatgggccacaaaaagggttggtaaaaagaaaggtcccattgtggaggccgctctccacagtgccgcccccctccgacgtttcccccgaggaggtgtgttatctcctccaacacttctccacaaagggggctctcgtgtttgtgtgcggcgccaacaaattgggggagaagagagacccttgtgacgccacaacagagatgcgccgcggaaaattctcggggtgcgcccccaggtggataaattatgcgcccctcttctcctccccacggaagtttattccgccccaaatatttgtgtgctcacgccccccacagaaaaaggagtatctcccgtggggggtgtgttcagcacactggtgggccccacaccccggcgcgggcagcgtgtgcccaccgccaccatgagtgttcagcacgttcttgtgctttgtgtttccgcgtaggtgtcgccacagaggacagcacaatatggtgtcctcggttttgtcgtgtctcccaaggggatatgccgccgcgcctcgcgcgcctcgtgttgtgggggcgctcgcggcggctctcttctggtggtgtggagaaataatgtgcaacaccacgatatataatcgtcgttattatggaggacacaacagagactagtgtgttggtggggacaccacccacaagtgtgtgagcatattgtgttgtgcccacgaagtactctgtgatatatatagagatagtgtaccacccacggcacacacncgtgtctccgcccacataccccgtgtgggcacacacagagggagacacacgcgcagcacgcgcgtgtggtgtgtgtgtgtctctcctgtacacccacgcccaggtctcaggcgcccgtcctcagagagacccccccctttgggggtctttgtctccccagatctcacacacagcgacaggcgctctcctctccacaggagattcgtccagacccccacatattatatatatgtgtgaagagagattgagagaatatatctcacaggagacgcctgtgctcgccagaccacgccattgtgtcccacataaaggagtattccaaggtggtccccgtgtctcgtgtgttccctttagaagatgaatatctttgttcttataaagattgtggacacacatagtttaggaagcacccttgtggaaccatctttagacccctgcgggatatccagcttcccattgtgttctctttttttcagcgaacctgaatttgatcccgactcttaccca

SEQ ID NO: 662647 - DNA, 1197 bp, Homo sapiens
  misc_feature (494)..(494): n is a, c, g, or t
  misc_feature (551)..(551): n is a, c, g, or t
  misc_feature (554)..(554): n is a, c, g, or t
  misc_feature (616)..(616): n is a, c, g, or t
  misc_feature (628)..(629): n is a, c, g, or t
  misc_feature (643)..(643): n is a, c, g, or t
  misc_feature (647)..(647): n is a, c, g, or t
  misc_feature (651)..(651): n is a, c, g, or t
aggagtctcccatcactggaacaaggctataagagcatgatgagaagtgacttcatctctcgacatcttagccattttgttgcgagccaagtgcatggcacagttgtaacatgcaacacagtttgggtgcgcagcagctgttaggctccaggcaggctgctaggttccagcaggctcgcctgtattcatcatggcgctttccaacagttcgtcatcgcagaatgttcactcagagatgtacagtattgctgcatagacacttacatcagagatcccaagaaaagggaatttttatttaatgcaattgaaaccatgccctatgttaagaaaaaagcgagattgggccttgcgatggatagcagatagaaacatctactattatggggaaagagtggtggccatttgcatgcatgtagaaggagttttcttctcaggatcttatgctgctatattctggctaaagaagagaggtcttatgccaggactcacttttnccaatgaactcatcagcagagatgaaggacttcactgtgacttgcttgcctgatgtnccnatacttagtaaataagccttcagaagaaagggtcagggagatcatgtgatgctgtcaaaatngagcaggagttnnaacagaagccttgncagntggnctcattggaatgaatgcatttgatgaaacagtacatgagttgtagctgacagattacttgtggaaccttggattctcaagaggtttgtcaggcagagaatcctttgattttatggaaaacatttctttagaaggaaaaacaaatttcttgagaaacgagttctcagagtatcaggcgtattgcagtctatggcatgaagaccacagataacgtcttcaccttggatgcagatttttaaaaaacctctcgttttaaaactctataaacttgtcataggtaaatagtagtctattttcctctgcttaaagagaaattttaagtatatccttctaaaggactgggggtttgcctcaaaaggacaatccaaagacctatactaagacaagtttgcatttatataattttcctgtttaacaagcaagagtgtgacctaaaatgcttagtcttgtcactggaaacttcacagatggcttatcgtggttacgaagcctggggcgaggggcccgacattggagccaagggtcctggccttactccagtgtgcgc

SEQ ID NO: 662648 - DNA, 510 bp, Homo sapiens
tcatagaatggcctgatagacaaagacttataacaggggatacttgcaatcctgttgacagagaggactaagtataagatatatgtctattgaatatgtgcaaagtagtcctaggcaagagttcctcagcatctttggtcaactgcacacatttcatcagcaagcaatcgtaaaactaattttgttagtggcagtgtttggttacttcagtagggccagacagtaatgctgtgtggtcagcaaacccatttttttttccttcagataggatctcacttggtcacccaggctgaagtgcagtggcaccatcatggctcactgcagccttaacctcccgtgctcacgcaattctcccgcctcaagctcccgagtagtagggtctacaggcgcatgtcaccacgtctggctagttttttaatttttatttttcgtagacacatggtcccactatgttgctcaggctggtttcaaactcctggatgcaaggtatcctcccatctttgcttctca

SEQ ID NO: 662649 - DNA, 233 bp, Homo sapiens
accaggctgattattgcagaaagaggaagacaatagagaacaatggacgcaataacatggactgtacatgagaagtggtatgcgggtcgtggtggctcacacctgtaattctagcactttgaaagattgaagcagtgtggatcacttgagtgtctggggtacgagagcagcctggccaatatggtgaaagctgtctctgcgtataaatacaaaaatataggcaagcatggtgg

SEQ ID NO: 662650 - DNA, 1208 bp, Homo sapiens
tgggatctgtctcttccttcgcctcctgcacacttgggagccctgtgtgactactctttcactggacccatgttgccctgtgatctgtagtgtcctatggtggacgcacagttaattgtgccaggacatcctggaagctgggaaatgatatgtattacattaacctacccaccgtagtggaacgagacgataattcccatctctttacaacctgactagcatttccaacacgtaaagctgtgacgattctgctatgaaatcacctctacaaacaaatacacaaacagacctgggagacatgctacactcattactgctgagtgaaataggcatcatagctgggaaacggatacacaagacccaggctgtaccctacatatgtaacctacctccgaacatcagttcatcagtcaatcaagccaatgtgagagtggaggccattgtataccctatacattcttggtgcactctactccaagataggaaaacggccagtgaggtcctgttaaacaggatgcacatcagaaggccgggactccctaagcactatgagacgtgctaaaccagaacaggtgtaagaacaatcattcacacgacatgacgcactgcagtggagggacatccaaacctggacctacaatccacttactgcaaatcctcaagacccacattcctgcaggggcacgtggcaaaggaaacacgtcatcctggccagggttccaaacttcgacgaacagacgtgttgagcactctgcatgtgacctcagtctgcgacatctacaattcggtcgaccacgacctgtcacaagcgccgaaacatggtgcctcgttgactcattcccgtactaacggtagagattcgagtacccaacacattataccacatgcgcacggccgaccagccagacaagcgagagacagcaagaaggaagaagccacccggaaaacacgcaccagcgacagcgcgagccgcgggcgagcgacgatcggccggcccgaggcagggggaaagcggctgagaaccagaggacgatagcagcagggagcagcgagggcacaaccaaggaagaagtaagaccgccagcaagataccaaccacgcaaaggcacaaccacaagaaagcgcacaccacagccagagccgcgaggaggagagagaggagacgagagcgggggacggacaacgaacgcaacagaccaagagcaggg

SEQ ID NO: 662651 - DNA, 462 bp, Homo sapiens
atgggtggttttgccatgttggccaggctggtctcgaactcctgacctcaggtgatctgcccaccttggcgctggggttgcaggtgtgagccaccacacctggtcacaggtgcagttttgttacatggatatattgtgtagtggggaaatctgggcttttagtgtaaccatcaccaaaatactgtacattgtacccaaaaggtaattgctcatctctcaccccctcccacctttccaagcctccagtgtctattattccacactccatgaccctgtatacaccctgtttaactcccacttataagtggaaacatgtggtatttttttttgtttctgagggttctttaaaaatctttattttcttatttttttctgagttgtttcacttaagataatagcctccagttccaccccgtcgggtggagcgctccacccgacggggtgggggaaagactgaggcag

SEQ ID NO: 662652 - DNA, 250 bp, Homo sapiens
tctgggaagggggtggcactcatgctgagtagcagaggtatgtagatacagatgtgtgtggttactgtaagtggaattcaataattttatttattgtattttcttcgctcactttgttattgtgtattgcgttattgtctaggagtgcatgaaatcatctggaggagcatataaatacaaatggctggacccctctcccctctataaacgctgatccgataacacaaacgcctggacccctcttccccag

SEQ ID NO: 662653 - DNA, 284 bp, Homo sapiens
gaaaataaaggttatttgaagtgttgaaggtataaaaattatttgataaacaccccaccgaattccaaacgtgctgccactgtctggcctgtgtttcgtcagtggtaaaaatggtcgctgaaaggccgaactcactataatagccagttccagtgcatgttctgcatctctcgcaaatggtgattgccgcaaaacgggccaaaaacatttcttccaaacgcgtcatttctgggtaacattcgccagaaacgtgcatagtagtacctgccccagcatcttttccg

SEQ ID NO: 662654 - DNA, 454 bp, Homo sapiens
atcacatctgtgtcaggttagcaaactatgacctggggccaaatctggctcaccgcttgttgttgtaaataaagttttattggaataaaccatgcttatttacttatatattgtttgtctatgattgctttcatgctgcaacaagggtaagtagttgtgacagagacgggctcaaaaaacctaaaatatatactgatagagctcttaaaagcaagatgttgtcgatccctggtgaatgtcagtggctcctttatcattatccagctattcctaactgccctgcatgtgctgtggtgaaacagtgttggtttgaactgtaactgcttaatagctaggaaaccctaaattttctgagactcagtttatctataaaatgaaggttaaaaatacatttttaagcttattgtaaattcattgtagatgctcaataaatgttaatttccttcctgacaaa

SEQ ID NO: 662655 - DNA, 452 bp, Homo sapiens
agtatgttgactctggagagaagtattattaagagaaatggagatcagcacctcggagccacacacaggtctctgatatcccttttctgttcttctttctgccctaacggacaggcttgcagttccctacctctgaccaccatcttttgtttctgatcgctgttcctccttttctttctgcattgcccagaccacactagagcagaggtgtctttgtgctcctagctctaatgcaaacctcacaaacactgaccattcagtattcagataaagttcttagctaacagaatagctaatatagtcagtagaaataaccctgagggagttcgagatcatcctggctaacgtggtgaaacctagtatcaattaaaaatacaagaaattagccgggcgtggtggtgcacacctgtagtcccagctactggggaggctgaggcaggagaatcacttga

SEQ ID NO: 662656 - DNA, 153 bp, Homo sapiens
ctcatgtccactggaaccgccacagctgcttctaacacaggattttgaggttgcttcagcctgacgctttttttgtgctatctcctaatagcaaaagaccctccagcgacaaccagtatgccaagctccgtgtgcacaccgacttcgaccttg

SEQ ID NO: 662657 - DNA, 194 bp, Homo sapiens
ggggacttgcggctcctcaggctctgagaggccctgtgtgacaccggtctgtcgtcccggcctcccagtggtctgagggaccgtcgtctcgttgtaggccttaggctctgtcttgtctctccggtaggccttgggcggttccttgtatgccgaaggcggctctttggtcgacttagtccggctgcggtgggcct

SEQ ID NO: 662658 - DNA, 143 bp, Homo sapiens
ccatcgtccaccggcaagatgcttctaaacggactcagcagatgcgtagcattgctgcagtgggtaattgagaatagaaatgtgcccctggcaaatgcacacacccttcatgcttagcctcacgagaactggaataaggcctt

SEQ ID NO: 662659 - DNA, 236 bp, Homo sapiens
gaatgactaaatgagaaagttcagagtgatcagaggacctgctccagtgtttaccttcacgtgagtgtcagagctgacactcacaccctggtctgctgagcctggccgccgagcctgggactcccatgtttgcctcacccatactcttccaggtgcctggggcaactgctggggctctggcctaatggctgttcctgttatgagggtctgttggccggtgtgggtctcttggccag

SEQ ID NO: 662660 - DNA, 1066 bp, Homo sapiens
  misc_feature (53)..(53): n is a, c, g, or t
  misc_feature (90)..(90): n is a, c, g, or t
  misc_feature (95)..(95): n is a, c, g, or t
  misc_feature (103)..(103): n is a, c, g, or t
  misc_feature (133)..(133): n is a, c, g, or t
  misc_feature (145)..(145): n is a, c, g, or t
  misc_feature (149)..(149): n is a, c, g, or t
  misc_feature (169)..(169): n is a, c, g, or t
  misc_feature (171)..(171): n is a, c, g, or t
  misc_feature (191)..(191): n is a, c, g, or t
  misc_feature (194)..(194): n is a, c, g, or t
  misc_feature (244)..(244): n is a, c, g, or t
  misc_feature (279)..(280): n is a, c, g, or t
  misc_feature (310)..(310): n is a, c, g, or t
  misc_feature (315)..(316): n is a, c, g, or t
  misc_feature (327)..(327): n is a, c, g, or t
  misc_feature (329)..(329): n is a, c, g, or t
  misc_feature (335)..(335): n is a, c, g, or t
  misc_feature (372)..(372): n is a, c, g, or t
  misc_feature (384)..(384): n is a, c, g, or t
  misc_feature (492)..(492): n is a, c, g, or t
  misc_feature (506)..(506): n is a, c, g, or t
  misc_feature (747)..(747): n is a, c, g, or t
  misc_feature (766)..(766): n is a, c, g, or t
  misc_feature (807)..(807): n is a, c, g, or t
  misc_feature (850)..(850): n is a, c, g, or t
  misc_feature (861)..(861): n is a, c, g, or t
  misc_feature (873)..(873): n is a, c, g, or t
  misc_feature (883)..(883): n is a, c, g, or t
  misc_feature (937)..(937): n is a, c, g, or t
  misc_feature (960)..(960): n is a, c, g, or t
  misc_feature (993)..(993): n is a, c, g, or t
  misc_feature (995)..(995): n is a, c, g, or t
  misc_feature (1048)..(1048): n is a, c, g, or t
gggggtgagggtgatgagggtcaggtgtgaatccttgggcaggagaggggatntccagtgggatctgtgtccacacggggggcctcctangcctnaccggggntgggcacccgtcagttcttggtgcgagganctgcgcgtgggngggnacgcaccttgccatcgtgcncntcgcatgaccttggtgcggnttnggcggctgcgaggaggtcacatctctggatgactgcgatccagaggaggnctgggagtgagcgagatgtgggcgtcctcgccctnnagcaggcggcggtaggtggcgatctcctgntccanncgcgtcttcangnccagcnggatgttgtactcctggttctggctgctccatctcgnagcggagctggngccagctgctcctccacgcgtgccaagtcatctcctggatctgggccagctgcatgcagtagcgacctttggtctcctccaggctgttctccagggatgctttcatgntgagctgggggtgnagctcaatctccaggttctgcatggtgcgccggagctccgagatctcgctcttgccgctctgcaccatctcgctgttggtggctacctcgcggttcagctcctctgtcttggtgaagagccattcctcggcatccttgcggttcttctctgccatcttctcatactggtcacgcatctcgttcagaatgcggctcaggtccacgccaggtgcagcgtccatctccacattgacatctccanccacctggcctctcagggnattcatctcctcctcgtggttcttcttcaggtaggccagcncctccttcaggctctcaatctgcatctccaggtcagctctggncagggtcagtncgtccagcaccntgcgcaggcnattgatgtcggcttccacactcatgcgcaggttcaactctgtctcatacttggngcgggagtcatccgcggccagangggcattgtcaatctgcagaaggacattggcantntccactgtggctgtgagaatcttgttcctcagggcctcaatggtcttgaagtngggactgtagtctttgat

SEQ ID NO: 662661 - DNA, 624 bp, Homo sapiens
  misc_feature (163)..(163): n is a, c, g, or t
  misc_feature (168)..(168): n is a, c, g, or t
  misc_feature (179)..(181): n is a, c, g, or t
  misc_feature (192)..(192): n is a, c, g, or t
  misc_feature (198)..(198): n is a, c, g, or t
  misc_feature (205)..(205): n is a, c, g, or t
  misc_feature (217)..(217): n is a, c, g, or t
  misc_feature (236)..(236): n is a, c, g, or t
  misc_feature (292)..(292): n is a, c, g, or t
tatactacatgttcaggaactcagtgtgttcaccgagtccctatctaggcgattgttccactgcattcaaaccggcacgtcagaggccacagagcagctatttcataggacactgaatactatgattctgtgaactcgttatgaggtaacccaatgttatgtncacanacctttctcannntggtctcatanttctanaatgganggtccagctgtnacaaaatgaagacagacancacaacatttactctgtggagatatcctactcatactatgcacgtgctgtgatttngaacataactcgtcccaaaaacttgtcacgatcatcctgactttttaggttggctgatccatcaatcttgcactcaactgttacttctttcccagtgttgttaggagcaaagctgacctggacagcaaccaatggctgtagatacccaacatgcagttttttcccatcaatatgggcaaatattttaagtctatcattccattatgaggataaactagctacaatttggtatctcttcattctttgaaacacaatctatccttggcagtccttcaggctttaatccaattattctgtacatattcacaaggaatacaagggttaccttgaga

SEQ ID NO: 662662 - DNA, 153 bp, Homo sapiens
cagacaatgtggattggggacaaaggtcaggacagatccccttagaggacctgagtctgggagagtggtgagtggaagggaggagcagcaagaagcagcccgtattcactcagacttaattctccttcccagatcaggcaagccagtcatgga

SEQ ID NO: 662663 - DNA, 377 bp, Homo sapiens
tgggagagaggcctttgctttctgggccgccctcttctagtcagcagcttctagttgttggcccctgtgccttgcggtttgtaggtgccaggcatgtgaaaacggctggtttcagggatggcttttccctgccatcttcctctgttttcagtgaattttggaagatgacacttctagaagcgcctcttctttgccatcttagctcgaagtctggagcttctgcttgctggtgagattgaagcagacgctgaggtcctttcacccacctgcctgctttcctctctctcggattccattcctatccaaaactctgtctctatttaaagcagggtccgcaaatgactgcttttaaaaataaaattttatcagcataaaaa

SEQ ID NO: 662664 - DNA, 142 bp, Homo sapiens
gtcataactacctttctctagtatactttggaaacacggataaatcttcatcagtaaactttcatcataagcaaaacccattaaacgaacaatatctttgttatctacagcataaatatacatacacagtattctacagaat

SEQ ID NO: 662665 - DNA, 349 bp, Homo sapiens
cccaaatggggggggggggtgggcggtggggggttttttttacccaaccttgttttttttaccggccggtcgcgtgggggggcccccccccctgtttttttctccttttaaaacccgggggcgggtccggcccccggccttttgttttggccggggggggggtagcatttttcccccggaaacgcttattctcttttggcgttttttgggtgcccctttaataccggtttggtttaaaaagcggggggggggggggccggggttcccggggtgttgttgtcccccggggccgctttgcgggggggggcggggtttgggccccccccccccccccgggttcctttgttca

SEQ ID NO: 662666 - DNA, 336 bp, Homo sapiens
  misc_feature (25)..(25): n is a, c, g, or t
  misc_feature (34)..(34): n is a, c, g, or t
  misc_feature (75)..(75): n is a, c, g, or t
  misc_feature (79)..(79): n is a, c, g, or t
  misc_feature (195)..(195): n is a, c, g, or t
  misc_feature (239)..(239): n is a, c, g, or t
  misc_feature (251)..(251): n is a, c, g, or t
  misc_feature (264)..(264): n is a, c, g, or t
  misc_feature (327)..(327): n is a, c, g, or t
  misc_feature (332)..(332): n is a, c, g, or t
gtgcggagacaagtcgagcggcaanactacggcnagttcacgtgcgagggctgcaagagcttcttcaagcgcagngtcngcaggaacctgatctacacgtgccgcgccaaccggaactgtcccatcgaccagcaccatcgcaaccagtgccagtactgccgcctcaaaaagtgcctcaaagtgggcatgagacgngaagcggtgcagaggggcaggatgcgccgacccagccgacccanggtcagttcgcnctgaccaacgggnatcccctcaactgccactcgtacctgtccggatatatttccctgctgttgcgcgcggaccctnatgcncacg

SEQ ID NO: 662667 - DNA, 443 bp, Homo sapiens
atagacggatgtgatgagatattgtgaggtggggatcatatagggggaaatagaatgatcagtacgtgcggcgggtaggcctaggattgtgggggtaatgaatgaagcgaacagattttcgttcattttggttctcagggctttgttataatttattatttttattgggctttggtgcagggaggtaggggcttactagacagtgtgaaaacgtaggcttggattaaggcgacagcgcatttctaggcatagtccagtcagaattagcaattgtgcacagcatgatacagctgtagcagggcaaggttcaatgcgttgcatattgctcagggtggcgccttccaattaggtgcatgcagtaggtggcctgccagtaatgttagcggttaggcgtacggccagggctatcggttgaatgagtaggctgatggtttcgatagcca

SEQ ID NO: 662668 - DNA, 196 bp, Homo sapiens
atgcacaaggggaaggtgccgtgtaagcccaggcagacagagacctctgccggtggaagaccaacaccagcccgtgggctgccgcctgcctccccaccctccccatggcccacccatcatgggctgtctctgcagggcagaagccgtccagaacctgggatcacgggaagcctgctggcaatcgatccccaccccc

SEQ ID NO: 662669 - DNA, 414 bp, Homo sapiens
ccttatatgctgttcataaatgagataggtgttcaactttttgggaacacttcggtgtagaatcgtggttattaatttatttattgatgtaggtaaatgttgggtagaattcagcagtgaagctatcttgggtagagattttctttttgggatggtagaaggatttatgattacaacgttccggttctaataagagatacgtggttacctggttcctgggaaggcttgggaaagtttaatctttaaaggaaattgggccaatttcactctaaggttggcttaaacatgggttcacaggcattccctttaattctttccagtggtctattggaatctagtattggcggtcccccttcttgggttggtccatatgggggacggggaaagggggacaaggcatattccagggttacc

SEQ ID NO: 662670 - DNA, 603 bp, Homo sapiens
gttctaaagggaggagacaccaccgaatcctgggacttctgagattggttgtctcatttgccaaccctaccgaagcactagataatgtgctgaaatacctcccaaaaaaggatcgagaaaatgttaaggaacttctctgctgttccatggcaagaataccaaccagtcccaggtgaagcgtacaggacttctgtccagtgtggtacttatgtctgtccagatgccttgaatcttggtttaccagaatgggtattcagtggctttagctaaaggccagctatctcctttcatcagtggatgctttggtcctaaggacggaccagtcttccgcacacaggtggaaaacagtgcagcaatcaaatgcccatcatgaatatctcagttccattaggcgaatcatctatgggcttcttttacatgcctcatcacatctggacaaggacagtcctggaatgcattgtgctcctcgagcctgctaggctgttcacgtgaagctggaaaggattagtacccaatatcaagaacctcatatcattggtgctagttagaactggtcaagtgatcattctgacttaaggcaggattgacgtgacgcgtctcctt

SEQ ID NO: 662671 - DNA, 227 bp, Homo sapiens
  misc_feature (69)..(69): n is a, c, g, or t
  misc_feature (109)..(109): n is a, c, g, or t
  misc_feature (199)..(199): n is a, c, g, or t
  misc_feature (206)..(206): n is a, c, g, or t
cctgcctcattgtgcccaggagttctccaaacccgcgcatggaggtccttcctcgggaggcggcgaagnggtccaccctgcgcgtgatccttcatgcccggcccctgcncctccctccgggtggaacttccccctcaccgccagactttaagctgaggatcgttgtatctctggcggggtgcagaactgagcccaggcnacagtancctattcacgctctgtgcttg

SEQ ID NO: 662672 - DNA, 364 bp, Homo sapiens
atgcagcgaaaggggaaagtgcctgtcctaaaggcagaggaggtaaggtgtctccttgggggtgcccctacggactaccagggttgaacgcacaggcatggacacgtcgccctattgccaagcttttggcgcagctggtcgggtggccagactgcatgcggcttagcaggagacgtactgggctgtttgcgcaggacctctggaggccctcgagatcgtcgcaagtggaaaggtaaagcggaacaagggacaggctggagacgggggtcgcgtctaacatcaggataacttacaattcggttccaaagagcgcggtacgcgcagagctggggaaaggtgttggatccggcgccagtccttggac

SEQ ID NO: 662673 - DNA, 241 bp, Homo sapiens
aatttagatcttttatgatttaattattattgtttcccaaagaagttccccccctttgaaattaataaataatgtataaattttgccctgaaccatggcggagatgggcagcccctaggttaaagtggagacggaggcccaggcgcaggggtcacccctcatttggtttccttcccatctcacagcttagcttgtgcttttcaacaccaagtctttaagagcaataaaaactgccccctga

SEQ ID NO: 662674 - DNA, 351 bp, Homo sapiens
caaccagtcaggcgtgggggcgcgtgcctgcgatcgcaggcactcggcaggctgaggcaggaggggcgggcaggcaggttgcagtgagctgagatggcagcagtacagtccagcttcggctccgcatgagagggagaccgtggggagagggagagggagagggagagaggagaaccgctttaaccggggaggcggaggttgcagtgagccgagggttgtgccattgcactccagcctgggcaacgagagtgaaactccgtctcaaaaaaaaagaagaaaagttagaagccaggtgactgaatttcaaggaagtgtgcaaccccgaagacggatacaaccccgaacacgata

SEQ ID NO: 662675 - DNA, 1332 bp, Homo sapiens
tctccaagggtccatggaccacctactgagactctgggggggtcccagggagaggaacctagcatccccatcaccttccactctggttgaggcaagagaggtgggggaggcaactgagtggtcctgagctatctgtgggtccctcgaggagagagcgaggagacaggaagctccgagggtgccccggggggctgcttccagtcacacgtggccccatgagggtaccaggcagctggaggcaccactctgaagataattctggacagaactgacccagcagggacctcagtgcaggccctagacagtgctgaccactgacagcgccagccgaggtggagtggcacgatgagtccacctgcatcaggtgaccttgtgtcccacagacacctgacacaagtggctggtgacatgcttggaccgcaggcagtcacacgggtccgcatgcctactgtctgcactggcattatggcgagagagcaacaatgttgtacaaactagcttgggaacctccagagtgtcaactagctaacaccacggaactgaggaacagtccccatttaccaagtggtacgtcctgtgataacatatgccaacattattataccatcaaaacaacacatgtatgctgagacaggtgagggtagcacgaccacgcagttggcctgagttttgtcttgggcgcaggaattctaaggaagcatgcagattcaatcatatagccactgagtagagacctccagacccttccaccatcacacctagcacagggctaactcagtggagcataccaaatggtgggcatttgggaactaagctcggcacctaacgccatctcagtcatagtgagacacttcttggaatgactctgctatgtcgccttcacgctggccccatagtagacatatacggacgaaccacatgaggcaatgatcatagaacaagagaaacttccagatgcaagctacagcaacagtgctcggccacatacacatggcaccgacacctgagggaacagatgtacgtatgaatgagccgaacaaaatctaaagaatcgaacacagggcaacgcagtgagccggtactacgagaagaaggaccaggaggcaaagatgggcaagttgcaggacgtccggaacgggagtgagtgaggacacgtggtcatagcgtgtgatgttggctgcgagcaggaggtggaggtcacagtctggagcgtgccaccaggcgtgaccatctcttgcgcgtctggtgctgtcctcgaggcctcagcgggcgcggtcgggtcggtgcagaggcgcagcgagaagggacggacgggaaaatgaagcacaaaga

SEQ ID NO: 662676 - DNA, 470 bp, Homo sapiens
tacaggattacccggcatcgctaccgccggtccctgatgacacagcccaatggcctcacgccgtcctggcaagctgaacgccttctaatgcagacactcccagtctgggcgagggcccagagaatacccgctcccagctgctgataatggaccgggcagctgaccccgttgtccccactactgcatgagctcacgttccaggccatggcgtatgatctgctggacatatgagcaggacacataccggccatgatacaacacgggctgagcgaggcgcgggagaaggccgtcttgctggacgaggacgatgacttgtgggtggagcttcgccacatgcatatcgcagatgtgtccaagaaggtcacggagctcctgaggaccttctgtgagagcaagaggctgaccacggacaaggcgaacatcaaagacctatcccagatcctgtatcctgttggctggcgacacgggta

SEQ ID NO: 662677 - DNA, 119 bp, Homo sapiens
ctccctgctcacgaagccccctgtgggagcgccccagtagtgaagggcacgtggtgtgtgggaagccccattccccatgcgccggtgtgggtgaatgcgacccacgagggagcaaggtg

SEQ ID NO: 662678 - DNA, 663 bp, Homo sapiens
gctcggtctcctgtgtgtatgtgtgtgagtggtgggcaggccagtggtcagtggccgtgcccaggtccctgcatggattccttgtggctttatctgtactttggcctagtcttcatcacagtttctgttccttgtgggatgctagctctagggatactcagggggcgttcctgactctccgttctcccttcccgttcttgcgctcacttgattctccctagggcaggacctcgtgcgaggtcgccaacagcttctcctcagggccctgaaacttgggcgtgcttgccctgaggagctggtcctccggtgaggccctgtcaggcggtcttaggctcctgcacatgaaggtgtggttgcctgtaggttgtagtgggctggctgctaggagcagatacagggctgggtatacgacggatgcaggaaagggtagagggagtagtgtgttgaaagtccgagagttggcacatggctagggatactgctcactaggctgtggagtgtcctcaggagtggagagaatgatgtaggagggcgagaagcttaccatatttggtggctttcctaagaccctgtctgttgttgttatgctcctgccttgtccgagtcctgcagtgggctgcctgtactcctgaacctcatgagcctctaatggcaaagggaggc

SEQ ID NO: 662679 - DNA, 975 bp, Homo sapiens
tcatgcttgtatgtctgagataagaactgtctcaaggccagacgcggtggctcacacctgtaatcctagtaatttgggaggccgaggcgggcggatcacgaggtcaggagtttgagaccagcctggccaacgtggtgaaattcccgtctctactaaaaatacaaaaaaaaaaagaaaaaaaaactgggtgtggtggcgggcgcctgtaatcccagctactgaggaggctgaggcaggagaatcgctgtgaactcggaggaggttatagtgagccgagatcgtgccactgcactccagccttgggcgacagagcaagactccgtctcaaaaaaaaaaaaaaagaaagaaagacacggcctcagggattttaaaacattaacccaaaacaccccacaatttttttcccattcttctcaggcttttaagtggtttgcggcccaacttggcctcgtttggcacaattattgcagcaacatttccttatgacaagcgatttctttggcgtaagatatattctcttttaaacactgcagcacgcacagattaagaattaactggtcgaaagggacggttgggcccacgcaggaagggaccttccacacaattgaccgggacttccaattctggatttgggagcctgggaaacacaactcagctttgttctccaacacggttaatggtgaagcgtgcgctcctttaccagttaaatgctgcccccctagtttttccgtttcttcaagaccccgggggttggccatagcgggcacatcgggggttagtaagtcctctgggtcctcccaagagaaccccggatctgcggaacatccctcggggcggctttaggcttccaggccgccagaatattacggttgggggcatgcggcaggcccgcttcctggtttgaatgccaaactacagggggctggccaaagttccgcggaaacagcaacgaagtgcggacagcgagcaaatgcg

SEQ ID NO: 662680 - DNA, 124 bp, Homo sapiens
gacatccttcctctctcacgtttgtccccggtctttgtgacccctgcgtccataggtctttctccaaatctggtggtgactattgcattgtgtgtgtgttctagtgcatgtggctcagagtcta

SEQ ID NO: 662681 - DNA, 650 bp, Homo sapiens
gtctccaacccctactactggaagcacctcaaatcatgagtcttcatgttgacactctggttacaaaattcctgaacctcagctccagttactcaatggctgtccggattgctgctctgcagtgtatgcacgctctcactcgcctccccacttctgtgctactgccatacaaatctcaggtcatccgagccttagccaagcctctggacgacaagaagagacttgtgcgaaaggaagcagtgtcagcgaggggagaatggttcctacttgggagcccggggagctgagcccttggtcctggcctaaaccctcctgacaatctaacctgcaagtactaactattgagccatcccacaaggcaagactactggtctgccttcccatggatgcagtacaaatgctgggcctcctgcatggctgtgcaaaactcttaaagagccatgacttctaatggattgttgaagagactgagacttgtatttgaggaaaagaccttggatgttggggctctcccgtgtctgtcaggaataggaagctgtgctgctgaagggtcagtgcagtggagtgtgacctcgagaactggggttggctgtttacattgagtttcacctcgccagagaattaaagccttcttttgttaatggcgcacc

SEQ ID NO: 662682 - DNA, 310 bp, Homo sapiens
atgttttcacaaagtgttcaccattccatctgcccttgcatggtgagggctctcttcactgctagaatctaggctgaccctactctgtaatgatcacagggtgtgggattatcatcccctctcatgctgcacaaggtctcgagggtgtcgtcatagctggatcctggtctttctgcattgcactgcacagccccatggaacatgaggcacttgaggccttgcttcttggagcctctggggagcagagtaggtcactgccctctgggagtgttttgcagtagttttgtaaatgtgtcgcagtgtgcttccg

SEQ ID NO: 662683 - DNA, 925 bp, Homo sapiens
  misc_feature (253)..(253): n is a, c, g, or t
  misc_feature (814)..(814): n is a, c, g, or t
ggaggtattttatctgtaatgtttacctatgagctattttaaatgattcttcaaaatttagagtccagaaggtagaagaccatgtcctttctgaaaatgtcccttcctttcccaggtaccaggctctttttaaaattagcttctgaatatgaacaacccagctctttaaagtttaatgtcccagccattttaattgtttctttcgaagtacaaaagagcagctgggccacatcggcactaatcacttgccaantttcctttttacaaaaacagctaagctctttctgagatttaaaatcactccatctgagaccccagcttggcacctatctttgcactaacataaaaggaacctaatttctgcttttaagaaatgtgttgcggaagtgatttttggtttggggtttgttctccttcttctttttaaaaataacgtaataaagtgtaatacaacttttaaagttttttttttcctttaccagttctctattctccttttctacttgaattgtcctgagacaggttgccagataaaatacaggttgctcagcaaatgtgaatttcagagaaacaacagatactctcctagggcatggaccgtgcaatatttgaaacatacttgtattaaaaagttatttgttgtttatttgaaattcaaatttactggggccccatgctttagtttgccaaatctgccaaccatagcctgaatgcttcccgttcccaccatgagtttggcaaatggaaaatgctaacctatgcgatggacactgctgtattctgaaaatgaatatgtaaataaatcaaactaccntgacttgagagagctcattacgtgcgtgcatgcatgcccactggtccctgctaaataattcccttcttgcaatccagaaggataaatcaatgtaatttctggaattcaaaa

SEQ ID NO: 662684 - DNA, 303 bp, Homo sapiens
aaagggttcaccgcacgcttcataaccgcgcttttcataaaagacctgggctgaagccctggcattaagctcaatttctttgtatccgcgagcctgggctaaagtttttgcaaagcgcaccagcttgcggcccaagcccgccccctgagcttgtggtccgacagccatctgcctaagtttaatgagatcagacgtaagcggctttagcaaaacgcaactgacaatttctttgtcttcagcattaatagccacaatgtgaatctgtctttcctcaccggctatgtcttgagcgctcagtgtcag

SEQ ID NO: 662685 - DNA, 342 bp, Homo sapiens
gatagagcatccccggctaatatagagagacattggctcaaaaagaagttatacatttaccatgcgatacagccattctattcctatctcctcacaagaaaaggaaataggctgggcacagtgtctcacgactgtaatcccagtacttcgggaggctgaggtgtgtggatcatgaggtcaagagatcgagaccatcctggccaacacggtgaaaccctatctccactaaaaatacaaaaattagctgggcgtgatggtacgcacctgtaatcccagctactcaggaggctgaggcaggagaatgacttgaacccaggaggcagaggttgtagtgagccagga

SEQ ID NO: 662686 - DNA, 751 bp, Homo sapiens
ctgcatgggctgtaggcagccattgctgcccagccggaatggcatggtcttgaatgccccacttccacaatggactggcagactggctgcgtggccactgtggttcaaccagccgtgccctgtaagatcctgcatgactgtaatgtgccctggcaattgccaatggctgctgcctgctatctgcccctgtctgcccctgctgtctgtgtgtcctcatcctgtgcccagtctgtgctgcttgcccgcacgggttctgcgtaccagcactgaattgtgttgcgctgcctgggcctgcaggcttctagccttggatggatgctacagatggatggcctggaactttcacataaggaaagtgtgtgtccctgtgattccattccggcagttatcatgtagggatcctgaaggagtgctggaacaaagtccaacgggaagttccccttgcaaagggcccaacccggttgcatagcgggtttagacgggagatatacccgtatcaaaaaatactcgatcgctatcttccgccagtgagagcgcctcgagaaccacccaaggagaggggaggacatgattctgcctagaaaagaacttgaacactggcacacagccagctgagcactgggaccgggtcattgcccgtccgggaacgtctatacagaaaggagaaaaggctcgagtcatcacttgagggaaggcagaagaattttcaaaagcctttcggatagtctcccgtaatggcccgtgacaaccg

SEQ ID NO: 662687 - DNA, 114 bp, Homo sapiens
ttgaggatccctccaaagaggagggttgtctcatagatactaaattgtggtctagtgagcagcaaagggtttggttttgtatgtttctcctccccagaagaatgccactaaatg

SEQ ID NO: 662688 - DNA, 1029 bp, Homo sapiens
gcctgtttttttcctgcttggacgcgcatgagggccccgtccactggaccgcgcggccgttggcgatgggtgggcgcggttagcgagcgccagcgtgtgcgccctgtgttggcgtggggctggtgctggctcagtgtacagtattcaccttgtaacgacggaagacggggcggaaagaccaagatcagtcgagcagtgaacgattggactaatgccatatgaaatgatctacactcaaggatgttctgccgctatcactgctgaagagagtgactgccagagaattccagaaggagcttcagttcgatggtcaagaagccctatcacatgagttacgagacgaagacttcactctgctgggtcttactcagaaaggagagagctgtccaatagcgttcaggataatacaacggaccttgtgataatgaacacgtcagttacggagttctgagtattacagaggggcaaaacgtatgctccatagcagtgatccatgaattagtccacttgagccaatctgttaaagcatggggttcagcaggagtgaaattgtcgtaaacagagaagtttgatttggcaacctgagatgaggggacagaggaacatcatttagagcggccttgattgtgcgaacagcttggcaattccccctgtttagcttgtgacctggttcagccacagggaggtccaaagttcgagcccccgtataactaagttgggtcgtggcaaagtcgtggctcaattgaccttacgaaattcccaccatttggggctatttcgcctgtgtaggctttacccaggtccaaaaggatctgttttaagccccaaaaagaaggtcctagaaaaagcgtgtatgaaccatggtacacacttgtgggttggagggcaaggcagaacttcctagggaacccggttataattgggcttcttccgaaacaagccaataagcgtgaatcacatttgggacgccacatattttttcccctttttctggccaaatttaacaggtgcgtgcggcgaaatgccaga

SEQ ID NO: 662689 - DNA, 354 bp, Homo sapiens
acggacatgggctgtatcatgtatattatctttggttttcatgttggctgtgaagacaggtggatattattattattttttttttttagagacggggtcgaactactgtctcccatgctggagtgcaggggtatgctcatagcttactgcagcctcgaatccggggcacagacaattcttctgcctcagcctgctgagtaggcaggagccaggtgcacaccattgcacacagctaatggttagaatttggggtagagatggggtctcgcttagttgcccaggcgggtcttgaagtcctggcttcaagctatcctcccaccttggcctgtcaaagcactaggattataggtgtga

SEQ ID NO: 662690 - DNA, 298 bp, Homo sapiens
gagagagagagagagagagagagagagacagagaatgatgaggagatcattatataccataatgtgcgctactattgcataatatgagcaatagcccggcacttatatctaagacctctctgatgcactccattactttttatgaggtatcatgccacgagacggcctagagttctaacagaccttagcagctttagagccattacaacgtgccaggaactgctttgagtgaccaatagcagcccatattacttggacgtggtggacctttacacatgctcagagaccctcagcggcc

SEQ ID NO: 662691 - DNA, 1282 bp, Homo sapiens
taacatggtaaacaactcaaagggctttcttttaagtgctaggaaaacgtggtccaccttttcaacgggtgacggggcgtggttaacacaggtgtaagagcaaacaagggtaaaaaggtgaaagccacttacagattgtatgcacacaaatatttttacaaaatgtgcccagaaaatctccacgaggcactgtgttaagccaagtggtttctctttaagccagaaactttttgtgtggtccttataaaatagcacctaacaatatttggggtgatagggtgggagaaaagaacttcgagtatttctcacacaaattttataacttgtggaaacaccgaggcgtggtaatacaagccctccagcctccaatgtggttataattaaaagaattataacaagaggacacccacaactcggatcacttttgtgagacaacactcttatgagaaacacggaaagaggcctccacaaaagagacacacccacatatttttaatttatctctccatatccaccgagtgtgccccccaagaggagtagtgtccagccccacataaagggactctcccgagagagggggaaacaacacagagaaaccaaggggtccctggctatccccatcacttatatttggccatttcacccacacacgttttaatggggcccataccagagacgacaaaaacaaaaaattcctcccactctttccacgtgtggggctccccaaattggtgtcctcaactcctgggggtaaaaggcccactcttttattgagaaggatatgaggaagggggcgttcaacaacatttgggacagaaagcaaaaccgtggggctccaaagattcttggcgcattcaagagagaacaaccccccaaaatattcccctatacactccttttgggccccattctgggcgcgtgagaatgcgcaaatttttaaaactccccattttttataaaaacgcaacgcaaacctttttccccacgggggacaacaacatcttgttcaaacaacaaaccaatatttccgtggggggttactcttggaagccagaaaaaccacggcacctggcgggcaaaatgctgctagtataataaagagacacaagaaaacaattttcaagggggccccaagggtattttttttcccactctcacaagaaaacacaaacatacacttctggtctacaccaaattggtggtggtctccccttttgtacattattgcacaaacagctgatcaatatactcgcacattataagtatataaccccccaattaa

SEQ ID NO: 662692 - DNA, 398 bp, Homo sapiens
agaagctaacaaactgaaggtaatacagattgaggtaagtaggacagaaggacatttgatggtatgcttctctggtgtctctccccctcctctcttcctcaaagctctagcttttattggagatggctatggttctgatgaaggggactccattgtggtttcaggagcggtacaaactaatcagtggccatggtgattggatcagggttaagactgtgatctaatccagtaatagaaagtgaattttctgatttttcctaggaatcatgagggtcaaagttgtttgtattccttacgggtgattatcgtcccagctgaataaggacacataaagtccctcgttggaagaggagccagccttaaggaatacaaacgagggactttatgtgtccttcttc

SEQ ID NO: 662693 - DNA, 102 bp, Homo sapiens
gataagaattcaagctttgacattgtaaaccacagacgaattggatgcttggcattgaaaggaggtgttctgcaatgattttttttcttgtttagagaagtt

SEQ ID NO: 662694 - DNA, 420 bp, Homo sapiens
caagtgctactccattgtagcggtcaagtagtctcaggtcgacagtgtctaggactaatggcttcagtatgtagcagttacagatgagacctcggtagcaggtgcactcgtaggtacagtactactggtgaccgtttgatttgatgtgtaatcgcaggagtcgttaacatggtctgctatgtgtagtatgagtacggatcggaagtagatgaggtctaggatgatggcgccagggatagatcagaatgtttcgagttcttgagggtagacactgatagtataagttagttgtgttgtgagtgataggcatataccactacattccgaggaaccagatcagtaaggtcactatgagggtgtgatcatgtagggtcttaagtttggctatgatatcgcagtctgagtcaaggatctcgacat

SEQ ID NO: 662695 - DNA, 362 bp, Homo sapiens
cggcacgagggagatatacaagtagttaagaaaaaagtgtaccctattcctttaaaagccagggtaaatttaaaacctataattgataattgaaggtattctccataaccctataagactccaataccactttgttgtcagtgtaaacaagggcgtattctgaaagcactgaggccactgataacccgtagccttcctatcaaaaatccttaacccagtaacccgcagatggcccagatgcattcaatctgtagcggcaactgctttgctaacagaagaaagtaaaaaaataacttttagaggaaacctcattgtgaggaaacctcattgtgagcacacctcaccagttcagaagtatccta

SEQ ID NO: 662696 - DNA, 160 bp, Homo sapiens
gtttcccccccagagaaaaaggggttttttttgccctttttgccccccctaataaaggtcttggggttcccccggaaatgtagacttttttttatgggtccaaagtcccaggaaagggggggatgttttttatagccactaaaaattatttttgaactga

SEQ ID NO: 662697 - DNA, 109 bp, Homo sapiens
  misc_feature (79)..(79): n is a, c, g, or t
  misc_feature (100)..(100): n is a, c, g, or t
ggcgactacaataagtgccgggagcttgtgagaaggccattgaagtggggagagaacaccgagaagactatcgacagantgccaaagcatatgctcgaantggcaactc

SEQ ID NO: 662698 - DNA, 110 bp, Homo sapiens
cgtgaatatgtgcacaagtatttgtttgagtccctgatattcagtcagtttgggtgtatatacctaggagtggaattttatgggtcatatagttattctagtttactttt

SEQ ID NO: 662699 - DNA, 182 bp, Homo sapiens
cacatgaaaaaaaagcgactatgaaaggaccggatgacgatagacagtcaagtgctagctatggttagctatacaggtagcctgatatgcagatgacagagtgatgaactgctacctgtaatcttctgattgctcctggggaaaacacgccttgtcctgaagaacaaacggctgccattggg

SEQ ID NO: 662700 - DNA, 142 bp, Homo sapiens
ctgtaggaaagcggcttcgagaactgtgcagttggggtaggcttcctcaaaacgcttcttgatcttttctgactctgcatatttggagattccattgatgaagagggtccgcttcacgcagaccatcctccttgctagcgca

SEQ ID NO: 662701 - DNA, 180 bp, Homo sapiens
gagcgactcgccagatagaataacctatcatctacacacatttaggacttgctgggctcgtacatataggatgtcgtgtagtggcaaatcaccgttacgatttgaaacacttgtcgcgtctatcactaaataactgtccaaggttgaccaattcgggcgtggctaatgcattgaatcaat

SEQ ID NO: 662702 - DNA, 171 bp, Homo sapiens
tcacaagaatcgaagaagtaaagaaagcatagaataggaagaaagcacgagacaaagaagaacacacggaagcacaaatcttccaagtcaaatgagggttctgactcagagtgacaaggatgtgacttgttcaacattctcttctcaaacactgaccaaggaacagaggaa

SEQ ID NO: 662703 - DNA, 195 bp, Homo sapiens
tctatacttgttctctggttctgggtagaacgacttcttcctattgtgttctcagcttcttgaagatcagtataatgtcactaccctgtgttgatcttctagattgtcttgcctgtctagatcttgatcttcttagggattcagactcttcatccctaacaggtgtgaggtatgatctgcgtctctccctggatt

SEQ ID NO: 662704 - DNA, 801 bp, Homo sapiens
ggtaccggggctccatccatgacttcccaggctttgacacccaagcaggatgccagaggctctgtacaactgaccatgaatgggctattggtcagtgacaaggaggccatattggacataatcgacctcgacgtggagcaacagtgctagaggcaggaggtctgccagagtctacaagtccctctacggcaaggacctcattgctgatttcaagtatgaattggacgggcaagtttgaacggtagatatgtggagcctgaatgaaggccagctggcctattcgtgatgccaaagaaattaaagatgccatctcgggcattggcactgatgagaagtgcctcagtagagatcttggcttcccggaccaactgagcagatgcaccagctggtggcagcatacaaagatgcctacgagcgggaacctggaggctgacatcatacggcgacacctctggccacttccagaagatgcttgtggtcctgctccagggaaccagggaggaggatgacgtagtgagcgaggagctggtacaacaggatgtccagagacctatacgaggacaggggaactgaaatgggagaacagatgaagccaagcacagaatacatctgggaaatcgcagcaatcagcatctcaggatggagcgacgacgagtatctgaaaaaccacagggaagacagataggaagccagactccgacagggagctagctggggactctgagaagcaaaggaggacgtgaggaaagggataccagaacaacccggaataaaaagatgaaaggcacaacaagatatgaa

SEQ ID NO: 662705 - DNA, 325 bp, Homo sapiens
ccccatcaatgactgaatggataaacaaaaagttatacacacacacacacacacacacacacacacacgcaccaaggaattattatacaggcttaaaaatgaagtaaatgctgacacatgctacaacatggatgaaccttgaggatatcatgctagctgaaataaaccagtcacaaagaccatatattacatagttccattaatatgaaatgtctgaaataggcaaaaatctagagacagacattagattagggcttagggccctaatctatgagaggtgcttaggaccccaacctaagagagcttcttagagctgaaggagata

SEQ ID NO: 662706 - DNA, 181 bp, Homo sapiens
taatgccgtccgatgccatggagagatggctgcatctctcaaagattagtctgagccagcgcatctcttgtactgtgttcaatcagtagtccaggagagaagcttctgctacttcagagctttgataaactaacctaatttgtccaaatcaggttagtttagcaaagcgggtaccgagctc

SEQ ID NO: 662707 - DNA, 819 bp, Homo sapiens
cacggccagcagggtgtagcccgagagccacctgcagcccccagcccttgccaggaaagcagcagccgcagccatggcggggatgaagacaggctccggggactacatcgagctcgtcatgggagctgcgggtgttgtgggagaggaggacccagaggccgagtcggtcacgcctgcgggtcactggggagtcgcacatcggcggggtgctccgtgaagattgtggagcagatcaatcgccaagccaggactggtcagaccatgctatttggtggggaacatgaagaggcagtggctgctgcagtacgccacttgggaacaacttggggcccagttcacgggtatctgtggcggatcgcacgctctcttctttgggccccagccatcggcccgtcatccttcggttgccgcgaaccgtccgcgcactgagcctccgtgccagcttcctcccaggcccctcttccaggctgtggctgccattctgcgcgccgtcctcagtcgatccggcaagccaccgatggagctgtccctgctccgggctcctgagaagaagggagaagaatgaagaaaggagaaggagccaggaggaagagcgtcgtatgactgtgagcagggttgtcttggctggtgggcgtggctggctgcactgttccgggggatgtcctagctcacttctcgtgacagcgcccaggactgagggctgtagcgcatgctgagccgggcccagcggcaccgatcccctctgctccagcgtctgcgcggccagtccctgtcgactgaccggtcacagcggtggtggatcgtcggggggttctgggg

SEQ ID NO: 662708 - DNA, 1145 bp, Homo sapiens
tggttagttgctgttggttaaagcttgtccctggacgctattgagctattcgtctggatgaagcgcggttgcagacagtcgtgaatacacgggtgctgccaaggatacggtgcagcacaagtgtaatatgagatctccctggattacatgagtgcgttacgaacaaaggtgcatactgttcttagagctgaaacgcggaactggaccttaattgttaagcaacgggagaaccagatattcttggacccatctgtttgttagtttctgtctttaaggacagccttatgtgtggtgatacataggcacttctgatagctgtgaaggttcttttgagaaagtgagaagtatatgtgctcattgtgttaagtatataatattggttttgtatacttatcactcgtaattttgagtactagtttgtttataaaacatgtgtataaatatatctgtcttagagaccgatttatcgttggtagtgaatttcatagagggctgggtttgggtaggaatagcacgagtcactttcagaggcgaaaggggagtcattcagaagtgatagcattttatttgtctgaatactctgccagtttaatcagctgtacgtagaaagttatctcgttgtgtagaactaatgatgtagagtttacgtaactcagtgcaggatgtcttgcttctctctattttctgcaaactctgcctcacatcttaaaatgcattatcaacaatacctaatctcaaagataactctttggctctgaaacgcttaccttatttttatgttgagttagtgacttcattgtctcttgccacaatataagcttttgagggatttttataaattggtcgcttttaataagcaaataaatcccagggttttatattcttcagtgatacccctatagacactcttaaatgtatgtgcgcatatatatatatatattgtcttaagcatgctcgatgcattttcgtcctgagaaaaatgttctctacgagaaactacccggctgtgtaaaaagaagattggcttaaaatggctactgtgatgggaacagtgtcttagggagatgcacccttggacttcgaggtaaacttgaatactttacaactgtggtttagagtttgctttaatgacattgtattacacc

SEQ ID NO: 662709 - DNA, 655 bp, Homo sapiens
caaaacaaggaaagattgcgctccaaccccaaaatgtgttggtttttcttttcaatgaataacctctttctattaataaaaatgcgaacataaaaaggtaggattctcccagctttgttttgtgcagaatttgatttatccttctcttatgaagcttagttagctggaataataaattctgggttaaaaatattttctttaacaatgttaaatattggctctcactatatctgacgttcacagtttctgctcagagagccactgtagtctgatcggtcttcactttgtgggtaagccgacctttctctatggctgcccttaacattttttccttcatttcactgttagtgaatctgatagttatgtatcttgtagttgctcatctcaaggagcatctctgtggcggtctctgaatttcctgaatttgaatgttggcatgccatgctagattgagtacgttctccagaataatattctgcacagtgttttccactatctgttccattctcgccgtcactttcactgtacaccaatcagatgtagatttggtcttttcacatagtaccatatttcttgtagacggcgttcgttccgatggaatctatgtcatgtgaacttctcttctccttcatttcactcgttagatcctccatcg

SEQ ID NO: 662710 - DNA, 364 bp, Homo sapiens
aagatccatccatttattccttcagccaacattttctgggattccttgggtgctaggcctcgggccaccatttggagatgcagagaggcgggagacccatgtggcctttgaggggctttcaggctcgtgggggttcaggcacagacaccaccaatctgaaccaggggactgcaggatgctgggttaggggagagagggataggctggctggcctaggggggccataggaagtctttgggggaaaggagagaactcctgaaagttaaggtgatgccctggcctatatcacattactagtggaggggaagggttgtttacgaactactgttaatcactttgatcagaaacgtggtttcttcacagg

SEQ ID NO: 662711 - DNA, 446 bp, Homo sapiens
ctttgatccatgggtaaggagaaattaaaccggctggatgactcagataagggcaattaacttagcccatttcccaccatcataaatgggtgcaaacaaacccaggagcctcccatggacttccaccagagctaaggagaaaagcactcccttctgtaagatactgagtgttgcggacgattgttattacactacagccatccctctcaatacatgaacaaagctttcgagggaagcatcacggaggcaagacgatccccagtaatacctaaagctaaggaaggaatatccctagacttttcagttagcagaataagtcttacttttttttttttttttttttttttttttttttttggaaaagggattccccctctgccccccgggttaaagtgaagggccccaaccccgccccacggaaccccccgtcccccgggttccccccc

SEQ ID NO: 662712 - DNA, 646 bp, Homo sapiens
cgctccagctctcggggtcggctccaggaggcgccctcaggagaggggcgggcgctctattccatgagacctgcgtggcatgtgcggccactgtggcggggctctttccccgtttcgcctcagctacccctcagctcctggtagtctgccatgtcctggggtctgtctgccgtttggtggctgggatgctgctcggccccgccgccgtccccgtcgccgcttccgtggtccagtgcccctcgtggcctgctctgcctgcctgtcattgagtgcttctgtggtgcgtgcttctgaatgctggacctggccagctggatgtgtgccctgagactggatgcctgatgctggggcattttgcgctcgcacctgaggcagtccctgctgtgcacctgggggtacagttctaatacccgatttacaagttacattgaactacaaggatcccctcactggagatgaagagaccttggcttcatatgggattgtactggggacttgatatgtttgattcttcacagatgacattccagcgcctaatataccttacatccacagattcagagcatacttcactccaagaataatgagcaagcctctttggccacatgctccaatcagactagcattgcaggatgaacaacaagtg

SEQ ID NO: 662713 - DNA, 882 bp, Homo sapiens
cctccagacgttacctacaccatacgttcatgactgggtgaacccacccttttagttcagcctgtgcataacttcctccaactggatctttcacctgactcgtgacttgtatactgtccaatgaaaaatgcccgggtaaccagagctctactgtgtaaattctagattgagttcttgtgtcgagtcatcagtggtttgtatctatagggtcgtctattaagtattgctctgtcagtttgtactgcagatcgaggatttcattgcacttttaatttaacttaaaaatgccttcccttgatgttgatatgtatttttgtgaagtgtgtgttgaagccttgagattatttttaaattagaggtttatcataggtatatctcctaatgctatccctcccccctccccctaaatgatgagttaatggtgcagcacaccaacatggcacatgtatacatatgtaacaaactgcacgttgtgcacatggtaccctaaaacttaaagtatacttaacaaacacacattcgaggtttcttcgggtgcctttctgagagttcaccaggaattcttgcaacttatttctattctgtaacctacctttcattaccttagcagtggttaaaagccttaagttggatcacattccaaattacttcccattttaacaagtaatgcttaattggttccagacaaggtctttacttcggtcacccaggctgcgtgccgtgccagcctgtccccgcaggtctcgcccccagtcaagtgatctccactccaattttaagccaaaggggcattgcgcaaacacgcacctggattggagctctcccaaacacatctgcggccccttccaatcgacggggtcgcccagccttgccccccggacc

SEQ ID NO: 662714 - DNA, 240 bp, Homo sapiens
tctgacagcttcctgatacacagtatagaatacctattatccccaggattacaaaattcctctaggctgggcactggtggctctcgcctgtaatcccaacactttgggaggcagaggcaggctgatcgcctgacgccagtgagttcgataccagcccggccaacatcgcgaatcacccggctctaccaaaattacaaaaatcagccaggtgtggtggcaggagcctgtcatcccagctac

SEQ ID NO: 662715 - DNA, 893 bp, Homo sapiens
ggacgtggttcctgacagtcaagatgtgcgtggagcagctacccaggcttccctggagtcggcccacggatcatgcggtggtggctgaatgcagccgctccaggcccgggcaggcgagctgttgggctgcctgcatgggacagtggccactcctgtgttcattgccagtgggcactgcaggccaccatgaatgggcatcactgacccgaacagttggacgctctgggtttgcctgatctgcctgtggcaatacctaccatctgggtctaatgtgccgtggaaccgagctgatccagaaagccaatggtctccactggcttcatgaattggcctcataatcttgctaactggacaagctggggtattacccagattggtgtcgctaggtgtctctgtcccgaggtgacgagacggagggctgtccgcttccgatacacgcctacgacggcaatgagaccctgttgagcccggagaaatccgtgcaggatccagaatgcagctggggatcggacatcatcatgcaagatggacgaagtggattagcagtacttgtgatgggacacgtgtgcacggaggccctgtacaaggtcaactcccgagtgggttggacagggatgtaattgcaagactcattaagcaggcaggacaagagcgagacactattggacattattccaggggtggagattgaagaagaatttacggggcaacatgctttgaggatgatggactaaggagagtgcttggtattgcaatgtgggcataaaggggtaaagaaagtagatatgcggattgtgaaatgggaataatggtgcagaagaaaaacccaatatatggaggtagaagcaagattgaaaagggagtagggataaagaatgataaaagagaagtta

SEQ ID NO: 662716 - DNA, 151 bp, Homo sapiens
aggtagaggatccattaggcaggacgatttgtcagatggtgagggccagaggtggcaaagagctaagggccaggccgacctgccccgagaagctgctggatcgaactcctcccggggacctatacccggacgtcgctgaggcagagggata

SEQ ID NO: 662717 - DNA, 245 bp, Homo sapiens
  misc_feature (34)..(34): n is a, c, g, or t
  misc_feature (36)..(36): n is a, c, g, or t
  misc_feature (139)..(140): n is a, c, g, or t
  misc_feature (190)..(190): n is a, c, g, or t
tttcgtcattaaggtttgactattaatatggtgncngtaccaatattaccatactgggtggaagtaatggggtgcgtggtgagttaaccaatcgttgtgggcattatctttccgttgagggataacagaaagacggtanncccagttccatcactattagcattaagcatggtcgttagggtgtctacgnttgtaattagtagtcccttatttgtagcgctaccgggaacaggccacacaccgac

SEQ ID NO: 662718 - DNA, 436 bp, Homo sapiens
  misc_feature (17)..(17): n is a, c, g, or t
  misc_feature (119)..(119): n is a, c, g, or t
  misc_feature (159)..(159): n is a, c, g, or t
  misc_feature (249)..(249): n is a, c, g, or t
  misc_feature (254)..(254): n is a, c, g, or t
  misc_feature (262)..(262): n is a, c, g, or t
  misc_feature (270)..(270): n is a, c, g, or t
  misc_feature (362)..(362): n is a, c, g, or t
  misc_feature (364)..(364): n is a, c, g, or t
  misc_feature (428)..(428): n is a, c, g, or t
ggacgtccgagagaaantgagacacgccggttgtgaaacctactgaagtgagaagcgctcaggattcctgggaccccgacctctttgcagctcgcacagctaagggcgagggcgcttcnggcagaagcagcaaaccgccggcaagcccagcgaggaggnctgccgggtctgggcttgggaattggctggcacccagcggaaagggacgtgagctgagcgccgggggagaagagtgcacaggtcagagancggcnacagctcncagcaganggtccccacgccgggcgatattggggtgcctgctgtttctgctgctctgggcgctcctccaggcttggggaagcgctgaagtccccgcaaangnttttccccctccgcttgcctccagatcttcgtcctttcgccaatagcagcttggacgcgcaacngacggctt

SEQ ID NO: 662719 - DNA, 317 bp, Homo sapiens
tgggtttttggggtaaaaacccgggttttttttttaaacgggaatggatttacattgattttaaaaaaaccctggttacattagggccccccaaagcaaatttacatccacccttcaattggggaaaaacaaagttttttttgggccccaacccaaaaaaaaacttctttggggttttttttaaagagccttcccctggccctaaaaaaaaggaaaaaaggccggccctttaaaagggaaagcgtggaaggttccaaaagggcgcaaaccccaaaaccccggaggcgaaaactttttttttttttttaaaaaaaagg

SEQ ID NO: 662720 - DNA, 183 bp, Homo sapiens
gattggatatagaatttgtgacgaacaggcgatatgcactggtcttgggcaacataccttgttgtacaactttagcatcgggactgctgtaaggggtaaaagctaaatgtgagtttctcctgctctgtccatttcctattaactaatgacaacttgagaaggctgggaggattgtgtatttgg

SEQ ID NO: 662721 - DNA, 536 bp, Homo sapiens
cttcatatcatgatttctctcaccctcccaatctggacccctctcccgaattctccatcttagttcataacatcactgttaacccagtcatccatgttaggacaatttcaattcatttataatccatgaaaccatgaaaaattgtcttctaaaaaccttaaagagagcacttcacactctcaaataaagacctccattgcccaactacttaactatcagccgaagacccccttctttgtcttcagcatgaagcaccaggcctaatcggactctgacccacttctggcagatcaccgcctcccacatccccaggctaccctatgcttgagccccactggactattcacagtggagattctttcacatttctagccttgcatatgctgctgctgccacctacagcagtgactctcaacaggggacaattttgcccctaggggacatctggcaatgtctggggacactttttgattgtcacactgggagaaaggggtgttactagcatttagtgggtggaggccaggcatggggtaccg

SEQ ID NO: 662722 - DNA, 405 bp, Homo sapiens
tatggaggtgacatgcaagttaacaataattaataaaaaatcttggcatttggttgctgaggctctttgagagctaaatatactgcctatatattatacttaataagacagcagttgttaggaagtgtttgcagtcagaatttaaacttgtttctaatcatactaagcatttaaaatattattttatttgaaggcgctgtgtgctatcttgaacatcagctttttagtataatttagatatccaagtttaactgaggttagttgctaagtgtaaaacattcaagtaattcatgttttggggttaggcatttgggcaaatgataaataacagacatgttctaaagtgccaagagacttcacttaatagtcctgagcataattagcaaaatgtacataggattaaca

SEQ ID NO: 662723 - DNA, 359 bp, Homo sapiens
  misc_feature (31)..(31): n is a, c, g, or t
  misc_feature (101)..(101): n is a, c, g, or t
  misc_feature (264)..(264): n is a, c, g, or t
  misc_feature (305)..(305): n is a, c, g, or t
caataaattgtaggtcattgatgccgatagntcacaactgaaagactccaaacatcgaggaaaacatgctgagccaaaacgcctggcaggcgtggctcgtntcaccacgatgaacaccaggagacagaatgtccgttgaggccatgcaatccatcgagatggacgaggaaaacagcgccagccagacagtttgcgcttgttacagcttcttctcgtggtcaggatgctgcgtagtctcccaagcggtggaagcatcttatcgtntgagacgccgtcgactacctgtcccccgtggtacgcacacnccccgtcctggacagtcccgatcaatgaccaacaatttattggggtaccgagct

SEQ ID NO: 662724 - DNA, 112 bp, Homo sapiens
cagcagctagatattacggtgttagagaaatgaatgagcctacagatgattagatgttccatgtggtgtttgcatcgtggtagtccgattaacgtctcgggcattccggcat

SEQ ID NO: 662725 - DNA, 151 bp, Homo sapiens
  misc_feature (2)..(2): n is a, c, g, or t
antagacattcttaaaggtgcacacagactttcaactgcactagtgtcccagttcagagtgaggtctccacagttaactaggtcaaacctgaccgcagattcttgtgaggacatcatgggaaaacaggggtgaatgtggcttgttgtgagg

SEQ ID NO: 662726 - DNA, 107 bp, Homo sapiens
cttctacgacgtcggcgtcgtccattcgcccaagcgcgatggactgaccaagctggtgcgaatcgagggcgccaacctcgatcgcatcaagcgttcgaacatcaagg

SEQ ID NO: 662727 - DNA, 3173 bp, Homo sapiens
  misc_feature (1435)..(1435): n is a, c, g, or t
  misc_feature (1515)..(1515): n is a, c, g, or t
  misc_feature (3066)..(3066): n is a, c, g, or t
aattcggcacgaggccacagtggttatctccaagctcagggcaatcccttccctcctgtcaactgctccccgactcctgcatggctcattccttcacaatgtcgccgtggctgccaggttcctcaggcagccccggtgggaggctgcggaccatggggactcagctctgcatggcaggcaaaggcccagggacactgacgtgcatgagcttgctgctttccagggtgtgttgagggtggccatgggtgacacgtcccactctttctgatggaggggcatccgtggtgccttctagcttagaaccattttccaggtctcttctgggttgggcaggactgatattcccaagctggtggaagatggttcatcttcctcgcacagtgtgggttcttggagttcatccagggaaggcggcgcctctttctcaggtcctgcaggctggtctctgagcctgcccccacgaactttctggattccaaggtgggatggtgatccctttgacccctgcagaccctctacttgcgaaaagcagcattgaagcagccttttcccattgtagaagggacagggagtcagatcccctcaaccccccggcttcagggaccccagaagtgccttccaagcttcccccaagatccacatcacccacgaccctgccactgtttttgctgtgttcaccacatctctgatcctgaagtgaattctggaactatggaccacattagactgggcagagattcgcccaacccctagcactccggctctgggctttcggccagaagttaattaacctcagagccaggagcctggggctggggcctccctcccaggccctgtttagctgtttagctggttgtgttttaagcaagttcttgcccaatcatgcatcctgctagaaaaggaaatgaagcaacgttcccagccaccgcaggcagttgtcggcgactttctgatgtaagcacctgggctccgacttgaggggggcccttcaagacccaatgtccatttcccaatccttgtcatcggcagggcccagggatgtgacaatttttgctaatggaggagtcacttctttttttttttttctttttgagatggtctggctctgtcacccaggctggagtgcagtggtgcaatcatagctcaccacagcctcaaactaggggtcacttctaagggatgctgggggttgggcggaaggggtgaggaggtaggattgagtaacttgctgtcactgcttgtactttgtagacagcctgagagtggcaggaccttatgtgaatggggggatggactgtgatcagtgccggggagtctctgaagctggggtccccacctccaggggcttctgctcagaggttacgtgtgcagtttgaagatgtacatcttgacctccggtttagaggcactttctgcccatcagattccaaactcnaggggcgcagcaccttttctttgctcccaaacaccaaccaacaccccttcacaggaccagcactgttaggatggctaagnggatgttttatgttcccacgtccctgatctgtttcagaggttgtgtctgctctcccagcccctgaagccaaaatgacttcctgcagctttcatgagctcagcctttccctggggtatgtgtgagggggaaagcctggttcaagtttagatttatttctagggagccctggtttcttcataccagaggctacccttagaactttggagtggggtatctttttttcatttgtttttttgatacagagtctcgctctattgcccaggctggagtgcggtggcacaatctcagcttactgcaacctccacctccagggttcaagcgattctcctgcctcagcctcccgagtagctggcattacaggcacctgccaccacacccggctaaattttgtatttttagtagagaaggggtttcaccatgttggtgaggcttgtctcaaactgacttcaagtgatccacttgcttcggcctcccaaagtgctgggattacaggcgtgagccatcacgcccagccgagggtatcttttataccaacaaattagatgactgaggtgtaatggacaaatcctatgcacaaagtgagggtatctgaatatgtgggcgggagtcaaaaatttttagctactttaacactaaagtcaaactaaagtagcttcaaaaagacttctcaagatgcagtatggcctgctgaggtttttttgttttttttttttttaagacagagagtcgctcgtcgcccaggccgcagtgcagtagcatgatctcagctcactgcaacctccacctcccgggttcaagcgattctcctgtctcagcctcctaagtagctgggactacaggcacctgccaccacgcccatctaagttttgcatttttagtagcgacggtttcaccttgttggccaggctggttttgttggccaattgtctctaaactgctgtcaaaaaaaggaatggatcagattgtcttgaatagggcagagctaacctgtaatcacctgtgtgatgagaaacagctttgactgcattttactcctgacctggcctaagctttctgtttacataagatttttcaagaattcaacttcaagtagcagccgagagagctgcctcaggattctctcaaaaactgggaataatatgggaacatttgtttcttctaaaaataaggcaaatgttacattgaatgatttggggggtgaggtttaattggaaatggtctctggggactgaaaactgatgtttttgcagattacctcagggaaacggaggtttgttgagtttacagacacattaaaccaaaggccgtgggaaaacccctctccagctccaggggattggtcaggaccacccactaaccagtgccttccttcttaacattcacttttagcagcttgtgtttattttacatgggcagttttgatgggaaattgccatgaccacaggggtttggagttctgctttttttttcttcttctttttcgggggactgggggactcctcccaagatcacattttagcatctttctctcctactccatttagaaaaanaagtaacaggtgaaatgtggtctcagtgttaacgggataattctgctaccggctcctccctgatgattctgaaatacactactgaacgagctctggctggtcctttc

SEQ ID NO: 662728 - DNA, 3293 bp, Homo sapiens
  misc_feature (1435)..(1435): n is a, c, g, or t
  misc_feature (1515)..(1515): n is a, c, g, or t
  misc_feature (3066)..(3066): n is a, c, g, or t
aattcggcacgaggccacagtggttatctccaagctcagggcaatcccttccctcctgtcaactgctccccgactcctgcatggctcattccttcacaatgtcgccgtggctgccaggttcctcaggcagccccggtgggaggctgcggaccatggggactcagctctgcatggcaggcaaaggcccagggacactgacgtgcatgagcttgctgctttccagggtgtgttgagggtggccatgggtgacacgtcccactctttctgatggaggggcatccgtggtgccttctagcttagaaccattttccaggtctcttctgggttgggcaggactgatattcccaagctggtggaagatggttcatcttcctcgcacagtgtgggttcttggagttcatccagggaaggcggcgcctctttctcaggtcctgcaggctggtctctgagcctgcccccacgaactttctggattccaaggtgggatggtgatccctttgacccctgcagaccctctacttgcgaaaagcagcattgaagcagccttttcccattgtagaagggacagggagtcagatcccctcaaccccccggcttcagggaccccagaagtgccttccaagcttcccccaagatccacatcacccacgaccctgccactgtttttgctgtgttcaccacatctctgatcctgaagtgaattctggaactatggaccacattagactgggcagagattcgcccaacccctagcactccggctctgggctttcggccagaagttaattaacctcagagccaggagcctggggctggggcctccctcccaggccctgtttagctgtttagctggttgtgttttaagcaagttcttgcccaatcatgcatcctgctagaaaaggaaatgaagcaacgttcccagccaccgcaggcagttgtcggcgactttctgatgtaagcacctgggctccgacttgaggggggcccttcaagacccaatgtccatttcccaatccttgtcatcggcagggcccagggatgtgacaatttttgctaatggaggagtcacttctttttttttttttctttttgagatggtctggctctgtcacccaggctggagtgcagtggtgcaatcatagctcaccacagcctcaaactaggggtcacttctaagggatgctgggggttgggcggaaggggtgaggaggtaggattgagtaacttgctgtcactgcttgtactttgtagacagcctgagagtggcaggaccttatgtgaatggggggatggactgtgatcagtgccggggagtctctgaagctggggtccccacctccaggggcttctgctcagaggttacgtgtgcagtttgaagatgtacatcttgacctccggtttagaggcactttctgcccatcagattccaaactcnaggggcgcagcaccttttctttgctcccaaacaccaaccaacaccccttcacaggaccagcactgttaggatggctaagnggatgttttatgttcccacgtccctgatctgtttcagaggttgtgtctgctctcccagcccctgaagccaaaatgacttcctgcagctttcatgagctcagcctttccctggggtatgtgtgagggggaaagcctggttcaagtttagatttatttctagggagccctggtttcttcataccagaggctacccttagaactttggagtggggtatctttttttcatttgtttttttgatacagagtctcgctctattgcccaggctggagtgcggtggcacaatctcagcttactgcaacctccacctccagggttcaagcgattctcctgcctcagcctcccgagtagctggcattacaggcacctgccaccacacccggctaaattttgtatttttagtagagaaggggtttcaccatgttggtgaggcttgtctcaaactgacttcaagtgatccacttgcttcggcctcccaaagtgctgggattacaggcgtgagccatcacgcccagccgagggtatcttttataccaacaaattagatgactgaggtgtaatggacaaatcctatgcacaaagtgagggtatctgaatatgtgggcgggagtcaaaaatttttagctactttaacactaaagtcaaactaaagtagcttcaaaaagacttctcaagatgcagtatggcctgctgaggtttttttgttttttttttttttaagacagagagtcgctcgtcgcccaggccgcagtgcagtagcatgatctcagctcactgcaacctccacctcccgggttcaagcgattctcctgtctcagcctcctaagtagctgggactacaggcacctgccaccacgcccatctaagttttgcatttttagtagcgacggtttcaccttgttggccaggctggttttgttggccaattgtctctaaactgctgtcaaaaaaaggaatggatcagattgtcttgaatagggcagagctaacctgtaatcacctgtgtgatgagaaacagctttgactgcattttactcctgacctggcctaagctttctgtttacataagatttttcaagaattcaacttcaagtagcagccgagagagctgcctcaggattctctcaaaaactgggaataatatgggaacatttgtttcttctaaaaataaggcaaatgttacattgaatgatttggggggtgaggtttaattggaaatggtctctggggactgaaaactgatgtttttgcagattacctcagggaaacggaggtttgttgagtttacagacacattaaaccaaaggccgtgggaaaacccctctccagctccaggggattggtcaggaccacccactaaccagtgccttccttcttaacattcacttttagcagcttgtgtttattttacatgggcagttttgatgggaaattgccatgaccacaggggtttggagttctgctttttttttcttcttctttttcgggggactgggggactcctcccaagatcacattttagcatctttctctcctactccatttagaaaaanaagtaacaggtgaaatgtggtctcagtgttaacgggataattctgctaccggctcctccctgatgattctgaaatacactactgaacgagctctggctggtcctttctatcctggatgtggttcttctgtgtagcaattccttgatgtccagtttggaaagatgtactcttctcaacaagaaaaacttaaatccgtcgtgcccaaatatagttgtgcttttatttcc

SEQ ID NO: 662729 - DNA, 1094 bp, Homo sapiens
aattcggcacgaggccacagtggttatctccaagctcagggcaatcccttccctcctgtcaactgctccccgactcctgcatggctcattccttcacaatgtcgccgtggctgccaggttcctcaggcagccccggtgggaggctgcggaccatggggactcagctctgcatggcaggcaaaggcccagggacactgacgtgcatgagcttgctgctttccagggtgtgttgagggtggccatgggtgacacgtcccactctttctgatggaggggcatccgtggtgccttctagcttagaaccattttccaggtctcttctgggttgggcaggactgatattcccaagctggtggaagatggttcatcttcctcgcacagtgtgggttcttggagttcatccagggaaggcggcgcctctttctcaggtcctgcaggctggtctctgagcctgcccccacgaactttctggattccaaggtgggatggtgatccctttgacccctgcagaccctctacttgcgaaaagcagcattgaagcagccttttcccattgtagaagggacagggagtcagatcccctcaaccccccggcttcagggaccccagaagtgccttccaagcttcccccaagatccacatcacccacgaccctgccactgtttttgctgtgttcaccacatctctgatcctgaagtgaattctggaactatggaccacattagactgggcagagattcgcccaacccctagcactccggctctgggctttcggccagaagttaattaacctcagagccaggagcctggggctggggcctccctcccaggccctgtttagctgtttagctggttgtgttttaagcaagttcttgcccaatcatgcatcctgctagaaaaggaaatgaagcaacgttcccagccaccgcaaaaaaaaaacaaaaaactaaaaaaaccaaaaaacacaaaaaacaagaaaaaaaaacaacaccaaaacaacaaaaaaagaaagaaaacaaacaagaaagcaaaaaaaaagccaacaaaacataaacaaacaggagggcgtccgtgcctattaaatatcttacccg

SEQ ID NO: 662730 - DNA, 169 bp, Homo sapiens
gcagcggtacggttcgcatgttcccaggctgacgtgcaatggctcgcttggtcacctgaactctgtctcctggttcaagtgagtctcctgcctcaggctcccaagtagctgggattacaggcatgtgccacacacccagctaatttttttgtatttttattagagacgg

SEQ ID NO: 662731 - DNA, 590 bp, Homo sapiens
gtggatgatcgcgagcgccggaggtggtccattatcgcatgagcatgcaaaatctgatagaaagatcgcgagaaggcagtgggacgcctggaggcagtactctcatacctctgacatgcaccgctgggtatgcacgacgagtcctatcaaaagcaggagtagctccatatgatgcaggcactatgactcgctgcttgctggtcctgtggcagagtacttgacgatcagtaaacgagattgggggagacgtgcagaaacatgcggagatggtccacacaggtttgaagttggagcgagctctgttggatacagcttctcagtgtcaacagccagcagaaaataagctttccgagtatgttggcacccatctcagagcagatcaaaagaagtgataacctttcgggacgaagaaccgaggacagcaagttgtataatcacctgtcagctgtcagagaaacgtatccaggccctgggctgggatggctatggctcccaaggactgggccttatgtgaaagacatgaatgatggcagccatgttttatacaaaccagaggtcctcaaagaggtacaaaagatgtggataagaag

SEQ ID NO: 662732 - DNA, 415 bp, Homo sapiens
ctgtttgggtcttggaagcttcctctcatgtgtcactcagtgctcaattcacatacaacttgattggcacagcattgtccgaatcggtgcctaagttcattaaccttgtcaggtccgtgtctctccagatcatcccgtgtgtcaacgatgtatatagttctcaatcctgaccatgggtcgcgtgtgtcttcatcaatggtttgtggagagtacatagattctctcccagagctcagcatgatccagtcagccatgtcccggcctgtggctacctttggtgaagagagacatatacggcctttgatatcctccctcttctgatacatctggcgcctttatatccctacgagaactagcagtgtcacacatctgtacacacagagcgtctctcttcttgtgcggcatctggagggcc

SEQ ID NO: 662733 - DNA, 405 bp, Homo sapiens
ggatccaccatagcgagaaggacggaaggacactggggagtgatgtacagaatgacactgtggagaaaacaaaagatggacattgggaagagacggactgacagacagttgggacagagtgaaagacagagggacactggggagagaagaacagatggacactggggagagaaagtcagacagagggccactgtggagagaaagacatagtgacactggggagtaaaggacagaaggtcactggggagaggacagatggactgtgggtagataaggaaggatagacaggcactgggaagaaacccagacagacacctgggagagaagacagagagctggtcactggagggaaggacaaacgaaacctggagaaataccaattggggggggggggggggggaattc

SEQ ID NO: 662734 - DNA, 504 bp, Homo sapiens
ttattagcctcatactgcgagggacgaatatccctctggttaaacataggctctcattaagataccataggcgaggggcatatacctggcaaggtcagagcattcatggattagatgtaggctttagtgttgatgtctatccacgtatacccatggccacagaaagaaacatgaaaaggtgggagcgacctagagcccgtggcctgggagtaccaatccctgccatgtgccgcgtgacctttcttgggctgaacccaccagctccgtgcttgtgcatctgcgaggccctgttgggaaggagtcacctgacaccgttgtactgtacacagcagatctgttcccctcccctctggctcctgacatccacgatccctgccttctacggtatactgtcatatggcttgtaccactaaatcaccaaaatattttggacatatcaatcttgtatcgggcacctggagggagtcccataatcccatcaggtcacatgacccaagtatcggt

SEQ ID NO: 662735 - DNA, 945 bp, Homo sapiens
  misc_feature (642)..(642): n is a, c, g, or t
ccgcccgacaatgtgtttttctctccgcagagctgcgcgggccctctccaaaagaagagacaccaagctgttcctggggaacgagatgacccaaccccgggtgggtccctcccccctcggcgggggccaccacctgtggtagttgcggcaaacaaaaaaaaagaagggggacccaaaagcccaaccacagtgggggtgctccaccgcaggggcggcgctgcacaaaacaccaagtggtctccgcacgaacgaccacgggctccgcgcgaatgtagatctgccgcccactggaccccacttgccccctgaggatgaactatctcgctctcggctgcccctggacacccccgggagacgctagataattctctgctggcttctcttttccccaaggaggtccgcacccctctggttcccgcctggctctcgccctccccccccgagtggtggacgccccgtcttgtggcagcgtgctctctcgcccccagctttgtgggagatgataggggatattcgcgacggcccctcctttgttaccctctgagtgggggtgcgtggaacagataatacttctctcttcggtgtctctatacctacattgtgtctcgcccctctctctcccagggagggggttttaattcnacaatcgcccccctctcttcttggaacaagactcctcaagagacctccctcttttgccgcctgccacacattatactctctgcagccccatcttgacccaacaagcaggttttcactactgacgatataccacttattaccatgattgtccccacgaaagacactcagtccagatatctttatgcgtggtgaaaaaagagtctgtttacccaaaagtgagcaagaatccccactagtagtagtaccacttctttaaggacccccccgcagagagtacccttcttccccccctccccctcatcc

SEQ ID NO: 662736 - DNA, 1028 bp, Homo sapiens
  misc_feature (957)..(957): n is a, c, g, or t
cagcacctgccaacagaattcatacgagaaggcgacgatgaccggactgggtgccgggagatccggcacaactccacgggctggctggggatgaagggcccatggggccagggcccggagaatctggctggggactggttcaaccacaaccccttccaagctaaacttggggcggaggctcaccaaatccttcaaggtcgttgaaaggttgaccagaaaatccacgaggctggtaaagtcctaccagtggaaaatgctccctcctccttgctgaagcaactgaacgagcagttaaactgggtgtcccggctggccctcacgcagggcgaagaccagtactatctgcgggtcaccacggtggcttcccacacttctgactcggacgttccttccggtgtcactgaggtggtcgtggctctttgactctgatcccatcactgtgacggtccctgtagaagtctccaggaagaaccctaaatttatggagaccgtggcggagaaagcgctgcaggaataccgcagaaagcaccgggaggagggagatgtggatgttgcttttgcacctacgggggcatctgagtccagctccccccaagatgagctgcagccgcccagagagagctctgcacgtgaccaagtaaccaggccccaggcttcaggccggcaactgcggccagcctgtcgcggtctggatcctgcactctgggactgggggggtggtgctcatgggaagaacagaattgctgctgcatgcaagtgattcaataaaactgtcttgggaggctgggaagaggggtgcgggggtggggggggggaggggggggggggggagggggggggggggggcgggggggggagagtggaagaggatggagtgggggacggtgttcgagctggcgtgggagaggccttgggggccccgacttaagaggcttggggccggtccgcttgcgcggngtgcggggatggcggggagggcggggcggagggccgtgcgaagaggtggcggcgcggagatgggggggggg

SEQ ID NO: 662737 - DNA, 295 bp, Homo sapiens
  misc_feature (156)..(156): n is a, c, g, or t
agggggccccccccccccaaaaccctccattacgttggggcccctggccgtaaaaaacccttttcccaccccatttgggtgggggcgggggttccccctttttcttgaggctggggagccccccccgggattacccttggccaggggggggggggngcctttcagggcccctggttttggctccaaaaccaaaaaaaaacccttgggaaaagccttttaaattaaccccaaataagcctttgggggaccccccaaattttggtaaaaaatttttaaatttaaacccccaagggga

SEQ ID NO: 662738 - DNA, 242 bp, Homo sapiens
tatgctgcaactcatcttcataagctctctctcacagcatccaatgtctgtctcctctggatgaggaatgctcagtcctgaaaggggtcggtccaggaagtcgagagacatcagctctcaactgtaattccagctactcaggaggctgaggcaggagaatcgcttgaacctgggaggcggaggttgcagtgagccgagtatggtgccactgtactctgtatagggggatactcgggaaatta

SEQ ID NO: 662739 - DNA, 235 bp, Homo sapiens
gatatgcgtgccggtgcatgaggaaggttatctgaagggcggggccggagttgacgtcggagagggggcagactgtccaggtcacggtgtggagattcataaaatagcgtactgggtcacacaagatggtcatgtctggcccagtgccaggtggctcctttgtgtgcggggctcgagccttgtagtggcaggagagccaatatctccctaagcgcgacatacagaacctgttcct

SEQ ID NO: 662740 - DNA, 150 bp, Homo sapiens
ctcacccctggattctcagataatgcgatcatgttattctcaccagattgcactcttaggaatacattagagtgtacttcagaagacagtgttgtaaagccagagtgtatcagagaagtggttgagatacgtgaggctgttattgtgaag

SEQ ID NO: 662741 - DNA, 988 bp, Homo sapiens
caacgattctgctcaatgacccagtaagtggagaagatgcaggctggaccaccgtggggtgcacatggcagggctgcggtgcactaccgtgttcgtgaaactacagagtcggattaagttcctggtcatcgccctcaagagctccgtgggaggatgtatgcctgtgtgcccccaaacctcgtaccacaaattcgatggccgttcaagatcctttgccagaccgtcccccaccgtcctctgctggtcgatctgacagtgaagaggagtggtgcacgcggctcagaggtcatctatggctccattgctggcttccatgctgtggactgtcgactcggggaagcacgtcgtatgacatctacatccctgttgcacatccatgtagccatgatcatcgcctccatgtccatcatcttcctcgccgcaataccgacggcatggagatgctgctgtgctacgaggacgaggggtcgtctacgtctaacactgtacttggggcgctatcatttaaggattgtggttgcttgcagtggggggagatgcctacttctgtggcctacatctgcctccaaccagataatcgggctaggggtgagaaatgccattgagatccggtctgtggagacgggccagctcgacggggtcttcatgcacataacgatgctcagatggctcaagttcctgtgtgagcggaactgacaaggtgtatgatgcctcagtccgctctgggggcagcaagccaagtttacttcatgactctgaacctgttgctgcatcatgaactggtgacggggccctgggctggggctgtccaactggacccaggtctcccctgctgccaggcttcccgggcccgcctcctttccactccctggctattggtttactgggttggtttccttggagcttgtggaacgtgacctctgaccgctgatgcttcgtgatcagtgacattctcttcgccaaatttctcttccaactgtgctttgca

SEQ ID NO: 662742 - DNA, 211 bp, Homo sapiens
attgttaaataatgatatgtaactaaaaaacttttaaaataaataacaagtaaaaaatgtgtgtctccctcagggttgtttaaagtttattttctccctcaagtataaatagtggtactatatgtttagtatcttctagcccaactgctgtaaaggatgctgcaaataatgcttgaatacagtggctaagccacaacggaataaataccct

SEQ ID NO: 662743 - DNA, 196 bp, Homo sapiens
atcgggccgtactgggctgcgcgcacgtcccagcgggcgtgccggtgcctttgccgtcagctttcgctcaccactcagatggatgccgagcctccggaccctcaggcgttacgctcagcgccacggttggtggccgggcgagggcgagttccctctttccgaagtcttttctcgagttgaggatcatcctagactg

SEQ ID NO: 662744 - DNA, 927 bp, Homo sapiens
  misc_feature (9)..(9): n is a, c, g, or t
  misc_feature (52)..(52): n is a, c, g, or t
  misc_feature (64)..(64): n is a, c, g, or t
  misc_feature (85)..(85): n is a, c, g, or t
  misc_feature (679)..(679): n is a, c, g, or t
gccgactgntgtttatcctgtcactcgccagaggttccttgggtcatggtgnccagcctgactngagaagaaggacgctcccggngagacagaatgaggaaccactctcctctctactgttcaatgtacaggggcggcctgtgttccgcacaaggtgaagaaaacgcaaagagacggaaaagtggcttaaattcggtgattccgcccaagcacattgccggccgactgcatgtgaccattactgcgcgctggatccaagggacgctcggcttaagatattgacatacattgggacagacacaatgttaatctttaagcctcgaaaacagattctgcttacgaacgactggttctgggaagacgcccaccctcttttaaccaaactgccgtggtgtggcagaatgtgcccagaaagagcacgttggactcccggaaaggttcacgagtcttctaaagcttcgccaatgttactatgggcccctttcgcgttgtacaatggactggcgcggggacggtacactaagaagaatctctttacaacaataagagtagaatgcatcagtgataaaatggaggcacacaagccaatttgttgggcttgtggcccatgttactaaattttactctaaatgacccggtggatgtgcgcacagcttatgtggtatctgtgaagggactntcttctgtgactgaggtgacttatagaggctttggcataggatcagaaaattctggagaattctaggccagggtggccatgaggtgtcgctggcagcagatgcccttttggtagcggaatggatgaaccatcctcattctttaaaagaaaacgtggctctgattgccagtgaaagggttggactgttcaaaattcacacggggtttgtctcaatgggaccgcgagggggggtgcggtgaataaccctc

SEQ ID NO: 662745 - DNA, 308 bp, Homo sapiens
agtaactacgctgcctaatatcacatgcctttagtaagggtcagtgccagattctgtactcactatactgatttcaaagcctatggtgctaattagtacaacactaccttgcccttatggcaagtatttctttagctgaatagagacgtctcccattcccttctgaaaggaagactcttgtccatggagatttgtaatttagtaggaggagcaggtgtgctgagactcaggttgcaagatttacaagaaaacagacatgctatttccaccctaggaagaacttggatactgaacatgtatattcttga

SEQ ID NO: 662746 - DNA, 259 bp, Homo sapiens
atcaactttggctcagtgatctcccactggctcctaagctctggaattatagctgtgaagcactggggcttggtctgaaatctcttttttttatttatttatttatttttagagagacgatctccttctattcgcccagcctggagtgccacggtgtgttatcacagcccaatgcagcctcaaactcctgggctcaagcaatctttccgcctcccagttagcttaggacttattggtgtgtgccactacgcccagatta

SEQ ID NO: 662747 - DNA, 139 bp, Homo sapiens
actcggccatgtttactgttaccaggtgatcctattaattgtatatcaacaccaagctggtgattagcagaacccactattttcctacccaattgcaattcctttctaatttctcatgtaattttaaagcgtattgata

SEQ ID NO: 662748 - DNA, 255 bp, Homo sapiens
acgtatggcctcaggttagtggaaggtgacacaatgactgtctactgtgagtctaagagaacaagtggtgaggacgcagagccagatactaggcggctctttcaaggataccatactgagaggacagaggctggtggttggggcaagaggtggctctccagcaggtcatggcatgggctcttggggcaggaaagtgcatccagtagcagaagcagaggcgtcgagtgcttccttgcaagagcatgcaggagcagc

SEQ ID NO: 662749 - DNA, 168 bp, Homo sapiens
  misc_feature (153)..(153): n is a, c, g, or t
atgatctaaggatcccatccccggttctgggtactttctgcatatcatctcatctagcctctgtctcatgtcctatgagggtaggttcatgtcactatccattcctgtacagaataaagaaatactgcaggtttggcaagggagaagacactngacccagtgcaccca

SEQ ID NO: 662750 - DNA, 1009 bp, Homo sapiens
ggaagttggtgggaagcgtgcggtgtcgcagcaatggcggcgctcacaattgcccacgggtactggcaattggcttttcggctttggcgctcgcgggtgactcttctcaaatgccttctcatccccacataccattccacagcattcttgacgctacaccgaacactggcttgctatcactcacagtttgccaatatcacagtggctattatgacggcaacttcagcagtggacgcttggattacccccctttcttctgcactggtttgagtactatcctgctcacactgtcgccaaatacttctcgatcaacgaacatgctgaactgtccactaacttcgacactcactccagcctcaaggcacctctactcttctccacgcagcatttctccgctcatctcttatgcgatgctacctctctccgcctcgtactgctgctccgcgcacgtgcctgctaaactgcatcgcactgcgcacaacacaagtggcgtaaacgaacttacagcaacacgtcacaaaattttatttcctgctcgcgtactctcaccttcatgctggaacctttcgcgcgcttaacttaacttgctggaccccactactctcactttcccacgctaacaaattgcgccttctctcaactcctgggcattctaactggcctacctccctcccacttttgccacccgcactcaatctctcacgaacacaggccatactgcgcacagcgtacgcacttttcctcctctcgcctgcttcctccttacttctttccaacgcattatcctacactctaatgttagccaccaagctttaactgggttgctactctcctggcctgtcgattcccttacctggctttccacttgccgaacttacaacccagattgggctctaatttccgactgggacagaagttctccagcctccgctctcgcgcatccctttcccttgccgcacctggctcgcctccctccgccctcccggccttctccccctcggcgcttcat

SEQ ID NO: 662751 - DNA, 221 bp, Homo sapiens
acccttccccacagtagggtgtagcagcggaacaggcaatgccagacacaggctcgctgctgctggaagcggggtgggacttcattcctctgtccggagagcacaggtgtcacatgttccagccaaagctcctcacaggcgctgtaaatttttgtacaagtcttgtaattatcgaatcaacaatttgtttcattttaataaaaatgctcatgtggggaaag

SEQ ID NO: 662752 - DNA, 313 bp, Homo sapiens
tgttgaactatcctctgtatgttaatatttaaatattgtatatggcctatgcagctgtgcttatacacacaaaagagctgggtttatatgttgtgattatttctaagctctctgcgaaaaagttacaaatcgtctccttaagatattttttctttgtaatttttttatatcatgtcgtgatttccataaatatgtgcagttactcttgataatacttgtcttattcacttcaggttgctataacaaagtaccatagactgggtggcttataaacgacagaaatttatttcttacagctctggagctggaagtc

SEQ ID NO: 662753 - DNA, 432 bp, Homo sapiens
agaagcgatgtttacgttattctgacagcgcacgggtaacgtcatacccttctataatcaatacggaggctacctactccacattaccttcttttcaagggcctgtttcccttgcctccataactggggtgggtattgacggtcaggcttctaaatctcttaaaactccccaactctggtgccaacttggacaacattcttttatgcactcctttttagttatccccacctgcccagctcccttatgaggtcaagacattttaactaaattatctgcttccctgactattcctgggctacagccacacctcattgccgcccttttccccagttcaaagcctccttcacatcctctccttgtatctccccaccttaaaccacaagtataggacacctctactccctccttggcgaccgatcatgcacccctta

SEQ ID NO: 662754 - DNA, 118 bp, Homo sapiens
tgcgtgtggcagttttaagttattagttttttaacaattcagctacttttaagtggaaacaactttgaccaaaaattttgctcacagcaatttttgagacccatttaaaaaagtttaa

SEQ ID NO: 662755 - DNA, 827 bp, Homo sapiens
  misc_feature (44)..(44): n is a, c, g, or t
  misc_feature (48)..(48): n is a, c, g, or t
  misc_feature (53)..(54): n is a, c, g, or t
  misc_feature (59)..(59): n is a, c, g, or t
  misc_feature (61)..(61): n is a, c, g, or t
  misc_feature (66)..(66): n is a, c, g, or t
  misc_feature (72)..(72): n is a, c, g, or t
  misc_feature (80)..(80): n is a, c, g, or t
  misc_feature (111)..(111): n is a, c, g, or t
  misc_feature (113)..(113): n is a, c, g, or t
  misc_feature (130)..(131): n is a, c, g, or t
  misc_feature (139)..(139): n is a, c, g, or t
  misc_feature (157)..(157): n is a, c, g, or t
  misc_feature (289)..(289): n is a, c, g, or t
  misc_feature (293)..(293): n is a, c, g, or t
  misc_feature (301)..(301): n is a, c, g, or t
  misc_feature (303)..(303): n is a, c, g, or t
  misc_feature (326)..(326): n is a, c, g, or t
  misc_feature (329)..(329): n is a, c, g, or t
  misc_feature (341)..(341): n is a, c, g, or t
gcgcgatgaagaaagatatatttggccacggcagccggcggggnctangtgtnntagcngngtggntagaantcagacangcttccctcaggaattgatgtgcatgaggantnctggagaataagaaggnntgaagtanagatgaaagagaatgttncacacaaaggaaacatatgcaagcatcaactcaactctatgcctacagttctgggtcagaagaactgccaagggagaaattatgcattgcctgcccccagttccctcatgcctactacatgaaggaagaaancacnctcaaaangnggaagccaaagcaaactcccatnctngactagaagacncagcttgccatttaccattccattctgagaggcaaaagttctttctctcagtcccttttccccagaaactgtgagaaggtgcagagttgttggatgaagaagcccgttcatcaagggctcctccctgtttcctgtgctctttatcaacccaaactcagtgtgcctacttggccttagcagtttccttcactcctggactgatgggtggcacatgattgtgcacttaaataccacagtacagacgggaggaacacctggctaataactcacagccccaatgtctcattcagtaccttagcccatgtaacccagactaacttgagcagggaaaggactctctcatccttgactactgcatgatttattacatcctaaacagagatgattaccattcaattttatctgtccttaaaaaattatttatggccacagaaacatcagcaccgcttttcctcacctaatgagagactaagggacttttaggaa

SEQ ID NO: 662756 - DNA, 224 bp, Homo sapiens
  misc_feature (190)..(190): n is a, c, g, or t
  misc_feature (198)..(198): n is a, c, g, or t
ttcggccgggatactgcactgacatccccggatcctgggtagcttggattacaggcatgtgccaccacgtcatctaagttttgtacttttagtagagacagagtttcgccgtgttggccaggttggtcttgaactcctgacctcaggtgatctgcccgcctcggcctcccaaagtgctgggattaccccnggctaaangcttgtttttaactgtacctttgttt

SEQ ID NO: 662757 - DNA, 850 bp, Homo sapiens
ggtctgggtccagatgtggccccggcccgccaccccggggcgggcgcccacacggagccgcggtgcgcacgtgagctgtcccgcctgccaaatgcgcggcgaagctgcggctgcgacttggcgaggtggtccctaacgttgccgctcggcatccttagaacctgggcggaccctgagcgccgctgctggggaccccatgtcgcccgcgcgccccatgcgctcactcttcggtgcccggcctgggccggcgcctcgcagacgcggagccagcgcgggtgacggaacagggccggtgagctgccacatgcacagacaagcccagaccacgagagaaggagaggcgcaggcagcagacatgagaagacacacaagcaagaccctcgacgacgagaagacacgacgtgcaaggagagccgaagggatgacacagcctcgcacaacaaagaggaacaccgtgcagcacgactgaccaccacacgccgacagcaccacggcgacagccaccgcgccataatgcatgcgaaccacctaagcaccaccgcacgtgaaggcggagacaaccactaggcgagaacaagaccaccgaaatcaaacgcaccgcaacacagggacgacgaagagaggcgagcgagacacaacagcgaccgagtgaggcgagcgagccaggagagacaggacacagcgacggagaacgtgggggaaccacaggcgcaagaagagagtgacgacacagagaacgagcgccggcagacagacggacgcggacgaaaagaaggccccacgaggtcagagaagtcaacagagagaaacgcaacaggaggggcaccgcggcacatagcgcgaggggaac

SEQ ID NO: 662758 - DNA, 118 bp, Homo sapiens
ctaacaaagttagcctgatttattcagtgtagtgacaaccagcactgtactctgggtccatgagtcccctcgttggccctcctgtgggctccattatgaccgagatgtgtaagtctat

SEQ ID NO: 662759 - DNA, 153 bp, Homo sapiens
  misc_feature (69)..(69): n is a, c, g, or t
  misc_feature (99)..(99): n is a, c, g, or t
  misc_feature (102)..(102): n is a, c, g, or t
ggaagccgtttttggggtcgcggtccggactttgggcggggggtcggcccaggacagttttaccgcatncgtcactccgattcttcatggatccggcgnctnactttacagaggtcaatcacgcggacccagaacccatggtgaccgggacct

SEQ ID NO: 662760 - DNA, 130 bp, Homo sapiens
atttttttatttcaaaaaattttgttttgcggcagggttatcagctttttgaaaaagtcaaaagctgcagtaaacttttccaacgttggctgcagtaacaattttcaataaaagctgtttggatgtttca

SEQ ID NO: 662761 - DNA, 1123 bp, Homo sapiens
  misc_feature (274)..(274): n is a, c, g, or t
ggaactagtcttgagttttttttcttttgtggtcttcactataaaaatgcttaaatggtggtgtcttgtccgagcatggttttggacaggaaaaacagcaattgcccccagtggagacagtgccacagtgacacgcgctgggagttgattaaagatttcacactgctttcccgtgttttccccagttgcctgaaggcctctaggccacctcctcctcagcctcctcctcgaattcgccctcctcctcggctgtggcactcctggtactgctgcntcactcggaccaccaggctcatctcatgtgtttgcctcctcggccaatcggagaaacctccaatctgtcgtccagtgcccttcgccccggtgtataccagtgtgcagagaaggcctttgcacgccgataaccattggcccgtaaccgtgcctcgagaagattgccctttgaacacagcctccgtgaaagtggccgttgacttgtgtgcacaagtgcacagcggtgcggcgagacaattcttataggcgccctcgaaggtgtggcaccatgctcacatgtaacagcgcgattttcacacattgtgctagtgcggagaactccactctcaacacaaaaataggctgttgccgtgtcacagcgctctgtgggagagcatttataacgcactttgtgcttcattccccacctctcgcttatcatgtggcaccatttgggcgggccccctattaacaccactcgtgtcgggcacactccgctcaagcgtataagcgcgtgccatttggcgcggcgggattccgcaagtgcagcgccacctccagtgtgtccgtttgcgccatctccaacagcatctctgtggcgttggccgttagaagccctccgcggcccacccgggctcacgccgcccccgaggtatccgtggcgtgcgcgatgcccccgctgcttggtacccagtggcgcggcgcaacaggccccggtggctattgcacaagcacaggttgccatccgggggggaaccacccgggtgcccctttgttttccacaggcccactctctccccgcaggtttccgcacattcgacgtctggcccctgtggaacgcccgccggtgctacggcttggatgaacccca

SEQ ID NO: 662762 - DNA, 735 bp, Homo sapiens
cacacgagaaaacaccctcatgtgcaataaagcgtatcccccattgctccatcctatccctcaaccccgatcatcattaccgcggttttcctcttataaataaaaagaagaaaaaaaacaaaaaaaaaaaaagaaaaaaaaaaaaaaaaaaaaaaaaagggggcgcgacgcagcaaaaacatcactcgctccggaggagacgcccgaatacacacgctcaccccaccagaattttcgtggaaaaaggagggcgccccacatataggagagggagcgcaccaatatatatatataacccaatagaagaacggggcgcgcgcgcgcatataaacaaacggaacggacgcggggggaaacaggagcaaccacgggagcaccttggagaagaaagaacaccccaatctctgggggaggggggagaaccacccacgtggcgcgagcacaacacacacccaaaacacaagaaatattataacaagacaccctaatggggaggacaaagataataataacattttcacaaagagggtgtatatacgaggggtgaacaaaaaaaaaagagcgtcagaaataaattgcaggtgaggtgaccgacgagagaaaatgtttgttggctgttcataggagagttattatgataacatattatggaaaaaatatatattatattaccaaagaggagaaatatataaataaaaaaaatatacaagagggtatataataaaaaaaacttga

SEQ ID NO: 662763 - DNA, 934 bp, Homo sapiens
gcaaaggatgaggaccacagagattcactttcgaggaagtccagcccaagcatacaatacctgtagcagaaggttcgcgccaaggagaccaggaagccgagccactcagcaccgttaaagtcatgaagctgcaattcaaagatagtacgctagaagtctctgtgggcattcactaatctggttccacaatggctctcacagcctcctccgaagtaatagcgtcttatccggagattagacacatatgaaccagctgaaagaagccaggacccggacctttacatacaagttactgcgctggctttgcttctgcctagctgataccaacgtacgggtctcagaatctatgtggagatcgtcatggcattatactggacgaaagaggataacagaagagctaaaacggtttgatgatccaggttgatgctcatgggtttcaagccgttggtactgcgtgaagaaacagccattagcgctgaggccctccctgttcgtgtagcccagaggagtcgctggtgattgggagctcaaccctgttcagtgctctgctcatcaacgtgtctggagaaggcaggtagcagcattgtgcagatacacaccccgaggaacatccctccttattttgtggctttggtgccacaggaagaagagttggatgaccagaaaatttcaggtgactcctccaggcttccagctggtctttttaccctttgctgatgatacaaaggaagatgcccttttactgaaaaaatcatggccaactcccagagcaggtgggcaagatgaaagctatcgttgagaagcttcgttcacatacagaaagtgaaagtttgagaaccccggctgagagcacctcaggaacctggaggcttgggctggattgatggcaccggaaagcagggactgaattggccaggtggagcatgataaagcg

SEQ ID NO: 662764 - DNA, 487 bp, Homo sapiens
  misc_feature (487)..(487): n is a, c, g, or t
tattacacataaaatttcaccaaatttacatctttattaatttttacatttttaacacatctttctatctatcactcatatcaataaacattatcattacctttaatactctctctttccctttccatacacttccatccacttttcctctcccctaactcctccattcacctttccccatctcctcacccacttttccccattaaatcatcctttttactcacatcattttctattattttaaattttaacatttaataaatatttaacacttccaaactttaatttctcattacattatacatcataatttttctaaatcttacaaacaatttatatttcttcattttcttcatctttttatttttttaaacatcctatacttctctcctatttctttccaaatctttattttctcattcttcaacaaaaactttttttaaaattcccaccttcccttttcactccccttccatccattcttcan

SEQ ID NO: 662765 - DNA, 257 bp, Homo sapiens
tggcgggcctcattatgtaggtaaagctctacgactccttgagccaacttttaatgtaactggctatcctaggctggggcttgacttaagtaaggaagccagggagtccagatctagatagcagagaagtaagtctcattctaaaacatggcaactacggttagagtccaccccatgaagctgtaacagattgtgtatcttggactgaattctataagtatatatggtccagactaaaacatatgttgctagctagg

SEQ ID NO: 662766 - DNA, 364 bp, Homo sapiens
  misc_feature (354)..(354): n is a, c, g, or t
catcttctgtaactttttctctcctataatacagaagcactgctgaagcatctcttttttgtctgatatatagaaactaactggtttcaatgacacagtcggtccagtccaccttcttcaaggtcactgtgtctgccaagaataattctttttccaaagttggcaaaatatatttagtttcctgctgcaaggagcccgagacgctggaagagtcggtactcctcccgctatctcgcggactcctggctccatcgctcgtcccgccacctaacatgtgccgccgctccccaccgctcggtgatatcttccacctaaaattggcgttccctacagcacgtgaccgtccccctagcncacttcgtcc

SEQ ID NO: 662767 - DNA, 596 bp, Homo sapiens
  misc_feature (295)..(295): n is a, c, g, or t
  misc_feature (387)..(387): n is a, c, g, or t
  misc_feature (458)..(458): n is a, c, g, or t
gactgtcgcggggaagctgcggacggcttcggacccggaacaacagagcaaggaaggtcgggaatccggagactcatcgtgggagctccatagacaaagcgtggtccgggggcagagcgagtttcccatgcgaagcagctggagtgagcgcgtcgctcgctcttcgatcactacgaatgccttgatctgtccatgcttactctctctcagcgaatccgagcgtcatccaggtatagcaagcggcgtggtcgactgccgtaaatcgacgtctatccggagtttcgcatcgtattcnaatcagggagttgtggagatcttgacggggtctgtgatgggatagaggctttgaatagttatttttaatcacaaggcaatacctacttagantgtggtacttggcaacgaaagcatggtgggactgttgtagcctgaataggggttaactagttgcatacacntttacgagagactcgtagatccatgtcgaggtaggttttagcaaagcaatgcactggtcgaattatctaatagcgttataggggataggattggctcttcgagaaggagggagctgaaattgctcaagtatgggtaaa

SEQ ID NO: 662768 - DNA, 1141 bp, Homo sapiens
  misc_feature (160)..(160): n is a, c, g, or t
  misc_feature (168)..(168): n is a, c, g, or t
  misc_feature (277)..(277): n is a, c, g, or t
  misc_feature (321)..(321): n is a, c, g, or t
aatttgagggggctgagaatgaagaacatgagtatgacgatcgagggaatcgctgaagaggacggatgtagatcaagaaagaagattagcatgattggctgccaggtactgtacaggacaaacgaaggatccctgtaatcttgcacgtgagcgtagcaantcggactngatgagtgtgcctgagtgacagagaggctgacaggttgaattgatcagtcaatcgacggtgagagcatcatcgtgatgatgtgaggtgatcatagtgagcgtgtggaanaaggcgttaaagagcagtgatccgtactgatcagcagaatgcantatggagtgtagagtggaacttacgtacatcgcatcatagagatgcgggtggcaagtgtacatcatatgtatgcggacgagtcaactgaggggctgtctgatcgtctccatgagccgatgggagtccgatttctcataaaatcaaacaggtagacctggctcctgacgtgaacatatgattactggacctatccatgtacctcgaaaggtgactcgacatctactacttgcggtcatcatgagttacgatggtcattggcatgactcgatgggccgtcctcgaagatgttgaaggaggcaggcgaaggaaaggaggtaggatcgtgtgcgtgtctgagatccgacacgtggatggacaaggcgggagctttcgggtgtttgtctgtccactggtggtaggatgatcgctgatcaattgccctgggtccgcgattaccttcggggtgccttggtgcacaaggcgtggttcctttgtcgagcctttctgtttagtgcatggctggaaaaagagtgcaaccagcaaaaaatttaaccaaacacaagggggggccaaaaaaggcgggggcgacggtaggcacgaaaatggcggaaggctacatattgacgcagtcacacatgtcgtgtgcccgacgaaagacggtcctttcatacgagcaatgtggagagggacaccacacagcgcatgcttgttctgtccttgttcttccgttcccttgttgcctacgctttttccttgcttctcatcgcttgatgcgtcgtaatcaacccgaacaacatggacacacaggtacgcacaagacgaaagagcggccaccaagct

SEQ ID NO: 662769 - DNA, 210 bp, Homo sapiens
  misc_feature (113)..(113): n is a, c, g, or t
  misc_feature (135)..(135): n is a, c, g, or t
  misc_feature (166)..(166): n is a, c, g, or t
  misc_feature (180)..(180): n is a, c, g, or t
tctttgacgtgcatgtccacgaggtggtggacgcctcgctgtcagtcatcgcgcagaccttcatggatgcctgcacgcgcacggagcataagctgagccgcgattctcccagnaacaagctgctgtacgccaagnagatctccacctacaagaagatggtggaggnttactacaaggggntccggcagatggtgcaggtcagcgaccagg

SEQ ID NO: 662770 - DNA, 126 bp, Homo sapiens
agagattggtagtcagaatgtgtaagggacttctacagttcaagactaacaatgacaaccccgattaaaaaatgggcaaactgaaactctgtacccatcaaataacaactcaccattctatggttg

SEQ ID NO: 662771 - DNA, 194 bp, Homo sapiens
gtcgagagtcagcaggttcactgctgttggaatggcaggtgtcctggtgctggctaggttcatggctgccgagagggtgaaggaatcctgctggcaaggttggctgctggtcgggttctgagactcatgagaggcaccgggcctggaacctgggacatccttgcagcaaggccagcagcagccatttacggtgc

SEQ ID NO: 662772 - DNA, 216 bp, Homo sapiens
ggcaggtagatggaaatagagatccttctcccttcggtacccatgtgatttaacacagccatagaagggtcaagttttggggtgggggcaccatttcaaagatatatttctattaagcttcttgagagtgatatgaagaagaaacgaagtatagagtctctcagatgcaaaaatcacttagaggtaggccatgtatccatccttatcacacttcac

SEQ ID NO: 662773 - DNA, 232 bp, Homo sapiens
ccagtccttcatcatacctaccttccgaatgtaaactggccgtaatcccagcactctggaggctgaggtgggaggattgcctaaggtcacggagttcgagaccagcctgagcgatgtggcaagatcccatctctccgaaaaaatacaaaaattagccaggcgtgattgtgtgtgcctatagtcatgtttactcaggaggtagaggtaggtatgatgaaggacggggtacgag

SEQ ID NO: 662774 - DNA, 216 bp, Homo sapiens
tatacgcaatgaggaataagacttgcctagtgttcttacctctcccgcagccgagtggtttctggagctggaattaacagctgagatctgtttcactggcacacctttctgtttatctgcggatgcctttcctctggaaggatccttctcctccaagacaacccgctgtccgtccagactcgatataggggcgccaaggaccgtggggtaggaggt

SEQ ID NO: 662775 - DNA, 393 bp, Homo sapiens
  misc_feature (1)..(1): n is a, c, g, or t
  misc_feature (75)..(75): n is a, c, g, or t
  misc_feature (79)..(79): n is a, c, g, or t
  misc_feature (98)..(98): n is a, c, g, or t
  misc_feature (103)..(103): n is a, c, g, or t
  misc_feature (120)..(120): n is a, c, g, or t
  misc_feature (346)..(346): n is a, c, g, or t
  misc_feature (364)..(364): n is a, c, g, or t
  misc_feature (385)..(385): n is a, c, g, or t
ntgaaggctatcggttgagaagcttcgcttacaatacagaagtgacagctttgagaaccccgtgctgcagagcancttnagggaacctgggagccttnctttnggatctgatgggagccnggaacaagcagtggacctgacattgccccaaggttgaagcaattgaataaaagactgggctccttggtggatgagtttaaggagcttgtttacccaccagattacaatcctggaagggaaaagttaccaaggaggaaaacacggattaatggaaggttcttgggaagccaaaaggccccaaggtggggagtttttccaggaaggagggagcttgaaggaccccacntccagccaaggggtacgnttgggccaattttcactgttngccccttg

SEQ ID NO: 662776 - DNA, 260 bp, Homo sapiens
tcgatgccttggctgagtgaagacctaaagactctgggttgatacctgaaagaatcctgtcttatttggtctccataatcctctgaatggaaagtgacctgtgtgtgattgaaccatggagaaatttgtaaatcctggattctgagtatctgaatggcagggcgtttagtactgtctcccctgtaccagcatacttgatttcaccatgtttactccttattcctacaaccagtttatatctgtgtaacttatctcctcat

SEQ ID NO: 662777 - DNA, 414 bp, Homo sapiens
tgacaacgaggccctctatgatatctgcttacgcactctgaagctgaccacaccaacctacggggatctgaaccaccttgtctcagccaccatgagtggtgtcaccacctgcctccgtttccctggccagctcaaagctgacctgcgcaagctggcggtgaacatggtgcccttccctcgcctgcacttcttcatgcccggcttcgcgcccctgaccagccggggcagccagcagtaccgggcgctcacggtgcccgaactcacccagcagatgttcgactccaaaaacatgatggccgtctgctacccgcgccacggtcgttaacctgactgtggctgccatttttccgggccgaatgtccatgaaggaagtggacgagcagaagctcaaccggctaacaagaaacagcactc

SEQ ID NO: 662778 - DNA, 155 bp, Homo sapiens
tccttaaactatacttcaacctacagcctaatctacatccacctcaatcacactacatccccatatctaacaacgtaaaaataaaatgacagtttgaacacatagcctcatcatccccacgatcatagccaccatcaccctccttaacctctact

SEQ ID NO: 662779 - DNA, 302 bp, Homo sapiens
tgacatctggagagaggtttgtctggctgacgtctagagaaagggttgtatggctggggtctggatgaacacggggcatctgaccgacgggccgtgggaaacggtttgtcttgactgacgattctgtgacgagagcgtttcgtctgcgctgacagttctaggagcaaacgcggcttgtactggactgacagctctgggagacaactggcgtcatctgagccaatgggtctgggtgacaccgggttcgttcctgagctgagattctgtgagagacgagttcctcctggccttgacggttcctg

SEQ ID NO: 662780 - DNA, 367 bp, Homo sapiens
gccgcacttattgtagagacaggatttcatcatgttgtgcaggctggtcttgatttcagtctatcagcctgcctcagcctcccaaagtgctgggattacaggcgtgcaccaccatgcccacattgaaaggtaattatataatgagatggggtctcactctgcggcctaggatggagcgcagtggtgtgatcttggcccactgcagcctctgcctcccagctctagggatcctcccaccttagcctcttgagtagctaggaccacaggcatgtgcaccatgcccagctgatgttgtgttttgttttgttttgttttaagtacagcggggttcaccatgtgcccaggtggtctcaaactcacaagctta

SEQ ID NO: 662781 - DNA, 440 bp, Homo sapiens
aatctaaaagaatcccttccctgaggcccacgagccggaatatctggcgaaactcagacgaaaactccaccaatcacgtggaagttaattttataaagaaatttacgtcaccaagagattttcacccatccatcagctgctccatcacctagttcttgtcctgaagtccctgctgggaatgctcccagtctattagagagcttctgagtcggcaccctggcgtgactctagtgatctacgtagctcggcttttttggcacatggatcaacataatcggccaaggtctcagggaccttgttaacagtggagtaactattcagattatgagagcatcagagtattatcactgctggaggaattttgtcaactacccacctggggatgaagctcactggccacaatacccacctctgtggatgatgttgtatgcactggagct

SEQ ID NO: 662782 - DNA, 369 bp, Homo sapiens
  misc_feature (249)..(249): n is a, c, g, or t
  misc_feature (270)..(270): n is a, c, g, or t
  misc_feature (310)..(310): n is a, c, g, or t
  misc_feature (354)..(354): n is a, c, g, or t
  misc_feature (360)..(360): n is a, c, g, or t
tctttgagacagaatctcactctgtcgccaggctcgggtgcagtggcgcaatctcggctcactgcaacctccgactcgctggttcaagctattcttctgcctcagcctctcgagtagctgagattacaggcatgtgccactacacccagataatttttgtatttttagtggagacggggttcaccatgttggccaggatggtcttgatctcctgaccttgtgatccgcccaccttggcctcccaaagtnttgggattacaggcgtgacanccgcggcccagccctaggttcttttaatcgggcagttatncaacttcctttgttggacagcctttagtgcagtgaagagttttngatttnacacagact

SEQ ID NO: 662783 - DNA, 259 bp, Homo sapiens
  misc_feature (7)..(7): n is a, c, g, or t
tggagcntggctcacaccttaatctcagctcttaaggaggcagaggcgggaggatagcttaaacccaggagttcgagacctgccttggcaatatagcaatgacccgttctccacacaaaggaaaaaaaaaagtattgttgggccaggcacggtggctcacgcctgtaatcccagcactttgggaggccgaggtgggcggataacctgaggtcaggagttcgagaccagtctgaccaacatggtgaaacctggtctgtac

SEQ ID NO: 662784 - DNA, 128 bp, Homo sapiens
agctctatctcagttactgctagatccaccttcgaccttaagtacataagggctatcgtagttttctggggtagaaaatgtagcccatttcttgccactcatgggctacatctatgaacataacgtct

SEQ ID NO: 662785 - DNA, 130 bp, Homo sapiens
tgtgtaatattgtcccttttacctcaagaggctgtaaagaatagctagtcttagaggagttggttggaatagtgattatcaatgggaggtgttggtcccgatgtaaaagccctgctggcctttctggtgt

SEQ ID NO: 662786 - DNA, 131 bp, Homo sapiens
cgtctaatccccactgactgaagtggaggagaaagtgagatgttacgtggcaggaggaaagtccccttggaattatggggaggagaggaaagggctcccacattgtctgcatctgtggttgtttgctaggg

SEQ ID NO: 662787 - DNA, 261 bp, Homo sapiens
gatctttcaaaactttaaatcaaattttatatctaaccaggacatttttggaaaattggtctattcttcttacaacaaaatttgttttatcttggttattaaacagtatctgtgacttttttgtcagaattttaaacttattttgttgccaattattgtttaccgagtataatgttgctatttagcaaaatcctttgttttaaagaaattctccttttgaaaaaagcatcctcttttaattttacttcccataatcctaaa

SEQ ID NO: 662788 - DNA, 622 bp, Homo sapiens
  misc_feature (432)..(433): n is a, c, g, or t
  misc_feature (444)..(444): n is a, c, g, or t
  misc_feature (454)..(454): n is a, c, g, or t
  misc_feature (462)..(462): n is a, c, g, or t
  misc_feature (464)..(464): n is a, c, g, or t
  misc_feature (473)..(473): n is a, c, g, or t
  misc_feature (477)..(477): n is a, c, g, or t
  misc_feature (493)..(493): n is a, c, g, or t
  misc_feature (499)..(499): n is a, c, g, or t
  misc_feature (503)..(503): n is a, c, g, or t
  misc_feature (508)..(508): n is a, c, g, or t
  misc_feature (513)..(513): n is a, c, g, or t
  misc_feature (528)..(528): n is a, c, g, or t
  misc_feature (534)..(534): n is a, c, g, or t
  misc_feature (622)..(622): n is a, c, g, or t
agaacttgtggtatttattgtagggtactgagcaagaagattcaggcagctcatgtttaagacctgaactctgagatggtttaaaggtaggagtttataaagatggggaggcagaggttacagaaaaagtcataaatcaatacattgaggctatacattggtttgactaaaaatgtgggacatcttgaagcagggcctctaggtcataggtagattcaaagactttctgaattgtgattggttaagaagcaaagctttgtctaaaatttgggatcagcagaaaagaatgttagctttagctcatgggtttaactgcctccctcgggaagaaatttagaacgaagaatgggtgatcggagttcagtcctcaattgccccttatctgagttctatgtgccaatgggatccgtttggggggagtttggatttctnnaaaccaactangaagagaggntaaaatgntntctttaatntctntagggaacaaaacatnttggangctnactgntttanctattgtttaaagcnactttntgctttttgcttatcaaaatcgctcatttactttccagggctaactaggggtatggaatttttcctttaaggagtcaaagatatttcn

SEQ ID NO: 662789 - DNA, 225 bp, Homo sapiens
agcgtatgatgggcagatgagggggcgcatatgatcctaggctataatatccggagtatacgtagccggtaaagtaaacaacggtacctctagaactatagctagcatgcgcaaatttaaagcgctgatatcgatcgcgcgcagatctgtcatgatgctcatggcaatgggatccatatatagggcccgggttataatcacctcaggtcgatgtcccatggccat

SEQ ID NO: 662790 - DNA, 890 bp, Homo sapiens
  misc_feature (476)..(476): n is a, c, g, or t
agcgtgaggtatagagctgggtggtaacggggtgtgcgagtccggatggatcgtcgccggggagatggtgtggctgccgacttgaacagagagatttccctacacaaaggcgagagggaaataaatcggcaactagcaagctgagtgaactgcagaggaactgacagaaatagtcgggagagaagataagacttgacgaacgggatagtgggtagaagtttgaatagcgtaggactaggcgttgactaagagatcgcatcacagaattgaaggtaaaaagaattgagttttcacgatgcacatctatggtgtagtggaatatcattatgggattgtatatgctggaatttaatcatatgctaatactaccagtacacaactgcgtgtactggtgccgagacggtctgtaccgtgatctctggattaagtgttcattcggctccggctagtgagcactggaactagcttgtatggtntccccacaattcctagtcgagcctatgttaaagtattcagcggctcacacatcaaattgcgacacgatcgtggagatacacgaggacgaaaaagattgcatatcgcaaagatgtctcggagtcttattcttagttataataaacttcgggatgagaaagtctgggggggttcgtggtggaaaaacaggtcgtgctttgcaactagtaaagtgcaatgaggaacaaggagtacaggaatggttatttattcagtgaagccgattgaaatcggaggaatcctctgactggtctgggttagtcatttgagggctggagggaggaagaaaacgtggctattacattcgtgcatttcctcattctaacacgtgaattagttgaattgtccttaggtaatcgctttcctggataatatta

SEQ ID NO: 662791 - DNA, 1003 bp, Homo sapiens
atgcttcatagggaacttgagtgtttgctgtccagttgtggcttatactatatgttgagtatagtggtttatatcgtatcatgtattatttatattgattcaaagtttcaactgtccctcaggctggagtgcaatggcgcaatcttgcctcatgcaacctccacctcccaggttcaagcgattctcctgcctcagcctcccaagtagctgggattacaggtgtgtgccaccacgccccaccgattttggtacttttagtagagacaggatttcaccatgttggccaggctggtcttgaactcctgacctcaagtgatctgcccgcctgggcctcccaaagtgctgggattacaggcgggagccaccgtgcctggccaatgtaagtatttaaaagtcatttaacatattggtcattgatgaaactggggttacagcacacgtaatggcttatccctctcttctgtgtgataggtgtaaacctctatttaactcaggtcctagattagaatgtccttggtcctgatgtttgccgtaatggccttcctgggttcactaacagatcttttggaaatatactctggactgttggtgaaagaggcaggcctggctttactggctactagtttgccactgaactgtttggggtgcccatgaggtacgcagaccttatgctgtgtatttggaaacgggagttcttgcctctttttgcccaggttggaattgagtatgtgtgatctcggtgctaacggacaccctgcctcccagggttcaaagtagattaatccctgcataggtttccccattgcggtgaccacaaggattgtggccccatccccataatatgtggttcatacagaaccacttttgcattggataaggtgctggaaccgtagcaggtatcacgtttgtctaaaggtcggtacgcgtagaacgagggcaacatcgtcgaagggcgcgtgaagagtgtgacacacgcgagccgctcaacaccgtgattaacagc

SEQ ID NO: 662792 - DNA, 261 bp, Homo sapiens
ctgttcccctcaaacaaaatatgtgcaagacttctttgaaattatttatgttatgaaaatacattaaaggaaacgttaaggaaaaaaaaaaaaatttattgttaccaaaatagcccctttatgggccctggggtcttgggtatagggactttatcacctgaataattactttttaaaattataatggggcatttatttatttgtatccggcttgggggggggccctttggaattttccacatttggaatttatgtttgggt

SEQ ID NO: 662793 - DNA, 222 bp, Homo sapiens
agaagctggaaaatgggctgccccagcagaaaactgttgcctctatttctccattgttgcagcaacaatggcgggatggaagcactgaaacaacacaaaccctatctcaagaacttgttaacctccggggagagctagtcactgcttcaaccacctgtgagaaattagaaaaagccaggatgagtacaaacagtgtatgaagcattcgtccagcagcaccag

SEQ ID NO: 662794 - DNA, 272 bp, Homo sapiens
cgagctcggtacccctccgacggtgatgttaccgacgaccacgaccggcaccggcgactggtagatctcgccctcgcccgccaggaaccgcgcgcgcttgcgctgcaccacccggcgatagagggattccagcggctgcaacaacgcaagcgccggatggccttcgtaccaggccttgagcaaacgatcagtcatggccatcagggttggctcgccgcctcgaccgtggtcatgcgcaaatgtccgctggggtatcctctagatacctcagc

SEQ ID NO: 662795 - DNA, 709 bp, Homo sapiens
  misc_feature (21)..(21): n is a, c, g, or t
  misc_feature (24)..(24): n is a, c, g, or t
  misc_feature (32)..(32): n is a, c, g, or t
  misc_feature (49)..(49): n is a, c, g, or t
  misc_feature (52)..(52): n is a, c, g, or t
  misc_feature (195)..(195): n is a, c, g, or t
acgcttcttttattagttttnatnagtttttnaaaagtatcagaaatancanaaggtggggagaagataaatctgcctttggaaaccaaatatttaatattttcattaaatggtttcaatacaatcttgccaggcaaagtgccaacgggaagaccaagcccagaaattcagaggaaataatcttccaaacaaggnaacaccaggggtaatcttcttccattccagccacaatacggggtgatcataaggggtgctagtcgagcttatccagattatcgaggtgtttaccacatcatctatttctcagaagtgctccgaacagtttcagttggcaaagagtcagagcactggactggataccaacagaggctgggacaaccagttcctccaaaatggtgggaaataccaccctttcgggacattaatggcctggcagtttttgtctccctggggcatgccgggtttcttagttctggttcactggtagaactggggattcaggccggcatttcaagctgagtggtagatgggaatggacctccatagcatcgggcaaaagcacgaacgcagtaggattccataccactcagggtccgtgaatattcagttaatcgtagggccaactctatttctggagcaccacctcctgcaataagagccctcttcttccattaaacaaggaataccacatagggcatcatgattggcc

SEQ ID NO: 662796 - DNA, 112 bp, Homo sapiens
  misc_feature (15)..(15): n is a, c, g, or t
cagggcagggatggntgagaatcagtctggggtgtaaggcagggcccagggcttcagaaggcctctatgtcatgtcaaggctctcaggctcctcctgacagtcgtggggctc

SEQ ID NO: 662797 - DNA, 477 bp, Homo sapiens
  misc_feature (255)..(255): n is a, c, g, or t
gacatgatacgaatccgagcttgatacccattggagtacttgcgctcaattcatccaacacaaaggtactcttgggacaggtgtagcgaaggggcccttggtcttgggctcagcaggcagcgcctgctcacattcatccatctcctcctcaggagcagggtgcagtcgcctttttctcctccttccgctcagcctggggcttctgcttctcttcccgtgaacccttctctttccgtggtgtgtcctttttaggtngggtctctgcaaacttttgtagcatcaaactgggccatcttctcacacagtttcacttcccccaagacagcccggaactggggctggttaatgcaggtgaggaaccagcggttggtattgggaaaggcctggcggaaagaaggctctagaacctgcttatagagccacaacagggtgcagacaactgtgatgtcagccaatgtcactccttcacccaagcta

SEQ ID NO: 662798 - DNA, 934 bp, Homo sapiens
tccattaaattggaccattgatgataagaatacacattgtatgttcctgtgcacatcacagtgtgtgtgtgtgcacgtacatactgtataggtcttaagaaatagcataatactggccaggggtggtggactaacgcctgtaatccctaggctacttttggagaggccgatggtcgggtggtatcacatctgtggtcaggagttgtgagatcagattcaggccagactctggtgaagaaccccgtctctactaaagaatacaaacacattagctgggcgtgatggtcgggcgcctgtaatcccagctacttgggaggctgaggcatggagaatcacttgaacccgggaggcggccggttgcatgtgagccgatgatcgtcaccatatgacatctcgcagttctgggcaagcaggaggtgagattgccgtctgcaaaaagaatgacacgaacgcggatgcacatatttaggctttataacctcttccttgtttctcaagccgcgcatgaaggttctgaatgctccaaatccagtggaataatccaagaagcagaaatgtgtactgtatagacataggttggactttctggataggaaagtaaggatactgtgacaaaagccctcggggtatatttatcttctaagcgcttactctcaggggcggctccgtgagcccacctaggtctctctagtggagagccactcaggcctatttccctgtgtgtagcctccggcgctgaccatggcgtgcccttgattgttcggcaattaccctgttggtcaaccattcggttggtttacatctgccagaatctccagggcggtcatgggacctggaagtaaaatgggtctccagtaggcggggtgctgtcccgttccttttcaaccctatgcttttccacccgtttgttttcacacgggctcccgctttgtgg

SEQ ID NO: 662799 - DNA, 101 bp, Homo sapiens
tctagcctccagaatctcagccacagtttcaggctctgcaccccctgaggacctggagaatggtgagtccagatgaatagagcactgtgtgtacatcgttc

SEQ ID NO: 662800 - DNA, 260 bp, Homo sapiens
ggtgactctagaggattcctcgaccggaagcagagcaaggcagtcttactgagatgaggaaacagagactagagtttcagaggctgaagtggtcacaattggcagtgcagaatactggagagaagaggggagattcacacacacacacacacacacacacacaaagagctacagagatcataatatgggaatccatgagtctagatgtatactaacctgcccatgtaaaaggtacaactctctgaggaaggaagggaaat

SEQ ID NO: 662801 - DNA, 147 bp, Homo sapiens
ggcacgaggccaacatggtgaaaccctgtctctactaaaaatacaaaaattagccgggcatggtgggtaggggcctgttaacccagcttactcgttgaggccaaggcaggagatttgtttagcctccagcagttgcagtaagccaag

SEQ ID NO: 662802 - DNA, 743 bp, Homo sapiens
  misc_feature (464)..(464): n is a, c, g, or t
cccaggcccctaattttagccgcccggcttatagcccccctgttatttggattgcccacccacggcgtccaccatgtgccaaggcccagtttgctgaggactgtatagggacaagaattgtatctccccgttcttggtataaaaaacctggatagtatggcccctataattctctgagaagttctctggtggatagctcgcccttgcttgaatattggtttcctggccagccccccatgtgtgttgaggagctttctcacgactattccaccctcttgggtcgctcttgtctggtttcgtgatattgaggaccacgaccacgcttgccgcgtgggtgtcactcccaagccacgtggacccaagaaggctggctggagctcggccaaggtcaccccagtctgcccacgaaagcttcacgaagcgctataatgaactattattccctatatatcctcgccaccccncaccttcttaaatccacgtcggtggagagaaccggttctcacgaactcgtttgtttcacattggccactttaagtttagtagtataaagaactggttaatgataaccatgcatcgttaaacccctcagaaggaaaggagaatgttttgtggacccctcttggttttcttttttgcgtgtggccgttttaagttattagtttttaaaatccgtactttttaatggaaaccacttgaccccaaatttgtccccgaattttgagacccccttaaaaagttaa

SEQ ID NO: 662803 - DNA, 277 bp, Homo sapiens
gaataacgaaagcctgaagctgctgaagactgctattgggaaagctggctacactgataaggtggacatcgacataggacgcagcgagctccgagttcttcatggctgagaaggatgacctggactgcaagactcctgaagaccccagtaggtacacctcgcctgaccagctggatgacctgtacaaggccttcatgaaggactacccagcgatatctatcgaagatacttttgaccaaaatgactgcggagctagtcagaagttcacagccagcgc

SEQ ID NO: 662804 - DNA, 614 bp, Homo sapiens
tcgggctgttctacacccggcctgttctcccccaatattggcgggggtatccagtgtctgtactcctcccgggtgccccccggggcaaccagctgtgcccacaaatgcccgcggggaattatccttttttggtgaacgggttcacaccgtggccaccattctctgtggcgccctttcccagtcagccccgcggtgtaccccacaggcccgcgccattcaatgttcccgcgctgcaactcttcgtgagcgccctcgtgttgccggtccggctacccactcgctcgtgtgcctctctctgtgtcgggtggccgctcgcctccgttgccccccctcccacccgcttcccacgcggtgcgtccgccctctctgtgtcaactctctggttaacaccgcttgagtgtggcgccccgccccgccctcacacacctctgcctcgggtttatcggcggtttgaagccccccgggtctctgagattctagaaggcgagaaaaggtggtattttttggagtcattgaccacgaccccctagatagattatcctcattgtcgttctgtgacgctttataaaaaccggggacccaccccctgtttgataaattataccaaagtcaga

SEQ ID NO: 662805 - DNA, 903 bp, Homo sapiens
gcgaggttgcagtgagccaagatcgtgccatgcactccagcctgggcagcaagagcaaagctccatctcaaaaaaaatacaatacaataaatcttcttgggtggacagcttagtcatatgggaagtatacacgttacctttataagaaaccacaacactacttgcaaactgtgtcgcaccctttagcgtactcaccagcaagacatgagtgtactaattattttccatctttaccagcaattggcatttatgtgcttggtggtctcattttttagccattctataagatggtctggtgtctctttgtggcttaaatttaaatttccccaatgagctaataatgttggacattctgtgtgtggctttatttgccaggccgtgttttatcctcttgtagaggtgtctgacacatgaaacacatttcactcattttttatcaaggcggttgtcttcttacttatgtgagtggtaaagagtccttttttataatttttctgtataaatcattgtgattcaccaccatcttttttgaaggtattctccacgttggcagttgtcgcatttcctttaaggtgtccttaccaagatcacgatttaatttgatggcgtcacaatatacaaatttgtcttccatgtggtctgtctatctcaatgtggccaaaatatttctactaggcggcactaaatcttacaattacggattcacatgggcttgatcaattatcacatttatttcatgttatacacacggcggataatatatttacccatacttggaggataggagcccattccaatgggcactttattccatatacttactgtaccaccaccagtgtgggcacaaatctcgcactattgtcaaccgttcttgacacaggggttgttcctgcgtcttactcc

SEQ ID NO: 662806 - DNA, 121 bp, Homo sapiens
ccgctgagacattgatatcttcttccatctcactcccttcctcttctcttctttcctcctccccttcttgccttgccccctttctccttctcttgctccctccttccctcgtccgagcgga

SEQ ID NO: 662807 - DNA, 207 bp, Homo sapiens
taagagcggtctcaacgcgggatccgagccgtgtctgcaacctacaccacagctcatggcaacgccagatccttaacccactgagcgaggccagagatcgaccctgcaacttcatggttcctagtcatattcttttctgctgcgccacgacgggaactccttaagcacattttgtctttatgcttactgtggctgctattatttcct

SEQ ID NO: 662808 - DNA, 153 bp, Homo sapiens
gggatgtgcaggcccatctatcgctacgagtggggtaattggagccatgttcatagcctccctagcttagtgctgcgagttcagcttagctgagcttcacgctctcccctgaaattgctaaattgggcttcacaaagaggcacacacagggtc

SEQ ID NO: 662809 - DNA, 1582 bp, Homo sapiens
  misc_feature (1582)..(1582): n is a, c, g, or t
taaaaccctcatcaatagatggagacttacagaaattagttcaaaccacattctacaaaagtgccagttatcagggcgggggctttcgaagccaaaggtgagtgttgggagtgtaaaggtgaaatattagtggggggagtgaagcagataggtgaggaagagtgggacccaaataagtgacggtgaaagctccggggaaacccgtggtggcctacaaaaagagtgtggacccgctagaatgccgctcggaaaagtgggtgaaggggagaacctcgaaagagatacctcgtggagcccttgtgtatagagaggggctaaaatataaaagcacccagtatacacaattggctaatataacgccaggcgtgcttgtgacatattattgtggggttcacagagctgtggtcttcccatattataagaccatatgtgggtagacccctcaaggtgtgactgagaatacacacccgtggaaaggcacgaaaagataaaaccacgggaagtgtgtgctccccagggaagtgtgggggacacacctacacaggggggaaaatacacagccagcggcgagtgcaaatggcccgtgaacgaggagaggagccccccagaggaccccaccccaacacaatcgaggagaggatagaggagcaacctagcggactgtgacacgcgttgaggcacacaccacgggggccactccacaaaaaacacaacctcaccgtgggcgcagaacaaacaaaacacaaaggcttctgccgaggcgctaaaactaaacactgagggaataaatctcacgcggaaatatcgaacggcggccccatataataggggaacacaccagaggatgcccagcagtcgcgaagggccaccggacgccaagatgacaggcctaacacctccacgatgctaaaaccaccgcacgaccacacaccgaaagagggacacacgagggtcccacgcggcaagaacagagatagacaaacgacggcaaccaccaacaaccaaacggagcacaccactaaccagacaagcaggtacacaagcaacaacaacacccacagagccgacaaaccgaccggcagagcgacaccacacacacacgagcagcacaaaaacgcggcacccccgaatagcaagaggcaaaacagtgcggcgggcacaacacacccccacacatgccacaaaaacagagcaccaaccaggcaacccacgccgacgcgaggggacggccagacgacgcagccacgagaagccacacacggactggcacaaaaacacgacgccacacgcacacaacacgacacacacggacccactcagccaacgaagaccacaaccgaaaccgtagagcaacacattactcatcactacgagcacgacagaggccgacacccgacgccccaccagcaaccaatagagaaaacgaacagcgcgagcgagaagacaacaccgcgaagaaagtcgaacgactccacacatccacactccacacccaaacgagccacacggtcgaataatcacaccacaaccaggcagagacacgacacacgacctagacctataccgccagatccgaacgcan

SEQ ID NO: 662810 - DNA, 250 bp, Homo sapiens
cctggtcctggtctccatcttgaccgggttggcccacttccgtccagccagcctctgccccgtacatccctctcactcctggcaggagatccttcaggccagatgcccctccctggctcagatctttcatcggatatccttagctctccctctctctgttttcctgcccctccctctcggttgccatttcctctgccactcagaaacacctgagctcatgctgtttcctggcttagagactaagctgagg

SEQ ID NO: 662811 - DNA, 687 bp, Homo sapiens
  misc_feature (138)..(138): n is a, c, g, or t
  misc_feature (153)..(153): n is a, c, g, or t
  misc_feature (167)..(167): n is a, c, g, or t
  misc_feature (251)..(251): n is a, c, g, or t
  misc_feature (292)..(292): n is a, c, g, or t
agacagcgaaagcgcgaagagactgcaagctagatgggcatgtatggcagctacagcatgtgagtgacccccttccccagagtccgcgatgaaaataaagttacacttgtcaataaccagatgtgggagatggagagncctttggcataaccnataaccgagctagngcgtggcagagcggtcacgcctggacataaatagaaaatataagttagtataactttaaaaactttttgtacaaatatacatgntttttttattttttccttttttttccttttttctttttttngcactgagtttcagcagagattaaacattttatataaatgactcttaaagctttacaccttgggaccagtgtaccttctcgtgcagaatacatttagatataaaaagacgttattaatacattgcacagttttcaaaatttaaaaacaaaaccgaacgctgctctccgcagccgccgccggttgctgctacatgaacggtcccagccgagcccagcgcccttccaacgtccgctgcccggcagttccctcggggctctttggctctaaattgctcaccgcagcctcttgcgcggggtctgctccaccgagccccagccaggggcggcgcttggagagggacacggcgcgggacatcgcccgacgacttctcaggcgctgatctcttgcgcttggc

SEQ ID NO: 662812 - DNA, 247 bp, Homo sapiens
cgtccaaagctggccgggcgctggtggccacttttcacaaagaagtgtatgtgtgtgtttacaaacttgtcataatatcattccattcagagctgttcacttttgtctcagcccaacaacacaccattacctgtcatggaccagaggggtccctagagaattgcgaaacttgttatcatccacatgtattccaaggtatctcagttatacatactgtaccacttacttgagctgagagactaactga

SEQ ID NO: 662813 - DNA, 330 bp, Homo sapiens
  misc_feature (138)..(138): n is a, c, g, or t
  misc_feature (153)..(153): n is a, c, g, or t
  misc_feature (167)..(167): n is a, c, g, or t
agacagcgaaagcgcgaagagactgcaagctagatgggcatgtatggcagctacagcatgtgagtgacccccttccccagagtccgcgatgaaaataaagttacacttgtcaataaccagatgtgggagatggagagncctttggcataaccnataaccgagctagngcgtggcagagcggtcacgcctggacataaatagaaaatataagttaatacaacccggtaaaccttttgtaggaaatcaatcaatagagttagtctcttttttcctgttttttattcttttttcaatggtgttgcagttatatgcaggaatactctgtacgtc

SEQ ID NO: 662814 - DNA, 690 bp, Homo sapiens
  misc_feature (346)..(346): n is a, c, g, or t
gcaggcgcagcccagcctcgaaatgcagaaagacgccggagagttcgtggacctgtatgtgccgcggacatgctccgctaacaatcgcatcatcggtgccaatggacgcaagctacttcatccagatgaacagtcgccgatgttgatcaggtcacagtgcatgttgcatagaggtcagcttaaaacattatgtatatctgcggggacatatacgtgaggactgggtgagtcacggatgattccattctccgtacttgggcaatggccgatgagatcgtctcataagcagacgtgatgactggcaccgagcaatcaacagcagtgtcggcgaaatcatgaggtgcantaacactacacaataaatgaagaatcctactgcagagacacaacagacaactgatagtacctggcgcaggatatctaatggtgcggagtggaggctagtaacatacgagagttgacattgactgcgtacctcaacgtgggcgctttaaaggagaagcctaccccttgaactcgccgtcatcgcatccagtggagacacatcagctagtggcaccgaaatactggaacggcggtaactaaccccttgtggcacggtagtatccgcaaagtaagacagttcctcaataagagacccgatcgatcgatcgaggcagtgtaagagaacatcccgttgcaattgaacgc

SEQ ID NO: 662815 - DNA, 780 bp, Homo sapiens
agcagctggttctgggagttaaaggagcatgggaaggcccaaaacccgtctcccttgagtggccaacccagactggtcggctggttttccccattattcatctatgattatcaagtgggagtcttatacctatgacactctccatctctggcattagcaggatggtgctgtggcaggctggctttgtgaaccaaatagtgacgctggggcgggaggaaggggcaggaggaagggttgaggttactatggggcgagtcccttccccttcagagaggcttctatccttcccagggaggaggcgccgcatgagacccttctgctgagagctctgaccctcccctcatcacctggcctgtgcagaaacgctcatgcacacctgtgctgcacaggtgtgcacgcaataaccattcgcgtgtacgtacccatgtgccccgtgaaagcatgatgtggctgcagacgtgtccacatgggaccattgcgaacctgaggttagaaacacctggccaggcgcaccgtggcgagattcacagcacaaaagacctcaccaccacacctgcactcaccccacctagcatgcacctcgcctacctgactggcggaatacacagcagagacaagaacaggggataatagaaacaagagatagccacaagcgacacccccaaagacaccaacggcacatacagaactgatggaaaccaaccaaggactagcaccagagcaccaagcatgacagaaatagagcaaaccggacagcctaaacaagagctgacacgacaa

SEQ ID NO: 662816 - DNA, 141 bp, Homo sapiens
aagattttgatgatttttgttttttggtttttaaaaaggaaaaaaaatataccaactttggcttttgtggctttgtgaaggtttctttaaaatgggcattcccttttgcttgctctttagtaaatgtttttcttccgggga

SEQ ID NO: 662817 - DNA, 303 bp, Homo sapiens
gaaaaacaaaaacccccccccccacccgggtttttaaaagaaacagaaatggccccgggaaatttgcctctgtcccaacatttcacccggggggagggggaagggggggggggggggaacccccccgttcttttttttaaagggggggggtgtttccttttgggttgttttgggccccccccccggggggggggggtgggggtcaaccccttttggccggttatgattttgaacatttgacttgacccccaagggaatttttttccggggggcccaaaaaaaaggaaaatttttccccgggga

SEQ ID NO: 662818 - DNA, 113 bp, Homo sapiens
tagaatacaagcagcttttgcccgtcaggtgccatcgttgttttgtgtggccacggagaagtccccacctcaggctcctgggggccagaggcagctgtggcgtgatggatgct

SEQ ID NO: 662819 - DNA, 935 bp, Homo sapiens
aagatgactaaggacgatcacgaagctggagaaagaaagcaaccatgataccggagtaccggtgggagagcagcaagcatagggcgcactgtattgagatggcatgagggagaaaacagctccggtgatcacatgaagcatggagggccatgcatggtaacaatccaacggcctgggagaagcctgtgccgggcatgtgcatgacaagagcgcaattgactctgaacaaggagggtacacggagctgagtgctggtggccacgggctccctcacgtgacagtggccctgagaagtgatggccagagggtgccgtggtgggctcaagggcatcgccagactcgcacccagggatcacacgaaagcgtccttgactatcgcgcaggacgacaaccagaaggcacaggaagcagtacaggaccagatctggaggccatcgacgaggcccacctcccgaccaagggccgtaagagaagctctaggttgataaggagtcattgcatggagaaaaggcgacgccgtgcactgacccaagcgcaagggcctgtggccccactaaataaatggctccgcatttgcgtagacgtcaacgctccatgtgctttgacacggccaatgcgacttgttcctcgacaccttgtggacttggagacaatcattgggactccattgtggcagaattgtttgggatctaaatgtaaggtattgcaagggtaaatcactagtcagccgatagaggggacaatttttggcaaagcgtcccatttcgcaaaagtgcaattttaatataccttgattaaaagtgggtacaagttgaggagtatggcaatttaggagggaatcggggaggattgtggtaccgaagaattggaaagttcagctggagattcagtacaatggttgacgcttggaaaggaaggtcatttgaacaacggcg

SEQ ID NO: 662820 - DNA, 847 bp, Homo sapiens
gcagggctcgacagcgactgcagtgcccgaaggcatgcacaccctgcaaaaagtagcctttgtcccctgtccctgttccccccaccccttccctaaatctggaccttggcacctgcataggaagagccttggacccttccagttgctgtaaagcaacacctaccccggatctctggcttcagccgccaggtgcgcagtggcagccctgggtgccctttcccttctggaggaagcacaatgcctcagggacggggaagcagtgatgcggatgggccaaatgcccgggacctctacttgaccagttctactggcgaggctggacgaactaaggaaacacctgtacatagtgtccgctgccctgactcccgcttagcacacccttaggcaggcgccccttccacctttccccgagaccgtcgtcgctggcacggggcagggtccagcccgcctggcatcggtggctgtgcacctgatgggcattctgggcactgggctactccgtacaccgctctctcttgcttggcttacctgtgcagacgtgcgcttctcttcctctggtcccttctggcggactctgtttacccatttcttgctgctgtgtcctcaccagttccttgcacggattccttcgactctacatgcccttgaatctagctaacgccttgcagaccccagtgggtgctgtcctcgcgtctcttcctgccaatgcctgaatcattgttccatctcccaccctctgcccacttggccccttcgagcttgctgcctcaatcctggtcagcttgcaccgccacggtgacacgagagctctcgaaccggcccgagccaacgtgctcactgcctctgc

SEQ ID NO: 662821 - DNA, 756 bp, Homo sapiens
gatgcctgacgcatctgtctgaggatgcggtcagtgacgcgatggacgcgcggcagagggatctgcttacacctgagacgaactacagaacatgcacgtaccagaggtggaagtccaagtcaaatcgcggaaggactgcctcgactgagctaaacaagatgtgtcagttgtacccgaggcgtgctcagacagacagcaagtaccatgtgggtggatttccaggctgaactgaggcaggcattcttagctgagaacaccaagaggtggttaagagccatattggagtagcgaggaatctgattccataggcaatagagagctcgaggcttccgatcgtactctttgatagctgtctgcccacagcttgcacttgtttctacggagaacctgcgtctactacctttatctatagccttcccctaggtcttcagaagcatcaagtttgaagctgtggacattggatttggtggaacaggaactcatgactgttggcaagagtagcaagatgctgcagcaacattgactatagaatgacgatgtatccgtgcgaagatggccgaatcttcattggcacctttaaggctttgagacaagcatactgaattcggatcctctgtgcacttcgtgatgagttcacgaacagatcagagccaagagcactgctgagggccacccagagcgtgaagcaaaagccgagtgccgggtctggtgttggcctgcgtggggagaacttggactccatgactgcggaacggg

SEQ ID NO: 662822 - DNA, 214 bp, Homo sapiens
  misc_feature (71)..(71): n is a, c, g, or t
  misc_feature (78)..(78): n is a, c, g, or t
ccccccccggctccccctttttttaagccccgggcctgcctttaactcacacttggggggtttgccctccngggcctnagggccagcctcctcccccccccctccccccatgggggggtcaccctttttccttttggggcaaaagaacatttttaaaaaaaactccttttggcccagggtgaataaagttagtgtgttgtctgggcccccccca

SEQ ID NO: 662823 - DNA, 436 bp, Homo sapiens
atgacatgatacgaatcgagctggtacccccgtatagcctgatgggttgaccctcactcctctgtgctgggttctgccgggtggagacgtcctcattcccagatggggtggcagcctgggtggaggggctctcacttctcagatggggctggttgccaggtggagggtctcctcagttctcagatggggctggcggggcagagacgctcctcacctcccagatgtggtcgtggcctgggctgaggtgctcctcatatcccagatggggctgggtggcagaggtgctccccatatctcagacgctgggcagcctgggcagagatgctcctcacttcctagatgggatggctggcctgggcagagaccctcctcactttccaggacttgggcaagccatggcacgaggggctcctcacttggtcgggctagtcgcggg

SEQ ID NO: 662824 - DNA, 191 bp, Homo sapiens
gcctactactactaaattcgcggccgcgtcgacacgtggatcagaaattatttttaagatgtactagccaggtgtggtggtcatacctataatcctagtagtttgggaggcccgagtgagaggatggcctgagctcaggagtttgagaccatcctggctaacacggcaaaaccctgtctctactaaaaata

SEQ ID NO: 662825 - DNA, 299 bp, Homo sapiens
gaatcaaaagaaaatcaagatgagggcggtgacacaggcctactacctcagcactttgggaggccgaggtgggtggatcacctgaggtcaggagttcgagaccatccttgccaacatggggaaaccccgtctctactaaaaatacaaaaattagctgtgcatggtggtgggcgcctgtaatcccagctacttaggaggctgaggcaggagaatcacttgaacccagtaggtggaggttgcagtgagccgagattgtgccattgcactccagcctgggcgacagaatgagactccatctc

SEQ ID NO: 662826 - DNA, 183 bp, Homo sapiens
agctgcattgctgggttcttggagactcgtcccacaatgatcgaaagagatccagtgggcgaggtcactagaacggggattctagtattctagtatcctcacatccacagcttatacatactggtggtagttcctcacctccaggcggggttgcgtgaattaaaacagtcaccgggctatgca

SEQ ID NO: 662827 - DNA, 309 bp, Homo sapiens
cccctgccccgggcccggttttcaggggttttattccctttcaccccccccatttgttggcaggacaaaacatgttttccaaaccccccagtttcccccaggaataccccccttgttttggggggaaaggaaccaaaaaaagcatattttcgggggggattgggcccccttaattgggtttttagtctttaaggggcccccttaccccccccaaaagggggcccaaaaaaggggcccgcgttccaaatttattttggcaaagggacaaagtccccttttccctttccaaaaaaagggttttctttttta

SEQ ID NO: 662828 - DNA, 127 bp, Homo sapiens
ttcaccatcaaatagtcatggctttgcacagcaaggctgtgggatccagcatgctgccaggcaatgctcaggatgtggattgggttgcatgccgcattgtcaactcattcatgcagtccgtcagttg

SEQ ID NO: 662829 - DNA, 237 bp, Homo sapiens
agcggtcttgaccgatggacgcagacaggaagagagaagccacgcgcttccaaaggagccgggcggctggccggggagggccgtggcataaggcactagtacgatccgtcttgctgatacctccctgagggggacgcgaagctcaggtccacagggctgaggcccagctcctccctccaacagcctatccttttcacaggtccaagggaagagaccaactgacttctagtttaaagg

SEQ ID NO: 662830 - DNA, 137 bp, Homo sapiens
ggatctcggaagcacactgctacatgaggcgaggtgtgaagatggcttgagacaggagtcgaggctgcaccagtagctgggactataagcatgtgtcaccgtgcctggctaattttttgctgttgcgggttgttgtg

SEQ ID NO: 662831 - DNA, 289 bp, Homo sapiens
gtgtccatcccccttcgtgtgtccatcccccttcgtgattattttaaatagacaaaagacctcatattactttacttgtcacatttcaacatctttcctcagcttattagctctatttcttttctgtctgtaaatggttgttgtggttttgttctttgagacagggtcttgctctgtcatccggctggctaaatggaagactagagttttattattactcaaatcagcctccatgaaagttgaaggctaggggttttcaaagatagttcggcacgaagggtgatggaca

SEQ ID NO: 662832 - DNA, 195 bp, Homo sapiens
accatcaggatttctcagatctgaaacatcctgcagatcagctggtagacaatcccacagcagtacttgatttgattccttctgctttttagattttttttaaacagagaacaaagggattcactcagagatcagaatccgaagcttcctctcagcatcatgggaggagataaacataattcattctctggttgt

SEQ ID NO: 662833 - DNA, 1455 bp, Homo sapiens
ttctctccctggcggccgcttttttttgtggggggccctctctcccctgttggtggggccccccgccgctgactagattggtggtgtgtctggcccccacgttgttttccccgcaagggggtgtttgtgcaccctcctgatttgttttgtccccgcgcgggtggcatctctcttgggtggtgcccccctgtctcacgggaggcgcgtggtggcacctcccctagttggacatgtttgggggtgggcgggtgtcgccccacccgccgctgttgttgcccccccgttggggggctcccctccgtcctctagtgattttgtcggccgcccttgtgtgtgggcccccccccccctgggggagtgcgtgtgttgttgtgtgccccctgtggcccccccccttctctggggggcacccccctgtgtggcccacccgggtgtttcttttttggccaccccttcctggggggaccccagagggccaccccagggctcccaaggagccccgcagttggggcccaagacttttgtcccagacattgtccccgcccgcgattgtgtgtcccagcgcgtcccccaggggaggggggggtacccccccggtgtacactcttctgtgcacccccccagttctttgtggagaaagttgtgagagcgggtggggggcgctctcaatgggcgcccccggtcgccccccgtgcgcccccccgggtgttgtcttgctgtgcgtcttcgcccccacgacttgtgttttttctctctctcttggctctctcccctctgcctcccccccgagaagaccgggtgtggcgccgtcttttggggcccccacacagaggcctctcccacggcgcctcggggagtctctgaagatgtgtgcgccccccacgccccccccccagtgtgtgtgagtttgtgtgagtgtcccaccccgcgtgtcggggtgtgttggacgctcttgctctcccactctgtctcacctgtggagcgcccccccgagaggtctctagagtggggggtgaccacacacgtgtgtggtgtttataggtgtctccccgcagagggctctgagagggagatctcctcgtgatcccgcgagtgtttccccgcgggtaagaatgtgggaggcccgcgagattgtggaccctcgcgcttctggcccagcctggaccaccaccgaggccccccgtgagaggaggatatatggtataggggggttgtaaagaaattcccctcgtcccccctcccccaatcccggccccgcgcccccctttggcttggagacaccattcccacacccccccccccccccctatagaactccccattctccccaaccctctttttcccccccccccccccctggaacttccctcttgtcccccttgaaaaatacccctgttttcccgactttcccctactccctccccccccattaaaggtgttcccccttttaaaaaa

SEQ ID NO: 662834 - DNA, 235 bp, Homo sapiens
gtcgacgcgatctggctgcgacatctgtcaccccattgatcgccagggttgattcggctgatctggctgggctaggcgggtggtccccttcctccctcaccgctccatgtgcgtccctcccgaagctgcgcgctcggtcgaagaggacgaccatccccgatagaggaggaccggtcttcggtcaagggtatacgagtagctgcgctcccctgctagaacctccaacaagctctca

SEQ ID NO: 662835 - DNA, 133 bp, Homo sapiens
tcatctcctattcccctactcagtacatggtacttccacaaccatgatcccatcttctcttacgtacagacacccctttccacaacaccaacaactatcacctacccttctgtggtgctctaccggatttcct

SEQ ID NO: 662836 - DNA, 531 bp, Homo sapiens
gccgagtagtggagtctaaggactcgtgacaatcttcgggtgccttcgagagacaaggggaggatgccactgagtcatcctcttcaatgccactatccttcccatctctcttaccctacagtaccacacaatactaacccttcccctcctctgatgtcttaatcacctccaggagatgaagtgtatctcactgttgccaatgtcaggtccccaggtgaagttcctaaggaccgtagctaaggcaggcagaaaattacaaccacgtgatagtcgagcagttatgtgtctgggcagacgacaccttctacttgagtgcagctacatcttggatcagggtcgagctggtgagcaggagcgccggattgtcgacagtgcgtccggagccagactcgtgcacagttcacaagctggtgtacagtgtagatgtagctccgccacgagaacctagtgggctagcttaagtactatgtccaacgcgggtcaccgcgccgccgaggttaaggcgcccttgtttacacccattggcgcatt

SEQ ID NO: 662837 - DNA, 420 bp, Homo sapiens
caggacctgattggtcgatcactgtactatatgcctgtttatcaatctactgagcaattgtggtatttttttaatctactttttttttttaagaggtgagggtcttgctatattgctcaggctgacatcaaactcctggactcaagcactctttctgcctcagcctcctcagtagctgggtattatggtatgtgtacatatatacttttagagacagggtctcgttctgttgtccaggctggactacagtggtataatcatggctcactgcagcctccaacacctgggctcaagcaatcctcccacctcagcctcctgagtagctagggactacaggcgtgtgccaccatgcctaatctctttttttttttttttgggagagagagtctcgctctgtcacccaggggggagtacagggat

SEQ ID NO: 662838 - DNA, 587 bp, Homo sapiens
tgcgaggctgcattcagctatgattgtgccatcacacttcaatctggtctacaaagcaagaccttgcctcttaaaaatattatacataaaataaataataaaataggaaaacaaacattattcatcctactacctaaacttctattacattattggtaattaccttgactttttttttttttttttttgtaattcacaaagcatttatgtaacacttttctttttgttaaacctgattttcatgaaggtaatttattcaaaacagagtcttgtgccagcatagaggttttcttctcattgttccctgcactaactacttatttgaaggagtctagctagaataatataccaatgtagttaggttttcaggacatctgtggtgaagcataacagaaatttgcagactggcagttcaagggagcagaggtggatttcttagtgtttgaaggctcttgaggagaaacccacagtataatagaatagggcttactggttgggacttattctgttgcctagtcttgagaaatgtctgcctcctagttttttcctctcttggtggtcctaacctaagtactatgtgaattgct

SEQ ID NO: 662839 - DNA, 246 bp, Homo sapiens
gtgatctgtctgcctcggcctcccaaagtgctgggattacaggtgtgagccaccacacccggccattacagtgctttttttgagacagagtttcgctcttgttgcccaggctggagtgcaatggcctgatcttggctcactgcaacctctgcctcccgagttcaaccgattctcctgcctaagcctcccaaagtgctgggattgcaggcatagcactcacctgccgatgtgcccaagtcatgtaaa

SEQ ID NO: 662840 - DNA, 221 bp, Homo sapiens
  misc_feature (168)..(168): n is a, c, g, or t
ctagaggatcccgcgtggtactgcagatgcatagttgcaaaattttctgtcatttggtaattgtctgccctggttgtttattttgctatgaaaaagctcttaaatccaatttgtccatttttgcttttgttacacattgcttttgggtgtcttcactccatgtgaaantcttttggccagttcctatgtcagaatggtattgctaagtatcttcaggattt

SEQ ID NO: 662841 - DNA, 834 bp, Homo sapiens
  misc_feature (602)..(602): n is a, c, g, or t
  misc_feature (642)..(642): n is a, c, g, or t
  misc_feature (650)..(650): n is a, c, g, or t
  misc_feature (663)..(663): n is a, c, g, or t
  misc_feature (686)..(686): n is a, c, g, or t
ggccattctaatcgcaatggcattcgggggggcttaccgaacgaaaaattctaagctataatacaagctacgcaaagtgccccaatcgttgtaggtccccctacgggactacttatcaacccgttcgctgacgtccttaaaatctcttcactcaaagatgcccgctaaatagtccgccgaaactctacctgggggggggtctcacatcacgctggctcctgaccttgtatgcgtctcgaccagtcagctcgttcgtactgatgatagccctcccttccccaattatgcctagactcctgcttgggtctagaccctcagaatcgtagtgccctccatagttgtcattcgtatgctcagcgctcttagccctacgcctcgattatatcctcaatgtccctcgtgactcaagggatgacgacatttcagaatcatcagaaacttacctggcccctgtaggtctggtcgacaacttgtcggaccgcccacaggtacgtcccatatgtcacacgtctcagtagtgatagagatcaactccgtaggcgccatttcgatgtcctaacgtgaataccaacccaaattgacctcatattagaagattgagnctaccctcttgttagagcacattccgtgcccgagctcccngttcaatntcgagctatagcnaccgaatagaagatcaaaccttnacattgaattttaacccttcccattgacgcaattcaatcgtaagctcccctattgtgacccctatttacacttattgccatgtcttcaatcgtaacaccaaacaacataagaccagagaggaaccgaagcccagaaaaaccaccacat

SEQ ID NO: 662842 - DNA, 420 bp, Homo sapiens
  misc_feature (1)..(1): n is a, c, g, or t
ngggatccactcccccagaggctgttcagaatgaagatctgactcttttagttaaggaaatggaacagggtcacagtgatctggagaagatgcaagacctttattctgagtccttgatcatggactggtggtacaatgcagaaaaggatggagacagcaagcatcaaaaggaaatctgttctatgatttcaaccccagaaaagtgtgcaaagcctcaatctgatgtcgattcaacacaaacttcatctctgaatatgttgaagggaccatggggcctttcagatcaaaaggttcagaaaaagaaagtccttcacgcagaatcaaccaaaaccagcctgctcagaagccagatgtcctccctcaggagctcagcttgcagtgaaaggaaggatggcctctccaatgccagcagccggagac

SEQ ID NO: 662843 - DNA, 468 bp, Homo sapiens
tgacttggggccacacttaatcaacaatatgatctgaacgagcttttggttcaaaacattccccccttatgtcgctttttgcacgaacaacaagtgtcgtaaaaaccatgtcgatgtgatgaacagaacaacaaataaaacagaaaagccgacgaacaactgaggaaccgatctaattaaagtcgggatcactcgcaaaagactaagcataacactaaagacagaagacgaaagtgaaacgataaaaatgccaataggagacaacgccatcaagcttagcaataacactatgagagaagcaaaaacgaaccacgacaccttagtgcgtgaagcactcttttccgttttatccgcacgaatgacggcaagaacgttttcttcaaaactttgcggaacttcaacacattgataaactaacgaaatgttattttttattgtaaccatgttttccatcagcaattgacattg

SEQ ID NO: 662844 - DNA, 172 bp, Homo sapiens
  misc_feature (78)..(78): n is a, c, g, or t
  misc_feature (113)..(113): n is a, c, g, or t
  misc_feature (137)..(138): n is a, c, g, or t
accgtccttcactggggactggccttctcgggggttgcttcttccttcactggggacttggccttctcaggcggactntgcttcttccttcactggggacttggccttctcanggggactttgcttccttctccctnngtggaaaacgtacggggactccgtctagagtcga

SEQ ID NO: 662845 - DNA, 415 bp, Homo sapiens
ccgtttttagcgaccgggtatcttatagcaccgtgggtatcagttttttctacagcggctcaggccaagtagacataaagctcttgatgggatttttttttaagacagaatttcgctcttgttgcccaggctggagtacaatggtgcgatctctgcaacctccgcctcccgggttcaagcaattctcctgcctcagcctcccgagtagctgggattacagacatgtgacaccatgctcggctaatttttgtatttatagtagagacagggtttctccatgttgatcaggctggtctcgaacccctgacctcaggtgatccgcccgccttggcctcccaaagccgggattacaggtgtgagccacgtgcccggccagttttctacttctttacctcctgcggtaccacggtgctat

SEQ ID NO: 662846 - DNA, 403 bp, Homo sapiens
  misc_feature (11)..(11): n is a, c, g, or t
gaaaatagaanttatcttcagaattgtcagcatacatttttgtctgggttttatatttgtctttgctagaaatgttgaagtgtcagcatttggcatagaagattataaagctattaacccagccaaaacaaaatggccttagtttatgtggcttctttgacaaatgagactaatttaatattgttagctaaatcttctgggttattggcaaaaacacctatgtatttaactgtgaggttcttatttaggtgaacacataatgttcattggctattaaaaatggttaacaaagacatttggcttaaaatctctattttctctgatacagtatttgatttaaagcccctttttttctttaagccaattaattagagcacttttacatgtttccagtagtgaaacc

SEQ ID NO: 662847 - DNA, 925 bp, Homo sapiens
gaaaatttagaggaatcaccagttcagtatgctgcgtatgtaacctgtgggaggcatcacctctgttataaagctgatgttgcaggactttcttttggtcttggtgaggtttgaatgtgaaggcaacttctcataaaattcccatgttcttctccttgggctatttttcaaaacaagggcccaacacaaaaacagattgatgctgcctcatacacgctgacattcttgtggtcaaggatacagccaaggcacttgtacagataagagcaaacaaatatcaacaattgtgtcctcaggtgaaaggacccagaggttggctatgtggtacccccatagctatggttcaggcagccatgactcttctaagtgatgcttctcatctgcctaaggcgggcggggtcttcacacctgagcagtttttttccaaaacaaagttgatgtgacagactcaacaaaacaccgattttcacgaatgagctgcaggtctaatgggggaggcggcgtcccagtctgtgttgcagcacgcatctcatcggggtgcgcacaccatcgttactgtcgggcagtaacttggccggttggctttgccggcaagtagaagggaaaatctcaactttcctttccagatagtagcttggcgctttagtaaatttaaactggcgtttttggcaaacaagcacacaacacacaaaacacacacatttgtggggcgtccggcccagagaagagttaacaactcttgtgggggcgggcagggagaatagaaaatggccaagtgtgtcaaagaactgggcagcatgtggggtcacacaaaaaaccgggggccgggtgtgaaaccagagtctgtacggtcacggacgtcacccccccgcggggggaggaagaaggaacaacaagaaacaggacggaacaagggcaacagact

SEQ ID NO: 662848 - DNA, 901 bp, Homo sapiens
caacgattttttttcccccagaggaaatttggcggccgcttgagtttttttctgcacaaatcacaaccgggtgttttgttgttatcgatattatcaacaaacgagggtgtcttcctctcgtattgtcggatatactcatgcaggtagtttttatatatcagcatatcgaggttgtggttcggagtcagaccgccccccgccgtcgacaacaacgtagtgggtgttctttccagtgcgactgtcgaccggctttctctctcttgtcgatacaaaccaaatattttgggtaggctcgatactcaccgtgtgtgtgatgtaccaaacacatgatacatagtaattttcctggccggcgcgattgaagattcagtcactattattgtaaagaatgttttacgccacaaaatattgtttagtactagcgaggcaggagcaccccacccccaccccctcttgcgggtaggtgggaggaagatcatcgctcccccacgcgcgcgaagcggaagctctcttctgcgttagagaatacctcactccactcaggcggagtctttcctctctcattttttttttgtgataacacgaggcttgttttgagtgctctctgtgacctcctgcggagggcctccccctgctatgaatagaagtcctctccccctctttttttggtcctccctgttggctcccccccccgctgctctttcccccccctctggtgcagtcttttcctcgcgcccttatttgggccctgcacctcgaccatctcctatttggggggggctccccccatttttgtttccccccccgcggcgggaaatttttttttttttttgtgttttttttgggccccccccccccgtttgtttttttgggggaaaaaaacacaaattttttttttgga

SEQ ID NO: 662849 - DNA, 149 bp, Homo sapiens
atcgcccgctggccaatggcaggggtttatattgccattgttgtgatgaaattgatggccctaatgatagaggagacacctgctaggtgtaaggagaagatggttaggtctacgtgaggctccagaggtgaggagtagttcccatgcta

SEQ ID NO: 662850 - DNA, 259 bp, Homo sapiens
gggagctcaccacatcaaacacagcctgcaggcgactaggcggaattagccactaatgactccaggagaaacatgaggacggaggatgtcccagaacccaaacgtgtcttacatgatattcacaaaagacactactatctcaactatctctaaaatccacatgcatacctggataggacagagcctaccctaccacactcctgaggactgggaatctccggctatgccacaccagattgaaacatccaaccataaggca

SEQ ID NO: 662851 - DNA, 330 bp, Homo sapiens
gagcactagaagatgccttggccacacagcataagaattctgcgaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaa

SEQ ID NO: 662852 - DNA, 990 bp, Homo sapiens
  misc_feature (157)..(157): n is a, c, g, or t
  misc_feature (774)..(774): n is a, c, g, or t
ataacacacaggtcctcatttgtgctgtgtgttgtttgtggggcgaccgcgcagacatcacaatgtgttcttggcggtgtttcttcgtgaggaagttctgcgccggcaatgttgtctccagaagacagagcgctgggttgtcacattaatgatgggnggacgttgttgtccagacccacgccgcagacccgtgcgcgatgtgtgttgtctgacccgatgttgcccctgttgatggcccgccctcacccaggggcctgtgctgttatcaatattgactctctcgtgtggcatcggccttctggtaatctggtactggtagggatcgcaccaagtgtccgtcgcctcaaggccccctcttttgttaatctcacccctctcctgggcgagtgggtcttgtagagccctcccctgttgcgagttgcctcaccacataagatgccccctcgccttgctcatcttttactctagttgcgccgagcgggccgatgattccacgcccccgtggcctcactcttccatcttagagtgcgagggcgactcatcttgttacgccacacgctattgacaggttttccgtgctcgcaccataacacagacacagacgaggggctcacaagagggggaaaaccacaacactccaagtttccgccccgccggtgcttctcagaacgccgccgctcatcggttgtcaacgaatccctctctcgcgccccactcggcgtgttcgtagagcatattactagtttcctgcgaggtcgttgcagcgctacggcncacctctccgcgctctctcactagatagctccctcgccgtgagcaatgatatctctcctggcgaccacatcgggcgttgcacggacgtttctcagcacgcgtgtattcgtgttatttcatgtgtttacatgcggtctttgtcgtcaccaggcagaacaatcaccgaacaatagatcatatatcgccctttattgcggcccatcaatagtcacaaaa

SEQ ID NO: 662853 - DNA, 279 bp, Homo sapiens
tccccgggcttgcgctctcaagtaagaacaggacaagccttgctatccgcttctagtcatccacagtctcagttacttctccttttccctgtcctgggcttatggtgttagcttctgtatatggaatcagtgaggaagttctgtattaccgcctcatttaataaccactgttaaattcatagctaagcagattctgatactttcaggcaggttactttggggattgagatttttccaaaaagaaccattttcggatgcagccgtctatgggctgaaata

SEQ ID NO: 662854 - DNA, 370 bp, Homo sapiens
ccactgcagtccgcagtccggcctgggcgacagagcgagactccgtctcaaaaaaaaaaaaaaaaaaagggggaaaaattgggggaggtggtttttgccccccaaaatttaaatttttatttagggggacaggataaaggtaaaaggggcccaattttcaacacacaggttcgaaggaaagactgacctagggaggctagaaaaacccttggggagaaataaaaggcccctgctgggtttatctcacagcctcaagagaggacccacataaatgctcctgaggacaaatacttgatctccatgggggggggggcccaaggagcccttgtttataatctctcacactcacaatactggttaaaacaggggg

SEQ ID NO: 662855 - DNA, 458 bp, Homo sapiens
cttgaatgaatcactgggaagccagccatggtaagggctggtgaggttggggagaaaggaagagctttatgtttctctgttgtttggaccctacttggcatgaaaaaggaagctcagttccagccccttggatcaacgaaaatcagaggattctggaaaggcagccaacttgcgcctcttagaaggatcagaggcaagatgagatggcagcctgcagagtaaatgcttgaaaaaagaggggtgattttcaatggtttgcttaagtcactggtttcttaaaccccaaattactggtttggaaccgtgttaaatggttggggacccaggtgccatttaaaacatttggaatatggaaaggcagtctcatccggagtgatttgagtagaaccactgatgatgattttataaatggtgtgaagcgattttcccattgggcaacaattcactgatttgccgtg

SEQ ID NO: 662856 - DNA, 502 bp, Homo sapiens
ttcctgcatgacaaagagaaagttcacgagtacaatcgtcctgctggtagaccctgagcaggaccggaagaaatccatcgaggaacgtcattatgcccctacggacctagaggcggacatcgaatgggtcagccgtcctgtcactaggcagggcacacggtagactgtaacggagaagctgggcagcatcaaccagggcctggaccgcctgcgcagggtcagccacgcgagggactgacgagcactggagtgctgagttcgagtggagccctagggtgattgaccatgtgcgggacctgggcgccagtgccggccaaaactctacgggtactaaagggagcctgggaggggcgttccgggggagagagctcaagatcatcgttcgaagtcgcgaaagtccgaggaagtgctcataccatgtaaccgagaaggcagtcgtgggagaattggcgacacgaaaaaaggctgagaggcacgcagagagtcgatgggcgacggcgta

SEQ ID NO: 662857 - DNA, 947 bp, Homo sapiens
  misc_feature (147)..(147): n is a, c, g, or t
  misc_feature (149)..(149): n is a, c, g, or t
  misc_feature (156)..(156): n is a, c, g, or t
  misc_feature (195)..(195): n is a, c, g, or t
  misc_feature (252)..(252): n is a, c, g, or t
  misc_feature (259)..(259): n is a, c, g, or t
  misc_feature (275)..(275): n is a, c, g, or t
  misc_feature (283)..(283): n is a, c, g, or t
  misc_feature (287)..(287): n is a, c, g, or t
  misc_feature (292)..(292): n is a, c, g, or t
  misc_feature (296)..(296): n is a, c, g, or t
  misc_feature (302)..(302): n is a, c, g, or t
  misc_feature (314)..(314): n is a, c, g, or t
  misc_feature (325)..(325): n is a, c, g, or t
  misc_feature (343)..(343): n is a, c, g, or t
  misc_feature (347)..(347): n is a, c, g, or t
  misc_feature (357)..(357): n is a, c, g, or t
  misc_feature (360)..(360): n is a, c, g, or t
  misc_feature (363)..(363): n is a, c, g, or t
  misc_feature (365)..(365): n is a, c, g, or t
  misc_feature (367)..(367): n is a, c, g, or t
  misc_feature (388)..(388): n is a, c, g, or t
  misc_feature (391)..(392): n is a, c, g, or t
  misc_feature (427)..(427): n is a, c, g, or t
  misc_feature (441)..(441): n is a, c, g, or t
  misc_feature (454)..(454): n is a, c, g, or t
  misc_feature (461)..(461): n is a, c, g, or t
  misc_feature (466)..(466): n is a, c, g, or t
  misc_feature (468)..(468): n is a, c, g, or t
  misc_feature (471)..(471): n is a, c, g, or t
  misc_feature (473)..(473): n is a, c, g, or t
  misc_feature (508)..(508): n is a, c, g, or t
  misc_feature (513)..(513): n is a, c, g, or t
  misc_feature (520)..(520): n is a, c, g, or t
  misc_feature (547)..(547): n is a, c, g, or t
  misc_feature (558)..(559): n is a, c, g, or t
  misc_feature (591)..(591): n is a, c, g, or t
  misc_feature (842)..(842): n is a, c, g, or t
  misc_feature (909)..(909): n is a, c, g, or t
cgcagggggtgtgcgaggctgagtccaagagatagcaaatcgagtcttaaataatccggggagaaagacgcccgggtagatttgaggtgcagccttggagggagggattagaagccgctagactttttttcctcccctctcagtagnanggagtcngaattaattggatttcattcactggggaggaacaaaaantatctgggcagcttcattgagagagattcattgacactaagagccagcggctgcagntgggtgnagagagaacctccggntttacttntgtntcgtntgcnccaacngctagcctcggnttgggtaaggngagggggaattaaacggnggtnggagaggggnagnttngngnggggtgcgctcggcctatggntgnnccgaggggcgtctggtaggcaccccgccctctccngcaggtcgagcccnatgatagataagnttagaantgtgntnttngngtcggaaatggcgatcagcaagacggtggcgtggntcaangagcagntggagctgggcaaggagcggctgctgntgatggactgnngggcgcagagctatacgagtgcgtcgcacatngagtcgggcagtcaacgtggccatcccgggcatcatgctgcggcgcctgcagaagggtaacctgccggtgcgcgcgctcttcacgcgcggcgaggaccgggaccgcttcacccggcgctgtggcaccgacacagtggtgctctacgacgagagcagcagcgactggaacgagaatacgggcggcgagtcgttgctcgggctgctgctcaagaagctcaaggacgagggctgccgggcgttctacctggaangtggcttcagtaagttccaagccgagttcttcctgcattgcgagaccaatctagacggctcgtgtanagcagctcgccgccgttgccagtgctgggggtcggggg

SEQ ID NO: 662858 - DNA, 181 bp, Homo sapiens
cccctctggaatgcaaaggtgtctcaattacaaatttggctcctgtaggagtctcagaaaattaacagaagaaaatatacccccctctccaaaagaagtatgacacacgcattttgaagaaaccccaatgtttcatgcaataggtaggcaagatgtaataagcccacccaaattcacacat

SEQ ID NO: 662859 - DNA, 561 bp, Homo sapiens
  misc_feature (272)..(272): n is a, c, g, or t
  misc_feature (506)..(506): n is a, c, g, or t
cgagatgaaatcatacgatccgtccttccacgtccttcatttagcagaatgcatttaagattcatccatgttcttgtatgaatcaatatttgttctggctgtgtttccacgtttttggcaacttatcacgtaggtcctttaaagaatattttcattaacaggtttttctatgacatatacggtttttaagttcccctgggtaaataccgtgggactgtgactaggtgggctatattggtaagtgcactgtttagtttttataacgaaactgnccaaactcttttctaaagttgactgtaccacttttgcatttgctccagcaaggtacgagagttctggttgctccaaatccctgccaacacttggtattcagtttttttttcttttgttggacattttaataaggcgtgtagttgtatctcattgtagtagcttatatggcagaggtttaaggtaattcatttataactaatgtccaggctgtatatattttttaaagtatgatngccataatagctcttcaggctattcacaaaggggggtactgtggtccatatgact

SEQ ID NO: 662860 - DNA, 660 bp, Homo sapiens
  misc_feature (651)..(651): n is a, c, g, or t
atgcattctgtacattatgtcaagggcagttttctacaacatagctttccgatagcaagtgtttacgatgaataaacttaaaagtactcgactgtggaggtaatcgtaccatctatatcgacctcaaatagacttttaaatgcatctgttcctctaaagttagatgtgaaaatttcttcatttcccgcaatatctgcaatattacttgcttcttttctaactccgaagatgtcacaaagtgatattgaaagaagagttttcttgaacaactcattcgttaacaattcatttagcagagtatggattcggtcttggatatcaggactcttaagtagatccaaaagaatgttggataactggctgttataagatacttgtattagtttgagttttctttctggcccccatgttgtatatcttttccataggttttgatcgtctaagatatctattagttgctctatttcatcagaagataaacaatccaaactgttaactcttaggttaacaccattactacttagctctttgatatttgcaaaagagttaattgagcgatctgagagtaatagggttatgttatttggtagaattgaagtgaagtgttcgagaaactcggtctggtcactaatgtcgtcaataacagcaggnaccactcgg

SEQ ID NO: 662861 - DNA, 1001 bp, Homo sapiens
  misc_feature (1001)..(1001): n is a, c, g, or t
aactgcggtatccgcgatgcgtgtcctgggagctacattcctgttcctgctgcgcagctccggtggccagagtcgaaccggtgcgtttcaagtgattgcggtctgtggatggagttctaatgggacttgaatgtgagtccagtgagccaccggccaatgcctgtctcagagtgacgatgacaggaacaactgtatactacgatgctctaccaaagttcaatctgtcacacgatgcaactatcacaaagctatgatagcgagcaaggctggtgggtgcgtggcatctctgatggagaagttggcagagtccacttttgcactggtgccatgaaagcatggagtggtcccgtaagaagtggaaatccactgtgctatctaatgatagacgacctatagttacctgaataaacttagcggtgcaagaagtgatctatccctgctatataccgcatggtgtgctggagggcgcactctcctggaatgattacacaccaaagtgtctccgtgtctgtaagggttccagtagccatatcgttgctgatgtcgtaaggtgcctcatggagttcggggcgtctgggcaactgagtctgctgatcactcgtgacagtacctaccacctccgctgaattcaattcaccggcgcactggcgctccagtggaatccacagccgagccgtcgcagaaggcgggccggtcacacacaccagacgccagaggagctggtccccaaggggtggccacggcagcataagcgggcctacgagagtcagacaagtcgcccctgggtgcccacctgcatataccacacaactgactgcgggcctcttagcctggaaaacctggccagagcaccgtgtggtgagacacagacaacaagacgtgcgctcggccaaacaaaaaccgggcgcgagaagcgagtttgcctacacgccagcacaccacccacggaaacaacgtagagaagaggacagaaaggaacacagcagcagagcacaaagagn

SEQ ID NO: 662862 - DNA, 208 bp, Homo sapiens
ttttaaagggggcccccctttaacccttacttttttttaggtgaaggggaacccttttttaaatatgatgaaacccctggcccccgaagggagggggatttccgaaatccccccttttttttttttaaatccccccatgggaaaatcccccgaaatttgtcctttggccaaatttccgggccctttttttttttaccttttgccttta

SEQ ID NO: 662863 - DNA, 1104 bp, Homo sapiens
cgggtgagtctgggtcgtggctgctgccgggtctgcgcgctccggactgagggtggctgtccctgggcctggacggcggtgtcccggctgtggcgggaagccggcactggagcgggatgcgcactggtgcgcgggacctgggaggctgcagggacctggactggctccctgatgtctgcccagcctgactgtgtacctgagatggtgcgtgcgcccctccgagcatgagcctgtccctggccactcccctgggatcttgacttggctcttgctgtgtcgctgtggcacctgttgaatgccctggggtgttgctgtggctccgtcctgtgtaggcgccctttccctggctgtcctggcttggggtggtggtggcagttgactccagcccctgcctctcccttggagaggagggctccactcgctccttcggcctcctcccctggtggccgcagctgactcgttgccggcttcctgcttccctgcctgcctggcggtcccgctgtgctagaagaagtcttcacttcccaggagagccaaagcgtgtcttggccctatgtgtgaaaagaactggctgtgacctaatgccctgacctggaagggcccatgccttgggctgacatggcatgatccagagcactgaccgtccggtgctgacccacctgcaggtggcatctctatcggcatgggctcatgggactgcggacaagtgggatcttgggtggaagctacctgtggtggtcaaaagatgcttcccacgactcgggattgggacgccctactccccctatcatacacggtcatctgatagattgatagagtacaagaggaaaacatagagtacatgcatgatagggtagacccatccaggatggaagagctgtgacccctagcaaaggactaacacatcgttacccaaatacatagttagtcgaagatggcatttggaatttgacagagaaaagatacgataattgacatataacaaaacgaacacatatgttcacccaaattgagataaccagtgagaaactagtgaacaatctaaaactctggcactagaatagacactcgacatgaagatgcatcaatttacaactacactgc

SEQ ID NO: 662864 - DNA, 437 bp, Homo sapiens
gcaacaacaaaaaatgaacatgaagctgggacctcatgttacagttcgtcacgcctgtaatcccagaactttaggaggctgaggtgggaggatcgcttgagcccgggagcttgagaccagcctgggcaacataatgagacctcatgtctaaaaaaaaattttttaaaaggccagacgcagtggctcatgcctgtaatcccagcactttgggaggccgaggagggtggatcacgaggtcagaagttcaagaccagcctagccaagatggtgaaaccccatttctactaaaaatacaaacattagccaggtgtggtggtgggtgcctgtaatcccagctactcgggaggcagagaatcacttgaacccaaaaggcagacattgcagtgagccaagattgcacccttacacttcagcctgggcgaccgagactccgtctc

SEQ ID NO: 662865 - DNA, 140 bp, Homo sapiens
ggtcgctctcgagatcccctaactctgtactcttgcgcatcaatgtaagtcacttattaacccagcaatcggattttggttttcagtgtgaacttcttgggggtgctgtctgcttaaattaatatttttcgttaacaggc

SEQ ID NO: 662866 - DNA, 158 bp, Homo sapiens
  misc_feature (23)..(23): n is a, c, g, or t
  misc_feature (28)..(28): n is a, c, g, or t
  misc_feature (60)..(60): n is a, c, g, or t
ggggggggggggggggggggggngcccnttctttcacccaattttgtttaaaaaaaattncgggggcccccgggcagctggaaaaaggagtcaggatgttgccccccaaagaccagaaagaaaagggggccggagacaaaaaaaaaaagggggggttt

SEQ ID NO: 662867 - DNA, 529 bp, Homo sapiens
tctgaggcagctgggaaatatgacagttggggctggaaaagagttggtgtagcttcagaggtgtgaaaggaccacaagagatggggtgttaggtttcctttgtttctttcttttttttttggaaacagagtcgttctgtcgcccaggttggattgcagtggcgtgatctcagctcaccgcaacctccacctcctaggtccaagtgatcctcctgcctcagcctcccaagtagctgggactacagggtgcccgccaccatgcccgactaattttggtattttaagtagagaccaaggtttcaccatgtgggccaagtgggtctcgaacctcctgacctcaggtgatctgcccgcctcggcctcccaaaaagtgctgcgataacaggcggtgagccaccgtgcccgggcctgaaaggacagtcataagggaacaaaagaccataatctggaactcacgtcttatggagcactaacttggcacaggccccattgcttatagtaccgtgtttaatcctcataataagctcatg

SEQ ID NO: 662868 - DNA, 115 bp, Homo sapiens
  misc_feature (17)..(17): n is a, c, g, or t
  misc_feature (79)..(80): n is a, c, g, or t
  misc_feature (111)..(111): n is a, c, g, or t
ggctccgaggcggcggnggcgactccctctttccctccctcctcctccgtccgcccgtccgtccgcgcgacagcccgtnnttaaaaaaccgttccgaagcaaggccggcgnctgt

SEQ ID NO: 662869 - DNA, 174 bp, Homo sapiens
gttccttcttagttctccttttcttctccttctccttcttctcttccttcttagttcttcttcctcctctccttcttctcttcttcttctccttcttcttccttttcttcttttcttcttctcctttcttcttccttcctcttcttcctcctctcccccttctgtcgtcttctc

SEQ ID NO: 662870 - DNA, 1745 bp, Homo sapiens
  misc_feature (619)..(619): n is a, c, g, or t
  misc_feature (1401)..(1401): n is a, c, g, or t
tttttttcacagggtttataaaaacccccttttttggttggaaaaaaatggtgtaaatgggctctcggtttgggacacccgtgtgtttattttttaatgagaaaaactatgtagaaagacctccttataaattcttctcccccatgtgttttctgtggtgtgtgtggtgctttattaaacaaccccccatatatttcaagtgtggaggggagaattttcacaaacattttaacgtgaaaacaaatatgtgaaaaatatatctttcctctctcagagagcaagctctctgtgcctattgttgtgcgcacaaaacacttttgtgtggaaagagagagataatataaacacacaccactctcgcgcagggtgtgtggacaccgtgtgtgaacagcgttttatttacccacacctatatatgtgtgcgcgcgcatgtgtgtgtatcatagacacaccacgagttgcgcgccacgacgtgtgtgcgcgccgtgtgaatgatgtgtgtgtgtggcgcacacaacaatacccacacaccacagacacgacgtctctatatacgctcacgacgccgcgcacagaatatatattatatatgagtgtggaacatttttatatacacccncctgagtgagaaacacactgtgtgtgtttatagacatttctgtgtgtatatacgagtatactctatacacagaacagtgtgtgtaccgcgcctgtgaacacaaatattacaacatgtaatgatcgtcgttttataaaacacacatttattttaagcgcggcgccccatcttcatatgaggtgcgccaatatgtaataaccaccggctcctactgatttatacacaagacacctgctccttatattctgatggtggaggtgtaaaagcaacaacagatggtggtgttgtctcattcttttaaaaaaaacaatcttgttgttctaataaaattaaagaacaactctttctctgttggtggtaaaaccacactcatgaggcggcgcgagtgagccccccctgttgggataaacacagcacaaaagaggcgtcaacacaggccgttgtgatctgtttaaaaaccacgtggtcgtgttggcgcacgacccctttttctaataagcgtggtgggggagcgagggggcacacgcaccaacaatcattagatacattatatcgcggcttatttatcaagcacaaaggttattccccccccatgatggtgggggcacaaccacacttatccggcggtgtggccttattaacaaccaccatcagtgactcgttaaatcaacccgacattaataatactgcatgtggtacagacaagaagagagtacgacacacaccctgtgtgtatttgtgtgtggcgcacaaaacactacggtcggttgtgatgagaaacnaccacacttcgttctcggggggagaaaaataataccaaaatgctcctttaaacaataataacaaatgaggggggagggggcgcacacaaacacaagacgccagtcaatgtcatgttgatcgtactgttggtcgcacgccagaaagaaacatctcatgccatccaaggagacgaacaacaagatgtagttcgccgcggcgcctacaaacaaatcaacttggtggcgcaacacatagtatgtgaacgcaaccacgtctgtttgtattccgcagcaagtatgaatgattgacgtgacaacaaggaaaaaaattgtagtcgtcggtgaagtcgaagcatgcacatcac

SEQ ID NO: 662871 - DNA, 284 bp, Homo sapiens
cccgaaaccctgaattacggtgacacacagaccctctgtgagaagagaggcgagggatgggcccaaagtgggaagctctcaacgtcacccctcaattgttgtagaaggatggctcttcccctgaacgtgtgtcaggctcaacacggtggttcaagaactgtttcccaggaatacacagtctacaatctcattggtaaagaaaatatttgtgctttacagagatgtgagaatttaatgtatttggttttataaatccttgccattccaaaggcgtaattagggtt

SEQ ID NO: 662872 - DNA, 270 bp, Homo sapiens
agatactgatgatgatgtcctgctgcatcgctgtgctgctgctgctcgtgaggggcaacgtctcactctgactcagtacatagtgtgtattagtctgtttcacactgctataaagaagtgcccaagattgcgtcatttataaaggaaagagatataattgactcacagtttctcatggctggggagcagcttaggaacacttagaatcatggtggcacaggggacgcagagaggtttaaccacggtggtaggatcacagtcagggcagca

SEQ ID NO: 662873 - DNA, 209 bp, Homo sapiens
  misc_feature (1)..(1): n is a, c, g, or t
  misc_feature (192)..(192): n is a, c, g, or t
nggctcctaccatgcttttaccgcctccaaatttaacccgcccacaaaatgcccattaacctttctcatgcttttagactgattacggaatataaatagcaaagtcaattttaatgaaattagatcttcgacttcacttcgggttaaggaggcctctttttttcctgctattcgatgaacctgcggtaaaancttgggcgagctcgatt

SEQ ID NO: 662874 - DNA, 123 bp, Homo sapiens
cctgtgttaaattgttctcccctaaacaagcagcagtttcttaaccacgttgaaaccaagactgaagactgaacctgacgaagtttccatagaagacagtgcccagagtgacctcaaagaagt

SEQ ID NO: 662875 - DNA, 101 bp, Homo sapiens
ggatggatagatcagtatcataggttacagctgttacacaggttcgttcttggcgcgacataaaaacaagccaatcacatcgaataaatcatggctttttg

SEQ ID NO: 662876 - DNA, 241 bp, Homo sapiens
gtcgacttcctgatgattctttcctgctactatcctgaactctcagcatttccaattcctttgcctggtttggttccctacagggtggtggcagactagaaatttggctttgtgagaaaaatgccttgccgtttctttctttcgttcttttgttttttgagatggagtctcactcttgtcgcctaggctggagtgcaatggcacagtctaggttcactgcaacttctgcctcccgtcgacg

SEQ ID NO: 662877 - DNA, 177 bp, Homo sapiens
ttttgtttttgtttttttgccccccttcatcaaagcattcattgtagtgtatgggaattgtctttgaaagtaacaacctctcttccctgagggctgggtttgcttgtttcaaaccattttttccttaacacccagggcttggtaaacaaaacctattaataaacatttgttgaatta

SEQ ID NO: 662878 - DNA, 421 bp, Homo sapiens
agcggctttcctttcagcggagcgcggcggcaagatggcagtgcaaatatccaagaagaggaagtttgtcgctgatggcatcttcaaagctgaactgaatgagtttcttactcgggagctggctgaagatggctactctggagttgaggtgcgagttacaccaaccaggacagaaatcattatcttagccaccagaacacagaatgttcttggtgagaagggccggcggattcgggaactgactgctgtagttcagaagaggtttggctttccagagggccagtgtagagctttatgctgaaaaaggtggccactagaggtctgtgtgccatttccccagcagagcttttgcggtaccaactcccaggacggctcgctgcgccgcgtctttcctatcgctgtcccgcacgcccatggggcc

SEQ ID NO: 662879 - DNA, 198 bp, Homo sapiens
  misc_feature (26)..(26): n is a, c, g, or t
  misc_feature (31)..(31): n is a, c, g, or t
  misc_feature (91)..(91): n is a, c, g, or t
  misc_feature (115)..(115): n is a, c, g, or t
  misc_feature (195)..(195): n is a, c, g, or t
aaagtctaatcaaataagatcactanaattnccagaacagctctgaaatactgattgcagattcatttcaaagtagatttaacccccttcnggatctggtgcttacatcatgaangtcttcaccaacttcaactctgaacaatataaaaattttagccagttctggctatagttaaactcgtgccgaattcctgnagc

SEQ ID NO: 662880 - DNA, 2049 bp, Homo sapiens
ggcacgagggaggctccgtgagatggggtccagcccatcccaacacaagggtgcagcttgattcgggagttccccacctcctgcccattctccgcgtccttttaccccatggagagcctcagccatggcaagtccatctggagtccaggaagcaggcaactggcctgacccatgagaccgtttggagaccaagcagcagatgcaggtgtggaccccaggaacctacaggggtgtcagccgctgagccccctccctgctgtgtgggtggtgagcaggctgggtctttgtctgtcttcttctacacggcatgtgcctgcaccagccccaacacctgagctggtttagcgcaaagaagagctctgactctccaggggtgctgggacatcacgtggaattggatcccaggctctcttgggcgagaaagaccattctggaggtgggagtgggagagctgcctgtctgcccacgggctctgcgtctccgcagtgggtggccttggatgcccggcccctccctttctgtgcactggggacgctgatggaggctgaagctgctgttcggaggccctctattggtgcctctctcctgccgtcatcactatggcaggaaaacagagatggtttagtaatgaattatcattcccaaacccgtgtccacctggaacatcaggatgggaccatgtttgaaaatcgggtctttccaaatgtaattaagtaaggcgaggccatactgcatttacaatgggcccaatccagtgtccctatgagagacggaagaggagacacagacacaaagcaggaggccacataaagacagaggcagagactgaagtgatgctgccccaagcccagggatgcctggagtccccaggagctgggagaggcaggaaggaccctcccctagagtctctggagggaactggatacaattgcagagtgcactaaacagttgccccagaaagacatgtcttgttttaaagcccagaacctgaaattattatagattttattcggtaataaggaactttgcatgtgtaattacttaaggatatgaagatgagattgtgctggattattaagcaccctaaatgccatgacaggtgtccttccaagagacagaagaggagacacagacacagagcaggaggacacgtggagacagaggcagactggagtgatgcggccacaagcccagggacacctggagcccccaggagctgggagaggcaggaaggatcctcccctagagcctccagggggaactggaggatgcgtaagagacccagaacttccacagaaggaggaaaattaacctcctgcttctctagactgttccaaagctgaaccctagaaagcaaagctgatacagaagcatccaggctgcaggagtacaggtcgcaagtgctgagcgtgggccttgggtgtgtctcatgggggaaaaaaaactgtgaaaaacctcagagtagcatcttcacagtaacgcacggacgatccctaaactgccttgtaaacaaaaatgagagcttgagtcagaggaagccgagacaatatccttcctcgacaacgtgcgagaaccctgacgtcccccagcaaaggaagacgttgcaagcaggcaaaatgcgtcgatttttttttttgtcagtatgatgatttttgcagccacttggctatggagagcagccgacaccccctcttacagccgtggatgtttcctggaagctgactcagtctgttcactggttgagctttgagtgaaaagataacacaggtctattgactcacacacatgttttaagatggaaaactttacttctgttcttggcaggacatggagagagggagggattccaaaaagtctcagcctccatcaaggcgtggcagctcatgccggtaatctcagcactttgggaggctcaggcgggaggactgattgagtccgggtgttcaagggccaacctaggcaacacagtgagaactcatctctgtaaaaaataaaaataaaacattaaaaaaaacatgagctttgaagtgcacagggaaaaaaaaaaaa

SEQ ID NO: 662881 - DNA, 353 bp, Homo sapiens
atagaagatccctgcccatttactaggaacctggttaagcaagcactaatctcttttcctggagatcaagaatgcatcctcaggttgagaaagaaacagggttccctgggcccattagactgttagcagggcatcgctgcttccccctggcccctcgcaactagcaaaaatcgtctttgtctttgccaattatagagggatttgggtatccacagtgctcccatgcaaggttagactgtcttaatccccagttagacccccagaaatgctcttaaaatgcctgccttaagatgggattgggccttttataatttcattatagtgctaaatatatggttggctttgtacatgaa

SEQ ID NO: 662882 - DNA, 853 bp, Homo sapiens
agcggctttcctttcagcggagcgcggcggcaagatggcagtgcaaatatccaagaagaggaagtttgtcgctgatggcatcttcaaagctgaactgaatgagtttcttactcgggagctggctgaagatggctactctggagttgaggtgcgagttacaccaaccaggacagaaatcattatcttagccaccagaacacagaatgttcttggtgagaagggccggcggattcgggaactgactgctgtagttcagaagaggtttggctttccagagggccagtgtagagctttatgctgaaaaaggtggccactagaggtctgtgtgccattgcccaggcagagtctctgcgttacaaactcctagggagggcttgctgtgcggagggcctgctatggtgtgctgcggttcatcatggagagtggggccaaaggctgcgaggttgtggtgtctgggaaactccgaggacagagggctaaatccatgaagtttgtggatggcctgatgatccacaagcggagaccctgttaactactacgttgacactgctgtgcgccacgtgttgctcagacagggtgtgctgggcatcaaggtgaagatcatgctgccctgggacccaactggtaagattggccctaagaagcccctgcctgaccacgtgagcattgtggaacccaaagatgagatactgcccaaccacccccatctcagaaacagaagggtgggaagccagagccgcctgccatgccccagccagtccccacagcataacagggtttccttggcagctgtattttggagtttggatgttgctttttaaagacccttttattaaattttgtaccaagacca

SEQ ID NO: 662883 - DNA, 887 bp, Homo sapiens
agcggctttcctttcagcggagcgcggcggcaagatggcagtgcaaatatccaagaagaggaagtttgtcgctgatggcatcttcaaagctgaactgaatgagtttcttactcgggagctggctgaagatggctactctggagttgaggtgcgagttacaccaaccaggacagaaatcattatcttagccaccagaacacagaatgttcttggtgagaagggccggcggattcgggaactgactgctgtagttcagaagaggtttggctttccagagggccagtgtagagctttatgctgaaaaaggtggccactagaggtctgtgtgccattgcccaggcagagtctctgcgttacaaactcctagggagggcttgctgtgcggagggcctgctatggtgtgctgcggttcatcatggagagtggggccaaaggctgcgaggttgtggtgtctgggaaactccgaggacagagggctaaatccatgaagtttgtggatggcctgatgatccacaagcggagaccctgttaactactacgttgacactgctgtgcgccacgtgttgctcagacagggtgtgctgggcatcaaggtgaagatcatgctgccctgggacccaactggtaagattggccctaagaagcccctgcctgaccacgtgagcattgtggaacccaaagatgagatactgcccaaccacccccatctcagaaacagaagggtgggaagccagagccgcctgccatgccccagccagtccccacagcataacagggtttccttggcagctgtattttggagtttggatgttgctttttaaagacccttttattaaattttgtaccaagaccaaaaaaaaacacaaaactcgagactagttcctctc

SEQ ID NO: 662884 - DNA, 871 bp, Homo sapiens
  misc_feature (207)..(207): n is a, c, g, or t
  misc_feature (215)..(215): n is a, c, g, or t
agcgggtcccgcgcgtcggcggccgcggagcagcgcagggagccaggcgggctgccggcgggtgtgaagaaaaaaatgacactccaatgggctgcagtggcaacctttctttatgccgaaataggactcattttaatcttctgcctaccttatattcctcctcagagatggcagaagattttttcatttaatgtctggggtaaaatngcaacttntttggaacaaggctttccttaccattatcatcctattgattgttctatttctagatgctgtgagagagtaaggaaatatcctcagatacataccatagagaagagctccaccagcagacctgatgccgtatgaacgacacacagatgaaactaacaggtctcaaagaaatcttaacataactggataaccctatagagcaggctcagtcccgagacgtctggttacgctacatgactcacactggcaacaagaacagtcacaaacaaaggtgcactccagaactccagacagacaaagtactaacaagggctgccaaaacaattccatggaacgaacacgaacaaaactaacacaaggataggcaaacagcccacggctcacaggaatgcacgacactgcgcacacgggaacggcccgaacaacctcaaccaacctacgctaagacaggaacccagggacgacagaatggaagacacaatgacacggacacgcggacagcaactacaccagtgaccgacccgaactaagggcacaacaaacagacgacatgcgggaaatgggcacactggacaagaactgcaccaaacagcaacaagaagacagagcagacccacgaagagtagaggcacagcaacacagcggaacaacgaacaaa

SEQ ID NO: 662885 - DNA, 314 bp, Homo sapiens
gaagtctcccatatgtcgaactgcaggcggcgcaaatacactagtagataacagagccaacaagcagtaggcagtgaccatgactgcagaagagcagaggacagactccgatcatggggacagacaggctctgtaagctaactcctcactggtcatggcttagcatggaacctccccaaagtccttagtaaacaaagacactcgcaaaaacccaagtaaactactattaaaactactgatggataacggggagcttatccaatagctaaagaactgagaaactagttgctctagaactgctattctgactcgat

SEQ ID NO: 662886 - DNA, 221 bp, Homo sapiens
  misc_feature (19)..(19): n is a, c, g, or t
  misc_feature (169)..(169): n is a, c, g, or t
  misc_feature (197)..(197): n is a, c, g, or t
caaatatctaatgtaaatnacgagttgatgggtgcagcaaactaacatggcacatgcatacctatgtaacaaacctgcatgttgtgcacatgtaccctagaacttaaagttttaaaaaaaagttaattttgtatatgtatacattaattaggcatgtatgtggtatagngttgttaaaaaaattcaaatataatttncacaacataacatttgttttcata

SEQ ID NO: 662887 - DNA, 303 bp, Homo sapiens
ttatcagcaccagccgccatggccaagcctgattgttccagctccaaagattaaggaaggggcaggggtgggggaaggggttgggttgggctttttttttcagtggagcttaggaaacgttcccattcccaggggccattgagggcccagcagggttgaggggttgaaaaaccgtagccatagatcctgtccccctccactcccctttgaccctcaggttttcccagtttcctccccttgttacagcctttgccctggtttgggttatgtcagatccaaaaacatcctgaacctttgtttgta

SEQ ID NO: 662888 - DNA, 854 bp, Homo sapiens
agcggctttcctttcagcggagcgcggcggcaagatggcagtgcaaatatccaagaagaggaagtttgtcgctgatggcatcttcaaagctgaactgaatgagtttcttactcgggagctggctgaagatggctactctggagttgaggtgcgagttacaccaaccaggacagaaatcattatcttagccaccagaacacagaatgttcttggtgagaagggccggcggattcgggaactgactgctgtagttcagaagaggtttggctttccagagggccagtgtagagctttatgctgaaaaaggtggccactagaggtctgtgtgccattgcccaggcagagtctctgcgttacaaactcctagggagggcttgctgtgcggagggcctgctatggtgtgctgcggttcatcatggagagtggggccaaaggctgcgaggttgtggtgtctgggaaactccgaggacagagggctaaatccatgaagtttgtggatggcctgatgatccacaagcggagaccctgttaactactacgttgacactgctgtgcgccacgtgttgctcagacagggtgtgctgggcatcaaggtgaagatcatgctgccctgggacccaactggtaagattggccctaagaagcccctgcctgaccacgtgagcattgtggaacccaaagatgagatactgcccaaccacccccatctcagaaacagaagggtgggaagccagagccgcctgccatgccccagccagtccccacagcatgtacgacggtctgcgcggcggagcagcctttcgttagtctgggcgctggtgtttacgcccggcgcattggactatgcgctgagc

SEQ ID NO: 662889 - DNA, 826 bp, Homo sapiens
  misc_feature (207)..(207): n is a, c, g, or t
  misc_feature (215)..(215): n is a, c, g, or t
agcgggtcccgcgcgtcggcggccgcggagcagcgcagggagccaggcgggctgccggcgggtgtgaagaaaaaaatgacactccaatgggctgcagtggcaacctttctttatgccgaaataggactcattttaatcttctgcctaccttatattcctcctcagagatggcagaagattttttcatttaatgtctggggtaaaatngcaacttntttggaacaaggctttccttaccattatcatcctattgattgttctatttctagagtttcgagacgtgtggttacgctgtattactcacactggcaaaaagagactgtcaaacaaaggtgtaacttaaaaggtcaagcagaaaaatactaacaaggttgccaaaaaatttatggaagaaaaggaaaaactaaaaggggattttgaaacagccagtggtaacacgatgaagaatgtgttttgaagcaggacaaataaaaaaagtatgtagaagaccaggagaaacttgaaaagtgaagttagaggaagacttcagatgccctttctaaggcacaaaaattgatgtgatggaaatggaagattgcagtcagagagaactttcgcaaacgaattttgatcagttcctgaaagaacactctgaacttcaaggatcgtcagaaaagaggcacccgaaaagactggacttttataaaagaacctgcaaaatctgggtcacactgctactcggtatgtaggctccagaaatttagtcagaaatgcctagacggtgcgattttaaggcccactagctgctggacggctacacaatttgggggtccgtattgccctcgtc

SEQ ID NO: 662890 - DNA, 127 bp, Homo sapiens
ctcaggaggttgacaccgatgaggagaaccaggacgaagaggaaaccaccaacagtcgccttgcccacatcagaacgcttgcgagcacgcttcgagtagatcgacgcaccctcgatcccaataaaca

SEQ ID NO: 662891 - DNA, 131 bp, Homo sapiens
aatcctcctgctgctagcgtctaccttagctccggagggcagcagcttctttgactcaaccagaggaggaacagaagctgcagccagagctgcagcttaaaagtccctggagagcaaggctctgatgagga

SEQ ID NO: 662892 - DNA, 872 bp, Homo sapiens
  misc_feature (17)..(17): n is a, c, g, or t
  misc_feature (26)..(26): n is a, c, g, or t
tcattgtggtacccccncggggttanttgtgatatcgtctgatccacggccgtcgggcagtgcaaatatccaagaagaggaagtttgtcgctgatggcatcttcaaagctgaactgaatgagtttcttactcgggagctggctgaagatggctactctggagttgaggtgcgagttacaccaaccaggacagaaatcattatcttagccaccagaacacagaatgttcttggtgagaagggccggcggattcgggaactgactgctgtagttcagaagaggtttggctttccagagggccagtgtagagctttatgctgaaaaaggtggccactagaggtctgtgtgccattgcccaggcagagtctctgcgttacaaactcctagggagggcttgctgtgcggagggcctgctatggtgtgctgcggttcatcatggagagtggggccaaaggctgcgaggttgtggtgtctgggaaactccgaggacagagggctaaatccatgaagtttgtggatggcctgatgatccacaagcggagaccctgttaactactacgttgacactgctgtgcgccacgtgttgctcagacagggtgtgctgggcatcaaggtgaagatcatgctgccctgggacccaactggtaagattggccctaagaagcccctgcctgaccacgtgagcattgtggaacccaaagatgagatactgcccaaccacccccatctcagaaacagaagggtgggaagccagagccgcctgccatgccccagccagtccccacagcataacagggtttccttggcagctgtattttggagtttggatgttgctttttaaagacccttttattaaattttgtaccaagacca

SEQ ID NO: 662893 - DNA, 460 bp, Homo sapiens
ttaattgaagcccagtgtatttagggaaaatgaagaaggcaagtaggatccgtacacttgtccatggcttaacaccgactaaaacaaaaaaccgatgactacgctaacacccttgattctctttatatcctacggaaaacagggtgcaaggctatgaacggggagggggtccgcctacagccagggggactagcagtaacaagacttttacggtgctacacaaaacaagcctccttatggccagacacccagcacctttggtgggccgggggggcctaatgggtaacagctgctaggggcaactttgaagactcgagccagtgtttcacgagctccacacgtgccgtttgtttcttgattagaagatgcctctgacaaagcgcgcaatatgcgaatgtaaggtgaacgctccagcatcaaactcttatggaacgcttggtgaaccaccaaccagcgcaga

SEQ ID NO: 662894 - DNA, 199 bp, Homo sapiens
tgtagagaagagcctcatagggatgacaaaagtgaaagtagggaaggaagattcttcttctgcagaatttcttgaaagacggagggccgctttaggaaaggtaccttcagaggattgtaaatcatcctaccatgtacaggaccctgacgtcagagagttcttggaaaaagaagagctgccacgtgccgtggggtaggag

SEQ ID NO: 662895 - DNA, 858 bp, Homo sapiens
accaccaagtatagcaggcggtccggatgttagttcagtacacggggctgcgtattcaatgaaaatgacatgggccgtggctacaattacaaagctgaactgaatgagtttcttactcgggagctggctgaagatggctactctggagttgaggtgcgagttacaccaaccaggacagaaatcattatcttagccaccagaacacagaatgttcttggtgagaagggccggcggattcgggaactgactgctgtagttcagaagaggtttggctttccagagggccagtgtagagctttatgctgaaaaaggtggccactagaggtctgtgtgccattgcccaggcagagtctctgcgttacaaactcctagggagggcttgctgtgcggagggcctgctatggtgtgctgcggttcatcatggagagtggggccaaaggctgcgaggttgtggtgtctgggaaactccgaggacagagggctaaatccatgaagtttgtggatggcctgatgatccacaagcggagaccctgttaactactacgttgacactgctgtgcgccacgtgttgctcagacagggtgtgctgggcatcaaggtgaagatcatgctgccctgggacccaactggtaagattggccctaagaagcccctgcctgaccacgtgagcattgtggaacccaaagatgagatactgcccaaccacccccatctcagaaacagaagggtgggaagccagagccgcctgccatgccccagccagtccccacagcataacagggtttccttggcagctgtattttggagtttggatgttgctttttaaagacccttttattaaattttgtaccaagacca

SEQ ID NO: 662896 - DNA, 984 bp, Homo sapiens
  misc_feature (279)..(280): n is a, c, g, or t
  misc_feature (285)..(285): n is a, c, g, or t
  misc_feature (289)..(289): n is a, c, g, or t
  misc_feature (291)..(291): n is a, c, g, or t
  misc_feature (296)..(296): n is a, c, g, or t
  misc_feature (299)..(299): n is a, c, g, or t
  misc_feature (311)..(311): n is a, c, g, or t
  misc_feature (313)..(313): n is a, c, g, or t
  misc_feature (319)..(319): n is a, c, g, or t
  misc_feature (321)..(323): n is a, c, g, or t
  misc_feature (326)..(326): n is a, c, g, or t
  misc_feature (334)..(335): n is a, c, g, or t
  misc_feature (340)..(340): n is a, c, g, or t
  misc_feature (342)..(342): n is a, c, g, or t
  misc_feature (345)..(345): n is a, c, g, or t
  misc_feature (348)..(348): n is a, c, g, or t
  misc_feature (360)..(360): n is a, c, g, or t
  misc_feature (366)..(366): n is a, c, g, or t
  misc_feature (372)..(372): n is a, c, g, or t
  misc_feature (378)..(378): n is a, c, g, or t
  misc_feature (389)..(390): n is a, c, g, or t
  misc_feature (396)..(396): n is a, c, g, or t
  misc_feature (410)..(410): n is a, c, g, or t
  misc_feature (422)..(422): n is a, c, g, or t
  misc_feature (428)..(428): n is a, c, g, or t
  misc_feature (444)..(445): n is a, c, g, or t
  misc_feature (795)..(795): n is a, c, g, or t
  misc_feature (821)..(821): n is a, c, g, or t
  misc_feature (837)..(837): n is a, c, g, or t
  misc_feature (851)..(851): n is a, c, g, or t
  misc_feature (854)..(854): n is a, c, g, or t
  misc_feature (856)..(859): n is a, c, g, or t
  misc_feature (861)..(861): n is a, c, g, or t
  misc_feature (863)..(867): n is a, c, g, or t
  misc_feature (873)..(873): n is a, c, g, or t
  misc_feature (875)..(875): n is a, c, g, or t
  misc_feature (917)..(917): n is a, c, g, or t
  misc_feature (953)..(953): n is a, c, g, or t
agcggctttcctttcagcggagcgcggcggcaagatggcagtgcaaatatccaagaagaggaagtttgtcgctgatggcatcttcaaagctgaactgaatgagtttcttactcgggagctggctgaagatggctactctggagttgaggtgcgagttacaccaaccaggacagaaatcattatcttagccaccagaacacagaatgttcttggtgagaagggccggcggattcgggaactgactgctgtagttcagaagaggtttggctttccagaagnnaatanaaancntaatncanaaaaggatggcnanaaaaanannntanacaattanncaggnanagncantacataacaaanaccaangagggnatgcanaacggagggcnnacaatngagtacagcggaanaacaaggagaanagggcnaaaggcatgcaaaganntacgaggttgtggtgtctgggaaactccgaggacagagggctaaatccatgaagtttgtggatggcctgatgatccacaagcggagaccctgttaactactacgttgacactgctgtgcgccacgtgttgctcagacagggtgtgctgggcatcaaggtgaagatcatgctgccctgggacccaactggtaagattggccctaagaagcccctgcctgaccacgtgagcattgtggaacccaaagatgagatactgcccaaccacccccatctcagaaacagaagggtgggaagccagagccgcctgccatgccccagccagtccccacagcataacaggtatgtttgcnagggcaggggcctcttggggcataanagggtccttccgagtntttctgtaaatacntanannnnanannnnngaaaananttggtgaataaaatttcatttatttgctttatgtgggagatncaagttgaaacctggggtctatttacccttggttcnaatggacaggtgtgccttattctttcagaaa

SEQ ID NO: 662897 - DNA, 1792 bp, Homo sapiens
  misc_feature (451)..(451): n is a, c, g, or t
agcggctttcctttcagcggagcgcggcggcaagatggcagtgcaaatatccaagaagaggaagtttgtcgctgatggcatcttcaaagctgaactgaatgagtttcttactcgggagctggctgaagatggctactctggagttgaggtgcgagttacaccaaccaggacagaaatcattatcttagccaccagaacacagaatgttcttggtgagaagggccggcggattcgggaactgactgctgtagttcagaagaggtttggctttccagagggccagtgtagagctttatgctgaaaaaggtggccactagaggtctgtgttgtagttgcccattatgcccaagtgcaagaaagtctacatagctgatataacaaatctacactaaggagatgtgtggccttgacattgtttgctgtgatgtgtgccttgccataattgtgttgntgcttgctgtgtgttgagaggtagtgtttgggtgccaccggtgagtggtgtgaggaatgggtgcggttgttgtgtttggtgggtgcgtgcttttttgttgccattccaccagccaggatgggggtgacccctccagcctttgtgtttttaaatgggtgctacgtccgttgttttgttgattggtgcggcgtcgttcttggattgattaaataataaggtgttggtgtggggggccacacaccaactttctattaggaaggagcgggttgtttctttgctgatggttggtggcgtcccgtctaccgttctttgtggtgtggcgtcctaccgggtggtccaccgagtaggggtggtactcgttcttgtggtgccggggttttgtcctctctataatactgtttgtctgcttgttatttaggaggatggagaggggccatctgtttggtgctgctggtgtgcgcccgcgtcgatgaagtgtgcgcctgcttccttcggcctggtttattatttttggtggttggtgctgtgcggtctctccgtcaggtgggtgtttcttacatatgccttatgttagggggaagacgaagtatgttttgttggggggccatacaacaacaacagagggtgtgcctttgggctggaagaagtgatgttgtgttttgttgtggtgttgttcttgtgggggggagatagttgtttttgctccagcaagaggagagctacacagtagaggggggtgtttatgattattagctcgtcatctgctgagagtagtggttgtgtggtgtgaggagttgtggggtcatctcttgagtagtgagtggctcagcgcacgcgcggggagagagaccccgctctggtgtgagtagtctagtgtactgtatacgctgtgtgaggacactgctgtgcgctgtgtggtgggcgggccacacggggggtgttgtgtgtctctcagagcacacagcgtgtggtgtgttgctgtgaggggcactggtcacaagtgtgtagaggagttcacttgtgttgcccgctcgggagacgcccacactcgggtgaaagagatttgcgcgccttaaagataagccctctctgcctcgagaccacacggtggagagcactttgtgggagaaccccaaagagatgagagagataactgcccacccaccccccactttcacggaacacagagaagggggggaaagccacagagagccccctgccacatgccccacagccacaggccccacacacgcacataaacagggtttccttggcagctgtattttggagtttggatgttgctttttaaagacccttttattaaattttgtaccaagacca

SEQ ID NO: 662898 - DNA, 972 bp, Homo sapiens
agcggctttcctttcagcggagcgcggcggcaagatggcagtgcaaatatccaagaagaggaagtttgtcgctgatggcatcttcaaagctgaactgaatgagtttcttactcgggagctggctgaagatggctactctggagttgaggtgcgagttacaccaaccaggacagaaatcattatcttagccaccagaacacagaatgttcttggtgagaagggccggcggattcgggaactgactgctgtagttcagaagaggtttggctttccagagggccagtgtagagctttatgctgaaaaaggtggccactagaggtctgtgttcgcccatttggcccgcatgtgcctaggaacgttccattccttggcgtttttaccctaattaacctttccccttaaggggtaggcgtgtccttttagccctaggtttgcccagtgaatgtgtggcccatggacctattagcgttggtgcctgcaggattcaatctatgtgagaagtgagggcacaaaagtgtctgccgaggttgtggtgtctgggaaactccgaggacagagggctaaatccatgaagtttgtggatggcctgatgatccacaagcggagaccctgttaactactacgttgacactgctgtgcgccacgtgttgctcagacagggtgtgctgggcatcaaggtgaagatcatgctgccctgggacccaactggtaagattggccctaagaagcccctgcctgaccacgtgagcattgtggaacccaaagatgagatactgcccaaccacccccatctcagaaacagaagggtgggaagccagagccgcctgccatgccccagccagtccccacagcataacagggtttccttggcagctgtattttggagtttggatgttgctttttaaagacccttttattaaattttgtaccaagaccaaaaaaaaacacaaaactcgagactagttcctctc

SEQ ID NO: 662899 - DNA, 375 bp, Homo sapiens
  misc_feature (374)..(374): n is a, c, g, or t
tcttgtctccttatgtataggaggtgggtgatgctgcagcttgcacatagttgtagtattgccctaagtgacagcctcatgaggtagtgctcgttttataagctgtgcccctggacttctggggaaatatgcaaatgactctgttcttcaccagttgtatgattattaaaacttctttccctgcctactattgctgattatcttagataaaaaaaatggcagcagccatacctgctttaggggactgttgtgaaggatagtttggtctgttattaaatgttgttgttattactattattattattactattactattactgtttattaattttgagaccaagggttcccctgtaacaatcccctggccagcctng

SEQ ID NO: 662900 - DNA, 168 bp, Homo sapiens
cgaggggatgccaaacacattggctgattttttatttttggtagagaccgggttttgccatgttggccaggctggtcttgaactcctgacttcaggtgatccacccacctcagccttccaaagtgcccatatggagatttttaaggtcagaggtataaactgtacata

SEQ ID NO: 662901 - DNA, 1812 bp, Homo sapiens
  misc_feature (471)..(471): n is a, c, g, or t
cacacccgcacgaacaactaggcaggtcgaaggctccgtggttaatcttgctcgagggcagtgcaaatatccaagaagaggaagtttgtcgctgatggcatcttcaaagctgaactgaatgagtttcttactcgggagctggctgaagatggctactctggagttgaggtgcgagttacaccaaccaggacagaaatcattatcttagccaccagaacacagaatgttcttggtgagaagggccggcggattcgggaactgactgctgtagttcagaagaggtttggctttccagagggccagtgtagagctttatgctgaaaaaggtggccactagaggtctgtgttgtagttgcccattatgcccaagtgcaagaaagtctacatagctgatataacaaatctacactaaggagatgtgtggccttgacattgtttgctgtgatgtgtgccttgccataattgtgttgntgcttgctgtgtgttgagaggtagtgtttgggtgccaccggtgagtggtgtgaggaatgggtgcggttgttgtgtttggtgggtgcgtgcttttttgttgccattccaccagccaggatgggggtgacccctccagcctttgtgtttttaaatgggtgctacgtccgttgttttgttgattggtgcggcgtcgttcttggattgattaaataataaggtgttggtgtggggggccacacaccaactttctattaggaaggagcgggttgtttctttgctgatggttggtggcgtcccgtctaccgttctttgtggtgtggcgtcctaccgggtggtccaccgagtaggggtggtactcgttcttgtggtgccggggttttgtcctctctataatactgtttgtctgcttgttatttaggaggatggagaggggccatctgtttggtgctgctggtgtgcgcccgcgtcgatgaagtgtgcgcctgcttccttcggcctggtttattatttttggtggttggtgctgtgcggtctctccgtcaggtgggtgtttcttacatatgccttatgttagggggaagacgaagtatgttttgttggggggccatacaacaacaacagagggtgtgcctttgggctggaagaagtgatgttgtgttttgttgtggtgttgttcttgtgggggggagatagttgtttttgctccagcaagaggagagctacacagtagaggggggtgtttatgattattagctcgtcatctgctgagagtagtggttgtgtggtgtgaggagttgtggggtcatctcttgagtagtgagtggctcagcgcacgcgcggggagagagaccccgctctggtgtgagtagtctagtgtactgtatacgctgtgtgaggacactgctgtgcgctgtgtggtgggcgggccacacggggggtgttgtgtgtctctcagagcacacagcgtgtggtgtgttgctgtgaggggcactggtcacaagtgtgtagaggagttcacttgtgttgcccgctcgggagacgcccacactcgggtgaaagagatttgcgcgccttaaagataagccctctctgcctcgagaccacacggtggagagcactttgtgggagaaccccaaagagatgagagagataactgcccacccaccccccactttcacggaacacagagaagggggggaaagccacagagagccccctgccacatgccccacagccacaggccccacacacgcacataaacagggtttccttggcagctgtattttggagtttggatgttgctttttaaagacccttttattaaattttgtaccaagacca

SEQ ID NO: 662902 - DNA, 462 bp, Homo sapiens
ggtaagaatttggaatcgagtcagcctgcccaagtgcaagtctcagctttgccatttgctggctctgaaagcgtgtagaagctacctaccctctccatgcctcagtttcctggtctgtaaagtgcgattgatagcccctacccttgacacaagtgagagaacacatgtgaggctctttgagcactagcaagtgctcactccctgttagctcaggtttttattagaggctggtaggcagggtagaaggagccatggctttcatggggttcagagcatttcacaccaaaatatgccgctttggcatagtgattattttgagttaaagatacttaaaggccgggagcggtggcttgtgcctgtggtcccagcactttgggaggccgaggtgggtggatcgtgaggtcgggagattgagaccatcctggctatcacggtgggaccccgtctatactaaaaaggcaa

SEQ ID NO: 662903 - DNA, 349 bp, Homo sapiens
ttctttgggccatttgcagccaggccccacgcgcacagctcatggccctgcttcgccagctccacctgtttcgaggctcccagtaggctgcccctgcgggcggcactgcgacttggctgctggcctgcagaagggcagccaaacaggccggcagcggacatctgagggtgaccagctgattagaaagaaaactcaccggcgtgtataggcacacattaagcacacacgttttgaagtaaaaggccctcgcgttggatctcggatctgcagctttccagctgtgcaggctcatttctctgagcctcaatgttcacacctataacacgtggaaatcctgcaagaacacaga

SEQ ID NO: 662904 - DNA, 961 bp, Homo sapiens
  misc_feature (45)..(45): n is a, c, g, or t
  misc_feature (75)..(75): n is a, c, g, or t
  misc_feature (94)..(95): n is a, c, g, or t
  misc_feature (104)..(105): n is a, c, g, or t
  misc_feature (110)..(110): n is a, c, g, or t
  misc_feature (115)..(115): n is a, c, g, or t
  misc_feature (117)..(117): n is a, c, g, or t
  misc_feature (136)..(136): n is a, c, g, or t
  misc_feature (138)..(138): n is a, c, g, or t
  misc_feature (148)..(148): n is a, c, g, or t
  misc_feature (168)..(168): n is a, c, g, or t
  misc_feature (198)..(198): n is a, c, g, or t
  misc_feature (211)..(211): n is a, c, g, or t
  misc_feature (213)..(213): n is a, c, g, or t
  misc_feature (220)..(220): n is a, c, g, or t
  misc_feature (226)..(226): n is a, c, g, or t
  misc_feature (228)..(228): n is a, c, g, or t
  misc_feature (230)..(230): n is a, c, g, or t
  misc_feature (232)..(232): n is a, c, g, or t
  misc_feature (239)..(239): n is a, c, g, or t
  misc_feature (243)..(243): n is a, c, g, or t
  misc_feature (251)..(251): n is a, c, g, or t
  misc_feature (253)..(253): n is a, c, g, or t
  misc_feature (256)..(256): n is a, c, g, or t
  misc_feature (274)..(274): n is a, c, g, or t
  misc_feature (385)..(385): n is a, c, g, or t
  misc_feature (471)..(471): n is a, c, g, or t
  misc_feature (564)..(564): n is a, c, g, or t
  misc_feature (597)..(597): n is a, c, g, or t
  misc_feature (829)..(829): n is a, c, g, or t
ttatctcttcaaataatcgagaattgcgtacaaaaaaaaccttanataaattaagtatatgaatacatttatatntgtaaatgcaaatcgcttnnaattcaaannaattnacagncnatggtgttctgtgccaaananattagctaanaaaggaaactgggtcctatngtttggactttccaaccctgatagacccgnaagacaaaacaantngttcttnttagcntntntntaaatcncatnacactcancnctnacacgttaataccaatanggaacagttaacttcaatacaaggtcaaaatcagcaacaagttctacaatcctatgtgctgatatcagatacaagcttcaaggacaatttcttttcgaaggcttattccantttcgtgaggctagcatgaggtgtgtgcatttgccaggggcaaatttctattctcaattaacccatgtcagcaaatgctacgcatntgtctgagtccgtttagaagcatttgcggtggacgatggaggggccctactcgtcgtactcctgcttgctaatccacatctgctggaaggtgnacagtgaggccaggatggatgccaccgatccanaccgagtacttgcgctctgggggtgcgatgatcttgatcttcatggtgctgggcgccagggcggtgatctccttctgcatcctgtcggcaatgcccggatatatggtggtgctgcccgacagcaccgtgttggcgtacaggtctttgcggatgtccacgtcacacttcatgatggagttgaaggtggtctcgtggatgccgcaagattccatacccaggaaggaaggctggnacacgcctccggacaccggaaccgctcattgccaatggtgatgacctggccatcgggcagctcgtagctcttctccagagaagaggaggatgcggcggtggccatctcctgctcgaagtccagggcgacgta

SEQ ID NO: 662905 - DNA, 105 bp, Homo sapiens
cattatgtatgatatggcctggctgctgtctactacagcgagagatagcctgggctgaaacctcttctacgtcacaggctgcctgtttgtggctgtgcagaactt

SEQ ID NO: 662906 - DNA, 1082 bp, Homo sapiens
  misc_feature (1)..(1): n is a, c, g, or t
ngggcggcgcgcgttgggtgtgttcttcgtgtggtgtcgtttctttcctcgttctggtttgttgtgttgtctcccttcttctttcgttctgttgttcgtcggcccgggtattttcctttctttgctccatgcttgctccaggggtgttcttactaccgtgtgtatgtctttgcactgtatggttccactcctctgcgtgtgtgctggcacctctcgcctttcgtcgggcctgcggtcttgcacgtgcttgcaccccgcgcctggcacaggtgcccaccttctggattttcgcaggctctcggcccttcttgtgccccgagtctgctgacgagcttccccgctgcgtggtccgcctcacctgcccctctctcgtgtgcactctgcttgcccggactcgcacgcctgtccctcgtgtgcgtgcgggtaagtcttcatccggcctaggctcccccggtcctgcacatcacccggtggcatccactactcggcgccctggcccttcccgctgcgctcgagtgcggctggccctctcacccacaaggatcacctgctggagcaccagcgcgcgacacacggggcgagcttcgccctacccctgcacgctctggcgcacaagctgctctcctgctacaacgcacgtcgctcaagataccacgcgtgccggacctcacacggccggagtcgtagcgcgcgtccaccgccgacgcgccggcccggcccaggtagcggcgcaccgagccacacaccctcggaccaccgccaggtcccgagccccaagcagaacagggccgcccgccccccagcccctttgtccgtgagctccccctctcctctcgtccctcatccccaaggacatgggaggacagtgagtaccaggtcaccatatgctgcacgcagtttacccacgggggccccagtggtggtggaggaccgacggacgctggggaaccctttctggtgctgttaatttaccttgacaataaaatggatgaaaccaatcctagcatcggggagcgtgatttgaccgccggccacctcagagggacggtgtagggcccatctagtttacggactagtagctt

SEQ ID NO: 662907 - DNA, 170 bp, Homo sapiens
gatcttatcggttgtgcatcagtgcagggatcttaagtgggtagacacacacgaaggagtttgcagtgggtttacacacacggatcagtttgcagacagatgtgaaggggtatgcagtgggtttgaccactgggtttgcagtgggttacacactgaggagtttgcacaca

SEQ ID NO: 662908 - DNA, 693 bp, Homo sapiens
  misc_feature (328)..(328): n is a, c, g, or t
  misc_feature (361)..(361): n is a, c, g, or t
tatacagcgacggctcgctgtctgcgccggctcgtcgtaggctgacgtgggggctgcatggggcagcgcgtcgcaggtgagcaccttctcgccggtccgagcatcatcctccgtctggaacctggagcatgggctgcgcctggttctctgccagccacagggccttgagattgaggtgggtgagcgcgaacggcagactctgcaggcggttccccgccacgtccagcacgtgcagctctgtcgtgtgggccagctctggtggcaggacggccaggcggttgtccctcaaggagaggacgctgagtgccacacagcccccgatctcggncggcagcgcctcgaggtggttccggtccacgtngaggttggtcagcttagtcagctttcccagggagcggggcagggcctggccaagaagaggaggtcagaggacgctaggggcttgccgggggtgggaaggagatgacagcccctggcaggagggcacagacaccccaggccagctccagccagggtccctcacagcccctggagaccgggacaaggacctgaccacagaagctgtctccaccccacttcgtgccctctgctccccaagctctgcccactaccctcagccttcagtccccaccaccaaaacaccccacgctcatccctgaccctctcccatggtgcctggactgaagctgtctg

SEQ ID NO: 662909 - DNA, 346 bp, Homo sapiens
cggccatctcatgctacagtcgctgcttcttgttaacatagcaattgagttgcctgttaatttacctaccttagctccagattaccctaaacttttcccttcgatataggagaaagaatcagcgaggactcgagaacgtacgactcgagaacgcacgacttgagccatttccaagagctcgatagtaatagggtcaaatcaatgtcctctggtataaaggcgacggcctagctaggtacatacacaagacattgctgtctacggttcacttgaacactaaatcaacaaacgctcggaagagactccgacagttgagcttctatttccgactgtagcatgagtccgc

SEQ ID NO: 662910 - DNA, 170 bp, Homo sapiens
tgtaactacaatcggtagaacctgggaggcataggcttgtagtgaactgcagactgcgccacatgcgacaccagcataagaaacagcgagattccgtctcagaacaaaaaataagtacccattacctacctacctctcctattgtgggtatgctactttaatacctcgtt

SEQ ID NO: 662911 - DNA, 275 bp, Homo sapiens
  misc_feature (2)..(2): n is a, c, g, or t
  misc_feature (51)..(51): n is a, c, g, or t
  misc_feature (92)..(92): n is a, c, g, or t
  misc_feature (103)..(103): n is a, c, g, or t
  misc_feature (178)..(178): n is a, c, g, or t
  misc_feature (189)..(189): n is a, c, g, or t
  misc_feature (234)..(234): n is a, c, g, or t
cncctcggtccccttttaaaaattacttttcagccgggcatggtggctcangccttgtaattccagcactttgggaggctgaggttggaggntcacctgaggncgggagattgagatcagcctgaccaacatgaagaaaccccgtctctactaaaaatacaaaaattagccgggcgtngtggcacatgnctgtaatccagctactcgggtggctgaaacagaaaccaccaacgnctgacctcagggagatgtctaagagcttctggcatgcctca

SEQ ID NO: 662912 - DNA, 1549 bp, Homo sapiens
  misc_feature (306)..(306): n is a, c, g, or t
  misc_feature (313)..(313): n is a, c, g, or t
  misc_feature (669)..(669): n is a, c, g, or t
  misc_feature (804)..(804): n is a, c, g, or t
tcgatcgcaagtagcctagtgccctgtatcttaggtagacctcaatggcctcggatagtgtggtatgcgcctgtgtgatatgattggccttccgttgtcctcctgtccaaggttctaacaacacttataggagacctccgtaaacatccaatgtcaaccatatgatctaatcgtcctcctgctagaatactatgcagactacagtagtctttgatgctccatctagactattcagatacatactcttacgtcagtgatacacgcacctgttacctctataggacaaacactagcctcaggtgcaangtatcangttcgatagacactaatataaccattcatatcctgaacacgtacgtcatattacgtcaacttgtttgatgtcttcgtacacattattcctactggggtccccgtgataacatttctgagcttcagtagtactaggggtgccatgaggcaacatgcgccaacgtttaggaaagacggtctagagctggtttcttgggataatagagcagttttactcccttatacgctgttccataacaagagccaattactactaactttcacagagtcttagctgagaggggactactatgctggaggtaagcccctaagggtgcaatctattattgttgtcttgtatgccacggaagagacctntgtatcccgtgtgttagattacttgtcacggttggtttcccatattcatgcgtacgccttgtgcccccgattgaccattattcctaagagcaaggtaaacaaaacacagacattttgttacacgaagttgaaganttagtttctgtaccgacactggtaaggtaaagttccccataggggttaacgacagtaaggacttaccatcaaacggtacaagtgaaccctccagccacttcttggttactctcagtggctcaccagaggtcatcgaaggtcacacccactttaatcctaggttaaacaactttgttccagtaagtacttccaacccggtttcacccccagttgccccaagtatttcgcacagaatatgccccaatttaccccagtccaggaattagagccatggggggtttcattctgggtgggggccctttctctttggcccacggttacatttacccaattttctgcccaaagaaagccggttctacacactggtcgcaggcaggggaaaataggctgttacaacggcgcttggttcgtacaccaccaaagcaagcacacccctatttcctcgttaaattatcacaagcccccgctgccgccccgcggagaattcctgtgcacactatacgtgaggccactaccgcacattgcccaacttttctcatcatcaggaccgagaactgacgtggttgtatcacagaggggggtataacaagacagaatcgatggtggtagctgggaacacaatcctacgggtgtggaagcaactgcacgagcgcgcaacaacctactttcgtcaacgacgcaggcctaacaagtagactacaagtcggaccgaaggatgtgtgccgacgacaacacagaatatctg

SEQ ID NO: 662913 - DNA, 464 bp, Homo sapiens
gcggccgctactactactaaattcgcggccgttcgacattgaattctgcctccaagaatatatgttgaagtcctgacccccagtaactcaaaatgggaacttatttggaaagagggttcctgcagatgtaattaagatgaggtcaaagtggagtggggtgggcccctaaattcaatttgattcatgtccttataggaagagatccggctgggcatggtggctcaacgcctgtgatcccagcacttcgggaggccgaggcgggtggatcacgaggtcaggagatcgagaccatcctggctaacatggtgaaactccgtctctgctggagatacaaaaaaattagccaggcgtggtggcgggcgctgtggtcccggctacttgggaggctgacgcaggagaatggcgtgaacccaggaggcggacttgcagtgagctgagatcgcgccactgcactccagcctggg

SEQ ID NO: 662914 - DNA, 1371 bp, Homo sapiens
gtgagtaacttggctccgggggctcgctcgcctgcccgcacgcctgccgcacacccagtgagcagcgcacgccggtctaccgacgctagcaaacccttccgacggccctcgctgcgcaagccgggacgcctctcccccactccgaccccgcacgcggaaagttaagtttgaagaggggggaacgaggggaacatggacatgaagaggaggatccaccatggagactgaggaaccggaccccggcagctgtctcgagaacttgtcttggacaatggcaacatcaacatgatggcacaccttgagcggcttaacagctgaaatctgtgaacttagagtacctcagtagaataacatgtaggcttgatcacagatttcaaatcatccccaagcctgcctaaattgacaaaacgcttgaactcagatgaacactacaatcataaggaggtctggcacatgtaagcatgacacaacttccaaatctcacacaatctaacactccaagtggacactacacctcgaacgcatcatccacgcacacctagagacaactttcgcacaccacagttagaactgtctgacacagcctggcaccaacttttcaaactgtagagagattaccaaaccctgcaacatgcactataccgcaaaagcacgctgatcattcacaagacttccttgcacaacaagaaaaacatacatatgagaattcgcatataaacacgaagtagacacacaaagagaaacacctcgacttcacactgcccgaaaagtgacaacgcgactgtgcgacataacccacgaagacagcacataaaacatcgaccaaaacgcaagaacacaaacactgacactccaccacgaaagacaagaaaaaacaaaacgagatcccgcagaacaacccactatcggacaacgacagaactacaaacacacgaacaaaagaacccaaaacaaaacaccaacagcagaacacacacacacacagccaacaaaaaacacaaacaagacaacacacacaaccaccaccaaacaatgagcacaacgaccaatacacacaacacaaccccataaatcaaaccacaaagaatgacagccagacaaacaaaacacaaaacaaaaacaaaaaaaagacacaaacaacaaaacaaactaaacaataacgaacaaaacaacctcacaacaacacacagcaaccgaacacaaaaaccaacaacatcaacgaacacaaaacaacaaaactaaacaaatcaacacacaaaccacacaccacatcacacatacacattcactaaacattaccacaaccaaccaataacaaacacaagacaacacaacacaaacaacacaactccccataacacatcgaaacca

SEQ ID NO: 662915 - DNA, 688 bp, Homo sapiens
ggttcgacgccagctcgggggcacgaggagctggcgtgccactgctgcgactgttccgtggactgtacatctcctctgtgtgacctggcagcgcccagatgcagctgcgaaccagcagaatgtggcgccttccatccgctaagatgggtccctagcttcccacagtccgaagcgtggtagcgagcggctgtccttcgtctcgtgccacagcttagacgcacgtggcgcataggacagcatgatggctatgatggctccagagacgccacgctggccctccacgggctcacggtggatggacgagggcaactacacgttgcgagtttgccaacttccccaaggggtccgtccgagggatgacctggctcagagtcatagtcgaaggcccgaagaaccatagctgagtgcccacgaaggtcacgttcagccagtgacccctagcgaacatgtggtccctctgcatctaccaaagagggccggccacgccttggccggatctcctggctctcatccctggactgggaagccaaagagactcaggtgtcagggacccatgtgcgggaactgtcactgtcaccaggcagttcaccttggtgccctctgggccgagcagatggtgtcacggtcaccttgcaaagtggacgcatgagagcgttcgacggaaccaggcctgatacctgtgacctcg

SEQ ID NO: 662916 - DNA, 95 bp, Homo sapiens
  misc_feature (1)..(1): n is a, c, g, or t
  misc_feature (86)..(90): n is a, c, g, or t
  misc_feature (92)..(93): n is a, c, g, or t
ntatttttaaatattttattttcctgttctttgtgaaaacatcaataaatatcgaaacctctctgctctaacacagagggaaacannnnntnntt

SEQ ID NO: 662917 - DNA, 129 bp, Homo sapiens
  misc_feature (100)..(100): n is a, c, g, or t
ctagcaggatcttacagtggatgaatcacccactggctggccttcgtagcacaccttgttacacagccatgagcaagggaaacttgtctaccaggccctntgtgctggaggatgctgtatagctcccgg

SEQ ID NO: 662918 - DNA, 245 bp, Homo sapiens
aagcagttaatacatgactcaccaagtcacagacttgtcttccacaagcacgtacttaccttagccacgaaggtctcaaagccacaggtactacgggttgaactcaaagatttgtccggggtattaaccaattaccagggggaccagtgacatttcattcacagggtcaaattcatgcaacaaggtctagaatccagggctggtatcagatacaagcttcagggccaattcctttccgaagggct

SEQ ID NO: 662919 - DNA, 175 bp, Homo sapiens
cacgagggagatttccgggacagatgacggtcagaaccacgggatgctgacatgtctcagcagtttgacactaccccacacagatcactgcttggaacttgttatcccgtcattgaatgcacagatccatggataggcgattggctatcacgactacaaattgatcatcaacaag

SEQ ID NO: 662920 - DNA, 265 bp, Homo sapiens
gaggatccccatatttgcagctgctgagtagctgggagtccaggcgcccaccaccacgctcggctaatgtttgtatttttagtagagacggggtttcaccatattggccaggctggtctcaaactcctgactttttcttttttttttttctgaaacagtttggctctttttgcccaggctggatgttgcagtggccgcaatcttggctcacttgcaaccttctgccgcccaggtttcaaagcaaattctctcatgcctcacgcct

SEQ ID NO: 662921 - DNA, 794 bp, Homo sapiens
  misc_feature (34)..(34): n is a, c, g, or t
  misc_feature (125)..(125): n is a, c, g, or t
  misc_feature (129)..(129): n is a, c, g, or t
  misc_feature (154)..(154): n is a, c, g, or t
  misc_feature (298)..(298): n is a, c, g, or t
aaggcacaggggcattggggcttacccctttggntggatcccagaagacgcacatgatgtgaaaaggagatctgcagccagtactgatgctgcattccagtgtaatcatcttgggttggtttggncagnatttcccaggttctttgatgtctgnagtttcttcaccatgtcggggcatcctgcggaggcttagtgtacaggcgtagggtcagcagcaatttgtctggtaagtgatgggatcggtggctgaggtctctaggctgggccattgctaaatgccatggccatgttgatctgnggatttgtccctctagtgtcttgcctcacatgggccatttgcccactgtgcaatatagggaggtgttttcagaagtgtttggccgtggattttcacatccatcatggggttggcattcaatggggaaagggttctgactccagtattgaattgtacataaatcccaggtgttcttggggaacgctcagggacatgtttgttgcctgggattggtgatgaaaggttggtttttgaagcttggaatttcgccattggtttttttcctgtcgtttctgcatatccagcaaggggagtctcgtgttgactcctggcagagttcagtggcttcggtctgtctgtctgttctgaggggaggattgtgttctggatccagtggtcagtttggcaactttggtcgaggttttcggaattccggggagggttgatggagagtgatgatcagttttgtttgctggtggctaggacaagtttgtagtgaagtgttttataatacttc

SEQ ID NO: 662922 - DNA, 318 bp, Homo sapiens
tcccccacagtgagacttgtacatcatttgcgtgaaaatagcttattttttcctcaagacatttttcattgcctgaagtatttaccaagtctttcatcactgtacacattttcttaaaaaccaccattgataccaggctgcaactgaaaaatgaatgccgaatttggaacccattgtgttatcctacctcagggtacccagagttttgtggcaaatatataccacccataggtgttcacaaaaggctcttctataaaggcagcgtgaattgtagtaaactattcttaataaaactcactcactgtgggggcagggggg

SEQ ID NO: 662923 - DNA, 92 bp, Homo sapiens
taatttccaaaaaaaaaggggtttatggggcttacaggtccccgggggggggggaaccccccctttgggggagggggccttgggcggggtac

SEQ ID NO: 662924 - DNA, 929 bp, Homo sapiens
ctgctgcctggtctgccaagaatgtgctctcaagatctctagagactggactcttcctaagacaagtccgagaaggaagcaccctcactatgtggctctacctggcaggccttctgtggagcctgtactacccttctgcagtaggatatccgaggatgacggcacggtcgcgtcgagccactcatcaagacaaggtatgtctttatcacagggcatgtgactcggggcgtttgggcgaacctgcatgccagacagctggcatgcacgaggcttgcagagtgctggctgcgatgctcgtagacggagaagggtgcgccgagccagctgaggggccagacgtctgacaggctggtacgacggcgaccctggatgttaccaatgagtggagagcatcgctgcagctactcagctgtggttgaagtgagcatgtgggggacagaggactctggggactggtgaacaatgcaggcattcttacaccaattaccttatgtgagtggctgaacactgaggactctatgaatagctcaaagtgaacctcattggtgtgatccaggtgaccttgagcatgcttcctttggtgaggagagcacggggaagaattgtcaatgtctccagcattctgggaagagttgctttctttgtaggaggctactgtgtctccaagtatggagtggaagccttttcagatattctgaggcgtgagattcaacatttggggtgaaaatcagcatagttgaacctggctacttcagaacgggaattgacaacatgacacagtccttagagcgaattgaagcaaagttgggaaagaaggcccccaaggcatattaacggagaacttatggacagcaggaatttagaatgccccttaacaatatcactgacaggagggctgctgacttgtggcacaaatctgaacctggata

SEQ ID NO: 662925 - DNA, 397 bp, Homo sapiens
gtcgactataattctaatgcagtagtggtctgcagaaattttcaagctctctggcttttatctgatgttgaggctcaaggaatgattctgtcttaagagaataaagataagaatgatagaatagggcatgccatgtccttagctggccttatctgttatataataatgcatggtcacatgtgtgtgtaacatataaacacacacataaaatcaagtaaattagattgagctgactattcctagggtagaagacattgaaaactccagaggctgtgctggttcctggcccctcaatctctacaggaaatgcctgcggagggctacagtttggcaaactcttcaccacattaaggaaacttggatttggtgtctatcaggcagcagagcgtcgacgcgg

SEQ ID NO: 662926 - DNA, 435 bp, Homo sapiens
tgactgaatgtgaaatacttttagtagctactatgacatgagaagtacatgttgtttatactacaagtgaataaggacaagagatcaagctgagaaatgtcaaaaagtaaacggaggagagagtgtagacagtgctaggatatcagtattataaatgttgcgttagaggaaggctattgcgaagcgtggtccattaactatttgtgagctgtccagaatgatgagaggcttgtgccagaatgaaaatcaattacatcactaatcatactggctcagttgactttttttaaataacaagacttctttgataaaggaagcaatgtgttgatttatattctggcacaagtaccttattactgactagagcaggggtccccagtccccaggccacgaccgggctgcatagaaggtgggcggcgggccctggctcggggg

SEQ ID NO: 662927 - DNA, 122 bp, Homo sapiens
aaaggtgcttgtctatgccagacacattcggatggactcaataactagaaattaagtttcgtctggagcatgctaggaaataggtcttctaatttcattttttttgagaccaagtctcactc

SEQ ID NO: 662928 - DNA, 1035 bp, Homo sapiens
  misc_feature (546)..(546): n is a, c, g, or t
gaggctgaggcaggagaatgcttgaacctgggaggtggaggttgtggtgagccgagatcgcgccattgcactccagcctgggttgacagagaggagaaactcagtctcaaaagaaaataataacaagctcactaaataataataaaataaagaaccacgatctgtggcgtgacaagttacatacgagtgagcaactcacgccatgtagtacagagagacagcgactaagcctattcatgacgggatctggccccattgactcaaacgccctccacacctcgcaacagttgggagatcagcatttcaacgaggacgcatacggaggcggacacgagacagcgccaacaaccatagtcgactattgtttcttcttacctgccggtttggctccaacacttcaaagtttcactttttgcttggcaccccattcgcggcctagatgcggcggttcctgcgacggcgctggctgtctcctatgtcctgttggcgaacacgagacagagcggagcaacgtggtggtgcccagggtctgcctactgttagacnccacgctgagctgggctattgatcttccccaagctgtgatttcgcaacggccctacaccttccttgacgcccaatgcgttcgtttagcttcctctgtactctgtaccctctaccgtggttcactccgcaacgtcttgtggctttcctgccgtctgacagatacttcaccactctgtctttctgtccccagcccattgtccctattcccacccatccatctcctttcactggactgtgtccctgacttcccttccttcagttcacccccattacacctcctctgggggggcgctctaagcaccgttgcgaccctggtcgctcccccataacaacagaactttagcgggcgcctgcgcatacacccgcgttgggctccaccgattccggcgcccggatgcgttcttcacctttcggcgtccctcttttcccaccccaattgccgcttccccggactcgggaccgcttgcgcttttacaaaaaacccgtgca

SEQ ID NO: 662929 - DNA, 574 bp, Homo sapiens
  misc_feature (547)..(547): n is a, c, g, or t
tagtaggcggcagcgctgccgctactactacacaaaaaataaaaatatttagccaggtgtggtagtgtgcacctgtggtcccatctactccagaggctgaggtgggaggattgcttgagcctgggaggttgaggctgcagtgagccatgattgtgccactgcactccagcctagacaacagaggaagaccctgtctcaagaaaaaaaaaaaagagcttggttaatatacatggtttacatatttttcgggtttggaatgttaacgggagagaaacctgagctttggttttattggcttttattgggtttgggtttggtgtgtgtgtgtgcatcctatggtattagtcagggttctctagagggacagaactaataggatatacgtatatatgcaagggagcttattaaggagaatggactcacatgatgacaaggtaaagccatctgcaagtggaggagcaaggaagtcagtggtagatcagtccaagtcccaaaacctcaaaagtagggaagctgacagtgcagccttctgtctgtgggcaaaggnctgagagtccctggcaaaccactgatc

SEQ ID NO: 662930 - DNA, 422 bp, Homo sapiens
  misc_feature (189)..(189): n is a, c, g, or t
agagtctactgcaggtagctatataacttatctctcttttcagatgttaaggaatgggctgcaggaagacagtgaaaatgatgaaacatgtgctcccttaactggagggtggaatgggagaatcccagttattagtgaacaggtaagagaacctgaatcatacaacttcacttttaaactgcccttatntagaacaatataattatatgtaagcatggagtgcgggagatttaggaatttatcacgataggtcagaattgcttttaaaaaaaaaagagggaggacaggctttggctatggtgtccagctggcctctagaactcctgggtgccaggtgatcctccaaccttagcctctggagtaactgggactacaggcaggaaccactgcacctggttgaattgactttatagaagtctgca

SEQ ID NO: 662931 - DNA, 1289 bp, Homo sapiens
caacccgtcatctactctaccatctttgcaggtcacactcatcacagcgctaagctcgcactgattttttacctgaggtaggcctagaagataaacagtgctagcttttgattccagtatctaaccagaagataaagttaaaccctcgttcctacagagagctgccatcaagtatttccgtcacgcgagcaacctggatcgctataatcccttctaatagctatccgtcttcaactagattgattgatcgtctcgcggacaagggaaccataagccaactactacgcagatcaagtgactctatgcattgtaattgaattcagtaagtgggcatagtagccaattgatagaaacctgaggaagtatgcctccgctattccacttcgtgcaggtcccgagaggcattacgccgaaggtgcacccactcgtgcacagtcacggccatgcgtgtcttcctcacaatgcacaaagaacagtaggctcccacattcatcaattacatgatacacaagaatcgtcatcccgtcaggtaaaacgtagagccttactcctacacatctcgtacaatacttatgccatcgatagccagtgcagtggaggtggacttaaagcaaagccaggtacgcagaaatcgtagccatactacctcaatatacccacataggatgcaataatagcagtgtctaccgaacaaaccgtaacataaacatactataatcgaactatatatatattatgcctaaatactaccgcattcctattactacaattaaactcacagaaacaagagcctacctaacttaatctcgcaacctgaaataaggctaaacatgactaacacccattagtttccatacaccgtactcatcctaggaggcctggccctgatatccgggattttggcccaaagcgccatatatcgaagattagaaagaaacaaatgcctcacaatcaccaacatagttagcacatgaccatcgatacattaaatttaacaatgaaataatcataatcaaactaatcgaaaatatacccaaataatgaaacgtgaaagaaatgagggtgataaatataaaaaagacagcaatataacaaatatgtaataaaagaatacgaagaagatccactaatacttagattataacgaaaaaggggcgaaagataacaagaaagaaagaagactagtaagatgaataatgcaataagcgaaaaaaagaagaagtacacagatgaacaaaataatgtagatgtgaaatggagatcaagaagacaataaaaaagaagagaaa

SEQ ID NO: 662932 - DNA, 197 bp, Homo sapiens
ttttttttttgtctttttagacagggtctcactctgccacccacccaggctggggtgcagtggccaaatcacagctcactgcagccttgaaccctcagactccagggatcctatctcagccaagtagctgagaccacaggtgtgcaccaccatgccttgctaattttttaaaaattttatgtaaagatgggatgtca

SEQ ID NO: 662933 - DNA, 153 bp, Homo sapiens
cccgcaggctgcggtacgaggatggtttgagcctgggagatggagtgttgtattgagccgagatcacaccattgtattccagcctggacggtagagccagacccagtctcacaaaaaataaaaatcaaaaaattcatgtgatacagctaccgg

SEQ ID NO: 662934 - DNA, 979 bp, Homo sapiens
  misc_feature (396)..(396): n is a, c, g, or t
  misc_feature (424)..(425): n is a, c, g, or t
  misc_feature (437)..(437): n is a, c, g, or t
  misc_feature (542)..(542): n is a, c, g, or t
  misc_feature (550)..(550): n is a, c, g, or t
  misc_feature (553)..(553): n is a, c, g, or t
  misc_feature (566)..(566): n is a, c, g, or t
  misc_feature (569)..(569): n is a, c, g, or t
  misc_feature (944)..(944): n is a, c, g, or t
ctgtgtgtctctcctgtatcgggtttacttccgtcttcttctggcttccctgttagcgggcgattttcgttgccttgcttctgttattgttcctctttggtgttcctatgcttttgcactgtgtgggtgtctttaacgttctgtgtctgcttccagtgtcgccgccgtctctttcttcccgactgatcttctcgttgcccttatcggctcattgattgggacgggagactttcgaacagcgatagcttccttggtgctgactactagcaacgtatcctgcctctatctctgagtctgtctaggtgctattgatccctgctggcctctgcacctgtctgtcgatccccactgacctgttgggtgcagcaaggccgggccagctgggcccggcgcctntgggaggcctcccgtatccccctgcttnnggtccaaggtgnccgacagtctgcctttgcatcctgtcctccagccacccttgcttgcctactgttcacccatgacgagagcctcctgtctgacagtggccatcctgaggatagggncagagtgnccnagggtggccccanggncttctaaaaccctccatggtctaaaacccacttagaccaccctccatgtcaggtactgagcaaggccccagatccttctctctggaggaagagggaagcccaggggtcctgtttgtaaaacaacgtgggcaacagctcctcttccagagctgcctctgcctttatcctgggagatggggaggaagccccatctctgctgttccctgcgtggaggaagcccacccagcaagctctctcctaccccaggtaaaaggtgctcctttgcctgggtttgaattccagcgctgccacttcctctctgcacctcctggcaagtttcttctattccccacgtttaaagcgatggcacctccgtcccagggtggtgtgagatanacaggtgtagtgctcatatgtgtcttcctttctgt

SEQ ID NO: 662935 - DNA, 352 bp, Homo sapiens
ggtaggtgacggacaagctcatgtttgtctctactcacacactatctgactagaatgtatgtatgcagtttctacaccaaattcttgagggcactggatattaactgggtatcccatgactttattctgacactacctggagttagaacagaccccacaagttaggggctcagtcccacgaggccatcctcacttcagatgacaatggcaagtcctaagttgtcaccatacttttgaccggtctgttaccaatcgggagttcccgtaactgtcttcttgggtctaataatttgctagaacagtttacggaactcagaaaaacagtttatattctccttctctggcgagagag

SEQ ID NO: 662936 - DNA, 659 bp, Homo sapiens
  misc_feature (659)..(659): n is a, c, g, or t
gggagcagtgtctcacacctctaattccagcactttgggaggccgaggtggacagataacctgaggtcaggagttcaagaccagcatggccaacatggtgaaaccccgtctctactaaaaatataaaaattagctacgcatgggccgggtgcggtggctcatgcctgtaatcccagcactttgggaggctgaggcgggcagatcatgaggtcaggagatcgagaccatcctggttaacatggtgaaaccccatctctactaaaaatataaaaaattagccaggcatggtggtgggcgcctgtagtcccagctactcggcaggctgaggtaggagaatggcatgaacccgggaggtagagcttgcagtgagctgagatagcaccactgcactccagcctgggtgacagagcgaaactccgtctcaaaaaaaaaaaaattaacttggcgtggtggtgggcgcctgtaatcccagctactcaggaggctgaggcaggagaatcactagaagctgcgaggcagaggttgcagtgagctgagattgtgccagtgccctcctgggcaacaagagtgaaactctgtctcaaactaatataaattaagcggtctttatatgttggtggatggattttggtcagtcccccaattatttctggtttgcn

SEQ ID NO: 662937 - DNA, 778 bp, Homo sapiens
  misc_feature (64)..(64): n is a, c, g, or t
gtatgtagttagcatatgtgtcactgaactgtttaaaaatctagcatgtagagcaagcctgttntgtggaaaatccttattcattaaaaaaataatcatggcagattttctgcaaaaaaaaaaaaaaagcctttgtgcaagtccagaaatacgtgattttttaaattttattttaaagaaagggctattgtgcgcttggcgggaaaaaaaatactacgagaatccatttagagtgagaaactcttggcaagagtgtattcaattcttaaggggcatcgtgggcatcttatagtgccgtgttgggtctccgtgggcttccttggaaattaaagtgtgtaacatacgttaacctttatacaattatggctcttggctccaaaaattgggtggaccctaggtaacattttcttcccgggctgtcccttctccttttatagtggctcaaaccaggcggaaacccaaaattttaaagacgatctggaacttccaggcaatggaatcctggattggctggaaaggattcccgggattaaagggggatcctcaaaaggggctttcccaattaatctaacgggaatggttagggcacctatactcttgtggcctgtggccctttcattaatacaacccactttttaacatatcatcttttcatcatgataaacgtggttcaaggccccacataaggagagttcctttagtcaagtgatcagcataagatacttccggaaggaataacttagaacatttctattggttgagaaaatccttgggccaa

SEQ ID NO: 662938 - DNA, 321 bp, Homo sapiens
gttttttttctttttttcttcccttttttttccctttggggcggccaaattggttttgctagaacgcctgctgaaggggaaaaatttaaactggcctttgaaaataaaaaaaatctatttttttagaacttcataaaaaaaccccttgattttgtgattccaatttttggtaattgttttcaaaacagccctacaagcacaaaccggggggggtttgtatttttgtgaacacacaaccagcccgtttttaggctttgtttctttgggggcttagttttaaaaacaactttgaagtaaacaatgaaaaaaaaaaggtcccta

SEQ ID NO: 662939 - DNA, 556 bp, Homo sapiens
gcgggtgcattcaagtcacccccgaagttgttcgttgtagtagtcagatagcgatggtcaccaccgtactccaggtggtatcctctcaatgaagtaaggggtcaggtccgcttgcacatcttctcaagggggggcatgcttacttggagcaggtcgtccttgaagttgcctagtgagggtcccaggccctccccctccagcaggacatgataggtgggcaggggtggggggacagagtaatggctcatcaaggcaccaaattcctgcagaaacaacacagagtcgctgatgctatgcagctgctcccgggtctgcttgtcctcatgcaggacctgggctctctcatgcagagcatccatgatcaccttcagtgggtccacagcttcctgctcccggttgctccagggcagccctcatttcctcctttggcttctccaggtcccgcaccaggtcccggaagttcggctccaggatggcctgctcatggggggtgccgtcttgaggcgggcttctccttcggcacttctcaggttcaccctcaattcaatgatcttga

SEQ ID NO: 662940 - DNA, 103 bp, Homo sapiens
tctacgacggagagaatgcgggagctgcgccggccggtggacccgctaaccaacgacaaagcccgcgtcgatgtggagcgcgaaaaccatgggcgcaggacca

SEQ ID NO: 662941 - DNA, 581 bp, Homo sapiens
ccgtgttagccaggatggtctcgatctcctgacctcgtgatccgcccgccttggcctcccaaagtgctgggattacaggcgtgagccactgcccccggcattcaactatctttttatcagctagactccagtaaagaaatctgaaccactccagttattttaatagagaacatttaataaacaattctgtataaatagctattggtagagtgaaatgctaaattagacattgtatataaaaattattaagtagaattatttagtaattctactgtgaaattattataaaaatagaaagacacagagggtttaactacccaaaggagcccccattggtaacacttggagacccaccaggattgggtaagaaaattcaaattcttaaaattttggaaaggccgttcttgcagctgcagctccgactttcaaaaaacatgctgggccgggattttttgaggtggtttaatgaggctggttctaaaagttgggaacgcaaatgaaaaactgtggccaactgatattaggggaatccactctgtgtttcaggtggatggattttgcttgggggatgctaccaggaa

SEQ ID NO: 662942 - DNA, 408 bp, Homo sapiens
aaactaggaatataagcagaattatatagtcgagtagagcatgtattacatacagacgaatttataattatagagtagtgctgtcgtttaacacatttctataatgtatagcatgtgtataaagaaaaataagataagtgatagtaatttatacagaacatagccttctagaatatattagctgtcatttactacagaagaaatatattacacaaaaccacacatattgtctcatattaaatcttttataagtgtcctctttcagctgcttcctttaaaatccccttccttaatatagatgtatatgatgtatattgcaagaacagcagtgaagactatcgcttgagggatttcaccaccagttacacttatatacacaaaaaatacagcaatagtacgttccatata

SEQ ID NO: 662943 - DNA, 353 bp, Homo sapiens
ggggcagcccttcctattatttttcttagcccaagaggtctttcactgatacaagaaaacttgcagaaatgtgatttttcccagatttgtttacatgttccctgggacagatccaggtctgcagatcgacaccagtgggcccaggacctgggggtggctttaaatgaggcttgcagtgttaaaggtcttggataagaagggtcctggggaagaagactctgtggacaagataccagtccccaaaacagcattttcagttccttcttcaattagtttgaaatccagacctgagtttggaagactgattttttgagaccatccctgtgtttggagtggataattgtccctcccct

SEQ ID NO: 662944 - DNA, 740 bp, Homo sapiens
ccgtttgcgtggtagtgctgtgcgttccttcctgtgccgtatcttctctctggttgttggcttgtctgcctgattccagatcgtcggcggtccgggtggcgctcactgctcgcgctcgccggccgtgctgtgtctttttcggccgtctgtctgtttcgttctgtagttgggggggtcgtgctcctcctcgctcccacctcggttgtgtggtgtagtgtggctcggcccgaccttctcttcgctggtggctggcgctcggtgcgcggtcgggctccgccgcttcgcgggctcgcgctcctcgccgcgggcgggcgggtgagggtggaggcgcgcgtatgcggcctcacgctcgctcctgcactgcaggttggtgtggggtgaggatggctggtgtgtgtctgtggtcgatgttgtttttctagctgtgtctgtgtccttgttgcctcgtgctgcattgtgtgtcgtgtgtcgtgcggggccctcgcccaccgcgcggagtgggagtgcgcagggcgcagcggttcacgcccccgttgggtgggtgtctgtcgaggtacactctcctcccccgactgatttgtctatttgtgtgcgtgtgagtggctgtggtggggtcttcctgtagcatgcttaaaatgaacgaagtcttctacattctataacaatacaaaaaaaaacaagaataaaccaaaaataaaaaagacaataaaagaaaaaaaaaccaacatgcacgaaagtca

SEQ ID NO: 662945 - DNA, 132 bp, Homo sapiens
ttcagagacgcggtcaagatgtactgctatttattgatgacatctttcgcttcacccaggctggttcatgaggtgtctgcattattgggccgaatcccttctgctgtggtgctatcagcctatccacaacca

SEQ ID NO: 662946 - DNA, 981 bp, Homo sapiens
aggaaactcatcccgggtaacgcgcaaatccgggggagccccgcgccttgttgccgcacagagagtgcaagaccacaaaggggaaaaaaacaaaagaaatcttcgaagcagccccacgatgtgctgccgccccccatgggcaacgtgacgccaatgggcgtcccccacccccgtcgggtgtcaagtaaggcccagggccacgggtggaaaacaaagcagggggtaactaatacgcggggtgagcaaaaacagcctatagtaggaagtgtgagaacatggggggtattatcgccgggcgcgcaacatacacgagaggccttcacgtgccgcccaagtgactcgcctccggaggttcaacgaagaactagtcacacgccgtggcgtggtgattactagtcggccaagttgcatccccgccgcgttacttataagggctcatttgttacaaaacgccggatgcaaccttcctcccccttgggaccagttacgcaccataaaggacacggtggcttggattcaaccacaatacggcgggcagaaatagtgggtagtcccccacaaattattagtgagcatatttggggtatctattaaacccagtgtcaattaatcacacaaggcgcctctgggggaaccacagtgtaacaacatggtggtccccaataaatctactgcaaggtgccgatcccggggtgagtgatactaccatctttgggctgagtagaccacctatgctgaagtcctcctcataaaggttgccaggcacccacaggtctagccccccacttgtccatgtagcactacatggaggacccacgatatatacaaaaagaccaagtcggtcccgctcgggcacgcacttctccctttgtcttccttaattacgaatgatatgatgtataggtaataatagaaaaggcccgggcacggaaggtttaaggaagaaaaaaaaagggaaacccctaacacaacatgacgcga

SEQ ID NO: 662947 - DNA, 106 bp, Homo sapiens
acctggtcatgccacccatgctaccgcctggctattttggacaagccacggggcttgctgcgggactgatcatgccgatcggcacaacgtggctggaaggacatcc

SEQ ID NO: 662948 - DNA, 109 bp, Homo sapiens
atataggcagtcttgaagaactcccatacgtgtctgctgctgctcccattaactgctgccaccaccatcagatatacataatcaaacctaacctttttgtctaggagca

SEQ ID NO: 662949 - DNA, 110 bp, Homo sapiens
tggggatagtgggataataaagagggtttttaaaccgagtgggggcctttttgggaaaagtggccgacacccctttttgttttttttttaacacctataaattttcctcc

SEQ ID NO: 662950 - DNA, 1447 bp, Homo sapiens
ggtgccccttgtgccccgttcctggttctgcttcctgggtgtgcagtggttcctgccttgtgacccccagatctggtgaactgtgtggacatcaagtgccttgcatagagccccctcattccaccgacccagctattcccagtgtgcacagcatctagagctgagaggggagaaccagaacacataaccaactgccccacgctccatacccatgagagacatgagacgggcccacatacacaacacatgaagccagtcaatgaacataaggaaagaggcaggcgggatgagacatgaaaaccaccatgaggagaacagctgcaagacagagatacaaggtaccatacagagcacaccacaagaaaggcaggaactacaacaccaagaggacacagaaaaaggaaaagaagagagccaaggctacacctcggcatacaatacccaacagaaaaagagaacactccgaggcacactccaagccctcagaaagccaaggaaccaccgggggccgataggagtacaccaccaaaggtccatggacgacggtcgatgaggagccactcaagcgcaagagaacacaccccacatttgatggatagcacaatattaaaacatacttgtccgaattcatcgtcactcactaagacataaaaaaaagcggaaaaagagagaagaacgacgaaccgaggggccacgctgcaacaacaccaaccacccagcatacaccagactggccaccaatgatcacacaatgagcgaccccaaagaccaacacagagcagcggagaagagaggaccggagaacaaagggaataagaaacccgtaataccaaaaaacaatgaaagtaaaactatcacctgagcacaagaaacagaggcgacaaagagagacccaaaggcacaagaccacgtcctgaacacataaacacacccgcgataggaccacaaaatcactcatcattaccaaataacaaacctattacgtatgaaggcacattacacatgttaccccacgtaataattgatatagagcacatccaagacatcataacacgaaatagaacgaacggcacataatacaaacaacgcacacatacgataacaatccttgaacaataacattagaaagaaatccataagagatgcacacagacacagacgaaaccacaagagagacagagagacacgaagaagcaacacgaaaggagaccgagccgatgatagcgaccgaccacaagaacgcacgactcgacacaaagagaggacgaaaaaaagaacaaaagaagacatgacgagaccaaaaacacaaacagaagcaaccagaacacacacatgtaggagacaaagagaaaactgacgagaaacgcgaccacagatgcgagggacggacaagataacagaacagacagaccaaccagtaactgaatgtgagaatacaggaaggaaa

SEQ ID NO: 662951 - DNA, 719 bp, Homo sapiens
tggaaacggagtctctatcacccaggctggattgcagtggccaatcttggctcactgcaacctcttgaagcgatttcttctgcctcagcctcccaagtagctgggtttcacgggtgcccaccaccacacctcgctgttttttttaatttttaatggacacggggttccaccttgttggccaggtctggtctgtgagctctctgacctcaaaatgtgatctgcccaccttcagcctctcccagagggtgcgtgcggatttacagaccttgagccatttgttgcccagttttatacccgtgtttttaaagaagaacaaacaatgggtttagggaacttggcgttaaagggccaaaccaaccttacttgtgcggtggggaccccagacttctaattcaaaggcttatcaaattcccgggggtctaaactcatcatgggcattaccattcaaccaaatttttttttggaccgctgaacactttctattgtttacattatgttacacaattctagtgtttccacttagcctctccagtttagatactctcaaccaattaatatccactcattttttacacgctgaaattccaaccctgtgtcatagaggatggttccagcgctcaaggattccctgttgctaaaactaagtagggctgtgaaactttgggccatgtatacaggacagtgcgacttttaataaggttaacataattggacatttg

SEQ ID NO: 662952 - DNA, 529 bp, Homo sapiens
atcgagtctatcgtacaactgaggagctctatcctcttggatctagatttgtcatcaggtgtttccacgatcgagaatgatggatatattcagtaaccggacagcttccttcacatgtataggtaggacctcatcacagcagtgcatcctgagccatagcttcagagagacgaatcatgctctcaagctgtcgcactgtagtcctccatgaagacttggtccactccagaaccatctctctggcggaaatctttatcttgctccacaatgaagtcctctgactctttggacatcttgggtataaactgtcttgcaaagagaagatatcttctgatatcatcgagggaatagacacgatcaatatgattccatcattcttgaatgcaaatctactatgcgcctggcactggcataatctgtaacctcattacattcatccacaaggataaagcagagatcgaatcgggacatgatgggagctgacacattaatattctgtatcaatgattctgatctgtcatagtgtaca

SEQ ID NO: 662953 - DNA, 193 bp, Homo sapiens
tactgatagaatcgagctggtaccatatagggcaagcgggaggattgcttgaccaggagttcaggaccaatctgggcacgtatgagacccgtctctacaaaaaaataaaaattagctgggcatggctgtgaacacctgtagtctcagctattcaggaggttgagacatggaggattgcttggcccttatcgag

SEQ ID NO: 662954 - DNA, 1045 bp, Homo sapiens
agcgggggtggggaggcgcggcgccacgcgacgcctggctgggcccgcaccggagaggcgtctcggtacctggcaggtcggcctgctactcgtgagcccgtctgcgtgggcggcggcggcggggactatgcacgtgtgagatgcggcagctgggctggtgcaggacgctgaacagtcagcggcggcggcgggcgcggcctcctgggcgcggggcgctgcggtgtccctgaggtgctgggcgcgctgggcgctgggcgattgccgtgcgcgccgcctgcgcaggcgctggttcaggactcacactgccgtcgctgaggcccgctgggcccgtcatggaggcgcccatccgtggagacgctcccacgaccgttcgtcgccgcttcggtcccggctgctgtccatggattccgttgctcgcaccgggatgctggtgcaggactgccgcacgaggagcgctgaagaaggtaggaccactaagctagacaacagaagacacatcgcgaatcgatcggacatgaacggctagagatacgatgacgtaataactgccccacttcagtatgaaagaatctcgagcctagctctttgtccactgatatagacgtaggacgattaataaggtcactacgctgggtgcaagccgataattcgtgaccgttcttagcacacttcagtgcttcacgttggaaaacccaaagattaacattaccttacatgcgcgctcacatggtatacaccatgggagtggacccacctggtcgcgcgaaagatggcttcagcaaaaccgcagcgcgcacgaaaccgcgccccatgcaaaggaagccaacccggcaacacggcagaccgcagcgtaacgaacacacaccaccccaggactgcacaccctacgaccacccacccggggacatcaaccaacgacccgggcaacgtccacgaaccgacgcgagcacgcacgacgacccgactgagcgcgccagaccacacccggaagccggcccacgacggccaccaacggcccacaccacacaccgaacacaagccacaa

SEQ ID NO: 662955 - DNA, 110 bp, Homo sapiens
ggagcgagagactcactgctggggagtcctgtcacactcatgttccccagcacactgaatctccctctctacagttgcatgtagaccccttgaagaggggaggggcctag

SEQ ID NO: 662956 - DNA, 399 bp, Homo sapiens
  misc_feature (2)..(2): n is a, c, g, or t
  misc_feature (6)..(6): n is a, c, g, or t
gncaantagccggagacgcccataatgatgatgcagatatcgactacttatgaaggatgccaattccaacagaagctgaagattctatgggaatacacgctgaattaaacgaattggaaggggaacgctgtctaatcccttcagaactgtttatagagcttgagaatggggtaaaatttctgctagcaaaatcaagttctgaaattttatcagtaatccagaatttagtagtccatgccttctcactcagcatttagaaataaaaatgtggtttcttaaacgtatatcctttcatgtatatttccacatttttgtgcttggatataagatgtatttcttgtagtgaagttgttttgtaatctactttgtatacattctaattatattatttttctatac

SEQ ID NO: 662957 - DNA, 345 bp, Homo sapiens
ccggtaactaacacaataacaagaccttttccttggacatactctgaattttgttgtttggggggagggggtgtgtgtgtgtgtgtgtgtgtgtgtgtgtgtgtgtgtgtgtgtgtgtgcgcgcgcagtccccatcattctcagtgtctggctgagttgggtctacctggccaggtacatctaacgtctgtatgtgtgtacttgcgcttagtgtgtacccttcatcagggtgagatgaatatggctgtatataggctgagcaagagggggtgaggtcgatcggggtctatcgagtacagaacaggctcctctagaggggtatgaaacaccggcgggtcctttgag

SEQ ID NO: 662958 - DNA, 109 bp, Homo sapiens
ccacgatccccacacacacgtatatataatggtatctctagccaacccaccctgtaagctctggccaaggtttgatttggacaggtacctggtgatcgtggggttgtaa

SEQ ID NO: 662959 - DNA, 555 bp, Homo sapiens
  misc_feature (439)..(439): n is a, c, g, or t
ttttaagaagccgtcttgttctgtcacccaggctggcatgatctgggctaactgcaacctccaccacacgggttcaaagtgattcttgtgcctcagtttctcagcctcccaagtagctgggattacaggtgtgcaccaccacacctcgctaatttctgttatttttagtagagatggggtttcactacgttagccaggctggtctcgaaatcctgacctcaagtgatccacccagccttggcctcccaaagttcggacattacaggtgtgagccaccatacccagccagaacagctttatttttaatagccaaaaattggagacaactcaaatgtccatcaatatttgcatgaatggataagtaaactgtgttatatccatacaatcgaatatacctcagggggagaaaaaggaacaacatggatgaattgcaaactancatgttaagtgaaagaggcagacacaacaagtactcactgtaggattcctgtatatatactctagaaacacagactataggccagaacttgactccggtgcgatgggatgtaatga

SEQ ID NO: 662960 - DNA, 313 bp, Homo sapiens
  misc_feature (12)..(12): n is a, c, g, or t
  misc_feature (106)..(106): n is a, c, g, or t
  misc_feature (171)..(171): n is a, c, g, or t
  misc_feature (173)..(175): n is a, c, g, or t
  misc_feature (180)..(180): n is a, c, g, or t
  misc_feature (189)..(189): n is a, c, g, or t
  misc_feature (244)..(244): n is a, c, g, or t
  misc_feature (264)..(264): n is a, c, g, or t
  misc_feature (306)..(306): n is a, c, g, or t
ttaccctctaantcaaatatgactaatgctaacaacaacaaaccaaaaccgagggtttggttttaacatgattgggttaacaggcctttgaagaaaaatgtttaanacttgtcttcaagtctactaattgtacggcaatcatttaaaatagtaaaactatttaaatctaanannnatgtngtgtgtggnggtggggagaaaagggatcattaaatgcaatgcaagaacaccaagcagaattaanataaagaaataatgtaaacnggataagatagcaaaagctttttctaaggaaaactgtttcanagcatgc

SEQ ID NO: 662961 - DNA, 103 bp, Homo sapiens
aagcgtcagaacaccagtaactctgtaaaacaagcatatggcacttctgtctgattccttcttctccattatattttatatttcccttttttctttgagatgg

SEQ ID NO: 662962 - DNA, 252 bp, Homo sapiens
gccttgcataataaagacacgctgcttcaatcaaatgcaccatcacaacaaatgcagtaacagcattgctgcctcactttccaagccctatatgccaatttcattcctttcactttatgttccacaagtcccacagttgtggtcatcaatcatgccctcatttcattcctccagcagtgcccacacaatttcccaatcattcactcactcatgcaatctttacccctctgccacattcactcaacatcagca

SEQ ID NO: 662963 - DNA, 141 bp, Homo sapiens
tacaagtgccctatgtagtgttagggatgagggaggttactccttagcccagtgagtggttagagacagttgtgctggtagagatgcctgtttaatgccttgtgcctctagtgagtgtgtaagacgatttgcttggtgttg

SEQ ID NO: 662964 - DNA, 1022 bp, Homo sapiens
  misc_feature (661)..(662): n is a, c, g, or t
  misc_feature (751)..(751): n is a, c, g, or t
  misc_feature (760)..(760): n is a, c, g, or t
  misc_feature (762)..(762): n is a, c, g, or t
  misc_feature (808)..(809): n is a, c, g, or t
  misc_feature (901)..(901): n is a, c, g, or t
  misc_feature (928)..(928): n is a, c, g, or t
  misc_feature (969)..(969): n is a, c, g, or t
  misc_feature (1005)..(1005): n is a, c, g, or t
cggtggcttccccccccggctcacttctccgacgtcgtcctatcgctgttttctcttttatgccgcttgtccgcgcctcttttcctctgtactttctctccctcccttggttttgcgctctccgtcgaaagtctgcccctgtcctcctagtcctcctttgggtttcttttatcctcctccttcgtattctatcttctgtctgcgctttgttcctcggttctttcgtccgcttgcgattacttgtttgtgcgaagtcccccctagtccgcctcccctcttgtgggcgtgcgagaacctctatatggtctgatagccgcgccttcccgcccaaagggtcctcaatttggcccaatgctcgtgtttctggtccttccaacatctcccctctgggtgtagtaggtgccacctcagggcacgctctcttggtggacgtgtcacagacgactcgcgcaccggtaagtctgcgctttggacgtgttccgcgtgtatgctcttggaagtgcccacgtccccttggcctccagttcaactgggcaattcatcgcaccagctacttctaacgtaaagagctacctaaatatgtagccgtggcttggtcggcggctcgcctggtaatgcccgagctacatttgggaggctagaggcgtgagaatctctgganncccatgcgagatggaggttgcagtgagcagagatcgtgccactgcactccagcctgggttacagagggagactcctccgtctcagaaanatagaatanantaaacttgtgagctggccccaacccctcctaggaatcacagctccnncgtactggtgccgaccgcagtggccaagttgcgacagctgcccacggcccctccctctgatgcagattcagggcttctcttcgatcatgatngggtatttgattctgtttttccatgantgcaaaaccctctttcctctcctctatttgggacaagagcntggttttctacgctgccttggccaccacactgatanccccacgagctggatga

SEQ ID NO: 662965 - DNA, 873 bp, Homo sapiens
gacagctctatgaattcattcaataagcatgtgtcaggttgcactgtaagttccctatgtaatacgaaccccatggtgattgctgacattacatgcgcagactggcttcagtgtgtggcttggtgtttagtttagacaatttctggaactggaatggagattatgcaaggtatctttagtaacataatatggtgtatacttgcgttaattattgtgcagtactgattactaccccatcagagaggggtattggtatagagtagggcatagagtacggaaggtctggaagctgttgtaaatatggttaatcaaacagggaaaatgttaattgcctccattaatagtgtcaattgttgagacggagattcatatgatggagagtttgcagggcctaataattacaactacgatacggttcaactctcgaatgcctagccatacattattaacttgtttgaagctattacaccaagatatataagggcgaccttcctcgcgttattgttctacccaaagttctcttgcggtgtgggggcaccctccatcgggagatccaatgcggcagggggcgagtcctggaaacacactttaatggttggggcctctattagttgtccacttgcacacgcgagctgtatttggtgcatggtaatcgcaactgagtggttgcaggtgccgctctggactgtcgtaaagtgaaataatgttggactgttatcttgtttggtcctaatgaaaatctggaatttcaatatgtctctaggctaaataattacttcgtggcaggatgtttttggttacaaagcacggatacaatcttgtttccgtcgtttgcacaccaaaggaataaggtgaatttatttcccaataacc

SEQ ID NO: 662966 - DNA, 145 bp, Homo sapiens
ctggttattagtgctgctgaacttagtgacggatcagacgaagaggggcgtttggtattgggttatggcagtgtggtaatatacttgataatatgtatgtgattgaaatttgattggcccctaaagttacagcagccagtgtgtg

SEQ ID NO: 662967 - DNA, 105 bp, Homo sapiens
accagacagagggattctttagaactcataaactacgggaagtataagattcggaacaaagacctggtagggaccatctgtctgacttacgagcaacgtctggag

SEQ ID NO: 662968 - DNA, 497 bp, Homo sapiens
agctcccatcacacacataatccataaacttatacatctatatgtggttctgccatctgttcaagccagtacgcagatgcacacatcagccaccgttcgtaatgcatgtgccccatcgtgctcatcaaagccagctaatgcagcagaccagtccaattcacaagtggataagcatgttcctatgactgtaccgtaatgtcactatgatcagctgcaagaatccacttagcactttggctgttgtaggcgttctcgtatctggggcgtgtgagttcctatgtcactctctaagacatacgtctatgaatcagttacgttcgccagacaccacaggaatattgctacttacagtgcatgatcgtgtgccgatagtccatctgacatgatacatcagattctaacattaggactttgcgtatcagggcacacagcattgaccatagcacaagtaggcaaggtgtcatactactattcacagtctcatgtatatataacag

SEQ ID NO: 662969 - DNA, 624 bp, Homo sapiens
tggtgcagacgcacgtgagtctatgtttgacatcagaatcttcacattcatctctaaggttcatgaagctgtgacatcaagcaagcaatgatatgcagttccggggcattaaagtaagcacgtctcatggcaatgccatactagtattatttcaagaatgtctattcattgtcatagctagcagtgctcatcgcaacatatggtggtcgcaacaattggatcaattctgggttgtcctctttgtattacaagaagcatgtcatgtctcaaagattctcgtggtgcacagcattaagcccttgctatatacgattcaggatgagggccaattgtgcatcatttgtctccatagatggtatgaagtgatctgtaacaattctcagatgtctcaagagcaacacatgtcgatgcaaacacagctactccattcactcattttacagtgatcttagaatggacactgttgaagattggcagcaaaggcaatctacaccgaggctttgaaattttctgtctaccagatctttagtccgatatgcaacagagctcatgtgtgcatctaagcgatacaccaccagcgaataagccaagctcaatagacacagcaggtaaatatgggtttcc

SEQ ID NO: 662970 - DNA, 384 bp, Homo sapiens
agaagttgaaatgaaggaagtggccgggcacggtggctcacgcctgtaatcccatcagttgggaggccgaggtgggacttcaccatgttgccaggctgtttcaaactcctgacctcatgtgatccacccacctctactaaaaatacaaaattagctgggtgtggtgtgtggtgtgcctgtaatcccagcgactgggggaggctgaggccagagaatcacttgaatccaggaggcagaggtggcagtgagccaagatcacaccatgtgctctccagtctgggccacggagcaagactccgtctcaaaaaatacaaaataaccataaaataaattaaagtaatcaagaagaataacaacaacgagcaagaaacacaaacaaaaact

SEQ ID NO: 662971 - DNA, 215 bp, Homo sapiens
ctgtgggatcgagtgaagatgaaactaggagagggaaagagagagaagtggggagagggaaagatgacaagaccctgaaggaaaggggacagtggaccctgatgacaggcaaacgggagggagccctggatgagtagacggcgggaggttctgtgagcccactgccatgagggcttggaagacaccccccacccacgtgctgcacctgagacccc

SEQ ID NO: 662972 - DNA, 342 bp, Homo sapiens
gtggcgtctagaggatccctgcaaacgtatagaaccttatttcttcctatgaacttaagctgctgcgcacaaaaaaaaaaaaaatttaccaaaggggagatgcagtagagtccataggctgtagaaaactaaaagaaaggggatgcagggggaacaagttattggtccggagttacggtactggctggacagggtggtggggtactaaatcacaaaagaatccattccaggtatgcatggtctggggggtgggcgctggggtctacagatcaagaaactggggttggcgaagctctggcatggatgggcgagagctgtccttctccttctaatcaagctggc

SEQ ID NO: 662973 - DNA, 234 bp, Homo sapiens
tagggtgctttgaggtcaataaagcaaagccaaggccccccagttgcctttttgcctttggtaacataactttgggagttttggtttatcctgtgtgtcaaagagtgggcagaaataacggcctgaaggtttctgaggaaaaagccctggatgggagactgaaatggccagtttcggagcctgttaatcagctgatccccttacccatttaataataaaagagctggccctcca

SEQ ID NO: 662974 - DNA, 431 bp, Homo sapiens
tgacacatgtcggtagagtagatctggatcttatagtcaacagctgatgtgcatgctcatctgtacagtgcagtgattcaggagagtgtcttctctccattgatacatcttgatctgtctcaaaggacgtctagtccatagcgccataagctcgggtctgtgagtgcagcatgtagtggaatgagagggcggtctagagatggctcctctctctacagggcttatgcatataggtcttctatgtagattcttactcgttatccagctaagagtgggatcttgtatatatgattcacggagagcagctgtgatagcatacgtgtcgcagaactctctccatagatcacctgtagacggcacgccgcgcatactatcggcgatgctgctcgtactctcgctacaggtatcgagtagctaagttgagctcgtgc

SEQ ID NO: 662975 - DNA, 251 bp, Homo sapiens
gctaacatggagaaaccctgtctgtactaaaacagaaatacaaaaattagtcgggcatggtggcaggcgcctgtaatcccaactactcgagaggctgaggtaggagaatcgcttgaacctgggaggcagaggttgcagtgagccaagatcgcaccattgtactccagcctgtgtgacaagagtgaagactccgtctcaaaaaaaaaaagatttaacattaatttatttggaatttggacagcactctactg

SEQ ID NO: 662976 - DNA, 202 bp, Homo sapiens
tttctgcgggcaggtcccagcatttgagggtgatgatggattctgtgtgttgagagcaacgccattggctactatgtgagcaatgaggagctgcggggaaagtactccagaaggcagcagcccaaggtggtgcacgtgggtgaagctttgctgagttccgagtatagtggccccaggcaagtacctgggttgttccccaaac

SEQ ID NO: 662977 - DNA, 153 bp, Homo sapiens
ctgatcccgaacgtaagtcagccgttcagcaccccgtgtgtgccgtgtcagggttcaaacacgtttgaagtgcgtgtgagaagtggggttccgtcaggggttccgcgtcccgtgtataagggttcgtccccaaaacaggttgttaaggataca

SEQ ID NO: 662978 - DNA, 175 bp, Homo sapiens
  misc_feature (15)..(15): n is a, c, g, or t
  misc_feature (43)..(43): n is a, c, g, or t
  misc_feature (116)..(116): n is a, c, g, or t
  misc_feature (147)..(147): n is a, c, g, or t
gatgggccgctgctncaatttcccaccatcgggagcccctggnctcaaaacctcctagaatgagtcacccgtagatcagggtctggggaagaggctgatccctggcgctgcccggntccctcgctgccctctggagctcagggcagnccggaatagggctctttgaagaggaagt

SEQ ID NO: 662979 - DNA, 160 bp, Homo sapiens
ccagtctcgctcgtctctaacacgctatagcggagtgttccaggctgccccaacactccaggcctgcccctcccactcttgaagaggagtgccgcctcctcggggctcaggctggcttgcccggctctttcttccctcgtgacagtggtgtgtggtgtcg

SEQ ID NO: 662980 - DNA, 274 bp, Homo sapiens
gctctgaggaccctatcgccaacacagaaaacacaacaacaataaataaggtataggcattacatatatggatatatgatgcataaacaaataattttttttaccctacttcaggttacttgaaagccttcttttgagtgactagatttaagttttgttgaacccgggtttccagaagttttgggttttcattctcctcagacaattttgggctttcatttatttcaaccaaaaactttatattggactggtttaattttaggcagcatattta

SEQ ID NO: 662981 - DNA, 493 bp, Homo sapiens
ggcatttggggggctcagaaggaaattagctcggcttccatacctataaggactgcctaacttttaaactcccggcactcaaagatgtggacacacacacgtacaggaaatacagccagactccatctcaaaaaaaaaagaacgaaagaaagagagcagtgtaattggagcagggaaaatgcagcatcgtaataggaggtacaggttaggagctctggctgagaaatcccgtctgtaccatgtaccagctgtgtgacctggaacagaagaataaattcaccttcctgaggctcagtctcctcatctgtcaaatgcaggtgatgtaggacctcctgggaaggatgtgagcatgcaggagatggtaaatgaaaagcacttagcagagtgtctggtgcataataagtgctcagaaaacactggcctacgctgttcattatagtaatactcagatgagggggacctctgagtcaattaaacagttgctaagctctta

SEQ ID NO: 662982 - DNA, 320 bp, Homo sapiens
ttgcaaaacaaaccccgaacccattaaacaatttttcatttgccattttccagccagccttgggaacccccattttagttctgtctctgtgaatttgactgtgtaccccgtgtaagtgggatcaaacagtatttggatttttgtgaccggcatatttcacaaagcaaaatctccttgtggtttatccatcttgtagcatgggtcaaaatttccttcccttttaaaaataaaaaaaattcccttggggggataaaccccctgtgttatttcccccttttggttattgtgaataaaactgcttccaacatgaaaaaaaaaaa

SEQ ID NO: 662983 - DNA, 1080 bp, Homo sapiens
atcaacgcacagtggccatatacggcctgggggacttgtgactccctgctccgctgctgccgcttcggcccctgacacgcagacagactgccagccgccctgcaccggaccagctcccgccgcggacccttgccgaggtccctctcctggtcccctcccggttggtccgggggtgcgcagggaggcagggacgggcgcccagtgggaagctcagagggacgcagcgcgcgaagtgctccttatgatggacatatcacggcacgccaacatcttggtgcgcagcagacgggcacaccgctggcacagtcatcgccagccgaagtcagccctatgagggacccggagggggcatcacgccacccaaaggaccggagactgcgattcgcggacacagggccacccgggactgacggaagacggacgatgatgcgggacggaccgagaagacacgcatgaccggacgccagacgaagcaagaatacaccgactgggcctcccgatgcagccaattgggatcaaaccacacacaacgccaagaggatagcacccggcaccgacccgggggacatgaagagcccggaacgcacacgtgggaacaaacgagggccgttgaggaccagtcacaggaacccgcaccaagacctcacacaggaaagcagcagggtaacccagcggcattgggagtcggaatcgaagacgggagaaggagacagcaaaaagcgcgggcacagcgggcagacacgccgggcgacaatacctcacgcatggggaaacagacgacgccaaggtgggaacaaccggtgacagagagcacgaaaggccaggaacgagcccgtgggaaggtgccaccaagaatggcacagggatggccaacggacgcgggaacaaacgcaagtatacagaggaatttaaccgcaggaaacacgacgatcggagaaacccagagcatgacagcacaccatgactatacccagcaaggccgacgcagagggacggagagggaaacacacaggagcgatggaggaaccacaaaagagaagccacaatggcgaacgaacagacaagaacgtagtgacgagg

SEQ ID NO: 662984 - DNA, 622 bp, Homo sapiens
gtcctacaattcttaacattctcgagggttagaaagaaacacagaaaaattgcatcggtacatgagtacagtttcacaaataaatacatagactgatgtttcagacttgtgcagaatatatatatccattgcagatgaattgcatatttctgtgataacctggagaaaggcgctttcatgctgacagacaaactgtttttgaaatcgaaaaatgtttcatcattactaagcaggatatgcctcgtgacattgctgtctgtacccataatcttcatgtgtcgtgggagggacctggtgagtaagtaattgaatccatggaagcagtgactcccatgatgttcctcgtggattggttacatacgagtgaattagacaaattgagtcgtataccgttgatcgagtatacatgtagacaacatccaaaccaaggtgcagaatatttactcatatgctatgtaagaatcctgtgtactttgccccttgacaggtgaggatgatgccatgagttttgaaccaaaagatctgttgagcatcagggctgggaccctggcgccttctctttacgttaagtaaagagtgatctctctttaaccctgttgacctcagaaaaagtggtcagatt

SEQ ID NO: 662985 - DNA, 395 bp, Homo sapiens
ccggtgggacgcagcagatgacatccaccgctccctcatggttgaccatgtgactgaggtcagtcagtggatggtaggagttaaaagattaattgcagaaaaaaggagtttgttttcaaaggaggcagccaatgaaaagaaatttgcagccccagctgagaagaaccataccataccagggttccagcagggtttattattcttgggttccccagactcaccggaccccatttcctatgccttggagaccttttgtcacttgggtccctttttaccccccccaagactgtccccctgggcctgacccccctatgagggaaaaagtcccccctgggccaaagggagttcatgtgttactcataacatgcatttcaataaaaacatttttgcggtga

SEQ ID NO: 662986 - DNA, 113 bp, Homo sapiens
gcggaatgaaagtttctattccaactaaagccttagaattgatggacatgcaaactttcaaagcagagcctcccgagaagccatctaccttcgagccttccatttaaatgcaa

SEQ ID NO: 662987 - DNA, 739 bp, Homo sapiens
  misc_feature (9)..(9): n is a, c, g, or t
  misc_feature (19)..(19): n is a, c, g, or t
  misc_feature (54)..(54): n is a, c, g, or t
  misc_feature (61)..(62): n is a, c, g, or t
  misc_feature (69)..(69): n is a, c, g, or t
  misc_feature (98)..(98): n is a, c, g, or t
  misc_feature (109)..(109): n is a, c, g, or t
  misc_feature (121)..(121): n is a, c, g, or t
  misc_feature (131)..(131): n is a, c, g, or t
  misc_feature (166)..(166): n is a, c, g, or t
  misc_feature (186)..(186): n is a, c, g, or t
  misc_feature (211)..(211): n is a, c, g, or t
  misc_feature (242)..(242): n is a, c, g, or t
  misc_feature (265)..(266): n is a, c, g, or t
  misc_feature (288)..(288): n is a, c, g, or t
  misc_feature (321)..(322): n is a, c, g, or t
  misc_feature (331)..(331): n is a, c, g, or t
  misc_feature (357)..(357): n is a, c, g, or t
  misc_feature (373)..(373): n is a, c, g, or t
  misc_feature (379)..(379): n is a, c, g, or t
  misc_feature (381)..(381): n is a, c, g, or t
  misc_feature (385)..(385): n is a, c, g, or t
  misc_feature (393)..(393): n is a, c, g, or t
  misc_feature (397)..(397): n is a, c, g, or t
  misc_feature (401)..(401): n is a, c, g, or t
  misc_feature (416)..(416): n is a, c, g, or t
  misc_feature (420)..(420): n is a, c, g, or t
  misc_feature (423)..(424): n is a, c, g, or t
  misc_feature (463)..(463): n is a, c, g, or t
  misc_feature (481)..(481): n is a, c, g, or t
  misc_feature (607)..(607): n is a, c, g, or t
  misc_feature (629)..(629): n is a, c, g, or t
  misc_feature (639)..(639): n is a, c, g, or t
gcggcgcanggcggggcangggcactgtgtgctttctccgacaggatgagctcnctgcatnngggctgncgagctgcgatgccccgtcaacctggccngagagaacatnctcaaccctctncgaaggtcancccgggccctaaagctgatacccactagagcacanggaggacagtgccccactgntgagaacctgtgagctatgggtaanggagctcccagattccgaactaaccgatatnccagactactcattctgctccanntcttcacccccacctgcttctncacccagtcaggcaattggcttaagtcctcacnnataactcangatgcccaagaaatgaatgccctttncctctacaggagacgntgactngntctnttaagccnaaantcanggctttacaagaaantggnatnnaatagcctcccaagaaaagacaggaaagaggggtaatgngcacctaatgattttaangggcttttaattttccatggtttttcctggagaatggatgggaccctcccagaaggtttttcggaagcccgccaggcctgggtcttaggaaacagtgtagcttactaccaggccaagctgactggngaggatgatgaagacagcccangaggggactntgactttttctccaacctcggaaccaatgggaagctgcagccggcttccctgtctacagccggtggtggtgccctgggttgtcttgccgtgggggggggg

SEQ ID NO: 662988 - DNA, 119 bp, Homo sapiens
gtatctccctctacatccctcccgaaatactaggaatacttattctatatgagacatatataccacccaagttttaacaccatatcccatcggctgttagtgtatataaaaagaaataa

SEQ ID NO: 662989 - DNA, 594 bp, Homo sapiens
  misc_feature (9)..(9): n is a, c, g, or t
  misc_feature (19)..(19): n is a, c, g, or t
  misc_feature (54)..(54): n is a, c, g, or t
  misc_feature (61)..(62): n is a, c, g, or t
  misc_feature (69)..(69): n is a, c, g, or t
  misc_feature (98)..(98): n is a, c, g, or t
  misc_feature (109)..(109): n is a, c, g, or t
  misc_feature (121)..(121): n is a, c, g, or t
  misc_feature (131)..(131): n is a, c, g, or t
  misc_feature (166)..(166): n is a, c, g, or t
  misc_feature (186)..(186): n is a, c, g, or t
  misc_feature (211)..(211): n is a, c, g, or t
  misc_feature (242)..(242): n is a, c, g, or t
  misc_feature (265)..(266): n is a, c, g, or t
  misc_feature (288)..(288): n is a, c, g, or t
  misc_feature (321)..(322): n is a, c, g, or t
  misc_feature (331)..(331): n is a, c, g, or t
  misc_feature (357)..(357): n is a, c, g, or t
  misc_feature (373)..(373): n is a, c, g, or t
  misc_feature (379)..(379): n is a, c, g, or t
  misc_feature (381)..(381): n is a, c, g, or t
  misc_feature (385)..(385): n is a, c, g, or t
  misc_feature (393)..(393): n is a, c, g, or t
  misc_feature (397)..(397): n is a, c, g, or t
  misc_feature (401)..(401): n is a, c, g, or t
  misc_feature (416)..(416): n is a, c, g, or t
  misc_feature (420)..(420): n is a, c, g, or t
  misc_feature (423)..(424): n is a, c, g, or t
  misc_feature (579)..(579): n is a, c, g, or t
gcggcgcanggcggggcangggcactgtgtgctttctccgacaggatgagctcnctgcatnngggctgncgagctgcgatgccccgtcaacctggccngagagaacatnctcaaccctctncgaaggtcancccgggccctaaagctgatacccactagagcacanggaggacagtgccccactgntgagaacctgtgagctatgggtaanggagctcccagattccgaactaaccgatatnccagactactcattctgctccanntcttcacccccacctgcttctncacccagtcaggcaattggcttaagtcctcacnnataactcangatgcccaagaaatgaatgccctttncctctacaggagacgntgactngntctnttaagccnaaantcanggctttacaagaaantggnatnnaatagctcccagggacagagagagggatatgtgcacttatgtatttagaggctttttatttcccatgtgtctactgcagatggaatgaaacctttcatacccaaggctcaccccccaagacctgggtcttagtcacaggggtgcttactaccagncctctgctgtggggg

SEQ ID NO: 662990 - DNA, 312 bp, Homo sapiens
gtcgtatgacacaagtcattactaagttgagcaaaagagtatatatctattagcagaaagggcctctctggcagcagagattaaaaactggtccaacttcatttccatacttcagaggaacagcaaattgaggatttactctatctagtgacttaattccttactttgggaccaagttacataaaagaccacgaaactcctgattaaactggataatgacaggattctgtagacagggctgcacgtatcggatatcagaaagacttctctattctcagttaacatctcagagctagaacattccacattccc

SEQ ID NO: 662991 - DNA, 307 bp, Homo sapiens
tcttttatgaggcatgacgcaccaaagggtttgggcttccttcccccacctccaacctctaagcttggtatcccattatttatctgcattacttcttaaacctacatttcactatgtagacaagccaagacaatgtttattctacatgaatgaatcaaccctggtgcagtcaatttatttctccttagtaggataaaaagacaattgccatgtgatggattggatgaaacatagagcaatcggaaataatggtgaagaaggtaaagaccagcaccctgacagcccaatgttatttttctctctaaac

SEQ ID NO: 662992 - DNA, 1644 bp, Homo sapiens
  misc_feature (25)..(25): n is a, c, g, or t
  misc_feature (78)..(78): n is a, c, g, or t
tttttctatatatttttaatgatcnaaacaaagcatctaaaaccgcagtttctggaagaaccacttgtcttgcctgtnttgtatctctcttccgcttgtcctggctggacgctactaccggaccgcaaagcacgtcatcgctcgcaacgaacactacgacagataggcaccactcaagcatcgccccacacagaacaagacaacacgaacgagcaggacaacccgacacgctagcacccagacaaacagaagacaagacaagacacagtggagcacaacgagagaaagcaataccgaccaagacagatacaaacagcactagaaaacactacaagacgaacagccgctactacaacctaacacacaaacaacactaacagacacacagcacaggcaaactcctgaaggacaaatacaccacaatgagaacaaagacacaaagaacaacaaacgaaaccagaacagacactgacagaccgaggactaccagacacaaaccacaacgacacagagaacccgacagaacacaagcgaaacggaaccaacgataaggcagagaagcagcgaaaagcacaagaacaagagacgcaacagaacaacagaggggaacaaagagcaaagaagagcacagaaagagacaaacacgaaagagacagggccaaccacagcgcacgaacgcaaagccaaccaaaacagcacaggacaacagaagcagaagaaacaagacacaacggaagacagaaccacacagacacaggaacggaagagagcaggacaagcgcaccgagcggaacgcgagagaggacaagaaagagagaacgagaagaggaaaagcagagagaggaagcacggacagaagagaagagaaccgacacgcagcgcagacgagaaacgagaaagaacgagaagagaagaaggacgagagagagcagcgacaccaacagcgaaggacgccagccgagaagacccacagcgcggggaaaagcaagagaggacagacacagagaggacagcaagaaagaacagacagaaagaggacagcaagcaagacaacaagccgcaagaacgcacacgaaacagcaccgcgcacagaaagccagaaacgcagaaaacagaagaacagacaacagagcaaggagcagatgacagcacagcaagcaacgcagcgcacagcagcagagacagaaacgcacagatgaataggcggagcgagcgaaaagaagagcacgagaagaggtcaaagaagaagagggaagagaaagcaaggagagggcagtggaggaggccagaagaggagaaaggagagaggggcgaagagaggcagacaacgggagcgcgccggggcgcaggcaggcaagagcagcagacgagcagggccagaggaagcagaagggagcaagcaggaggaggagatagaagagaagaagaggggaaggagagagagagagcgagagggaacgaggagagagcggggaaaggagaggggaggaggcgagcgaggcgagagaagaagcaaggagagaagcagagcggagctcgatccacgatcaggcagcgacagagaagagcgaaagcagaggaagaagggagacgcgagctcgcagcaggcgcacgaggacagcggccgcaggagagagaaagcgg

SEQ ID NO: 662993 - DNA, 960 bp, Homo sapiens
  misc_feature (796)..(796): n is a, c, g, or t
gtgctccccccacggagcccgcggcacataacttctcgcagcgttgtactcatgcacagaagaacggatgtgaagacaccaagagagcaacgcttttcatagttggatatattattttatgaattttttctaatttttgcttctttgtgagatacaatagcgacctactttttataatacgttggtgattcgctcacgtgacctaataccttagacgtgaatatcgttctacagaggacatacaacttcagctcttgaagctacaaagaagggggcacaggatcattaagatcagcacactgatgggagtaactctataccgctaggacggactctggaatattccgctagggccacgttgcccattaaaggcactgaacaattcctatctccaggcgtcccgacaacacgctaaggatgcaacgggactcagcgcggggaagaaagtgctcgtagacaaacgggacccctgtctattccttaccgcgacgcgactatccacgtggtcctgcgtcccttgcgtgaacggtagccagccacggttccactcgcaccgagggagaaaagaatggatggagactacgttagtttcacttcatacagatgtaagaatagatcatatcctcaacgccgctacctgacgcttagcgagcctagtcacctgtgcccagagggtggcccggattcttacacttaaggccgctgagacacccgcgcgcaccctcagcccttctctaactcgccctccttgtatggcgtttggccgttcgtcgcgaggctgccgctccgacgctgntctaactattgcggagtgcgtgcgccgcgcctgtcacaccgtaaactctttatcatgtcgggaaatacgactaactcaggacgagcagacagctgcgaatttacgccacacctttccgccgatattgcatgcctcgcttaaccatcacctcgcgttagagggcg

SEQ ID NO: 662994 - DNA, 204 bp, Homo sapiens
gcatctattgaaccgataataggaagatgctgaatatgagccattaagaatctgtctccccacctagacacacttgcactgtctagaatctaactgttactattttggaactctggagactgtttaatgcttacagatttccaagaataggcttcagattactaaatgtatgttcagttatcggttcagtacacatgctcccga

SEQ ID NO: 662995 - DNA, 188 bp, Homo sapiens
tagtggagcttacttcagctgggggaatcaaaaataaataagtaaatagagagcagtgagtgctgtggagagccatacagcagtgaatgtggggacgggagcaccagtggtggacatgggtgattagaggaaggccccatatgagaaacatgggatgacagcctgagacctggcagaaacgtgaggtg

SEQ ID NO: 662996 - DNA, 452 bp, Homo sapiens
  misc_feature (25)..(25): n is a, c, g, or t
  misc_feature (78)..(78): n is a, c, g, or t
  misc_feature (127)..(127): n is a, c, g, or t
  misc_feature (131)..(131): n is a, c, g, or t
  misc_feature (135)..(135): n is a, c, g, or t
  misc_feature (153)..(153): n is a, c, g, or t
  misc_feature (164)..(164): n is a, c, g, or t
tttttctatatatttttaatgatcnaaacaaagcatctaaaaccgcagtttctggaagaaccacttgtcttgcctgtnttgttttctaaaaggaaaaaaagtagaacaccatggagaaaggaatggnaatnatgnaaacctaatcccaccttncacgaccaaanctaattaactttttttaaattgaccttggcctcccgtcgggccttgcgtttaagagcaggatctctgaagacatccttattgacgacagttttgtccaaggggatatccacagagtacctggggacaaaggtggagaggcaggattagcccacatactgccggggcccctatacagcccaaatccttgtgggacactagggaatcagagtctgactccttagaagcaaccatcaaaagccatgtcccgatgacattatctgaaaattcacacttttttttttttgaga

SEQ ID NO: 662997 - DNA, 510 bp, Homo sapiens
  misc_feature (19)..(19): n is a, c, g, or t
aaattttgccctggggccnagaattcggcacgagtttttttcaaagaagaaatacaatttatttcaaagaagatatacaaatggcccaaaaagcacatgaaaaggtgctcaacatcattagcccactggggaaatgcaaattcaaaacccacattgaaaataccccacttccgtaccccaacaggatgactaaaataaaagagtcacaaatgctcataaagatgtggaaacagccaagtgtggtggctcacacctgtaatcccagcattttgggaggccgaggtgagcagatcacctaaggtcaggagttcaagaccagcatggccaacacagcaaaaccccatctctactaaaaatacaaaaattagccgggcatggtggcgggcacctataatcccagctactccagaggctgaggcaggagaatcgcttgaatccagaaggcggagattgcagtgaaccgagatcgcgccattgaactccagcctgggtgacagagcgagattccaa

SEQ ID NO: 662998 - DNA, 241 bp, Homo sapiens
cccacaaaaaatttaaaaaaaaaaaaaaaggtcaggcttggtggtgtgcacctatagtctcagctacttgggaggctgttgtgggaaaatcatttgagctccaggtttgaggctgcagtgagctatgatcataccattacactccagacgggtaacagagcaagaccctacctcttaacaaaaaacaattaaacaaacaaaaaagatttgaacctaaaatttcaaaggttagtccgggcgc

SEQ ID NO: 662999 - DNA, 394 bp, Homo sapiens
  misc_feature (55)..(55): n is a, c, g, or t
cggaaccacaaggtcgggaaaatcgaaaactacccctggcccaacatggtgaaanccctgtctctactagaaatacaagggttggctgggtatggtggcgcacgcctgtggtcccggctgctcgggaggctgaggcaggagaatcacttgaaccgggaggcggaggttgcagtgagccgacatcgcgccactgcactccagcctggtgacagagtgagactctgtctcaaaaaaaaaaaaaaaaaaagagaattgaatgttttcattcaaatgtgaatacaacattgtatttaacttggaaattctgaacaaatgtaagatggcagtgttggtggcagattcttttttcaatggcatagtgtcatattttagtttcattcatattggcctggtt

SEQ ID NO: 663000 - DNA, 874 bp, Homo sapiens
gagcgggtcgcccgcgcggaacggcagcaccatgctctacgtgggcgtgctggcgcagcaagctggggctgcaggtggtggagctgccggccgacgacgagccttccggcactgcgtcttcgtggaggaccgtggccgtggctgtgcgacggagcacggccctcatcacccgacccggggcgccgagccggaggcaggcaggttgacactgactgaacacgaagcacttacgaacaaacttcagctcaaatatacgtacgagcatgaacagatgaacaatgcaactttagatggcggcagatgttttattcacaggcagagaattccttcgtgggcctttccaaaaaggacaaatcaaacgaggtgcctgaacatcttggcctgatactttttaaggactatgcagtctccacagtgccagtggcagatgggtatgcatttgcaagagtttctgcagcatggctgggccctaacctgatcgcaattgggctctagtgaatctgcaccagaaggcccttaagatcatgcaacagatgagtgaccaccgctacgacgaaacctcactgtgccctgatgacatagccagcaaaacctgtatatatctaaatattcccgcaacaaagggcaccgtctcggctggcaccgaaccccggaagagtatccagaaagtgcaaagggttcactgagaaagctggaacggcaccaatatgcttcgataccccgctgaagccatggtctgaaacttgggaacaaagtgtaggatgcaggctggctcaccttgccttgattccagagttccaattgaaagcacggacacggctaacaatcccttggaaccttggcaaaatccccctaccggcatcccgagcacaca

SEQ ID NO: 663001 - DNA, 149 bp, Homo sapiens
gaacttggcactggtgtgtttgggcccttccatcttaaccctcctaccttgtgtccccatgctagttctgtctttcgtgtgctcgcagaatctgtctgcctcttgccccacctcagaggcttcttccagcctgggcaacagagtgggac

SEQ ID NO: 663002 - DNA, 89 bp, Homo sapiens
gtccccgcctctatcctccgcccacaggggttagtgggcacagggcttatggggactccccgcgtgataaattattaatgttccgcagt

SEQ ID NO: 663003 - DNA, 129 bp, Homo sapiens
attccagggcccctttggaaaaattctttattcttttgcttttttaaaaaaaaattttgtttcatatttaaagcccctgtattagtcaatgtttcgtgttccccattatttgaaccctttgcccctaca

SEQ ID NO: 663004 - DNA, 919 bp, Homo sapiens
tgtggcagcggtgaccgcctcctgggttattttcttttctcccccagctgccccaggttctggtttcccgaatcacttgtgcaaataaccagcaggtgggcagatgtcttttttgcgttcctacggacgcgtacgcgcaagttcgatgcgccggagtgaacagccaggtcccatctctcagccggctcccgggcggtcgctacgcagggaacgagaggacgcgccggccactgaaacactactagcccggaaagccgccctggaccttccaccctggtgcagcgagtctggcaggcccctcgccgcacgacccctccgaccagaacagtactgcgctgcgagccccgggcttccgccgcagcgcgcagcaatctggaggtgccatgaggacaccagtcagtcaagcaacttgatttaggctgggctgcgggcaattcctgacgctgtactactgttcccagatagcctgactctctccatagtcctgcgccctaggtactcgatgccccggcttccaggttgacccggagcgcgcccccttcgtgctctcgtgccgcgttcgaccgtcgcgaggcctccgggtcctgtaaaagcccgaggcagcacaggccgctgactcagcatccagcccgataggccacgtgttggccaagccggaggaaggggtggagtgaacggcccgcgagacctacgtggcgacactcgtgggccgctcttgggcccttccatctggtgtgccgggaggccccttaggccctccggtccatggccgatctgacggcgaatgcctgctccaggttaccgaggccccctgcgtgggaacccgttcggctcaggcaaaccagcacgagggcacacagccatgggcaaggccgccactagcgaaggtgccccggcttccccgccccaaatcccggtc

SEQ ID NO: 663005 - DNA, 221 bp, Homo sapiens
gggggtaaaaccggggggcgcccccaaaggtttttttttgggccccttccccccccgggggttttttgggggggggggtttttgcccccccccccccccccggggtttgggggtttggggggtttttcccaaaaatttttttcggggggggggggggccttttgggggggtttttggtggttgggcccttggcccattaaatccccccgtttttttgggga

SEQ ID NO: 663006 - DNA, 925 bp, Homo sapiens
  misc_feature (226)..(226): n is a, c, g, or t
  misc_feature (250)..(250): n is a, c, g, or t
  misc_feature (510)..(510): n is a, c, g, or t
ggcatggttggtgagtgccgctgccgtgcgtcggtcgcttcgtcttggaagcagtgttcgtgtatcatcatccgattcggcgttactcctcctaccataacgtgcgatgcggccatccgcagatgcgcatcgactcgcgattggaacactggagcagtaacgactcctccttagggccacctatacatgtatccttggcaggcttgctcgaacatacagggccganctgagatgtatgttattcatcttnttgaccggatgcaatacacatgtagatgacatcacctagaagctaccgatgatgatctttataacgaaaccggctcatggtataggcgggctgtgctgcaaagacggtagtgacgattgcagctatccgttgcgagaggccatgagtgacaactgtaactttatgcatcaggggggcttctcatatttatcgagatgaagccagttggcattgatggtgttgcatagagatggtggtgtgacaggggccaaatatgggtntcctggccgtatgttggggggccttatggaaagaataaacggacgaaaggcgaattagggtagtcgaaggggtctgcaaaggtgtgggatataaacgggagcgatggtgcggagtatgtaggttggtcactagccaagtgtaagatcagacaatgggtggagcagggaaaaggattgccgtagggtgcgtgaaaagaattcgcaaaggaaggaacggaatgggaattgttcgtaggcacatttgtgttacactgtgattaagtaatcagaggacgactgggacggttcacttggaccccctttgggagagaggtggctgtaacagtaggcgggcttggccgaattaacgtagaacaacgagagtaaggaactttgggatttgcttgctagtttgaaacttaatttggattggagc

SEQ ID NO: 663007 - DNA, 623 bp, Homo sapiens
gacagatagcactgggcgctagtcatggttctggaatgcttaaccgactgagtatgcgtgagatgacagcgcatgtgttcatccttaaccttttccttgccaatgatacatgtttgccgttgacgaatgccttacccccataactatggcgcagtactggcatctgaactcatctacccgcactagacgctctcacgcgattcatgtcccatgctaatgccctgtgagtatttggtttgcctgcactccggccttaatgcagaacgcgctgcaaggcattgtaaccctgtgcagcctttatgctgacactgttgaggatgaccttgtgtgctcatgtgtctatattcttagatcttctactcgtaactgagatctattggaagtcatcagagcctgtaactccatggctacattgtgttactgtagacatgatattgtattgtaacatctggacaatctgtcgagagtagctagagcatcctgagggctgagatcgatgatactcatatcgactaatacccgtgtttaccagcttgggcttcatggttcactactgcggcaactgagccgaatggttgccctccctgcagagaaccaattatgaagtgatccgggctgggccc

SEQ ID NO: 663008 - DNA, 237 bp, Homo sapiens
ccgatcatagtcaggaggtcgagacatcctggtctacattgtgaatccccgtctctataatgaattctgatcattagcctcgtgtggtggcgacacagctgtagtcccagctacttgtggaggctgaggcagaagaatcatttgaacccaggaggcagaggttacagtgagccgaggatcgctgctcactgcattccaacctgggccaacaagagtgaaactcttgtctcaaaaaaa

SEQ ID NO: 663009 - DNA, 827 bp, Homo sapiens
  misc_feature (281)..(281): n is a, c, g, or t
  misc_feature (399)..(399): n is a, c, g, or t
  misc_feature (426)..(426): n is a, c, g, or t
  misc_feature (768)..(768): n is a, c, g, or t
atgaaagtcagacagaagaagagaacgactacacaaatctggatgcctcaccaacttataaaggcgcttttaatgtgattacacgaatcaactcaaggagatcaaaatctaagatatgatgcactttcaagtgaaaagctgaacctctcaaaaagatttggaaaccaggcctacgcagcatgagattaagactttataaacacgcaggtgaagaagctggaaaaagcgccttaagagaagaaagatgagcccagcaaatataatcagcaacaggccctaantgaccagagatactttcaggtgctgtgtagcatcaattcaattatccacaatccaagagctccagtaataatttataaacagaccaaagggggagtccaaaattttaataaagatctngttcaagattgtggatttgagcatctngttcctgtaatagaaatgtgggcagatcaactgacatccttaaaggatttgtataagtccttgaaaacactatctgcagaactggtaccttggcttaatttgaagaagcaggatgaaaatgaaggtatcaaagttgaagatttgttgtttatagtagatactatgctggaagaagttgaaaataaggaaaaggacagcaatatgccacactttcaaactttgcaagctattgcttctcacttccaaaagttatttgatgtgccttctttaaatggagtctatccccgaatgaatgaagtttatactaggcttggagaaatgaacaatgctgtgagaaacctncaagaactcttagaattagatagttcatcctcattgtgtgtgctagtaagcacttgtgg

SEQ ID NO: 663010 - DNA, 198 bp, Homo sapiens
tccccccgggggggggggggggccttcctttttaaacccggcccccccccaggggggggttttttttaaggggggcggggggcttttccccccccttggggggggggggcccccccctgggcccccctttttaaggggggccgggccgggggggggttttttctttaggttttttttttttaggggggggtttgggga

SEQ ID NO: 663011 - DNA, 258 bp, Homo sapiens
tcctcctgagctcaagccaacaaagcacgatagagaaacacagctgaagcatggtcagatggtctccctgcatacgtgctccatgggtagcatctatgtgccagccttcgtaacattacccagcatgaagtgtaatttacagatttgtctcggatgtgactggagtcatgcaagtaattgatgaactgtattgtctaagtgtaaagatatgtctgccgttctccgcgtggcgatggtggggatcactcatagagtcga

SEQ ID NO: 663012 - DNA, 124 bp, Homo sapiens
gggggaaccccaaaattttgcctttttccggggttttgtaccccaggttttccctttgggattttttagggttgtttattattccgggggttttgggaaataaacttttgtttcccgcccccca

SEQ ID NO: 663013 - DNA, 229 bp, Homo sapiens
aagaggaaggttttcggtaagaggcccaaaaagaggccttaagcaaaaccccccttccccccgggttttccggttccctaaccgtttttatccaatggcccctttccttccccccaaaattggggtttccgcccctattctggtttttggtttttttttttggggggggttaaaaccaggcccgggccaaaagaagccccccaataaaacctggttggttgaaaaaaaa

SEQ ID NO: 663014 - DNA, 391 bp, Homo sapiens
ggcctgtacactgtgatatgcccagtgagtgagactggagctctgatctaatacctttgacattaaagtttgtgcagtaaaccagatatgtgagtttgccacatttgtgatagtgtgtcaataaattttcacttaaagggttaatattaaagtgggagcaagaattcatataccttaattggctttaacaggttttcttttcctggaaacacgatgcatatgtacacatgcacacagattggttacaatatcagcacgtgaaagggctttgcgacattgaagtcggcactggtttggtgccttttttgtgtttttggctcggtggtttgactgcgaggctttttggatagttttatatggtaggtggcttacacttgggttttataggcac

SEQ ID NO: 663015 - DNA, 854 bp, Homo sapiens
gcttcagtatgggggctggtcaccagaaacaccaaggcaggattaaagaattgaaagccagacacagtggctcacgcctgtaatcccagcactttgggaggccaaggcgggcagatcacttggggtcaggagttcgagactagcctggctaacatagcaggactccgtctctactaaaaatataaaaattggccaggcttggtggcgcccacctgtggtcccagctgctcgggaggctgaggcaggagagtcgcttgaacccaggagacggaggttgcagtgaacaacactgccctccagcctgggcaacagagagtgggattccgtctcaaaaaaaaaaaaaatttgtggggactttcagccccactgtaaacctaccaaaccctggggaggagggaaagcgttagggttaagctgatcaccaatgggcaatgatttatcaatcgtgcctagatgatgaggcttccataaaaacccagaaatgggttcagagatcttctggatagctgaacacatggggtcctggagagtgacctgcccgggaggacctggaacgcctctgtgtctttctccctaatacaatctccttatcgggtatcactggtagttccctttttggtaccccgtcaggtggcagtttgtgtttccccaggtcctggggttcctccggcaataaaacccacaagtgggtcctggagcccacgtgtaacgcgttttcgaggtcggaaccttcttgacggcggccacgccggctttgggcgcccccaccgcgggctgaggttccgcagcgtggcgtgatgggggcccccgtctgttgcactgtcgtcgggggggcgccctggctggatgtcgtc

SEQ ID NO: 663016 - DNA, 1143 bp, Homo sapiens
ggattgtgaggcctccccagtcatacggaactgtaagtccattaaacctctttcttttgtaaattgcccagtcttgggtatgtctttatcagcagcatgaaaatggactaatacagtaaattggtaccaggagtggggcgttgctgaaaagatacccgaaaatgtggaagctactttggaactgggtaacaggcagaggttggaacagtttggagggctcagaagaagacaggaaaatgtgggaaatttagaacttcctagagacttgttgaatggctttgactaaaatgctgatagtgatatgaacaataaggtccaggctgatgtgttctcaaatggagatgaggaacttgttgagaactgaagtaaaggtgactcttgttatgttaaagagactggcggcattttgcccctgccttagagatttgtgaaactttgaacttgagagagatgatttagggtatctggtggaacgaaatttctaaagcagcaaagcattcaacaggtgacttgggtgctgttaaaggccattcagtttcaacaaggggaaacactataacaaaatttgagggggtgcattaaagtttggcaaatttgcaggctgacaattgccaatacgaacagcaaaatcccattttcttgaggtgacttggggtgctgtctcaacggcctttcagtttcccaacagggcaacattctgcgtaaacaaacatttttggacgagtgcatttagaggtttggcgaaacattttggacagccctgtggcacatgccaagttcgaaaaagaaaagatccaagtgccacggccaccggctgaactcagagcctgtttaagtccccaggcacctttgtgaaaggccaaggccaagcgggatcacatttagggtcggacagttcacgaacacgtccctgtagcacaagattgtgagaaaaacccccgaattcttctttgaagaattttcaatatgatgcccaggaggttgtgtggcgcattgcctgtgaaaccccagtaaatcacaggagagcagttaacacgggagaaagtgttggaacccccaaagagcacaagtgtcgcgtgtgacttgtgatacatgcccatggagccctctgccctgggacacagagagtggaaatcgcccgta

SEQ ID NO: 663017 - DNA, 281 bp, Homo sapiens
tttatatgagacagggtctcactctgtggcgcatgcttggagtgcagtggtgcgatccttgggctcactgcaacctctggcctcctgggctcaatttattcagggatttctaagtctttctctctcaggtgctgtccagaagtacccaagatacaattacctgcaacagcttctgatagtcctgtctgtactcagttctcagccattggccattttcttcccccaagtctcagaactcttaactggtgccctccccctcatttctatctttgcatgcagga

SEQ ID NO: 663018 - DNA, 228 bp, Homo sapiens
  misc_feature (1)..(1): n is a, c, g, or t
  misc_feature (3)..(3): n is a, c, g, or t
ntngaggatacatttgcgtaactgggtttggtttagtctacctcaatttgcctgctatgatggatatgattgagacgagtgaggagaagcgcttacggtttagtcgagggacagatttggtatattgattgagatgggtgcgctactttatagtcatgtagagaagcatcaggccgcgtatgtcagagtgggtgccttgaggtaactttctgggactcacgaagtgaa

SEQ ID NO: 663019 - DNA, 107 bp, Homo sapiens
gtatgtaggctgacgtgtattcaccacgtgcggtgcttgcctcctgtacaagttccgtcgacaagtgagcaccgtgctgacctccaaatatcgttcagctggagcct

SEQ ID NO: 663020 - DNA, 1586 bp, Homo sapiens
gcattgcatgccctagaccagagttggtggctggacctcctgcgacttccgagattgcgatgctgtacttctcgtttgtttttggtgctggctctgagcctctgcagagatgtgggcagctggtcaggatggccattcggtgctcagcacagcaacgcagcccagactcagactggggaagcaaacagtggctggacaggccaggagagcctgtcggacagatgatcctgagatgtgggagtttgcatgcagagggagaaggacaggacagatgtcgctggcctggagctcattgcctcagagcaacttctgcaagccgcagctgcagcctggagtgccctggaggatccatgtactggcaacaaccaagatactacgagagaggttatcctggccaaaaagatcactatggcgtgagcagcagcagagtggtcggcatcgaaatatgaggctgcattgtgccaagacagcccggagccataggacaaggacatgatggacacattggaatacctgaaacagaagcgggaagatcagacggtcccagacacactaactaccggggataacaccaagaccaaacctgggagcagacataccaacagaaccatcacatgcaaaccccatccaacgaaacccggaaatccaatgaggagacatgatacgaccatggaaccacggaaagagagcagaaccaatcagacaaagaacaacagagacacaacacatggatcatggaccggtcaaaagaagcgcgaaagtactcaagaacacacatatagacaaacctaacgacagcaacgaaacaaaaatgaaccgactaaataacaagcccacaagcccacccgacaaacaaggcgaaacagcagcaatgggcagacaagccaagcacgacatggggcacaccaggaaccgaggcgccacgaacgtatccaccgggagcacaaatgagaatccagtacacgttagacgttggacagcacaagaagcagccgctaaggacgacagcgaagccacatggacaccactccgccctcagcacagtgacgaaacaaggagtcgagacaagagacaggacgcaagggcgagacaacatcgtacgtgcacaagcaaaagatgaggagaccagaacacagcaacgtcgacgatcgtgacacgagacgaacacacgagaacaaaagcacaacaacagatagaaagagcaagagacaaacaagaacaacagacgaagagaaagtcagaggagcatactcggctgaggcacccgcccaccgagccaccgctaacagacagacacgggacaagaagatcagccacaagcaggaagcacaacaaacgaagataccacgcacaataggaagaacagaaaaagaagagagcaacaaaaagaacgaacacaaacacacacacaaaaacacaagaacacagctacagaaaagaacaacaagcgaagcgaggacgaaaaagagcagagaagacaaaaaaagagagatacaaacacagcaagaaaaaacagaaaaaaaaacacgagaagaaaacagacagaacacagaagacacacgacgacgagaaaaagcagcaacgaa

SEQ ID NO: 663021 - DNA, 252 bp, Homo sapiens
  misc_feature (115)..(115): n is a, c, g, or t
  misc_feature (129)..(129): n is a, c, g, or t
gaaaaataccatgaactatgattaaaaaaggaaaaggattcaagacctagcacaaacatattgagtgatgaaatatttgaaggtcaaggataaggcaagggggatctgggatggnggccacagccaatnactggctggtagaagtagaacaggtgggctccactgcttccaggagggacagctgtgagatgccagtcaggttccagctccctgtggggatcgggctgtggccaggtgtcaactcaacccaca

SEQ ID NO: 663022 - DNA, 342 bp, Homo sapiens
tttttattttttatctggtgagacagagcttgctctgttgcccaggctggagggcagtgtctcgatcttgactcactgcagccgatgcctcccgggttcaagcgattctcctgcctcagcctccaagcagctgggattacagacatggaccaccacgcctggctaatttttgtgtttttagtagaaacggggttttgccatgttggcaggttggtcctgaacacctgacctcaggcgatccacccgccttggcctcccaaagtgctgagattatagacgtcagccactgtgcccgaccagctcccacggtcttgagtcctggcacccacacatttttttttt

SEQ ID NO: 663023 - DNA, 157 bp, Homo sapiens
ccagtgactcttttaccagtgcaactcccaggaacatgagagagtggctcaacgtggccatcacccggaccctgcaccagtgcgaggagagccttttatgagctgacgcaaacagatctgctctttaccagcagacagcaccagagcagttcccctc

SEQ ID NO: 663024 - DNA, 114 bp, Homo sapiens
atcccctgaggtagaacagcatcgacacatccccaaccagctcttcatcaacctcactgacctactatacctggacctctgcaatgaacccacgctggtacctgagctcgaatt

SEQ ID NO: 663025 - DNA, 375 bp, Homo sapiens
actgagtggctgcattgtccactgggcgttctctgtgagaagaagaccttgcttggccaggactcgcagtgggtaatctgtttcatcgtcctcgggctaccgtcatggtgactggtgacagggagtgaacaaagctggctctacccccaggcagttgtcagtttcgtacccttgggagcaatgcagttcctcttgtagtctgtgacagtgttgccaattccattgcactccttattttctgaggaaactcctgtagtattgcagtaggctcccagtgaggaacagagtgtatatggtagggaaggcaaactcacgtgtgtgaagaacctttcagtcaccattgcgccagctccgtattcgcctgtttccggaaaa

SEQ ID NO: 663026 - DNA, 112 bp, Homo sapiens
ctcgagtagataaaactatacaaatcttccaagtgatcatacaatcagtgttctcagtacaggctactttaaagcgaactctggatgataagtcagacaatgactcttataa

SEQ ID NO: 663027 - DNA, 356 bp, Homo sapiens
ggactggcacactacacccattttcagtttttcttcgtcttaagacactcagccaagcgtggggctcatgcctataatcccagcactttgggaagctgaggcaggaggattgcttaaggccaagagttcaaatcagcctgagcaacctagtaagatcccctttctgcaaaaaatttaaaaattagctgggcatggtggtgtgcacctgtagtcccagccacttgggaggctgaggtgggaggattgcctgaggccaggagtttgagacctgggcagcatatgaagaccctgtctctaaaaaactaaaaataaaaaatagccaggtgtggttggtgtgcttgtggtcccagctactc

SEQ ID NO: 663028 - DNA, 333 bp, Homo sapiens
ggccccttccccggccccttttggggggggggaggggccaatatgggttttcccgggggggggcctttttttaaaacctccccaagggcccgggggggggggtttttttttaaaatccgggatttttttcccggggggggggtggggaacccccacctttttgggggggaacctttttgggggttttttaaaatttggggacccatttttttccacccccccggggggccgggttttggaggggggggggaaaaaattttggtttgggggtttgggggcccccccaaaaaggttttaaaagggggccccttttttatttttttcgccctttga

SEQ ID NO: 663029 - DNA, 126 bp, Homo sapiens
ccggagaaggataccccaaatcagtaggtcaaaaataggcataatttaaatatcacaagtaggtctaaagtgtcatctaggcatcttcttatctagtagccaggtacctcttagatcttatacata

SEQ ID NO: 663030 - DNA, 401 bp, Homo sapiens
tactcaattcaaggaagagagatgctgtaataggcttacttagagagtacaactgatgagattagaaattatgacaaatgtctcatagtatcatcaagagtgagtgatgaaaacactgagaaaggtcttatataacctagagaggacaaataattaacagcgcaataggcctttcaaactcataggttagagaatggaggtaggtcgtatgtatacacctcttaataactgaccctgggcctagttgtctacctgatactgattctctccttcattcttactaatagaactctgatcttgttaaggaaagcaatgtatacaggtaacaatacatttactggccttatatgcagataaaggggccataaggcccaaatgactaagggcaggtcagtacaagt

SEQ ID NO: 663031 - DNA, 788 bp, Homo sapiens
  misc_feature (499)..(499): n is a, c, g, or t
  misc_feature (506)..(506): n is a, c, g, or t
  misc_feature (533)..(535): n is a, c, g, or t
caaaaaccatcattgcagctagaaaccttgaatgcagtcggaaactactggagtcttacactctatgctcattatgagctaatcagtaatctgtataaacagatgtaggcaataccttgaaagatactgtagactatatatgtatagatagatcatattacccattaaagtctgggggacaaaagtggaattccactcttcttatgtactgaaaactttactgacaaaaggtgatgatgaagtgcattctgtagcagacagactgcagcatatgctttaaacccagcacaaaaggctgtgtccaggtgcagcctccttcacccttcctgcccacggtgaggattgaataaccaggacttggggatattgtttgttgtcagggttattctgtgtggtaaggaatattgtttcacatttatacattttctttttccactcacgtaagtttctatcttgagagcatagtccaaagtgcaaaacttggtgtttacaaggaaanttgtctnccagaactccactgtcatcactttcannnaaagtggaagtttgcatgaatatgctcagaatctaatattcaatgttctgttacattgtaagtgaagtccagctcaaaatagatttaataaattggatttatttggaccaaagcaaaggacgggaattccggaaggaatttgccttaatcccaatttttcccactttgaagaggaaaaaaattaatggggtggtaaggaaaatccgaatattggcttcataagaagattattattgaaattaaaccttaaacc

SEQ ID NO: 663032 - DNA, 150 bp, Homo sapiens
ccctagccctgccctttttctaaggccccgacaggtcagagtgcgcaactttctcaccccgtttgcccaaacaatcctctcaggaagggaggtaggggcctatacaaattttccgagaagaaattagagcctaggcgtttgccccccaaa

SEQ ID NO: 663033 - DNA, 370 bp, Homo sapiens
  misc_feature (4)..(4): n is a, c, g, or t
  misc_feature (49)..(49): n is a, c, g, or t
aatntcaaagagaccatggcccctctccgaccagagatttcaagagcanccacagtggaatgctgtgatctcaaaactcataacgtttggtaaaaactcagtaggctttccaggtcgatcaacaaaaatgaaacttaaagcagcttttcacttaacatcaaagcaagaagaaatccatcatgtgaccttacacttcaatacttgaaataggagcatgttacagataatatacaggtataataaaacggactatgactctttacattgaattatgcattagagtgggttactataaattgaatccaagccatgtaactccatgaaaataaagtatatggcgacgctcagaaatatcatagtaaaaaaaaaa

SEQ ID NO: 663034 - DNA, 158 bp, Homo sapiens
catgagaatggctcactgatggtggctgctacatacctgggctgatgatgccaatgtggttctgtgacctgtgacctcgaggtggacaccactctcaatgagcctagagccagacagatcgatgaacatcctgtgagcccagatgggcagcctgcaag

SEQ ID NO: 663035 - DNA, 334 bp, Homo sapiens
gtggtgactttgccagcatgttagtgccacgacgttgccaaaccaatgggtcaggttttctggcgtgcaaattgatgtgccattccgatttaaaagattgtgatactaccgtaacaaaaaatggcaacgttcacctgtaatggcactgcggagtactactcagtatgacaggcgtttgcttaaccaaggccttgatcctgattgctgcatacaaacgtggccgctgcaaatgctatatgaatgatggtacagcggccatcacgccagagcacagaaaccgggaacatgttgttgcaggatggggatcagacgttgactttaaagttgattatat

SEQ ID NO: 663036 - DNA, 872 bp, Homo sapiens
  misc_feature (778)..(778): n is a, c, g, or t
ttggcacgaggcctccgccgccgggcgagcgacacgtctgcggcccttcccctcccttcccttccctccactcccatcccccggctcccggagacccacgtaccccgaacccagatggccgaaacgggctccccgtcttaactgattttgtgtgtctccctcgaccaccacctctttgtgcagcagccccgggcagacctgttccgagggcaacgcgtcccacagtcggcccccaaccacacgaccccggaatcatgcatcggactacacggatcaaaatcacagagctgaacccccacctcatgtgtgcccttcttgcgcgtggtacttcatcgaggccaccactatcgtgcagtgctgcacttccttctgcaaaacctgcactcgtgcggctacctgtgagatccaacaaatactgcccatgtgtgacgtgcaggtccataaaacccggcctgcagctcgagcaatcaggtctgacaaaacacgttcaagacattgtctacaaaattggtccctgagctattaacagactgagatgaaacggtggagggacttcctatgcagacgtaccccactgaacggaggttccccaaggggttcaattggagcgcaccggaggggaggttcatgcgagcaagcagaaagggggctctgagtgatgaatgagattgctcagccatcttccattcgaaattcctaccaaggtctccaggaaccgggacaactatgaagcggcccccgtgagcacttgcgatttgcggacacagggacaacacgncggtactgatctgtcacgttcccataatcgagtgagcgcactcactttgccggattccccagaagtattctcacatatcaaggtagtccgtgat

SEQ ID NO: 663037 - DNA, 123 bp, Homo sapiens
  misc_feature (13)..(13): n is a, c, g, or t
  misc_feature (25)..(25): n is a, c, g, or t
  misc_feature (77)..(77): n is a, c, g, or t
ccggaatcacatnatttcgctgggnccctgggtcctgctggcacatggaaaccgtggtgaatctggtccttctggtngtgtccgtcctgctggtgctgtaggcccaagaggtcctagtggcca

SEQ ID NO: 663038 - DNA, 254 bp, Homo sapiens
  misc_feature (41)..(42): n is a, c, g, or t
  misc_feature (199)..(199): n is a, c, g, or t
gtgaactgtgaaggcctctgtgtggtgtcttcctccactgnnttcctgggggctgtttagctttaatttttctatgaaggacaacctggatgattggttaatcccttactgtgggtgggatgtcatctctggtctggcctcggcctgttctcggtagtggggggcttgatggggcagcaggagctgggcaggccatttncccctggtatgggggagcttgttcctaaggctctctgggcagccttcaatggtca

SEQ ID NO: 663039 - DNA, 114 bp, Homo sapiens
cgtttcagcatcactgacgagtccagcgccatggcaatatgggtcacgtggaagccaaagaggcgaatggaggcaacagtggacagcacaatggacaggcaggtggcaaagccc

SEQ ID NO: 663040 - DNA, 273 bp, Homo sapiens
actggttttctcctttgtcctctcgggtcaagcggttctcgggcctcagcctcccgagttgctgggaccactggtgtgtgcctccacgctcagctaatttttgtatttcttgtggagatggtgtttttccgtgttgcccaggctgatctcaaattcctgggctcaagcaatgcttctgtctcagcctcccaaagtactgtgattacaggcatgtcccaccatgcccagactaatatttacttttaatcagcagtaagatatggttactactta

SEQ ID NO: 663041 - DNA, 348 bp, Homo sapiens
  misc_feature (183)..(183): n is a, c, g, or t
tcagagtccctgtgctcctcttcacatctgatcagagtacgtctcatctcttctcatcttctcttctctgtgtctctcctggcaataaccaggctcaggaaggacttggggggggaatcaggaggacactcagcttctccatccttctcagctgcccccaaaggcttgacctcactctcctcncatcactgggttggaccaccaggacttgagctggggcctctgggctggggctgaggattgcggccctggggcagcttctcctttcccagtttcttcgtgtgccttttcctccttctcctcgggcgcctctcctgaacgatactcccaggacctggggtcggagcc

SEQ ID NO: 663042 - DNA, 460 bp, Homo sapiens
ttaaagtacccgccgcagctcctgagtagctgggaccacaggagtatgtcactaaaccctgataattctttctttctttcttttctttttattttcttttttgttttttgttggtttgtttgtttgttttagagacaaagtcacattacgttgcccacgctggtctagaactcctaggctcaatccatctatctcagcctcccaaagtgttgggattacaagtgggagccactgcatcaggcccagatttttttttttttatcctatttggtctaggcccgtttttcccgagactacacattttaataagaagactgggaatgagtcagaccttttttcaaaaactcctacatataattccattaacccgttagaacaaacatctaaggggaacggcagtcacctccattcacaggtgaaagggggaaatccagtggcgggtagctataaagggtaccga

SEQ ID NO: 663043 - DNA, 108 bp, Homo sapiens
caggcaggcagcttaagctcaggagtttgagaccatcctggttaacacagtgaaaccccatctctataatacaaaaattggctaggcgtggtgttgggcgataaatca

SEQ ID NO: 663044 - DNA, 707 bp, Homo sapiens
  misc_feature (388)..(388): n is a, c, g, or t
cttgactgacaacctctacaaggacctcttatcatctcctccgtcaccaaccacatctagccatgtggtaagttgggaggatcgctgtcccattctgacggtgacggcgtgggtggacatcttacaccctgaaggaggatgctcgcaccgaaagcaggagtcgcgcttctgcgtgctagttactgcaactccgtgtgggccacctcgcaaggtagtctcctggccattctctgtgtggtgaagagcaggccagaagccatgactatatgcaggccctgcagtgctgggtaccgtccgcattatgctcaacggagagaactcccgggacagtgtaactcgggaacataacagatggacccttgcgttaggtagcatgcctcccttagcncagtgtgcaggtgcccgagctcctgtgagtcgccttttgctaagagtacgagcttgtgctcggacatagcagatcccatcaggaaccgtgactcgcgagataggtccaataggtcaactgtccccttaggggctgttctgggatatgtcatgttgaagataaccatgcatctcttcggatgatcctcgcgggagctcgcgcgtgaacgtgaccattacgtgcaatcgaccagttggcgttgcccggccgtaaggggactgaactaagagaagtcacgacagagggaactgctgaattgcaggagccccaagaagggtct

SEQ ID NO: 663045 - DNA, 189 bp, Homo sapiens
  misc_feature (26)..(26): n is a, c, g, or t
  misc_feature (167)..(167): n is a, c, g, or t
  misc_feature (173)..(173): n is a, c, g, or t
tcccatttatttggacttttttttgnctctattttcagggaaaatttctatcatataaaagcttatttcagttattataagtgcttattctctggttatttcttctttttatatcatgtcatgtttcatagtagcagtatctctggctatctctctgagtatattanacttanttctacttcagctctg

SEQ ID NO: 663046 - DNA, 1021 bp, Homo sapiens
tcaagggggccccgggggttttttttttggacaaaaaaaacccgccgggggatttctccccgggggcccccccggaaaataacagcggggccccatgtgatctcaaaacctctggggggaaaagtggagcgggcgaaaaaacaacaggtgcctgggggcccaactacacccgccgagctgcaaactcataaagccgtgccaagagggccccgaggaagacctgggctctcgtgaaaaagctcacataaggaacagcggtacacaacaaccccagcggggagggggaggccgcccaccatagcgagggacccccggccagagtgtgtttgtgacgcggggacaccactacaagcgcagcgccctgtgaagcgtgtaaccccacgagaagggagagagggggggtctcttgtggtttccccccagcaggggtgtacccccaagagagttccatggcccctcgcccccaaaaaaaaacaataatagcaccccagaggggtctgtccaagacaagattccccaggcgggagaaccaaaaattataacccagttggatgtggcccacaaacatcatcccctctataacaacattccgcgagagaagaacagcggggagtacgaaaaaactgatgcgcgccgcaggaggcgcccaaaaatcattcagcacagaggtgggccgctccattttgtatgatctctgtacgccccaggatcgagagagtacgcccccaaaaaaacgcgagtggtggacagcggagaagcagagaggagacatctcacagaggatctccccccccccgaagaagtgaatgagaaagaaccctctgtatgaatgcgcccaccaacacatctgtggtcggcccgggggcgccccattttgtgaccgcctccttagaaaagaaaacatcgtcgggccacgaagacgacctccctcctcgtgttgtttgaatctctggaaacaacgaaagagacacaggcagacgaggcaacacactactagtacaacagagcgacgtgtgagaac

SEQ ID NO: 663047 - DNA, 748 bp, Homo sapiens
  misc_feature (35)..(35): n is a, c, g, or t
  misc_feature (70)..(70): n is a, c, g, or t
  misc_feature (96)..(96): n is a, c, g, or t
  misc_feature (105)..(105): n is a, c, g, or t
  misc_feature (107)..(108): n is a, c, g, or t
  misc_feature (121)..(121): n is a, c, g, or t
  misc_feature (134)..(135): n is a, c, g, or t
  misc_feature (166)..(166): n is a, c, g, or t
  misc_feature (171)..(171): n is a, c, g, or t
  misc_feature (174)..(175): n is a, c, g, or t
  misc_feature (182)..(183): n is a, c, g, or t
  misc_feature (197)..(197): n is a, c, g, or t
  misc_feature (204)..(204): n is a, c, g, or t
  misc_feature (206)..(206): n is a, c, g, or t
  misc_feature (208)..(208): n is a, c, g, or t
  misc_feature (210)..(210): n is a, c, g, or t
  misc_feature (215)..(215): n is a, c, g, or t
  misc_feature (218)..(218): n is a, c, g, or t
  misc_feature (225)..(225): n is a, c, g, or t
  misc_feature (235)..(235): n is a, c, g, or t
  misc_feature (246)..(246): n is a, c, g, or t
  misc_feature (250)..(250): n is a, c, g, or t
  misc_feature (275)..(275): n is a, c, g, or t
  misc_feature (279)..(279): n is a, c, g, or t
  misc_feature (281)..(282): n is a, c, g, or t
  misc_feature (309)..(309): n is a, c, g, or t
  misc_feature (316)..(316): n is a, c, g, or t
  misc_feature (328)..(328): n is a, c, g, or t
  misc_feature (337)..(337): n is a, c, g, or t
  misc_feature (353)..(353): n is a, c, g, or t
  misc_feature (381)..(381): n is a, c, g, or t
  misc_feature (390)..(390): n is a, c, g, or t
  misc_feature (419)..(419): n is a, c, g, or t
  misc_feature (421)..(422): n is a, c, g, or t
  misc_feature (431)..(431): n is a, c, g, or t
  misc_feature (451)..(451): n is a, c, g, or t
  misc_feature (459)..(459): n is a, c, g, or t
  misc_feature (465)..(465): n is a, c, g, or t
  misc_feature (474)..(474): n is a, c, g, or t
  misc_feature (480)..(480): n is a, c, g, or t
  misc_feature (539)..(539): n is a, c, g, or t
  misc_feature (598)..(598): n is a, c, g, or t
  misc_feature (600)..(600): n is a, c, g, or t
  misc_feature (634)..(634): n is a, c, g, or t
  misc_feature (637)..(637): n is a, c, g, or t
  misc_feature (643)..(643): n is a, c, g, or t
  misc_feature (646)..(647): n is a, c, g, or t
  misc_feature (649)..(652): n is a, c, g, or t
  misc_feature (654)..(654): n is a, c, g, or t
  misc_feature (682)..(683): n is a, c, g, or t
  misc_feature (726)..(726): n is a, c, g, or t
tttgtggagaccttaggaggggggggggggggggncgcgcgcgcaggcgcgggaccaagtgcagagtggnctctttctggatgttgtagtcagagngggggcggncnncggccgagcggtntcgccagcgaagnncaaccgcgggcggggcttggagggatgcctnccttntcnngggtctnngccttgacgattcncgggggngngncngggcnccnccgtcgngggtgagggnctgaccagtgngggncttcacgaagatttgcatcccaccnctgngnnggggccccaggggcggggggggctctntctgggnggggtgtgaganagggtgcgnccatcgttccagctgnttcccggcgaagatcaacctctgctggncaggggggntgccgttccttgtctctgggtctttgccntnncgttctcgntggggttactgggctccacntcgggggngggggnctggccagngggggncttcacgaagatctgcatcccacctctgagacggagccccaggggcggggtggactctntctggatgttgggtgtgagggggtgcgtccatcttccagctgtctcccagcgaagatcnanctctgctggtcaggagggatgccttccttgtttnggntctttnccnngnnnntnttaatggtgttactcggctccacttcgnnagttatggtcttaccagttagggtcttcacgaagatctgcatnccacctcttagacggagcacca

SEQ ID NO: 663048 - DNA, 210 bp, Homo sapiens
  misc_feature (13)..(13): n is a, c, g, or t
  misc_feature (32)..(32): n is a, c, g, or t
  misc_feature (117)..(117): n is a, c, g, or t
  misc_feature (128)..(128): n is a, c, g, or t
  misc_feature (161)..(161): n is a, c, g, or t
tgaaattgtggtntgtgatgaattgtgtgaanttgagtgtggtgagtttgtgattttaagttttttaagtatttttggtaaggttttagaggttgttaggtgtaattgagttattgntaaaatgtatngttttatgtggtttttggggattggagaaaganaaataatagtgaatgttttgatatgaatattgaaagtgttttttaatat

SEQ ID NO: 663049 - DNA, 299 bp, Homo sapiens
ggcccccccagggggtccccccacccctggttaggccttgagggttttggacgggctccaggaaccctgggtttatgggaacagtgaggggggtcccctgccccctgccctgccttggaccaggagtttggaaatgcctggggagcccccagcatttggaggggaacctgttcccgtcggtccccaaaaatccccttttttttttggggttaaggaaggggccgaaagatcaaaaagttgtttttttgtaaaatgtaatgtaaatggggtttttagtaaaaaagggcccctttttccca

SEQ ID NO: 663050 - DNA, 620 bp, Homo sapiens
  misc_feature (501)..(501): n is a, c, g, or t
  misc_feature (503)..(503): n is a, c, g, or t
  misc_feature (516)..(516): n is a, c, g, or t
  misc_feature (520)..(521): n is a, c, g, or t
  misc_feature (559)..(559): n is a, c, g, or t
cggctcgaggggagatgagtgtctgcctatgggtagcttatgctagatgttgtaatttcatagtctgttttcttgcccctgtagaaatttgggattcaactgaaagaaattgacaaagaagaacacctgtatattctcatcagtacccccgagtccctggctggcatactgggaacgtaagatgggaaagaaggtggaacatggcctttctcagtggtgctttttttctaggagtttcacgtagatcagggtccagggttcagggtcacatagcaggtcatgggcagagctggggtataattctcccctagctgaggaatattggggaggctagatgggcaagctggttggggtctctcatgcaaatggctactgtcctcttggtgattctgggtgtcatcttcatgaatggcaaccgtgccagtgagggtgagtggctggacctgcagcttggggttggccacagcctgatttccatgctttatttccgtcccttgtctncncttgcctaccatngcannctgtctcttggaggcactacgcaagatgggacttgctnctgggtatgattgggctctctcatctcttgcctgtttgtgccatccctttgcaacagtgga

SEQ ID NO: 663051 - DNA, 342 bp, Homo sapiens
tctcggaacaaatttttttacttcctcctcctgttcctccccccccccccccttttccagttcaggatttggagttcaaccctgtttttcaaacagatcatcttgatttttttttttatcccccctccccttcctaagtcccattttttggtcataaaaattgcattattccccctttccaactgggtttttttttccaataaaaaatgatgaaaaaaaaaaaggcttttctttttttgcatgccctttaaaaacaaaacaaaacatttttcaggttccaaggaaaagcatgaaaacggtcaaagcttttaattatttttgtaaataaaagggttcccccca

SEQ ID NO: 663052 - DNA, 486 bp, Homo sapiens
ttcacgcagtgatataatatcaaacgcaaaaaggctgtaacaaaaataagatacttacaaccacagctatatgttgagaaatttaattaaggcagtgtattacaccaaatttttaagaaaaaaaatgtatttacacataaagcttacatttcaagaggtagaaaactgaatcaacaggataaaatagacaaaattgtttatcaacaataggagtaactatagttaataccagtggcaaattacatatgtatgttgtttgtttgcttgtgtaagagacagttcactgttgctcagggtggtgtgcactggcgtgatcatagttcactgcagcctcaaactgccgggatcaaacaatcctgctgcctgagacttctaaagtgctgggattacaggcatgagccaacgagcccgatcctaaatccagattttaaaagaatcataaatttcaagccctgggagaatatgaagatgaacatactacccaat

SEQ ID NO: 663053 - DNA, 541 bp, Homo sapiens
ctggtccattctgtacgttctgctcccagggtgcctgcgctgcctcactcaaccgacagtccctctctgcttgtctctctctctctgtgtgtggtacggctgacacagtcacctcttttgcctttgttggctgatttgcacatcatgccagcgtcgttcagtcttgaagggcggggagtgaattgcgctttacttttgtatctcctgcacccagtctcaggatctgttggctcagagtgagacctcagtggttgttaactaactgaatcaaaaaatagcaaaatacttatgagtaccaggctgaggctcagaagaattaagacacttcacagaacaaacattaaggggtgaaaaaaaaattggagagatagggtagataaggaataggaagagaagatgccaaaaaaggggcaaattaaatttccttatatggaagaaaaggcaagttcttgcttttgctttgattttagtaaataaattcagaaaaatatgtttagcactaagagaattgacagattgttcacctttaaaatttgtttaa

SEQ ID NO: 663054 - DNA, 144 bp, Homo sapiens
agtttgggggggggggggggtaagggaggggatggtttttttttaatgtttagttttttttttgcctgaaacgccctgttggggggtttttaaaaaacttcctccgggtttaataaaaaaataaaaatttttaaacctgcttta

SEQ ID NO: 663055 - DNA, 1073 bp, Homo sapiens
  misc_feature (1030)..(1030): n is a, c, g, or t
gcacgagcaggactagtgcgactactactgaaagtaccaactccagcactaatgctactaccactgccagcaccaacgtcaggactagtgctactaccactgccagcatcaacgtcaggactagtgcgactaccactgaaagtaccaactccaacactagtgctactaccaccgaaagtaccgactccaacactagtgccactaccactgaaggtaccaacgtcaggactagtgctactaccactgaaagtaccaactccaacactaatgctactaccactgaaagtaccaactccagcactaatgctactaccactgaaagtaccaacgctagtgccaaggaggacgccaataaagatggcaatgctgaggataatagattccatccagtcaccgacattaacaaagagtcgtataagcggaaagggagtcaaatggttttgctagagagaaagaaactgaaagcacaatttcccaatacttccgagaatatgaatgtcttacagtttcttggatttcggtctgacgaaattaaacatcttttcctctatggtattgacatatacttctgcccagagggagtattcacacaatacggattatgcaagggctgtcaaaagatgttcgagctctgtgtctgttgggctggccagaaagtatcgtatcggaggatagcttgggaagcactagctgtggagagaatgctgcgaaatgatgaggaatacaaagaatacttggaagacatcgagccatatcatggggaccctgtaggatatttgaaatattttagcgtaaaaaggagagagatctactctcagatacagagaaattatgcttggtacctggccattactagaagaagagaaacaattagtgtattggattcgacaagaggcaagcaagggagccaagttttccgcatgtctggaaggcagatcaaagagttgtattataaagtatggagcaacttgcgtgaatcgaagacagaggtgctgcagtactttttgaactgggacgagaaaaagtgccnggaagaatgggaggcaaaagacgatacggtctttgtggaagcg

SEQ ID NO: 663056 - DNA, 293 bp, Homo sapiens
cgcgggcgcactgcccctcccttgctccctcctcttccctccttcctactcctagtttcttccctcacttacacgcactatgcttacacgaagacccgaaaaaaacaacaaggagagaaccatagcaaggacggaaagcgaaaaaggaccggccagtggcacggaagaaaagtagagaagcaactgaccgaataaaggagcaaaaaatgaaaacaaagacaaacagcagacagaacagcaggaaaagaagagagagaaccaacagaaaaggaaatagaagaaataagaaagag

SEQ ID NO: 663057 - DNA, 379 bp, Homo sapiens
  misc_feature (121)..(121): n is a, c, g, or t
tttgggggatgagaagttgggcagggattaaaagctttctcaaattggcccacaacccctcagctgtatgtgaaaggggagctggtgggaggattggattttgtgaaggacctgaaaaaanaatggtggattgctgcctatactgaggggagaaaattaataaattttaaactgggggcccccctatggtaagaaatatttaattcccttgggggcggttcatgatttggtccccagaaatgggctaggaatagaaaattcctgctttttcggttacatgttttggggttttcccaatgtgggggtaaataaagggatggtccctttttttcccccccaaaataggatgccataaaccttttccaattttttcccatta

SEQ ID NO: 663058 - DNA, 867 bp, Homo sapiens
ggcgagtggagtgtccgttgtgcccgggactgcctcatgagcgtcccgggcttcatcgaccatcattgaataacgatcacgctgctgagcttccgtgcttatctgacatctagaggagctgatattgctccaagacaaactcggaaggctggacttcatgttgatgttagctcaaattattgaacgcctgctgatgtgtgctctgaaggaggatgataaagattgtcgcaacagtgtgagtgaacagctgtggtatccctactcttgatcctggcaaccaagtacaagcaagaagcgttttgattagaaagcctatgctgaacagctggctcgaaacttgtcgaagtaagtgtgaagcgccctggtcctcttgatgactgccagtttgttgaaagcaaacctatttgccactggggatgcgataacgagagtatctcctgatagatgatgacacaggtagtatctgcacgccctatatgtgacatacgtggccatgccatcttagtgggcgccatccagatacgagtccccaaactgagactgggatcagcgggttaaggacaagaattggcatgtttctggcaccatggaagatcctgcgagcctacttgtaacaaaggccaggcacaagccgctttttctgagacgacctatcctttgattgcatggccagctgttggtggcgaatctgtccacgcgaaagaccgtgaacgccccgcctttcccaacagagctcccttgcgcggcgaacctctcggcctccgggaagctgcaaccccagaaagcggaacccaatgcattcccccagcgccgcccacgctcgaatcccccacaccgctgtatcttgcgccccaccactcgcacaca

SEQ ID NO: 663059 - DNA, 1484 bp, Homo sapiens
gaccgctgcctgaaagacctttctaggccaggtcggggtccggcacccagttgacgagacagcgcggcgctttcagagctggggagaggcgaaaactcttccggcccccgataccccggcagccgtccccggactccattgccgccttctcgcgggtctggggccgcccagaccgttctcggcgcatgatcgtcaggctgatctcgggggccagtcgcagccgacgatgtgacgccgcgcgccccggtggtcgtcggatgcactgcgccctctcctagtgatgccagatggccgacgaccgcggtctgctggacagcattagtacgtggctttctgcctggctggtgtgtatctacttcgcttcagactagaagccgtcagccggctctcgtacaggcctccccgccagagcgcgtacatccgttaagcagcctgaaacacccatcgcctatcaactccaagtctgccccagttctgagtggacgacgatatttctgaccacgctttcgacgcgcttgggcccgaatggcaccacaacccagcgcccgtggacgcacgtaactatacaggaagcccatcgctcgcgcgcaacgcacttacgagccgcaaaagcgacgtggcactgccacacggcgagcacacaatcgcaacacaccagcaggcacgcgcaagcgcccaacgcagccaaaactgccccaccagacctagtgcagacacacaagcgaaccacagtatcccggcgcggccggaaaccggcgcacacaaccaacaccggaaattggaaggccaaaagcacagccgcacgtcgagcgccaaaggcagcgcaaacgcgcaatacgacccaccgagtgacaacacagcgcgcaccacgacgcacctgcgcagccaccccccccactgcacatacgcgggcacccaccacagcacacttcccccgtcacacagacagccaacccaacgcgacccaccgcaacgcaccgtcgggccgcaccccagcgccccgaccccatcgaaaaccgtgcgaaaacgaaaagaaaacagagagggccacacgccccgaactggaaagaagaatcgaccacagaaccagccgggccgaacacgccggccgaaccaggcagcgacacaaaccgatcacagaaagcccaacaccaatcacagccaaggcacccgagcccctacacaacacacgacacagagaagccaattatctggccaaccacgacccaacgaagaacggaccaccacaagcacaccgcagcccaccgcgccacgcagagcgccgcacgccctatcgacccaccgccgcgaaataacaaacacaagacagacaacggtgcgacgcaccccacagaacaagcaagacccgcacgggcgagaccaccagaccgagcacttcaacacacgcgcatccccactcgatcagcacaaacaagagatcgacgacagacaacagaaatacaccgccgcagacacacaacaac

SEQ ID NO: 663060 - DNA, 135 bp, Homo sapiens
  misc_feature (22)..(22): n is a, c, g, or t
  misc_feature (118)..(118): n is a, c, g, or t
aaactgacgtaagaagaagttntgtgtttgagcccatgtgtttctaaccagagtgctcttttccatggaataaatgtttcctaacactagtgtgaagatttaatcaacatacacaatntcctcatccttgggcag

SEQ ID NO: 663061 - DNA, 465 bp, Homo sapiens
aattcctcaaaacgtaaaacggaattatcacccagtaattctactcttaagtatataccggattagtttgactgtttgttcctatgcaaatctcatgttgaaatgtaattaatctccggtgttagagttggggcctggtgggaggtgattggatcacgggagtggtttcccatgagtggcttcaccatctctagctgtcatcaagattgtgagttctcacaagatttgattgtttaaaagtgtgcagcacctccccacttcctctcttgctctggcttttgccacgtgacatacctgcacccactttgccctccatcatgattggaagcttcccgaagcctccctggaagcagatgctgctatgcttcctgtacagaccgcagaaatgtgagccaaccaaaccctcttttctttggcacttacccagtctcaggcatttctttatatcaatgcaagaatggccta

SEQ ID NO: 663062 - DNA, 379 bp, Homo sapiens
  misc_feature (284)..(284): n is a, c, g, or t
ggaatgttgaccttaaatgtcttgcaaaatgtggcacatgataaatggtattaatatttgcaaaggctgtgtacacgcaaccacccatgtggttgaattccatcgcagtcttcatatattcagttggttatcaacttaaagtattttttattatatggaatgccgagtaaatattggtgtcttacgaaaatatagtacctgtcctatatagagttcacattcatgtgatttatacaatgtctaagattctcaatatgaagagtcacatgtatatagttgtgcancacatatacatctcgagttttactcaacatctcccacaggtatagctgtgtatatagtagagtgtgtgtctatactctcgtgcagtattcgtaca

SEQ ID NO: 663063 - DNA, 913 bp, Homo sapiens
ttaattccctcaactctgtgatataagcagtggccggatgtccagctgcctactttctgcccggatctctggctcctcatctctccggtctccgcagactaaagccctcgggatatgcagcagccatgcctgtgcacacgctgagccccagagagccccgctccgcaccccgccctaccatatgccgccatgcagagaccagggtccctggcatacactgcatacgggggccggcagatggaggagcccggaaaccgagcagcatgtggagcaggcctggaggccagacaaggccaagtacagtcaagagcctgcacgtggacaacaccacgcacaggagaccatgtgcagccgcctgcatgtccaagacaagccggctcattcagacccatagagacatctgcacagacaacaagatgcatcacagcccaagccagccagagcccatgccatggccccgtgccgaaggacccagactaggaactggacaatcctcagacagacatcatcgacttgtgtagacaggcccacgatgatccccatgacgaaggccaagcacgcaactccctggaacgtggaccgaggggacgcaggacaggacaaacacacagcagaacaaaacaacaaccagagaaacaggacaagcacgcaaacgataaacatcacagagaggagcgagcccagggagtggaacgtccagacgcaacgggacaaagaacaacagacagggaccaaggaacttgacccaaacgaagacggaacaatgcagacagacatacacagcacaaaaacacagcagcgacggaataaaggaacgagacaacgacgaacctggaccgaacagaacacagagaagcggtaacgaaagcggttaaacaaaagcggagagacaaaaagaggaaggagaagaaca

SEQ ID NO: 663064 - DNA, 407 bp, Homo sapiens
cccgttctcccttccagtcccctaagtatgtgtttagttgtgccttatccaccacatagcccagtaagtcttcagttttggctgggcatgatggtgagcgcctgctgtcccacctacttgggaggataagcccggttcaaggcttcagtgagccacgatggtgcccctgcattcccccttgggggccagaatgttttcctggctcaaaaaaaaccaaaaaaagtagccaggcatggtggcgggagcctgttgtcccccctgttccgcaggctgaggcaaaaaattctcttcaacctgggaggtggaggttcctgtcagccgacgccacccctttgcactccagcctgggtgacagtgaaactttgtttcaataaataaaaaataataataaattgctcaaaaaaaaa

SEQ ID NO: 663065 - DNA, 545 bp, Homo sapiens
tgccagtttataagtaatttctagataaaatgtacaattgcctacaaaatgggatcagatgctttgtaacggcgttgtttcccaagtaggacctttgaatgcactgttcttgtggaccacaacaacttaaagggaaacacattgtcacgaagcgctcggtttatagtttcgggggatctattacctcgaaggcgtaaattgtcttttcccttgttgagaaaggttgttttaatacagaacaatgcgggaatatgtaaaggtgaaactacttacacactcttttgttaagtaggaggagttaaacaatttacaccagctgtgcatgtgtcactggggatggcaacagcattagtacttacaagcccatgcacagaaacttcggacaggtggcattttgactttcgtgcttattagcctacatctcaattgatgtataggaacaagggattgctaattagccagtgctgctagacactatggacatggtgtctatatatgtccgcatggcttctcggcgcctaatcctagaggttgatctcctgttt

SEQ ID NO: 663066 - DNA, 147 bp, Homo sapiens
catggatttgctggtgcagtacaactaggcttaatagggacatggtactggagccgaaacagatatatagaccaatggaacagaacagaggcctcagaaataacaccacacatctacaaccatctgatcttcgacaaacctgaaaaa

SEQ ID NO: 663067 - DNA, 383 bp, Homo sapiens
gagagagagagagagagtagagagcactagagagtgcatgaccaaccgactacttcacagaatacaaatgttcattgatgtacttaatctctgcaaggccacagcgcctcatacagaaattccgtaaacactagtctaaatgtacacagaccacactcggatgtcatctatgcattcggattcatatctcatttcggtggtggcatgactactggctctggcatgatccatgattccctgcattatgcatagtctaatgaacccatacatacacttgccagacatggcctgtctagacaatataactacctcaatattgcaacgaaaggaacgcacgaccacaatgaagatagtcatggggactgcggcctgttggtgctggc

SEQ ID NO: 663068 - DNA, 244 bp, Homo sapiens
tagagatcccgcctacgtggaactgccgaagtccagattcgagtctggactacctggacaatgtacacaaggattatctggacattactggatttgttcttgcttaacagtagggaaccccaaaaaaaggggtctcccagacgaaacacaggtggaggattccatccccaacatgtgctctgcagtcatcctgtaacaggaattgctttcaagaagaatgtggcgctcagccctatactgaagc

SEQ ID NO: 663069 - DNA, 248 bp, Homo sapiens
caatcctctctcttgggctcatcggacccgcgtttctaccttgccccggacagaatgccgggaatctataaagaaatagaaaagcttgaagtgatgggatcgttacggtataaaccccagccaaattatcctacagaaagaaatgtctgctgcagaggcattgtctattcctgctataagttcaaacagccggaataccagatcaatcctatgaagataaattgatcctgagccacagagcgaaatta

SEQ ID NO: 663070 - DNA, 1349 bp, Homo sapiens
  misc_feature (710)..(710): n is a, c, g, or t
  misc_feature (754)..(754): n is a, c, g, or t
  misc_feature (785)..(785): n is a, c, g, or t
  misc_feature (787)..(787): n is a, c, g, or t
  misc_feature (790)..(790): n is a, c, g, or t
  misc_feature (806)..(806): n is a, c, g, or t
  misc_feature (828)..(828): n is a, c, g, or t
  misc_feature (843)..(843): n is a, c, g, or t
  misc_feature (847)..(847): n is a, c, g, or t
  misc_feature (882)..(882): n is a, c, g, or t
  misc_feature (919)..(919): n is a, c, g, or t
  misc_feature (999)..(999): n is a, c, g, or t
  misc_feature (1015)..(1015): n is a, c, g, or t
  misc_feature (1043)..(1043): n is a, c, g, or t
  misc_feature (1334)..(1334): n is a, c, g, or t
  misc_feature (1340)..(1340): n is a, c, g, or t
ctgtgattggtccagtatgcagctgactgtctcctgtatcgtggagcagtctcattcaattcaagtgactggttcagaggacaccagtattcccagatagagctaccatctctacctcaccatgctccagggctccggtggagctacacactatcgccccgctagagtgaagctctcgtatcgtgacctaagtactatgcggtattgagataccgaatacaaaccgtatactgattggcctcgtgctaggaccactctgtcagtgtcctcgtgcatagagaggtctagcggaatgtcgtagtagtgcgtgtgccctgctcatacactatcacgagagtgacatgtgctagctagtctccgtgggaccaccggaggtgacacgtggagtgcactgcgggattgaggtgcatgatgaatgatggcgctctcgcccctcgcaggtgtgtcctgcaatgatgcttgtctgcacttgtgtcatgtgctgcctcattgcacgggtaacttatgttcgcactatacatgctcatgctactgtttgtctggtcctatgcaactaatcatacgccactcagtatgtcacgcgcctgacactctacaaatgtgtgcactgttgccactcttccctcttacaataccagctcaagacacaagtgccgagacacaatagagatctcatacacgcctagcagcgacatgctctcagacgctcntttaatctatcttctaaaggtcaggactagagccacacgtgtgngacccaatctccggctgggcgatgattgttncnagntacgcgggaaagcctntcccacagtcttcggctctgtnagccttcgtaattanagcntaatgtgcgaaccgagaagcagcgtccagggcagngctacctattgtggcttgcttgtggtggtcgcctcgntggtccgctgttgcaccctcgtttggtacgccatagagtacaagctccatgtgctagtacacactgtccggtttgctcgntgtattcgtaccacgnaagtcggccgtacgtagaggatggtacngataaagaggggcacaggtgtccctatgtcagcgccgcaagggggcccccttgggaacgcgggcggccggggcttggggataactcttcctctcatgggggggggctcggaccattgtggtggcccgcacccctctgctttacgtgggcagccgggtggggggcgcccaacagggcggcagggggcgtctcaccttcacgggagggcggggggacacaggacctcctataagatgcgagcacgccgccggacaggggcggggtggcgcgccacacatctttgtggcgtgtngtggtntgtgcgccc

SEQ ID NO: 663071 - DNA, 179 bp, Homo sapiens
agtcaggtcttaccgtctgagcagctgggaagcccagagaacactggattggaaagagctcatccaggacatctcacggctacagaggcgcaccgtgggcactcggtcacctggaggtgcccgggccctattatgcagctcgctactctgtgctgccacctatgttcgatcccggggac

SEQ ID NO: 663072 - DNA, 497 bp, Homo sapiens
catcctctgcccaccaaaatggcattagtgcttcttactcagagtgccgaccaaaaaaacagcgtgcgttccagccatctccgggtcaaggcatggacattcagaaatggctgcattggtgatacagtagtgctggtctcttgggggaaaaaaaattgatggctttgtaattcttttaaaaaactttaatttgctacaacaataatgcacacctttatgaagaaaagaacaacggtgtctcctctctctgagaggcggtaactgcttttaatggtttggcatatataccttcagacttttttctatggttttaaatttatacatgtaggtagttttatttttataaaaggtatctttcaatttagtacaagtgggtatacctcgttatttttaacacatgcgtaacctaggtaagactgtcccgtaattggtaatttacctcttaccgatggatttttaagtcatttcctcctgttaccaataaggctataatggcg

SEQ ID NO: 663073 - DNA, 114 bp, Homo sapiens
tcccgattttctcctgctgctgtggcccggacatggcgacttccggcccaaagattccggaggtcccctttgaaccatcgaagcctccagtcatttagggggctgagcccaact

SEQ ID NO: 663074 - DNA, 159 bp, Homo sapiens
gcggggaacaatcacttgataggcgtagatgtctcacagaaagtactaccgctacccagacattgggtcccttcggctgactagcctcaggaagcgcagccagcaggccatcgtagggcaaggtgacgagctataccctcaaggatagacccataccaa

SEQ ID NO: 663075 - DNA, 169 bp, Homo sapiens
cacacgccgataggtattatactaagttgagatgcatatcatttacgggggaaggcgcttggtgaagtacgccttatttctcttgtcctttcgtacaggggagcgaatttgaagtatcattgaaaccgacctggattactccggctctgaacctcacgatcacggtagg

SEQ ID NO: 663076 - DNA, 321 bp, Homo sapiens
gcatgatcaggactcactgcagcctctatctcccaggctcaagtaatcctcccatcttagtgccccaagtagctgggactacaggggtgcactaccacaccgggttgaattttttttaattttagtagagatgaagtgtcactatgttaccaaggctggtctcaaactcctaaactcagatgatcctcctgcctcggcctcccaaagtgctgggaattagccgggccaatcttgggatttttaatgggaatatgtggggcacaaaattgacaggaacatagggacattcttaaagtttcccttgatttggatccattataa

SEQ ID NO: 663077 - DNA, 691 bp, Homo sapiens
ccatcagctattactaggtcgttctccgggttgttatttcgtcacggggcttggcgttttcgattctcggtttcgtggagcctcgtttgtaccgatacataccgccgcgtacgctcccggtccctggcccctcagcggcatggcgtgcggggcgacgctgaagcggcccatggagttcgaggcggcgctgctgagcccctggctcccctgaagcggctggcgctgcgccccttctgccctggccccactcctgggccttcaggcccccaggacgccgagcacgccgccgccgttttcagaacgccagaccaccacctgcagaagtctagcagcgagcccagcccctgcccggtcagacgagtcggcgcctttcgcaactccgagagcagaatttttcaggaacataaaacaaggaatataggtcgtatatcacgaggttggagacattttagaaagtggtacttaactcagagtgaagctttgtgcttccgaaaagtcaaacctcactccttcagcaacttcacaggcaccatagctactccagggttccctcattggattgacagaagtgaccgagcccacaattaacgcctccagacaagtttgggcataatatagtgaggcgccatcttaaacagactattgacagattaaattcgggaaggacgtatgagcaaaatcctcaaatacg

SEQ ID NO: 663078 - DNA, 769 bp, Homo sapiens
atggccgtgtgcagtggctcacgcctgtaatcctagcattttgggaggccgaggtgcgcggatcacgaggtcaggagattaagaccagcctgactaacacggtgaaactccgtctctactaaaaatacaaaaaattagccgggcatggtggcacacgtctgtagtcccagctactcgggaggctgaggcaggagaatggcgtgaacccgggaggcggagcttgcagtgagctgagatcgcgccactgctctccagcctgggcgacagagcgagactccatctcaataataataataataatctctgttctacaattataacctaggaccaggccatacagagataggagctgaagggacacagtgagaagtgaccagaagacaagagtgtgagcctctgtcacgcccggacagggccactagagggctccttggtctagcggtaacgccagtgccctggaagacgcccgttacttagctgaccttgctctagcagtaaccccagcgccttgcaaggcactagcttacatagcagacctgaacaggcagcttcctttcccacggtacgcagacagactctcgtcaccacttctcggaaggccgacatcagcaactcccccaagccacctgagccctgccggctcctgacacgcgtcgtcaagcgcacggcccggcctccttcaatgtgcaccctgccaaccggtctgcctttcaacccgtgctccccactcccgcagccctgctcctcactgccgccaccatgcgccttc

SEQ ID NO: 663079 - DNA, 280 bp, Homo sapiens
aaaagcaagctgaggcgctgctcactgcccctcggagcctgcgagatccagctgcttcgggggcaggatggacaggaattggagcccagagcggactggctgtacagcttccggtactgagatacagccagggaggacagcaggctggcctagggacagactcagaggctctgtccctgggtctctgctgcattgtgtcacttgtgcatgagtgtgatcatccatctagctgcagctctgtcacatctacactatgctacttagataagtgggtgatggg

SEQ ID NO: 663080 - DNA, 398 bp, Homo sapiens
  misc_feature (71)..(71): n is a, c, g, or t
acaaagtcacaggctttggggactgtccgtggaatctttgggaggccgttattttgcccaccgcaccctcngtttatcccctgccctgccgggcaccttgttttaccccaggaaaatgtgagcttgttttcctgctcggcatgtgctccccctaagggtttgctcccccctgggcctgaaagttccttttcagcctgaaagggggccctttggattcaggcatgactcagcccggctgatgcctttccagtgttgagtcaggatttggggccggctcttttgggtccgtccccttttcccagggaatcccttacaaaactgtggccaggaagtggccggtataaaggatgccccaggtctttgtacgtgtgtaggagttagggggtttgaaattgtta

SEQ ID NO: 663081 - DNA, 432 bp, Homo sapiens
  misc_feature (193)..(193): n is a, c, g, or t
cattcgagttaaaaataccctccctcaccccaccctttcctcagcagatgaaaacagcctggacctattctggaaaatataatatccctgccacattcaaccccaattccctgcctcattgagaaatccagagatcctacggtttgggaactgaaagggacgttagagatatccctccccaattcaaagatgnctaacagtgaaattccctaattcaaaaaataaaggagtgaatttctacctagctgcactgtcatatgttattatcccaaatcttgtcaaatgcatcagtaagcaggagtgctgccaccagatcggcagggagagccaatgtttccacttcaaacctctcagaccagagaaaaatgaactggagatttggcattggaagacctccctctcgattggaagttaattttcttaacagttaaa

SEQ ID NO: 663082 - DNA, 433 bp, Homo sapiens
  misc_feature (193)..(193): n is a, c, g, or t
  misc_feature (236)..(236): n is a, c, g, or t
  misc_feature (249)..(250): n is a, c, g, or t
  misc_feature (299)..(299): n is a, c, g, or t
cattcgagttaaaaataccctccctcaccccaccctttcctcagcagatgaaaacagcctggacctattctggaaaatataatatccctgccacattcaaccccaattccctgcctcattgagaaatccagagatcctacggtttgggaactgaaagggacgttagagatatccctccccaattcaaagatgnctaacagtgaaattccctaattcaaaaaataaaggagtgtgantctcccaagggtnnaatccatgttttaattaatgaattataagtacattataaattgcaggtngagtgctgccaccagatcggcagggagagccaatgtttccacttcaaacctctcagaccagagaaaaatgaactggagatttggcattggaagacctccctctcgattggaagttaattttcttaacagttaaa

SEQ ID NO: 663083 - DNA, 173 bp, Homo sapiens
taatttcacgagtactgtctggaacagcactctccaaacatggctgattgctggtcagcaatcatatatgtcccagcgcactcaggaggctgaggcagaagagtcacccgaacccgagaggcggaggtcacagtgagccatcggtgagatcatgccattgtactccagtctgt

SEQ ID NO: 663084 - DNA, 424 bp, Homo sapiens
  misc_feature (16)..(16): n is a, c, g, or t
ctctagaggatccggnctgaatggtattctagcgtcaggttggtttttgagatggagtcttgctgctccaccgaggctggagtgcagtggcgtgatctcggctcactgcagcctccgcctcccaggttcaaggactcagcctcctgagtagctgggattaggcaccctctaccacacccggctaattttggtatttttagtagagatggggttcatcatgttggcaaggctggtctcaaactcctgacctcaagtgatctgcccacctcagccttccaaagtgctgggattacaggtgtgagccaccgtgcccagccttctacggttacttctttaaggaatctccacactacttttcatagagcttgtactaatttacattaccaccagcagtgtataagcattcccctttcaccagatctgg

SEQ ID NO: 663085 - DNA, 151 bp, Homo sapiens
atacgacctcgagtgtcgacccctccagctgcggcagaaatatgaggacaagatgtaagcgcatggggaacggtgacccacatgtctatcaagaacttttcagtatactcctgccccgagttcctgtcgcctgtagtgccccactatgata

SEQ ID NO: 663086 - DNA, 1313 bp, Homo sapiens
tctgaccaacaaaaaaagttttattggcggggggcttctgaaacaccaaaggtggtccccaaaaaaaatcctgcccgtggcagataaggagaggagattccggtgaaactctgcaggcacgccactcttttccatctcctctcggaggtgtgggtgcgccttgtggatgtgttcgcagaatatcaccaacgcacaacggagaagcgcaaacacaaccaacgtgggttagacaattgtgctctccacctatgcagtgccaaatttgcacaaatatccacacctcgtgcacacccttttaccactatatcaccatataaacgcaacaagagacaaatttctcccagatataacacttcgatctctaaacaccaaaaattgagccctattatacttgtcgttttacaacccaccaacgtagaattgtgagatatatctcacagaaaaacaacctccctatagccctatatatatcatataccccctctccctcttattgtgtgccagcatatacaaacacaagttataagagaaacacgactcctctcctaactatgttcatccaacccctattaaccaaatgctgtcctatcctttcctctacacacatttttttatcaccgacaacaaaatatactaccaatttattctcctctgatgagaaccacccccacaacacataacaactaaactcgataacatcaaaccacaactagttgatgtcatatcacacaactagtggtatatacctaccaagcgcagtagaagaaacacaatgtagaacggaagggaccccacaagcacccatatagtagctgctactacccagcccgaagaacgtatgtgatagtagatactacccccgacgtctgggccacacgtggcatacagtagtgtgtcgcgagtcctattagattcagagaagacatcacgccccaattattattatctcataccgatggctgggagccatctatctatctaccacggagcaggactaatacttacatgtagtatgtagtctgaatggggaaggacgtccacaccaaacgaggtggggacgatcaatatctacccgaatggagtaagtagactggaacttacttcctaatttatacctaaaaaaaccacgcaccctttctacaaccacagccgcccgccattattgtagttaagcacgcactcaccctaatcagtatgaagaatccacgacaaaactacaagtattatccacaagcagcaagagcacgcctgtgtatggagtgaagacaacccccccccgcaaaatactaataattatatttagcgccaaccga

SEQ ID NO: 663087 - DNA, 867 bp, Homo sapiens
  misc_feature (56)..(56): n is a, c, g, or t
  misc_feature (120)..(120): n is a, c, g, or t
  misc_feature (151)..(151): n is a, c, g, or t
  misc_feature (166)..(166): n is a, c, g, or t
  misc_feature (172)..(172): n is a, c, g, or t
  misc_feature (242)..(242): n is a, c, g, or t
  misc_feature (309)..(309): n is a, c, g, or t
  misc_feature (313)..(313): n is a, c, g, or t
  misc_feature (316)..(316): n is a, c, g, or t
  misc_feature (325)..(325): n is a, c, g, or t
  misc_feature (604)..(604): n is a, c, g, or t
  misc_feature (854)..(854): n is a, c, g, or t
aaaataattaactaaagcaaaaaacaacaaaggcacagaaaagagactaaagaagncattcttaaggcaaaaaaaacggaggaagaatggacaagaaagaaaaaaaaaaaaaaacaaggnggcggaggggcgggagggggggagggagaanctaccaaaatgtganggagcnaaaaagaaaacatgcagcaacagtgctcctgcttaaacagcaccctggaaaataaaccagtaaccctggnagtgcagtaaccatttggttaacaggacaaacttcctgaaggacacagatagtaattcactgcattncccnacncaaactgcnctcttcacaccaataccgttgcgttcctttaagatggggttcaacctgttgacaaaagatttgggtttatttggaaagtaaagcagataatatcctgattgaagtattcaatgattaagatgaggaagcatggggatcaaactttggaaaaagggcaatgaagcgagggagcagagacgaacagtggcagcagaaaaaaaattcggagaagaaggatgtgaaaaagacaaaaagaataagcggtgaaaaatcctagggattactgtgacctagacaatnaaaagcagataggtgacctttgattaaatccatttacttgtggagtgagctaaaaggaggctccaagacagagtttggttcccaacagtgtccgtggccaaagggcacactcagaaggtctcctcctctcgtaggaactggaacacggatgagaagtctttctttgagtagccctttgcacacatcatcctgtagatctgatgggccagactgccaagaaggattgggctctttgtgctgggagcagagncttgtgccaatcc

SEQ ID NO: 663088 - DNA, 214 bp, Homo sapiens
tgaaagctaccttttgcctgccatattctcggtgtgaaaaagaatccatcgtccccattatatacaaccctgggtgtgatcaccaaaggtacagttattgaagtgaatgtgagcgagctgggccttgtgacacaaggaggcaaggtgatttggggaaagtacgcccaagttaccaacaatcctgagaacgatgggtgcataaatgcggtcttgc

SEQ ID NO: 663089 - DNA, 129 bp, Homo sapiens
cctgtttctgccgttctgctgcttctgcttctgctttcacttctgcatcaagcagcctctgcttaacaattcagaatctaactgtgtcccctgtattccatcctgggggacttggtgacttgctgggtg

SEQ ID NO: 663090 - DNA, 1372 bp, Homo sapiens
  misc_feature (1266)..(1266): n is a, c, g, or t
taagggaaccatagtgggtattaggattaggatggtggtgaagtatagtccggatgctaactggtccaatgtagtggttaaaagggtagctttacgtggtgtgtgctccctcgcgaatttcgaggtttagaaagtgagggaggtcgtggcggcttaggaagttcaataaaggtaatgtggtttaggtggggcgaaaatattagtgccttgaggtgtgttgtggattattatggagaggatagtggggaattatggctaagagaatgagagagagtggatcagtcaataaggcgccaaggagacgccctccttcaatgtgggtacagggcacggaatcggaagaaatgtggtgtaggcggaaatataggaaaattattcatattcggagccttgagagtgtgtgaggagaagggggtggtttaaaaggggggttgtgggcatagaggagtattaaatggtgtcgtggggttcgccctagagagagagtgtcgtggagtggagaacatagtgtgtgtctaaatctatctcatctagagagagagacagacagagtgcttcagccagacagagtataaagcccggagaggaggcgcatcttatgtgagagagtgtggttgtctagcacaagagggggggtgtgggccaagggtgtggacacttcttatactcgggggcatagtgggggagagggggctggacaatctcccccactaaggagggggcgagcatgtagacctacgtggaggaaccatcccccccgggatacatcatgcggcggaggcccaagagacaaacaacataaggagcagacgcaggaggttgcgacagacagtgcggccgtgggacataaaggagggggcctgttgaaccaaccaacccaaaacgtgcgacaacgaaggcgggggccacaacagacgcacttggcaaacaccggcccgtggcaacacgcaggggggtgtccacacggacacggaacaacactcccgccgggtgtgcctctacgcaaacgggcgggtggccggggcgcagccaacccatgggggtctcaatcaaactctgcgggcgaaggcgacaaaggccccatccccctatcccaaaagcaatttcccatatgttgagaaaaccccacaaaagaggcggtctctggagggcccgccccaaaggttcgggtcatacatcgggcggacaattaggggaggaagagcaaaccaagaatcacaacagggtgttggcggcaccacaatataccattggcggaggagggcncccccccgacgacagcaacacaagagggacaccagttcgtagggccgggccccaccacgaggggagaaagggagagcaataacgtcggccctacaatagaacagcg

SEQ ID NO: 663091 - DNA, 651 bp, Homo sapiens
caggagctgttgataaactaaattgactttaagcaagtttcaggactcctctttatttttatttgtgagagacaagagtctggttctggtggcccaggctagtatgcaggtgtgtgatctcagctcacagcaacctctgcctcccaggttaaaaccattttcatgcctcagccccctacagtagctgggtttataggcatgcaccaccacacctggctaatttttttatttttagtagagatgggatttcgccacatgggccaggctagtctcaagagctccgggcctcaagcgatccgcctgcctcagcctcccaagagggctgggattacagacgtgagccaccaggcgccgggccggtctgtataacctcagaattacttggtacctcacaaatctcaagtactaagtactgaatcttggttctccccctcaccaagtcctttggaagtcacacagagaaatttcttgaattttagagagaggcgtatagaatattaataactaatgtttatggactggttattctgtgccaggtacttggagtactttatgtaccttatttcagttactgtctaggacaatctagtgagataagtaatatgatctccatttattaaaatattcccatcttagacaaagggaaagacg

SEQ ID NO: 663092 - DNA, 957 bp, Homo sapiens
ctcatcggtactcttactgcatttccctcgtgctgtgtcccgctcggcgttccatatggaacagtgatcgaggtgcttgttatgactgtcatcgtcttatcaggtttgtcctttcaggttcgcacttgttatacaatgtgagttgttaacctgcctcttgaaagattcaaccgggtgtgttggctcacgcctgtaatcacagcatcattgggaggccaaggcagttggatcacctgaggtcagcgagtctccgagatcagcctggccaacagtgggtgaaaaccacctgtctctactgaagaaatacaaatagaagtagcctaggcagtgcgctggcgtggtgcctgatatgatcacagcctatctgtgtgggatggctgagtgcaggagtaactacgtcttgacaccgtgtggaggtggaatgcgctgaatgtctaggttgcacgaactgcagccatttgtcaactccatgccctggtgtgacaataagtcaggactccgtctcctaagcatagaacagaggaacgatgtcatgatgctggctggtcccacaaggttggctggagtgtgtgaacatagggaagtctgacttgtgtgcactacaggttcgttcatccagtgctctgtgattcagcctcctagctgtgtggccggcccagtgatttgtgtagcaaggaatgttgtgaaattgagtgcttccttagtaaatcggactgtccgctgagagataattggctcgtgctattccaaggggccttcttgaagttgtttttggggcccccgaggaatccttaaaggcccccatcgattgcggaggcctccgtggcttaaattctgtagaagtggtggccaagtgggctcccagggctctgggctgggggcctgcccccccggggggtgttggcctcgcgtttcccgccttggcgctggggcccccctcttggcggccgggggacc

SEQ ID NO: 663093 - DNA, 785 bp, Homo sapiens
  misc_feature (455)..(455): n is a, c, g, or t
ccattctgatcatcctcactgacgccacagcgccaagagggtggtttcctgaagcagctgctagtgctaataacttgtgaatgacctctgttcttcaatcgagtcctctacgaagaacacaccagaatttgtgtcatgtgccattcaaccaaaaatcgatatcagcaattgtaaaattcccaaaactatcttactgatgcttacttcaaagaagaagagcgcggcggaagcccgagacaccaggagggtggaagcatcttcgaaccacagaagggagaggcaattatggagatacagggagcagcgcagggaattggcttcagaaacgtggtggcccccaccaaattttttacccaaaatatttcaaaagggtttattcccctcaaaggtcccaagggcaaaacccttggagatcctgggtgtttgggcttctgagccgagatttgggatttttntctccctccaacaaatttggggtctgtctctaaggtttgtcctttaagggaccctaattttaaaaattgacgctggctttaaccagaaaaagcagccgaccacatacccacgcagcagcagagcaaaacaacaaagacgtggttcgggcgcccggcgcccagaagaagagtttaacacacaacgtgtggggggcgggcccaaagtgagaacaccgcggcacacgtgcccaaaacactccgaagcagaggggtgcgctcccaaaaaaaccggcgcagcggttgacacaccaggcgtcggccatggacaaagggccgggctaccgcccgggg

SEQ ID NO: 663094 - DNA, 611 bp, Homo sapiens
ctgaggagccacccaaggaaaagctgcacaccctgtgaggagttctcctatgagttcttcagtgtgccaggctagacccagttacggcctactttaggtgaactagtaacgcgtttgtccaggaaggctgttacgactgaattgcctgtattaggtacgcacatcacctagtatagaagcctacgttatgctacagaagacaagcgtcgtcgctacctcgaagttcgcttagggcgccgtcagagggatacctacatagacgcgagcaggcacaaaaaagacaaagagcgacagagaaataacaaacaagaaacaaaaaagaagagcaaacatcaagaaaaaaacagaatagaaagaagaaataaacgacgaaaagaaccaaaggaacagaagacgcacaagaaaccaaaagcacagaaggacaaaaaccacgagacaacagaagacgacaacaaaaaaaaaggaaaagaagaaaaaaacaaaaagataccgaaggagcgaacagggaccaaaacacaaagaaaagaaacaaataagacagagcaaagaagaccaaaacaaacagacgacaaacaaccagaagcgaagcacagcggcaagagcaagaccca

SEQ ID NO: 663095 - DNA, 1067 bp, Homo sapiens
gatcacagccttgtctcctgtagcctctgtaagtaatgcattaacatcaccagttaagactagccaaagtgaagcaggaaaagtcaagagtaccgcttcatccaccacaatcgcccgagcctatacatcttacacctgacaatttcatcaaacccgttgcagtctctgctagctagaaaacatcacgtaaatgaaatctactagatcctggtcaggcctcctatccccatggagctcacagacaaattgttgacttcttctgaggtaatatcaaaatatctacgaatgttgtatgttgtacgtagatatccacgggttcaagttcttgttaggactccaggatgggaagacatggagtgctatcaagtaacaaatataagtccggaagcaaatgttcaacccggtgaagttatatcttcaagtacgtagtctggcatctttcacaccctcaattaaaggcatttctggtgccaaaaatcaaccatacatggctcagttaccgtcatctaggtgagctgcgggagtgagctactacatctagtgtctactatgcttttcaaggcaatagagtactcacggttctgtgctctatagttcgccgctggtctttgcgtccaccccactggggaaacagatcgtcaaaatctacacaagggtcaaagcttgaggcaaagtgttatgctaggtccccaagtatatgaccagtacgtgcttacatgcactttgtccccctgaagtccgttagtatcgtgccacattaccgtggcatcaaggaccactaggtctacgtgcagtgtcactagcatatcaacaagcattgtgggtcaccccatggctgagtcatggctagctaatctagccacgagtagttgatggtccgaaaggtacccctaaagtcaaaacgccagggaaagggaggggcgaagaccgttcaactgaaggaggggcaacaccgcacgtctgcaggggcagaaggccaacacactaggtgtcaaagcccacgcagcgggggccttaaaactacacacgaaagagagacacaaagcatgactataaaagggaagcaa

SEQ ID NO: 663096 - DNA, 287 bp, Homo sapiens
tctccctactgtatcctagcagtttgggaggctgaggtgggcagatcacctgaggtcaggagttcaagaacagcctggcccacatggcaaaaccgcatctctactgaaaaaaaaaaaggaaggaaggaaactccaaaatttggccgggggggggccaggggcctgtaatcccaactacttggggggctggggcatgaaaatcgcttgaacccaggaggggggggttgcagggagctgagataatgccatttaactccagcctgggcgacagagcaggactttgtctt

SEQ ID NO: 663097 - DNA, 1151 bp, Homo sapiens
  misc_feature (10)..(10): n is a, c, g, or t
  misc_feature (79)..(79): n is a, c, g, or t
  misc_feature (200)..(200): n is a, c, g, or t
  misc_feature (211)..(211): n is a, c, g, or t
  misc_feature (214)..(214): n is a, c, g, or t
  misc_feature (320)..(320): n is a, c, g, or t
  misc_feature (337)..(337): n is a, c, g, or t
  misc_feature (355)..(355): n is a, c, g, or t
  misc_feature (369)..(369): n is a, c, g, or t
  misc_feature (399)..(399): n is a, c, g, or t
  misc_feature (403)..(404): n is a, c, g, or t
  misc_feature (441)..(441): n is a, c, g, or t
  misc_feature (448)..(448): n is a, c, g, or t
  misc_feature (457)..(457): n is a, c, g, or t
  misc_feature (465)..(465): n is a, c, g, or t
  misc_feature (473)..(473): n is a, c, g, or t
  misc_feature (493)..(493): n is a, c, g, or t
  misc_feature (501)..(501): n is a, c, g, or t
  misc_feature (506)..(506): n is a, c, g, or t
  misc_feature (508)..(508): n is a, c, g, or t
  misc_feature (536)..(536): n is a, c, g, or t
  misc_feature (553)..(553): n is a, c, g, or t
  misc_feature (588)..(588): n is a, c, g, or t
  misc_feature (614)..(614): n is a, c, g, or t
  misc_feature (619)..(619): n is a, c, g, or t
  misc_feature (623)..(623): n is a, c, g, or t
  misc_feature (629)..(629): n is a, c, g, or t
  misc_feature (639)..(639): n is a, c, g, or t
  misc_feature (653)..(653): n is a, c, g, or t
  misc_feature (656)..(656): n is a, c, g, or t
  misc_feature (661)..(661): n is a, c, g, or t
  misc_feature (673)..(673): n is a, c, g, or t
  misc_feature (684)..(684): n is a, c, g, or t
  misc_feature (692)..(692): n is a, c, g, or t
  misc_feature (713)..(713): n is a, c, g, or t
  misc_feature (716)..(717): n is a, c, g, or t
  misc_feature (725)..(728): n is a, c, g, or t
  misc_feature (744)..(744): n is a, c, g, or t
  misc_feature (760)..(760): n is a, c, g, or t
  misc_feature (773)..(773): n is a, c, g, or t
  misc_feature (775)..(775): n is a, c, g, or t
  misc_feature (788)..(788): n is a, c, g, or t
  misc_feature (800)..(801): n is a, c, g, or t
  misc_feature (804)..(804): n is a, c, g, or t
  misc_feature (807)..(807): n is a, c, g, or t
  misc_feature (812)..(813): n is a, c, g, or t
  misc_feature (835)..(835): n is a, c, g, or t
  misc_feature (839)..(839): n is a, c, g, or t
  misc_feature (850)..(850): n is a, c, g, or t
  misc_feature (852)..(852): n is a, c, g, or t
  misc_feature (856)..(856): n is a, c, g, or t
  misc_feature (863)..(863): n is a, c, g, or t
  misc_feature (885)..(885): n is a, c, g, or t
  misc_feature (890)..(890): n is a, c, g, or t
  misc_feature (893)..(893): n is a, c, g, or t
  misc_feature (897)..(897): n is a, c, g, or t
  misc_feature (903)..(903): n is a, c, g, or t
  misc_feature (912)..(912): n is a, c, g, or t
  misc_feature (914)..(914): n is a, c, g, or t
  misc_feature (934)..(934): n is a, c, g, or t
  misc_feature (943)..(943): n is a, c, g, or t
  misc_feature (953)..(953): n is a, c, g, or t
  misc_feature (960)..(960): n is a, c, g, or t
  misc_feature (963)..(963): n is a, c, g, or t
  misc_feature (965)..(965): n is a, c, g, or t
  misc_feature (971)..(971): n is a, c, g, or t
  misc_feature (973)..(973): n is a, c, g, or t
  misc_feature (992)..(992): n is a, c, g, or t
  misc_feature (994)..(994): n is a, c, g, or t
  misc_feature (1005)..(1006): n is a, c, g, or t
  misc_feature (1025)..(1025): n is a, c, g, or t
  misc_feature (1027)..(1027): n is a, c, g, or t
  misc_feature (1039)..(1039): n is a, c, g, or t
  misc_feature (1050)..(1050): n is a, c, g, or t
  misc_feature (1057)..(1057): n is a, c, g, or t
  misc_feature (1076)..(1076): n is a, c, g, or t
  misc_feature (1078)..(1079): n is a, c, g, or t
  misc_feature (1083)..(1083): n is a, c, g, or t
  misc_feature (1086)..(1086): n is a, c, g, or t
  misc_feature (1090)..(1090): n is a, c, g, or t
  misc_feature (1130)..(1130): n is a, c, g, or t
aaacaggganacatgggattgtgttttcatttaataaatacaaatgaataaaaatactttattttgtcaagagactgcntctcctccctctcccgatctcacagaagcgtccagggaattgtgtgcgcctccagggcctgcacccacagaccccgtctacttgcacaaatgactctgctttacagagagggctccatctnatttgcctgcnaanacaactaaggtataataccgctcctttcccccatctccttccaaatacgagttcttgccctgcgttccattttttttttttttttttttttttgagaaagagtttnactttgtggcccagggnggggtgcggtggggggancgcagcgcagtggnagcgccgcctccggggttcacgccattttnctgnnttagttttcagagtagcggggactacaggggcccgcnaccacgnccgggtaantttttgtntttttagnggggaaagggtttcactgtnaggcaggntggtngngatctcctgagctgatgagcggcccgcnttagtttcccaaagtgntgggattgcaggggtaagcaaaacacccacgcctncaaattttaaatgagctccttgtganatggnaaanaatttnctgttcacanaagcccagcgtggngcnacttnaaccagaaactnttacccatganactttgtntgggttcagttacacagaccncgnnccattttnnnngggggggggaaaaggntcaaaaaaaaaccacngtatgcctaaaanancaacccccaaatnaaaaaaagaaannccnatnaaaannccgcccgttttctatagggctnaaanttgctttttcntnttgnagaactnttattgcttacactgtggcctnctggnctnttcngctcanctggccctntnagagaacatgggaacacaanaaaatcctnagttacaaanaagggcnctntnccagcntnggcccaggggccacatgcncncttcacagccnntaagttttgggatagggantntctttccctcancaaaaaatagnagattcntcttattttgagtgcaaanannattngtncaanaattccagtcatcaaaagtcaaaacctagatttcagtttngttgaaaaaaattttttttgg

SEQ ID NO: 663098 - DNA, 101 bp, Homo sapiens
gacctgatgaggtactcatgagaatcaacatagcccttatgaaacttaagggtcgaaggtggatttagcagtaaactgagagtagagtgcttagttgaaca

SEQ ID NO: 663099 - DNA, 184 bp, Homo sapiens
  misc_feature (75)..(75): n is a, c, g, or t
  misc_feature (84)..(84): n is a, c, g, or t
ctataattcattaaccttaaagagtctaataattaaatccaatgactattttttagtcggagtacagagcagctnttaaagcanatgatattactaagtatcttctaacgagtagtaatatttcaaagtaaaacatgagagattgattaccaaacacatttttaagactgtcttcaagcgaaag

SEQ ID NO: 663100 - DNA, 94 bp, Homo sapiens
ccccggggggggggttttccccccccccccggggggtagggcctttttccggggccccattaacccccccttaattttttttttgggcccccca

SEQ ID NO: 663101 - DNA, 827 bp, Homo sapiens
gaaaagtgagtgattcgggtggtttccagtcagccccgctccgagtctcagggggacggccccgcacacagacggttcaccaggcctgcagcctctcggacagcaccaccgggtactgtgcagggctccgcagccgccggtgctcagggctgagtcgggctcagggacatgctggggccaaggctctagactctggccagggatggggagcgggctcacacagctggtccctgctgggaggcagagccgcagtagtgggctccacctggggctgggcctcacggtggcagggctcctggggccccgggaggccacaccctcagctccggcccatgcctggtggcacggggctcttctggctaactggcagcatgtccatgattgggagacccgtcagagcccaggagcctggaaagcagccttgctcccaggcaacgtctggcttctcggggtcctcggtcagcttcattcgggggttgggccccccagtggccaccagcttatagacaccacccagggaaggctgtgtgggggcaggtgaccaccttgggtgccatggccattgacattcacctcatggcctcctgggccagtcgggccagagcctcctcgtcaatgtgtggcggactacgatagaagactgactcccagcaggcacctgaacttgggtcgcaaacttcggaaaacctaggcgaaatccaaagacgtgtataacaggcacactgtgcaactaagccaatggcggtaacaattcacagggcaggaagtgaagaatgggggaacccccacactttttcaagagcaaagcggaaacaagtaacaagtcc

SEQ ID NO: 663102 - DNA, 270 bp, Homo sapiens
  misc_feature (118)..(118): n is a, c, g, or t
tgtaggtcagggttgacctatgaaacgtctttaaggaaactggctcattttctcagtcaaggcagaagttcaaaagcagctgccggaatgctcagagaccagcatgtcaaggtttctnttctgcagatggagaatctgaggccagaaaaggggacgggggtcgcagagcttggatttggagtcaggcttccaggctccccacccggaggtcaaggtcaggccctatagactctgaccctgccctgatcagctggccaccctgggattggg

SEQ ID NO: 663103 - DNA, 412 bp, Homo sapiens
  misc_feature (8)..(9): n is a, c, g, or t
  misc_feature (18)..(18): n is a, c, g, or t
  misc_feature (20)..(20): n is a, c, g, or t
  misc_feature (69)..(69): n is a, c, g, or t
  misc_feature (73)..(73): n is a, c, g, or t
  misc_feature (79)..(79): n is a, c, g, or t
  misc_feature (96)..(96): n is a, c, g, or t
  misc_feature (118)..(118): n is a, c, g, or t
  misc_feature (149)..(149): n is a, c, g, or t
  misc_feature (171)..(171): n is a, c, g, or t
  misc_feature (348)..(348): n is a, c, g, or t
  misc_feature (388)..(388): n is a, c, g, or t
cgcggccnncgacacggntncgagaagacgacagaaggggatctcccggcgaggtgcctgtgctgtacncggntttgtntgctgtgcccgctcttngcgctctcgcgtcatattctgnagcgcgccagcaggatggcccacaagcaganctactacttggacaagtacttngacgaacactacgagtaccggcatgtgtatgtgtacccagagaactttccaaacaaggacctaaaactcatctgatgtctgaagaggagtggaggagacttggtgtccaacagaggctaggctgggttcattacatgaatcatgagccagaaccacatattcttctctttagacganctctttcgatcaaccgtatataagggagtattcagtgagnacttgagtgtgcacctttattcat

SEQ ID NO: 663104 - DNA, 1506 bp, Homo sapiens
  misc_feature (1227)..(1227): n is a, c, g, or t
tccacgcttaattcacttaatttttcttgtataaaaaccctatgttgtacccacagttggaccctgatcccgctgcacggaaacctctgtgggtgtgtgggtctcttgaacagaaggtgtggctcaggtgaacactctcctgtgaaataggaaaacatgtgggtgaaatcacgagctcctccttctccagaaggtctgcgggggtctcgaggttagcgtgataggtctcttataaaagagtggctcttcacaagaggtgtgcgcctgtgtggcgacaaaagtgtgtcgcccgaggtgtgtgtgcgagtgtgcacagcccccggggctgtgagagatgtgtgtaccagagtctcacactcgaactcaccacacgccacactctgtgtgacacgcacaagacttctctcttgagacgccacagaggtcgtgcggtgacagacacaagaatgtggcccagaagttggtcgcccctctgttgggtgtgttgccacgaggggggacaagtagagacgcgcgggtctcacaccacacgacaaccacatgagagaagcacccctgacagtagaacgtggtgcccctagtggtgtcaccacctcctgttgttgctgcaaaggagggggcgaccaccacgagttgtgtgtgttgcggcagcgcacttttgtggccgcgaagaatacttctgttgttggtgtcttccccccccacaagagtagtataaggccccttcttctgttggcgcgacccaccgggggggggcgacaaccacgacaatgttggggagacgacaacgtcttgttgttggcgtcccccaagatgtcgtcatgttgtctattgtggcgccgccccccccagaaggaggcgatgatgtttgggggcgaggggtggtgggggcaccaaactcctcttcccctgttgttggggagaacgaccacatcattatttataacaacaacacccccaaccaatgagaaagccgctggagaacgtctggacggttggcggcccccacaatcgtttgtggtggataaggatgtctccccccccgaccggaagaaattatagaaggagcaccaacaaacgaccaacaatgaattggttgtggcccctctttggtggagaacaacccccgccgtgtggtggtagattgccagcaggcgatcggttggtagtcacagcgcaggtggtacacacaagcgcgaggaggaggatactaccatgtagggatantattcattctagtattgggcaaccaacctcgtgtgtgggcgcaccaataaataataatacattccctttttttccaaaaaaaaaaaccactcctgttatcaataaatatatccctcagttttatgtgataagacgacaacataggagagggggcgtgcgccccccccccccacagatgggggggaagaagtacagcagcaccaaacatctctctctcaccaagagtgtggagaacaacactatcccgcttcgctgatgagaagaacatattctaccgat

SEQ ID NO: 663105 - DNA, 80 bp, Homo sapiens
gcagtctgaatgccagatgataaccgtttgctacagcatttgtattgcttgtgtgcttagctcatttcaccatctacatg

SEQ ID NO: 663106 - DNA, 151 bp, Homo sapiens
atcgcaaagaccattgaaaattcagaggagctctaatggaaggctctcagatgcctggctgatactgaagctagctacgtgtcaccatgaattctttgaaattaacagcagactttacattatgcccagacaaggcttacaaacatatcag

SEQ ID NO: 663107 - DNA, 661 bp, Homo sapiens
ctatcctcatcctcttcagattctgaaataactacaggagccattctactgcacaatccttccgcacacacgcaattaactgccgacttgccccactagtaatcacctgcatctatataagataagatgaagaccttttacgtatcttgaaaaactatacaatagcaaagaaacctaccacccagaccctgtgcggagtatctcgaacttcccagtatattactctcaagtagatgacgcgtaatagacaggttttattggcaaatttcgagtcgctatcattatcaacattaattatagggtggtgtttggttggttcgagtgccgtcataactatttgttttttttgcatatctggttgatcctccttagttaatatagtctctttgagtttcccttaaggaactgtcatttggtccggccgaaaacatggtggtgacagacagccttttcagaggtgatgagcaatctcgatgagcatctcagcgggtgcatatatacacgtatataagatagttcaaagtatgatagattaaagtttactttgttgttgctgagaagtagtgagagtgtcagcaaatcaatacaatgaaaaacatgtcacaacgatccatggacgtggagaagaaggcagctaacgctgatagttgtgccgtaagta

SEQ ID NO: 663108 - DNA, 135 bp, Homo sapiens
gtacacgcagcggagcatgtggactgtgagccccaccagccagcgctgcagctcctggagccttttgacaagtgggatggcaaggacctggaggaccttgcagatcctcactcacggtcaacagggacagtgtac

SEQ ID NO: 663109 - DNA, 120 bp, Homo sapiens
cccccccgctctgagcagattctgagccagttcttctgggctatctttttcttctgggcaacctcctcttctggtttaggaaccatcttgtcctttccgtaatactcatctccaatgtgg

SEQ ID NO: 663110 - DNA, 870 bp, Homo sapiens
gactcggggaccgtgactgtgctcaattcactcttccgttgtccctgtggtgttgcggcccagccggtccatcatgttcctttcaagtggcgtggaccgagattgctgaattcgatgggggcatttcgtccgtgtttgactgacacaggttgcattccaggatccacctttaatgcccagtgtcgatcgatgtcctttcggagctctggtggcacggggatcctcgaactaatcgtcacgcatgcttccaggtgccaccatgctctcgtgggacatagccctaactattttgtactgatgctgacttgtccacaagaccacgctttgagatcaggactctccacttccgctggtccctcagtgaattgccacaggacctaatattttccaaatctatacagagggaaacccaagtgtcccaccattaattgtagacgcaacctttggttcctggacgctggttccttggccgttggttcctttgtggtagcgacagggggataaagagtcaggattagtgccaactaggttcaaggttgaggctgtcatagtaaagtgcccggccctattggttccgtaaggaccctagcccatgtgggtcgaacacatgcactggataaggacgcgtagatgaatgtgtagcagccccctttgattgggccctggtgtccatcgaaggtaagctccccaattgggcatgactttctaggcatatctggaaacgacttttttgttcactcgtcaccattctcactgtgtcttacttccttgcaactgggagcgccgtcttcgtagcgaagcccatgtcagtttgggtcccaagggggaaacgatcctcgggcttggcataaacttcatttccataggctc

SEQ ID NO: 663111 - DNA, 1075 bp, Homo sapiens
ggtgagaggtatcggcagtgcgcacgtgctgccgtcggtgcctggcggtctgacctcgtctgacttcccgtaccgtgcttgatgcccactcgagccgctgcgatgtctaggggcacggcagatcattgttagatccttactatgcagcagagaagacgaaagaagaagaagaagccttttatgtatcgatgcaggcaagggtggataccctaagacgagaggaaaccctaggctttcagtaaacaagaagaatgtggagcccagcagtcgcaacttgatgcgacaggagcgcatttctgtgacatgcctgattgcataagatgcgagcactaggggaccaacaatcgcatgctgtcttgaatgcgatctaggattcgatctctggaagcatttcctttgtaagtgcaataccaggacccacatggacaggaatacacaaaagtcttgaacatatgaggaagttactcattgcacgtaatttcgagatggccaacggcttggaaacgcaaaccgcggtgattagggaaggcgtaactctttagcagtacttgtggctgccttctgccgttgctgaccaccacgggagaccctaatgcgtggagagcccgaagtaagcgcatggaacccgtttgaacccgttaaaagtgccttttgcgacacaacgtaaaagtacgagtgaaacacacaggaatagaacactgatgttaaaggttctccaccgagtaactgaaggacatggcaactttacgtgacagagcagacaggatgacaacccttgtcagaatagcagtgccatgcatccagtcaaacttgaagagtgaatgggtattccccaaattcagagtaaagtcgaccaggattggtctccttgccttttgtcgcgaggggcgcttcctcgaacacatggagcaacttaacaacacttacagccacggaagcctgacctgcacattcgcacggttgttcgacaccgagtccatttcacgtgggaacaacgcacaatcccaagtaattagctggcttgactgtgaaggaccaaacatagggaccaatttgtcccttgaaaatctaccat

SEQ ID NO: 663112 - DNA, 761 bp, Homo sapiens
gtgctgattgtcgtattcggcggcgcaaccattgttttgggcgacagccgcttcatcatgtggaagccgacagtattgttctggtgcggggccttattcctgctgggcagccaccttgcgggtaaaaacggtttaaaggcgagtatcggcagggagattcagcttccggatgccgtatgggcgaaattgacttatatgtgggtcggttttctgatttttatgggtattgccaactggtttgtgtttactaggtttgaagcgcaatgggttaactataagatgttcggttcgactgcgctgatgcttgttttctttattattcagggtatttatctgagtacctatctgaaaaaggaggattgactgtggaatattttatgttgctggcaacagacggggagaatgtgcatgaagcgcgtatggcggcacgtcccgaacacctcaaacgcttggaggtgctgaaatcggaagggcggttgctgaccgcaggtccgaatcctttgccggaggatccgaaccgcgtttcgggtagtttgattgtggcgcagttcgagtctttggatgcggcgcaggcttgggcggaagacgatccctatgttcacgccggcgtgtatagcgaagtgctgattaaaccgtttaaagcggtgttcaaataatgccggccgtcgatttgatccgcgaacgcctgcagacgctcgatcctctggtgttggaaaatcggcgatgaagagtcatctgcacaaggacacgcgggcaatacc

SEQ ID NO: 663113 - DNA, 130 bp, Homo sapiens
atctatcagcactggtgcaggtgtcagcccatatacatagacttacagcttaacatagacctgtgttattgtaaaacagttgcttgagcctcttcacttgcgaccctcgctgcgctattgtatctgctgt

SEQ ID NO: 663114 - DNA, 175 bp, Homo sapiens
ggtcgtgctgaagactaagtctatagatgtcaaacaagaacatgttcgcgtggctatggtggtcatgtgtgctaaatgtgttcgtgacaggatcaagcgtggtttcgcttatcgaggaggagaaaatctacgtgggccaatctacgtgggcaatctacggggtacggctcgaatt

SEQ ID NO: 663115 - DNA, 551 bp, Homo sapiens
accgagctagtacgactgctatcacaatgtgaaaaactggtactatactgtacactactgtagacctaatacacgcattacagctctagactatgttacatttatactccggtatctcacataagacatagtaaattagcctccgctactgaaaatttccagaactacgtttcagggtacatgtgcaggtatgtcatataggtacatttgtgtcatgggggttcctggaccccatgatacataggggtaacatcacccaggtattacattcagtaccccttagttatttctcctgatcctactctctacctcccaccttctactcggtgatagtccccagtatgtgctgtcccctctatgcgtgcgtccatgtgttctcatcatttatcttacacatattagtgagaacatgtggtatttgatttgctcttcctgtgttagtttgctaaggataatggcctccagctccatccatgtttcttcaaagggcatgatccttttcttgtaataatctgcattgtaattccatggtgtatacgtaccagtttttc

SEQ ID NO: 663116 - DNA, 276 bp, Homo sapiens
taaagtatgacttttgagagtgctcatatgttgatgatgtgattagcagtagttggcagattttgtaattacttcattaatcttacctctttccttagactattcctatccgcctttcttcttactcttttcatgattttcatattatatttatctttttcttataatcttttatattctttccttaacttttcttatttgaagaattttctattattttcctctttttgtctttctttatatctttccttctttatcattcttatgtcctctccc

SEQ ID NO: 663117 - DNA, 104 bp, Homo sapiens
  misc_feature (104)..(104): n is a, c, g, or t
aggggccttgacagggccacaagtgcacacactattggtggctctgggcgggcagcttggagaaggcccaatactcttcacctttcaccttagccctaatatan

SEQ ID NO: 663118 - DNA, 742 bp, Homo sapiens
  misc_feature (2)..(2): n is a, c, g, or t
  misc_feature (17)..(17): n is a, c, g, or t
  misc_feature (21)..(21): n is a, c, g, or t
  misc_feature (40)..(40): n is a, c, g, or t
  misc_feature (69)..(69): n is a, c, g, or t
  misc_feature (181)..(181): n is a, c, g, or t
  misc_feature (192)..(192): n is a, c, g, or t
  misc_feature (211)..(211): n is a, c, g, or t
  misc_feature (244)..(244): n is a, c, g, or t
  misc_feature (246)..(247): n is a, c, g, or t
  misc_feature (256)..(256): n is a, c, g, or t
  misc_feature (258)..(258): n is a, c, g, or t
  misc_feature (263)..(265): n is a, c, g, or t
  misc_feature (270)..(270): n is a, c, g, or t
  misc_feature (274)..(274): n is a, c, g, or t
  misc_feature (280)..(282): n is a, c, g, or t
  misc_feature (287)..(287): n is a, c, g, or t
  misc_feature (289)..(290): n is a, c, g, or t
  misc_feature (292)..(292): n is a, c, g, or t
  misc_feature (295)..(295): n is a, c, g, or t
  misc_feature (297)..(297): n is a, c, g, or t
  misc_feature (299)..(307): n is a, c, g, or t
  misc_feature (310)..(310): n is a, c, g, or t
  misc_feature (312)..(312): n is a, c, g, or t
  misc_feature (316)..(316): n is a, c, g, or t
  misc_feature (318)..(318): n is a, c, g, or t
  misc_feature (323)..(324): n is a, c, g, or t
  misc_feature (357)..(357): n is a, c, g, or t
  misc_feature (373)..(373): n is a, c, g, or t
  misc_feature (379)..(379): n is a, c, g, or t
  misc_feature (381)..(381): n is a, c, g, or t
  misc_feature (384)..(385): n is a, c, g, or t
  misc_feature (391)..(391): n is a, c, g, or t
  misc_feature (431)..(431): n is a, c, g, or t
  misc_feature (569)..(569): n is a, c, g, or t
  misc_feature (738)..(738): n is a, c, g, or t
gntgttctcaatttcanttanaaatacatattttaaaaanacatagaccaatatggcctgcccaaacanatatttaacatggtaaatataaggaataaattgtttgaatataaatatctataaaaaaataagtacatcaaaattcaatccaacctctttcattagccggttatataaaggnaaataattttnctgctttaaagcgtaacanacacttacttttcaatatatttcataagggggncnntaccattgngnctccnnnaatcnaggncagggnnncgccngnntnagngngnnnnnnnnnctnangggncngggcnngtagattaccatgaaaatattatatctactgcngacacattagaccagncttcangnggnnaggggntggggggggggggggggggggggggcagcgggggtgggangagtttggggaggcaataattaaatgtgggaaatacttctgccagagtgcaatataggtgaggtagactcatattcatgaaacatatcctgatttatggtagtaacagtttcattcagttttgcattttacaaatttnaaccaaagtctttcttttttttttctttacttgcatgtttgtcttttgagtgtgttttcaatttgtgcattccttagaaaatctttgtgtggactttggagtttctccctgaaatgtgccaggcgcctgagtcagacacaaacactcccttaggaccttcgtcagaaantcca

SEQ ID NO: 663119 - DNA, 122 bp, Homo sapiens
aagctccatgagcaggaattattttattttgtggacctggtttccttgatgtttctggcccccacaacaaagaaaaggaaaggggggcattttttcatatattatttaacaaacccaaataa

SEQ ID NO: 663120 - DNA, 1010 bp, Homo sapiens
  misc_feature (600)..(600): n is a, c, g, or t
  misc_feature (936)..(936): n is a, c, g, or t
  misc_feature (944)..(944): n is a, c, g, or t
  misc_feature (951)..(951): n is a, c, g, or t
  misc_feature (957)..(957): n is a, c, g, or t
  misc_feature (960)..(960): n is a, c, g, or t
  misc_feature (967)..(968): n is a, c, g, or t
  misc_feature (975)..(975): n is a, c, g, or t
  misc_feature (980)..(980): n is a, c, g, or t
  misc_feature (985)..(985): n is a, c, g, or t
aaaataggtgttattagattgaaaggggtgtagtggagtgtaggatcggcgcgcgatccatttttatttcaaaatgtctacaaagttttaattctccattatacaggtaatttttcaaaatctagacattattcaaatgtaagccaaagtccttacacaaatagaatacactcaaagatcaaaaatatacatatctttcagcaaactttgttacataaataagaaaaatatatacagctggtgttttcaaagtacaattatcttaacactgcaaacatgtatagaaggaactaaaataaaaagaaacactacagcaaaggttaaaggaacaacaaattcattttacaacatcatcaattataaagatacatatatcaaatcttaggggaatatatacttcacactgggatcttaacttttacttcactttgtttatttttttagaatactctctggataggtgaaaatctatccatgacacctattacgaaagttacatgtgaagaattcaataatctaggtctttgtactctgggatagatgtaaaaagaattctttaaaagttaaatttgtataagcctatgttaacaatttccaagnaaactggtctattggaaattaaatatttcaaagtagaaaatgttaggaaaacttcacttcaaaaattttaacacagtaagcataagaaaaattttgccaatgtttccttaaaaaaaggcaactcagctaggtttatgtttaccccaaaattctccttccttttttaactcgggcgaaaaggttgaaagccctggaactagagctgcgaacgagcagaatttaggacattggtcgctatgttatattaagggttcatgtgagggaactggaatggtcatcttgcgttcccacgtgggtagactcgggatttagagaccctaattttggaaggggccnaagggaantgggganagggcngcngggggtnngggtttnaattnaacgnggaggccacaatggggggtgggcag

SEQ ID NO: 663121 - DNA, 263 bp, Homo sapiens
  misc_feature (100)..(100): n is a, c, g, or t
  misc_feature (174)..(174): n is a, c, g, or t
ggagtttggccaacatggtgaaactccatctctattagaaatgcaaagattatccgggcagtggcgggtgcctgtggtctcagctacttcggaggctganacgggagggtcgcttggacctgggaggtggaggttgcagtgagccgagaccactcctttacactccagcctggncaacaagagcaagactctctcaaaaaaaaaaagtccgtgatgaaattttaagaaattcttgattaaaataatattattgtataaatgtt

SEQ ID NO: 663122 - DNA, 1009 bp, Homo sapiens
  misc_feature (600)..(600): n is a, c, g, or t
  misc_feature (696)..(696): n is a, c, g, or t
  misc_feature (935)..(935): n is a, c, g, or t
  misc_feature (943)..(943): n is a, c, g, or t
  misc_feature (950)..(950): n is a, c, g, or t
  misc_feature (956)..(956): n is a, c, g, or t
  misc_feature (959)..(959): n is a, c, g, or t
  misc_feature (966)..(967): n is a, c, g, or t
  misc_feature (974)..(974): n is a, c, g, or t
  misc_feature (979)..(979): n is a, c, g, or t
  misc_feature (984)..(984): n is a, c, g, or t
aaaataggtgttattagattgaaaggggtgtagtggagtgtaggatcggcgcgcgatccatttttatttcaaaatgtctacaaagttttaattctccattatacaggtaatttttcaaaatctagacattattcaaatgtaagccaaagtccttacacaaatagaatacactcaaagatcaaaaatatacatatctttcagcaaactttgttacataaataagaaaaatatatacagctggtgttttcaaagtacaattatcttaacactgcaaacatgtatagaaggaactaaaataaaaagaaacactacagcaaaggttaaaggaacaacaaattcattttacaacatcatcaattataaagatacatatatcaaatcttaggggaatatatacttcacactgggatcttaacttttacttcactttgtttatttttttagaatactctctggataggtgaaaatctatccatgacacctattacgaaagttacatgtgaagaattcaataatctaggtctttgtactctgggatagatgtaaaaagaattctttaaaagttaaatttgtataagcctatgttaacaatttccaagnaaactggtctattggaaattaaatatttcaaagtagaaaatgttaggaaaaccttcactcaaaaaattgttaacaccagtaagccatataagaagnattatggccaatgggtccttaagagaagggcgaatcagctagggttatggtgaacccagaaattctcttccttttcttactccggcgaaaagtgagaagcccggaaattaaagctgggaagggccgagatttgaaatgttggggatatgatattaaagggtttgtgggggattgaaatggtatcctgtttgccggttggcgaacctgggagttaaaagagcgaatattcagaggggccnaagggaantgggganagggcngcngggggtnngggtttnaattnaacgnggaggccacaatggggggtgggcag

SEQ ID NO: 663123 - DNA, 885 bp, Homo sapiens
  misc_feature (600)..(600): n is a, c, g, or t
aaaataggtgttattagattgaaaggggtgtagtggagtgtaggatcggcgcgcgatccatttttatttcaaaatgtctacaaagttttaattctccattatacaggtaatttttcaaaatctagacattattcaaatgtaagccaaagtccttacacaaatagaatacactcaaagatcaaaaatatacatatctttcagcaaactttgttacataaataagaaaaatatatacagctggtgttttcaaagtacaattatcttaacactgcaaacatgtatagaaggaactaaaataaaaagaaacactacagcaaaggttaaaggaacaacaaattcattttacaacatcatcaattataaagatacatatatcaaatcttaggggaatatatacttcacactgggatcttaacttttacttcactttgtttatttttttagaatactctctggataggtgaaaatctatccatgacacctattacgaaagttacatgtgaagaattcaataatctaggtctttgtactctgggatagatgtaaaaagaattctttaaaagttaaatttgtataagcctatgttaacaatttccaagnaaactggtctattggaaattaaatatttcaaagtagaaaatgttaggaaaacttcacttcaaaaattttaacacagtaagcataagaaaaattttgccaatgtttccttaaaaaaaggcaactcagctaggtttatgtttaccccaaaattctccttcctttataactcgtccacattttaaaatcccgaaaatataagctcaaagcgaccaaaatataaaaatttgtcttatttgatagtaaaggtattgtgagtgacagcattgttattttgctttcgacatg

SEQ ID NO: 663124 - DNA, 927 bp, Homo sapiens
  misc_feature (600)..(600): n is a, c, g, or t
  misc_feature (784)..(784): n is a, c, g, or t
  misc_feature (927)..(927): n is a, c, g, or t
aaaataggtgttattagattgaaaggggtgtagtggagtgtaggatcggcgcgcgatccatttttatttcaaaatgtctacaaagttttaattctccattatacaggtaatttttcaaaatctagacattattcaaatgtaagccaaagtccttacacaaatagaatacactcaaagatcaaaaatatacatatctttcagcaaactttgttacataaataagaaaaatatatacagctggtgttttcaaagtacaattatcttaacactgcaaacatgtatagaaggaactaaaataaaaagaaacactacagcaaaggttaaaggaacaacaaattcattttacaacatcatcaattataaagatacatatatcaaatcttaggggaatatatacttcacactgggatcttaacttttacttcactttgtttatttttttagaatactctctggataggtgaaaatctatccatgacacctattacgaaagttacatgtgaagaattcaataatctaggtctttgtactctgggatagatgtaaaaagaattctttaaaagttaaatttgtataagcctatgttaacaatttccaagnaaactggtctattggaaattaaatatttcaaagtagaaaatgttaggaaaacttcacttcaaaaattttaacacagtaagcataagaaaaattttgccaatgtttccttaaaaaaaggcaactcagctaggtttatgtttaccccaaaattctccttgctctgattacctgcggcccgaggttnaatagcccggcgactaaaagctggggagggagcgtaatgttgaaacatgtgggctcattttaatcattgaagggcatgatgttgaaggacacacaaatttgtgattcctttgtttagccacgtgtgctgcaagcttgggattn

SEQ ID NO: 663125 - DNA, 1301 bp, Homo sapiens
  misc_feature (406)..(406): n is a, c, g, or t
  misc_feature (431)..(431): n is a, c, g, or t
  misc_feature (494)..(494): n is a, c, g, or t
  misc_feature (1301)..(1301): n is a, c, g, or t
gtatcaatcaccagagctcatcattatatgaacccctggtttaaacttcaaactaggccgtgcttatttattctagacgcacctctagacctagccgagtcacatctaatcactctggatcgaggaagagcatccatacattgcataaacgtgacgcacgcttaatcggtcgcacatgcagagccagtaagccgcgagacaaagctgcaatatggaagtcaccctaagcccatcattgctaacttatcaacaattacttaattcaaatggcttccatttaaccttctccagctcgcgttatcacaacactaatgaacaccttcatgcataactccatgcacatcatgagcactttagccagtaatatgagtatatcttcacgacacttaagcaagagaccaaatcngaacacccacgttcggacactagcncgaaagggcgcagtccggacacttgagtcgtcaaggcgttctacacgatctgaatactgcacnggcaggccccattcggcactcatattcgttcaatagcccgagatacatcataacattatattgtactaggataaaccaaccgctcatctcatcttatcaatatcttccgtagggaacaagctatagtgacctgcacttcgtccccatgaatctgctagacaatcattatttggttcatcctaagaacctacattctgacctccctgattcttatgaatacgaaccaggatatccaccgattccgatacgaatcaactcgataaacctcctatgaaaaaacttcctatcatttaccctagcattacttatatggagtattgtgtacatacccattttacaatcgtctaagaattccccatttaagactaaagaaaaacacaaaaagggggggaagaatagaaggaatacgggagaggggccaaagttaagggaaaggaggattttgtgtaagatgggggccatatataggagacgagagtgaaaacccaggacaaggcccagagattacaaccgccgggcccggggaaaccagccagcgggcgcacacagggaaaggacgccaaacgactgcgggggacgagacccatgtgcagaagtcccaccaaacagtatagcccaaggcgagaagataacacaaggggccagaaggaaacacgcatagtgtgtgcaaacagtttcggtaatatcaccaaacactagacatcacaatagaaacaagagagtaataggctggtgtccgatgatacaccaagaaccgagcgcagacgacaaaacgtgccaaaagacaaagcaagaaatacagaacan

SEQ ID NO: 663126 - DNA, 108 bp, Homo sapiens
accagtccagtatcgttctccggtgtcattttgaccaacttttttcctctccacgttcttactacataccccacatatgccactcttttctgtgccccacttccacct

SEQ ID NO: 663127 - DNA, 210 bp, Homo sapiens
gaaggcaatttcttaaaataagacaacatcgaacttcactatatcagatggagctcgtgctttcacaagtgatttctctgtaacatgtgatgccatttgatagcattttacccacagtagaactgttttcaaaattggagtgaatcctctcaaatcctacaactactttatcaaccatagtttactatatagagtgagtaagggagactt

SEQ ID NO: 663128 - DNA, 277 bp, Homo sapiens
tatgagtttcccccccgtcggatggccatgggtccatgcgtgtaatcccagctactcaggaggctgaggcaggagaatcgcttgaacctgggaggcggaggtcgcagtgagccgagatcatgccactgcactccagcctggagaacaagagcgatcatgctactgcactacagcctgggtgacaaacgcagacctctgtctcagacaaaaaaaagaaaggaaaaaaaaagaacatctggtgggtggaaccactcatgggccccatcgggaccggggg

SEQ ID NO: 663129 - DNA, 910 bp, Homo sapiens
  misc_feature (592)..(592): n is a, c, g, or t
gtgatgagaaagcgagaaggacggtggggagaaagaaggccggccgctgccgtttttatttcaaaatgtctacaaagttttaattctccattatacaggtaatttttcaaaatctagacattattcaaatgtaagccaaagtccttacacaaatagaatacactcaaagatcaaaaatatacatatctttcagcaaactttgttacataaataagaaaaatatatacagctggtgttttcaaagtacaattatcttaacactgcaaacatgtatagaaggaactaaaataaaaagaaacactacagcaaaggttaaaggaacaacaaattcattttacaacatcatcaattataaagatacatatatcaaatcttaggggaatatatacttcacactgggatcttaacttttacttcactttgtttatttttttagaatactctctggataggtgaaaatctatccatgacacctattacgaaagttacatgtgaagaattcaataatctaggtctttgtactctgggatagatgtaaaaagaattctttaaaagttaaatttgtataagcctatgttaacaatttccaagnaaactggtctattggaaattaaatatttcaaagtagaaaatgttaggaaaaactccgattaaaaaaatgtggacacagtaggcaataaagaaaagatatgggcatggtatctttagaaaaggggcagtcacctggggtgaagttagacccgacgaaagatgggttgtgtgactggagtcgtgagagaggggggaaagccgcggaaaattggatggtggggaacgagaaaataattcagacacgctgcgcggacggttggttgaaagatcaggatgataaaaggaccgttgtttgaccgtgtggggtcctgctgtgatg

SEQ ID NO: 663130 - DNA, 902 bp, Homo sapiens
  misc_feature (600)..(600): n is a, c, g, or t
aaaataggtgttattagattgaaaggggtgtagtggagtgtaggatcggcgcgcgatccatttttatttcaaaatgtctacaaagttttaattctccattatacaggtaatttttcaaaatctagacattattcaaatgtaagccaaagtccttacacaaatagaatacactcaaagatcaaaaatatacatatctttcagcaaactttgttacataaataagaaaaatatatacagctggtgttttcaaagtacaattatcttaacactgcaaacatgtatagaaggaactaaaataaaaagaaacactacagcaaaggttaaaggaacaacaaattcattttacaacatcatcaattataaagatacatatatcaaatcttaggggaatatatacttcacactgggatcttaacttttacttcactttgtttatttttttagaatactctctggataggtgaaaatctatccatgacacctattacgaaagttacatgtgaagaattcaataatctaggtctttgtactctgggatagatgtaaaaagaattctttaaaagttaaatttgtataagcctatgttaacaatttccaagnaaactggtctattggaaattaaatatttcaaagtagaaaatgttaggaaaacttcacttcaaaaattttaacacagtaagcataagaaaaattttgccaatgtttccttaaaaaaaggcaactcagctaggtttatgtttaccccaaaattctccttttcttacacaggcgcaaattttaaaaacccggtactaaaaagtgtgtatgcgggccagaagtcagaagagtagtcgaagtgtatatataaacgtccgttgctatgtggccgggtattgtttttcttacttttacaattaggaaag

SEQ ID NO: 663131 - DNA, 893 bp, Homo sapiens
  misc_feature (600)..(600): n is a, c, g, or t
aaaataggtgttattagattgaaaggggtgtagtggagtgtaggatcggcgcgcgatccatttttatttcaaaatgtctacaaagttttaattctccattatacaggtaatttttcaaaatctagacattattcaaatgtaagccaaagtccttacacaaatagaatacactcaaagatcaaaaatatacatatctttcagcaaactttgttacataaataagaaaaatatatacagctggtgttttcaaagtacaattatcttaacactgcaaacatgtatagaaggaactaaaataaaaagaaacactacagcaaaggttaaaggaacaacaaattcattttacaacatcatcaattataaagatacatatatcaaatcttaggggaatatatacttcacactgggatcttaacttttacttcactttgtttatttttttagaatactctctggataggtgaaaatctatccatgacacctattacgaaagttacatgtgaagaattcaataatctaggtctttgtactctgggatagatgtaaaaagaattctttaaaagttaaatttgtataagcctatgttaacaatttccaagnaaactggtctattggaaattaaatatttcaaagtagaaaatgttaggaaaacttcacttcaaaaattttaacacagtaagcataagaaaaattttgccaatgtttccttaaaaaaaggcaactcagctaggtttatgtttaccccaaaattctccttctttttttactcggcccaaatttgaaaccccggaaataaaagctggaagggagcaaaattcaacatattgccttttttctaataaagggttttgtgagggaacgaatggtcttccttgtttccacattggggaaat

SEQ ID NO: 663132 - DNA, 889 bp, Homo sapiens
agatgcggatgggcagtgcggtgagatgagaggaaaggagggtgggttcggccggatgcctttttatttcaaaatgtctacaaagttttaattctccattatacaggtaatttttcaaaatctagacattattcaaatgtaagccaaagtccttacacaaatagaatacactcaaagatcaaaaatatacatatctttcagcaaactttgttacataaataagaaaaatatatacagctggtgttttcaaagtacaattatcttaacactgcaaacatgtatagaaggaactaaaataaaaagaaacactacagcaaaggttaaaggaacaacaaattcattttacaacatcatcaattataaagatacatatatcaaatcttaggggaatatatacttcacactgggatcttaacttttacttcactttgtttatttttttagaatactctctggataggtgaaaatctatccatgacacctattacgaaagttacatgtgaagaattcaataatctaggtctttgtactctgggatagatgtaaaaagaattctttaaaagttaagggaggcaagcgctatatgggaagtgtgagaggagaaggatggtttggtaagcggaaagaggggaggggtaaggtgtggggaaaggcgcgatctgaggaaatgtgtgtcaggggggtggaggaaggagagttgattgtgtggtggggtggaaaggagtgcgtgcaagggggattagagggcgacgcccaggagcgagacgtgagaagacgtgattggtaggggagtagcggccgggtgtgtaggaagcgtgcgttgggaaagacgaggacagggaggcatgagtggcttgcgtaagtggagaggaagagtactgaaggtgat

SEQ ID NO: 663133 - DNA, 858 bp, Homo sapiens
  misc_feature (591)..(591): n is a, c, g, or t
gggagtaaccgaagtggacgggtaagagaagaagaatgctggccgcatctgtttttatttcaaaatgtctacaaagttttaattctccattatacaggtaatttttcaaaatctagacattattcaaatgtaagccaaagtccttacacaaatagaatacactcaaagatcaaaaatatacatatctttcagcaaactttgttacataaataagaaaaatatatacagctggtgttttcaaagtacaattatcttaacactgcaaacatgtatagaaggaactaaaataaaaagaaacactacagcaaaggttaaaggaacaacaaattcattttacaacatcatcaattataaagatacatatatcaaatcttaggggaatatatacttcacactgggatcttaacttttacttcactttgtttatttttttagaatactctctggataggtgaaaatctatccatgacacctattacgaaagttacatgtgaagaattcaataatctaggtctttgtactctgggatagatgtaaaaagaattctttaaaagttaaatttgtataagcctatgttaacaatttccaagnaaactggtctattggaaattaaatatttcaaagtagaaaatgttaggaaaagctggggccgagagatagttggcgtagtcgggaggaagaggagtaaggacgtgggtgttagggggggtggtgcgaggtgggagggtgaggaacgacgagatttgctttcgtgtggtagggcgggccgaagtgcgagagcgggggagatggaggaggggggcggcccaattttattgagcggagatatttgtggttaagtttcgggtgtggtgtgag

SEQ ID NO: 663134 - DNA, 900 bp, Homo sapiens
  misc_feature (600)..(600): n is a, c, g, or t
aaaataggtgttattagattgaaaggggtgtagtggagtgtaggatcggcgcgcgatccatttttatttcaaaatgtctacaaagttttaattctccattatacaggtaatttttcaaaatctagacattattcaaatgtaagccaaagtccttacacaaatagaatacactcaaagatcaaaaatatacatatctttcagcaaactttgttacataaataagaaaaatatatacagctggtgttttcaaagtacaattatcttaacactgcaaacatgtatagaaggaactaaaataaaaagaaacactacagcaaaggttaaaggaacaacaaattcattttacaacatcatcaattataaagatacatatatcaaatcttaggggaatatatacttcacactgggatcttaacttttacttcactttgtttatttttttagaatactctctggataggtgaaaatctatccatgacacctattacgaaagttacatgtgaagaattcaataatctaggtctttgtactctgggatagatgtaaaaagaattctttaaaagttaaatttgtataagcctatgttaacaatttccaagnaaactggtctattggaaattaaatatttcaaagtagaaaatgttaggaaaaactttcctagaaaatactcaacgcagtaggcattaaatataaattaatacaaatgctcccttatataaaggtaacaaagcttagattaagtatatcccagaattagtgctcctaacatatacaatgttatagataaaaatacctgtatcaataactattaggcaaggtgaggctcccctatttacttattcatctcatctatggcgatacatatgaactccttttatttactcattagtaattactaag

SEQ ID NO: 663135 - DNA, 115 bp, Homo sapiens
accgcacgaatcgagcaaagagctatcaatcgtgtcgaagtcctgtccgatggtccgtcgacctgggtgatgtttcccgtgattgattagccggaggtgtatcgggggatcctct

SEQ ID NO: 663136 - DNA, 126 bp, Homo sapiens
ggtggtggctgtaatagtgaggcaggagtccgaggaggttagttgtggctataaaaatgattaacggatactattataagagatcaggttcgtcctttattgttgtgtatggttattcttctttat

SEQ ID NO: 663137 - DNA, 758 bp, Homo sapiens
taaaagggcaaaaattgacttttttgaatgggaaaggggatgaggacaacggtgaacccccagtgacccctgtgtggaaaaaaaaaaacagacagagggggggttggtccggaggccctcgtcgtgctcaagtggattcccaggagcagggccattgtgtcgcgcttcccaaattctctctaggcataatattctggataagttatactacccactcagtgtttctcataagagaactgggcagacaccagcaacacgtgctagaaacctcaaactccttcaattactcaaagaaaggacccatttcagtataccctcaaggtgaagtgaaagagttagtgggacactctgcgtggtgggctcctctccccgtggttgcaccacttgggtaccttataactctgacaaaaaactcttggagctgcaacgggccttgccaaagggctcaggagttggtaatcaggacagaatggtggatagcgaacacagaagaggtaactttaacattcccccttaaaggtcaaattttcacccaactcatcttcctggaagtgtccctataacagaatgaggtcgaacatagaccagaggcccagccaactcttataatacaaagctcctccaacgggggtctcaaggacccggctcccttcacaccagatagggggcggcatccccagggtaagggcaccgtgaacttacggggcgcgttgaaggaggcgcccgaccaggtgaggctggctgcagagtgccaagtc

SEQ ID NO: 663138 - DNA, 1520 bp, Homo sapiens
  misc_feature (128)..(128): n is a, c, g, or t
  misc_feature (914)..(914): n is a, c, g, or t
  misc_feature (1315)..(1315): n is a, c, g, or t
  misc_feature (1320)..(1320): n is a, c, g, or t
cgccacaaagaatagctgtttgtggcccccatcactatgagaggtcctcttgtggttgctgcttttggtgggtagacagcccctgggggggaggttttctcctcccggcggtggttttatgtagatgncgtccggcgagattattttttttctcggggggggagaactcaaattgctcgcaacagttaattgcgcccccccttgtgtgtctccagacaaaaggactaatatgtagttgtgggcggggttgttcgtgcgaccggcgaacaattgttgttgggcctccacactagttggaagaacgtctgttttaattatgagtccgcttggtgagtgacagccgccgccccacgggggagagattattatataggaagaagggtagtaagaacatttttattagcaggttgatgagccccaccacatggtggtaataaaaggtggggtgttgttgtttgcctcctctcgaggatcatcaccgcctgcggaagattggggcgagaaaacatgggtgattattaatcagaagaagatgatgaacataatgaattttttataaggggcccaccacagtatatacgcggtcttgtggcgacattcgtggtgtctgatgaaagacttcactcgtgagtagatagttgatgataagaagagtttcttcttgatgagggactacctgatgagaggcgccactactcgactcctccttgggggggaagaacgcctgaactaatattagactgtggcggcacacctgtgttggtgtgttgttattccgcaaatatggcgcacatcgtcatcacacgtgtagtagaggaagattgggtcgctcacacactcgtatagtgcgcgacgctccctcgtgtggtcgcgctctaacatgtgtctcccggggtgtacgcccctccgtgtangggagatttctgcgcgcgttgtgtgggcgccccgcacactagtctcgccaactagggtgctcgcgtctcccgcgtttctcgtgcgcgtgtgcgcagtgtgtgagaagagagatgtgtgcgacgcgcgcgtaattagagtgtgctgtgtgatgatagtagtgtgcgtgcgttatattagtgggtgatagagctatctctgctctctctcacacacactggccgtcacacccacagtgctcacttgacatcttaggttgacactctctgtgctgcgcgcgagagagattctcactctccggcgtgggtgtgataacacacacttcactcacggtgtcgcctctatagagagagagagatatataactctggaatagacatgctttaaagaatttacacacctnttaangacctcacgtgtctcaaaagtgtgaaacacacacggtgttcaccacgtgtctcaacgccctgtgggtgtttgtggtgttgtgtgtgtttgtggtgtttttttagcgccaaaagggtttaatattatagattgtgaaccttgcttgtgtgggtttttttaagtagattccccaaataattgaaaattcccctgtgtctcca

SEQ ID NO: 663139 - DNA, 1089 bp, Homo sapiens
  misc_feature (178)..(179): n is a, c, g, or t
  misc_feature (188)..(188): n is a, c, g, or t
  misc_feature (191)..(191): n is a, c, g, or t
  misc_feature (209)..(209): n is a, c, g, or t
  misc_feature (296)..(296): n is a, c, g, or t
  misc_feature (322)..(322): n is a, c, g, or t
  misc_feature (437)..(437): n is a, c, g, or t
  misc_feature (452)..(452): n is a, c, g, or t
  misc_feature (471)..(471): n is a, c, g, or t
  misc_feature (772)..(772): n is a, c, g, or t
aaatatctaggtagaggcctgcgtttaattcggccgagggggagccggagagtttggaacctggagtcgcagcggcggtaattgtgcgatgactcctctaatgtcaccgtccttagctgcgggacctgctggtgttctgactgtggagttagctggggtgagacccctgtgcggtgcnngagggggcnggnggcccgactctgacccgngccgggggtgggccatggcggagatcagcgacctggaccggcagatcgagcagctgcgtcgctgcgagctcatcaaggagagcgaangtcaaggccctgtgcgctaaggccangagagatcttggtagaggagagcaactgtgcagagggtggactcgccagtcacagtgtgcggctgacatccatggacaattctatgacctcaaagagctgttcagagtaggtggngacgtccgctgagancaattacctcttcatgggnggactttgtggaccgtggcttctatagcgtcgaaacgttcctcctgctgctggcacttaaggttcgctatcctgatcgcatcacactgatccggggcaaccatgagagtcgccagatcacgcaggtctatggcttctacgatgagtgcctgcgcaagtacggctcggtgactgtgtggcgctactgcactgagatctttgactacctcagcctgtcagccatcatcgatggcaagatcttctgcgtgcacgggggcctctccccctccatccagaccctggatcagattcggacaatcgancgaaagcaagaggtgcctcatgatgggcccatgtgtgacctcctctggtctgacccagaagacaccacaggctggggcgtgagcccccgaggaagccggtactattggcagtgacgtggtggcccagttcacggcaccatgacattgacctgagctggcgtgccagcactggggatggcacgggacacagtgggacgtcaagagaacggggcctgtgcaatcgggcccaagactgcacgggtggaacggcgggcactgggcgggaaacactccaaaacatcactgagggggcccagaagggaacccaaaaccggcat

SEQ ID NO: 663140 - DNA, 1102 bp, Homo sapiens
cccacgcgccgcgcggccatcccggcacaccccgtaggaccaatgctcaggccaaaggtgtccaaactatacagacccacagaatctaacaacagatgtctcaatattcctcgtcctagaactctcagaggatccagaactgcagccggtcctcgctgggctgttcctgtccatgtgcctggtcacggtgctggggaacctgctcatcatcctggccatcagccctgactcccacctccacacccccatgtacttcttcctctccaacctgtccttgcctgacatcggtttcacctccaccacggtccccaagatgattgtggacatccagtctcacagcagagtcatctcctatgcaggctgcctgactcagatgtctctctttgccatttttggaggcatggaagagagacatgctcctgagtgtgatggcctatgaccggtttgtagccatctgtcaccctctatatcattcagccatcatgaacccgtgtttctgtggctttctagttttgttgtcttttttttttctcagtcttttagactcccagctgcacaacttgattgccttacaaatgacctgcttcaaggatgtggaaattcctaatttcttctgtgacccttctcaactcccccatcttgcatgttgtgacaccttcaccaataacataatcatgtatttccctgctgccatatttggttttcttcccatctcggggacccttttctcttactataaaattgtttcctccattctgagggtttcatcatcaggtgggaagtataaagccttctccacctgtgggtctcacctgtcagttgtttgctgattttatggaacaggcgttggagggtacctcagttcagatgtgtcatcttcccccagaaagggtgcagtggcctcagtgatgtacacggtggtcacccccatgctgaaccccttcatctacagcctgagaaacagggatattaaaagtgtcctgcggcggccgcatggcagcacagtctaatctcaacatcttcttatctgttccattccttttgtagggtggtttaaaaaaggcgccaaggtcaaataagctcgtgccgaattcctgcagcc

SEQ ID NO: 663141 - DNA, 1048 bp, Homo sapiens
ggcacgagcctaaaggcctgactcgctgtctctgctgggaagttggctgtattggccgagagactgagacctcacaggactttaacggcagctggtccttgctgggctgttcctgtccatgtgcctggtcacggtgctggggaacctgctcatcatcctggccatcagccctgactcccacctccacacccccatgtacttcttcctctccaacctgtccttgcctgacatcggtttcacctccaccacggtccccaagatgattgtggacatccagtctcacagcagagtcatctcctatgcaggctgcctgactcagatgtctctctttgccatttttggaggcatggaagagagacatgctcctgagtgtgatggcctatgaccggtttgtagccatctgtcaccctctatatcattcagccatcatgaacccgtgtttctgtggctttctagttttgttgtcttttttttttctcagtcttttagactcccagctgcacaacttgattgccttacaaatgacctgcttcaaggatgtggaaattcctaatttcttctgtgacccttctcaactcccccatcttgcatgttgtgacaccttcaccaataacataatcatgtatttccctgctgccatatttggttttcttcccatctcggggacccttttctcttactataaaattgtttcctccattctgagggtttcatcatcaggtgggaagtataaagccttctccacctgtgggtctcacctgtcagttgtttgctgattttatggaacaggcgttggagggtacctcagttcagatgtgtcatcttcccccagaaagggtgcagtggcctcagtgatgtacacggtggtcacccccatgctgaaccccttcatctacagcctgagaaacagggatattaaaagtgtcctgcggcggccgcatggcagcacagtctaatctcaacatcttcttatctgttccattccttttgtagggtggtttaaaaaaggcgccaaggtcaaataagctcgtgccgaattcctgcagcc

SEQ ID NO: 663142 - DNA, 142 bp, Homo sapiens
gtccccctctgaatacggtgatgctgattgatgagctgatcaagcggtaaggattacagtctgcagctctatccgggtcaggcacatggcccgcgtggcgatgcaatgatctggtcactgcaaaaagcgcgttgggagtttt

SEQ ID NO: 663143 - DNA, 960 bp, Homo sapiens
  misc_feature (86)..(86): n is a, c, g, or t
gatagtaaatcccaagtaaggtacctgccgtcagcagatttggctttcttcttgacacctaatacccacagtcctccaggtacctncgtcggcagatttgagctttctccttggacacctaatacccacagtcctccaggctccagtagattgcaaatgacctgcttactttctgttcccgggctgcgttctgacacctgtcggatagtaaatcccaagtaaggtaccagccgtcggcagatttgagctttcttcttggacacctatacccacagtcctccagtgttttagacgcccagctgcacaacttgattgccttacaaatgacctgcttccaggatgcggaaattcctaatttcttctgtgacccttctcaactcccccatcttgcatgttgtgacaccttcaccaataacataatcatgtatttcaaaaaaaaaaaaaaaaaaaaaaaaaaaaaaaaaaaaaaaaaaaaaaaaaaacaaaaaaaaaaaaaaacaaaaaaaacaaaaacaaaaaaaaaaaaaaaaaaaaaaaatagtactacgcccccccctcttattcttctctatctttgccccacacccatacctccccccacccccctcttttattatttacacccttcttctcccttccaatcactcatttatatccaacacaccctctcctccccacacacacactaccctccctcctcacttacccaactactctgcctccactctacctctttacagcccatacaccctccctcttctcccctcgtaagcacaatactacttctctcctcctcccctccacactcgtgcttatcctcccccctcccacctctctacctacacaacaactcccccacccatactaccttccatccctcccccatcaactcttccccccccctctccatcctacaccccccctcccccctctctcttccccacactatctctccccccg

SEQ ID NO: 663144 - DNA, 850 bp, Homo sapiens
  misc_feature (86)..(86): n is a, c, g, or t
gatagtaaatcccaagtaaggtacctgccgtcagcagatttggctttcttcttgacacctaatacccacagtcctccaggtacctncgtcggcagatttgagctttctccttggacacctaatacccacagtcctccaggctccagtagattgcaaatgacctgcttactttctgttcccgggctgcgttctgacacctgtcggatagtaaatcccaagtaaggtaccagccgtcggcagatttgagctttcttcttggacacctatacccacagtcctccagtgttttagacgcccagctgcacaacttgattgccttacaaatgacctgcttccaggatgcggaaattcctaatttcttctgtgacccttctcaactcccccatcttgcatgttgtgacaccttcaccaataacataatcatgtatttccctgctgccatatttggttttcttcccatctcggggacccttttctcttactataaaattgtttcctccattctgagggtttcatcatcaggtgggaagtataaagccttctccacctgtgggtctcacctgtcagttgtttgctgattttatggaacaggcgttggagggtacctcagttcagatgtgtcatcttcccccagaaagggtgcagtggcctcagtgatgtacacggtggtcacccccatgctgaaccccttcatctacagcctgagaaacagggatattaaaagtgtcctgcggcggccgcatggcagcacagtctaatctcaacatcttcttatctgttccattccttttgtagggtggtttaaaaaaggcgccaaggtcaaataagctcgtgccgaattcctgcagcc

SEQ ID NO: 663145 - DNA, 230 bp, Homo sapiens
gatctctatatgctgtctagaagcctcgctgcagaatgacagcgaaggagtgatggacagtcatcatctcgactgcagtacaagacagtgtcaggtctttcagagaggtaggggactccccttccaccttgccctaatggagaactccctccccttactggctatgtacctccaacaccaggtgccaggccaacctgggttcaaacccagattgcacttctccctagcca

SEQ ID NO: 663146 - DNA, 601 bp, Homo sapiens
ttccaccatgggcaagaagggcaacagttggcaagagccgacgagacaagttttatcacttggcgaaggagacgggttaccgttcccgatctgctttcaagctgatccagctcaatcgccgctttcagttcctgcagaaagcccgagccttgctggacctgtgtgctgcgccagggggatggctgcaggtagctgccaagtttatgcactgtatccagccattatagtgggagtggacctggttccaatcaagcctctccccaatgtggtgactctccatgcaggacatcacaaccagaaccgtatgtacggcatggccctgcaggcaacggatgctgacagaccctggaaaggtcgactgtctgatgcatcaactgattgggtgcccccacacgtatggggctagcttgggtccattgatgcttactcacaatgcccattttgacactgactggctctacgctttgtgcttgtgactttatggcccgtggtggcctgcttcatcacacaaggttcttccgttctcgtgactatcagcctctgctcctggctctttcagcagctgctccgccgttgtccaggccaccatgccccaagccta

SEQ ID NO: 663147 - DNA, 1243 bp, Homo sapiens
cacacacctgagtccacagaaatcaatgatgaaagcattagaagacaattgagtctgtcagaactgcaaaatattgctgagtgtggattgctctgaaatctgaaaacattacttgtgaattgcttctattcaaaatgcagacacaatgccaggtgttggtttacttgtttcccatttttcaaccctcgtttctaggcaaaggtgtccaaattatgcagacccacagaatctaacagatgtctctatattcctcctcctagaagtctcaggggatccagaactgcagccagtccttgctgggctgttcctgtccatgtgcctggtcacggtgctggggaacctgctcatcatcctggccatcagccctgactcccacctccacacccccatgtacttcttcctctccaacctgtccttgcctgacatcggtttcacctccaccacggtccccaagatgattgtggacatccagtctcacagcagagtcatctcctatgcaggctgcctgactcagatgtctctctttgccatttttggaggcatggaagagagacatgctcctgagtgtgatggcctatgaccggtttgtagccatctgtcaccctctatatcattcagccatcatgaacccgtgtttctgtggctttctagttttgttgtcttttttttttctcagtcttttagactcccagctgcacaacttgattgccttacaaatgacctgcttcaaggatgtggaaattcctaatttcttctgtgacccttctcaactcccccatcttgcatgttgtgacaccttcaccaataacataatcatgtatttccctgctgccatatttggttttcttcccatctcggggacccttttctcttactataaaattgtttcctccattctgagggtttcatcatcaggtgggaagtataaagccttctccacctgtgggtctcacctgtcagttgtttgctgattttatggaacaggcgttggagggtacctcagttcagatgtgtcatcttcccccagaaagggtgcagtggcctcagtgatgtacacggtggtcacccccatgctgaaccccttcatctacagcctgagaaacagggatattaaaagtgtcctgcggcggccgcatggcagcacagtctaatctcaacatcttcttatctgttccattccttttgtagggtggtttaaaaaaggcgccaaggtcaaataagctcgtgccgaattcctgcagcc

SEQ ID NO: 663148 - DNA, 1326 bp, Homo sapiens
  misc_feature (287)..(288): n is a, c, g, or t
  misc_feature (294)..(294): n is a, c, g, or t
agcggatggggaatcgtgcggtgtactagcacgtgactgctttctctggactggactgtgggcaggcatcccgaggtggggaccgggaccgtgatggctgcacgtggtggacggggctggtgatgctgtggccctcgtgtggcccaggagatagcagttcctgccgggtgctgctgagtgtcttcatcgtacaaccctgcgcttctggccgcgggacaggagaggttgtcggaatcctataattgaaaaacatgtaaagatggaaaaccagttattgactatcacgnngagggngttgacaggttatagctcggtgctgcagcagtgctacagcatgtacaagaagtctcaggggatccagaactgcagccagtccttgctgggctgttcctgtccatgtgcctggtcacggtgctggggaacctgctcatcatcctggccatcagccctgactcccacctccacacccccatgtacttcttcctctccaacctgtccttgcctgacatcggtttcacctccaccacggtccccaagatgattgtggacatccagtctcacagcagagtcatctcctatgcaggctgcctgactcagatgtctctctttgccatttttggaggcatggaagagagacatgctcctgagtgtgatggcctatgaccggtttgtagccatctgtcaccctctatatcattcagccatcatgaacccgtgtttctgtggctttctagttttgttgtcttttttttttctcagtcttttagactcccagctgcacaacttgattgccttacaaatgacctgcttcaaggatgtggaaattcctaatttcttctgtgacccttctcaactcccccatcttgcatgttgtgacaccttcaccaataacataatcatgtatttccctgctgccatatttggttttcttcccatctcggggacccttttctcttactataaaattgtttcctccattctgagggtttcatcatcaggtgggaagtataaagccttctccacctgtgggtctcacctgtcagttgtttgctgattttatggaacaggcgttggagggtacctcagttcagatgtgtcatcttcccccagaaagggtgcagtggcctcagtgatgtacacggtggtcacccccatgctgaaccccttcatctacagcctgagaaacagggatattaaaagtgtcctgcggcggccgcatggcagcacagtctaatctcaacatcttcttatctgttccattccttttgtagggtggtttaaaaaaggcgccaaggtcaaataagctcgtgccgaattcctgcagcc

SEQ ID NO: 663149 - DNA, 1064 bp, Homo sapiens
gtattactattttgaaatggaagcctcccagtctgaattctgtggattttcgtctaaaaataacaagaatgggaggagaaggaacctcagaggatccagaacggcagctggtccttgctgggctgttcctgtccatgtgcctggtcacggtgctggggaacctgctcatcatcctggccatcagccctgactcccacctccacacccccatgtacttcttcctctccaacctgtccttgcctgacatcggtttcacctccaccacggtccccaagatgattgtggacatccagtctcacagcagagtcatctcctatgcaggctgcctgactcagatgtctctctttgccatttttggaggcatggaagagagacatgctcctgagtgtgatggcctatgaccggtttgtagccatctgtcaccctctatatcattcagccatcatgaacccgtgtttctgtggctttctagttttgttgtcttttttttttctcagtcttttagactcccagctgcacaacttgattgccttacaaatgacctgcttcaaggatgtggaaattcctaatttcttctgtgacccttctcaactcccccatcttgcatgttgtgacaccttcaccaataacataatcatgtatttccctgctgccatatttggttttcttcccatctcggggacccttttctcttactataaaattgtttcctccattctgagggtttcatcatcaggtgggaagtataaagccttctccacctgtgggtctcacctgtcagttgtttgctgattttatggaacaggcgttggagggtacctcagttcagatgtgtcatcttcccccagaaagggtgcagtggcctcagtgatgtacacggtggtcacccccatgctgaaccccttcatctacagcctgagaaacagggatattaaaagtgtcctgcggcggccgcatggcagcacagtctaatctcaacatcttcttatctgttccattccttttgtagggtggtttaaaaaaggcgccaaggtcaaataagctcgtgccgaattcctgcagcc

SEQ ID NO: 663150 - DNA, 1028 bp, Homo sapiens
catcatacatacctttccctgtgaaaccgaaggggataccaaagttctatacctcacagaccatactgcagccggtcgccgctgggctgttcctgtccatgtgcctggtcacggtgctggggaacctgctcatcatcctggccatcagccctgactcccacctccacacccccatgtacttcttcctctccaacctgtccttgcctgacatcggtttcacctccaccacggtccccaagatgattgtggacatccagtctcacagcagagtcatctcctatgcaggctgcctgactcagatgtctctctttgccatttttggaggcatggaagagagacatgctcctgagtgtgatggcctatgaccggtttgtagccatctgtcaccctctatatcattcagccatcatgaacccgtgtttctgtggctttctagttttgttgtcttttttttttctcagtcttttagactcccagctgcacaacttgattgccttacaaatgacctgcttcaaggatgtggaaattcctaatttcttctgtgacccttctcaactcccccatcttgcatgttgtgacaccttcaccaataacataatcatgtatttccctgctgccatatttggttttcttcccatctcggggacccttttctcttactataaaattgtttcctccattctgagggtttcatcatcaggtgggaagtataaagccttctccacctgtgggtctcacctgtcagttgtttgctgattttatggaacaggcgttggagggtacctcagttcagatgtgtcatcttcccccagaaagggtgcagtggcctcagtgatgtacacggtggtcacccccatgctgaaccccttcatctacagcctgagaaacagggatattaaaagtgtcctgcggcggccgcatggcagcacagtctaatctcaacatcttcttatctgttccattccttttgtagggtggtttaaaaaaggcgccaaggtcaaataagctcgtgccgaattcctgcagcc

SEQ ID NO: 663151 - DNA, 1034 bp, Homo sapiens
aagacacttacctaaccaaccacacgccccaacaccccccaaaccaacctcagtagctacatagtaccacattgcagccggtcctcgctgggctgttcctgtccatgtgcctggtcacggtgctggggaacctgctcatcatcctggccatcagccctgactcccacctccacacccccatgtacttcttcctctccaacctgtccttgcctgacatcggtttcacctccaccacggtccccaagatgattgtggacatccagtctcacagcagagtcatctcctatgcaggctgcctgactcagatgtctctctttgccatttttggaggcatggaagagagacatgctcctgagtgtgatggcctatgaccggtttgtagccatctgtcaccctctatatcattcagccatcatgaacccgtgtttctgtggctttctagttttgttgtcttttttttttctcagtcttttagactcccagctgcacaacttgattgccttacaaatgacctgcttcaaggatgtggaaattcctaatttcttctgtgacccttctcaactcccccatcttgcatgttgtgacaccttcaccaataacataatcatgtatttccctgctgccatatttggttttcttcccatctcggggacccttttctcttactataaaattgtttcctccattctgagggtttcatcatcaggtgggaagtataaagccttctccacctgtgggtctcacctgtcagttgtttgctgattttatggaacaggcgttggagggtacctcagttcagatgtgtcatcttcccccagaaagggtgcagtggcctcagtgatgtacacggtggtcacccccatgctgaaccccttcatctacagcctgagaaacagggatattaaaagtgtcctgcggcggccgcatggcagcacagtctaatctcaacatcttcttatctgttccattccttttgtagggtggtttaaaaaaggcgccaaggtcaaataagctcgtgccgaattcctgcagcc

SEQ ID NO: 663152 - DNA, 202 bp, Homo sapiens
caggtcgccctccgattcaggttagaatgaggaggtctgcggctaggagccaataaagtgcttggcttagtgggcgaaatattatgcttatgtggttgtggatatatggaggatggagataattgctaggatgaggatggatacgtaatacgggaaggacgcctcctagttttgtaaggggacggactcgagaccttgtgta

SEQ ID NO: 663153 - DNA, 1035 bp, Homo sapiens
aaaaacacccccccactaaacatataccccaacatgtaaaataaaaaacctccataactcacagaatccgtatagcagccggtcgtcgctgggctgttcctgtccatgtgcctggtcacggtgctggggaacctgctcatcatcctggccatcagccctgactcccacctccacacccccatgtacttcttcctctccaacctgtccttgcctgacatcggtttcacctccaccacggtccccaagatgattgtggacatccagtctcacagcagagtcatctcctatgcaggctgcctgactcagatgtctctctttgccatttttggaggcatggaagagagacatgctcctgagtgtgatggcctatgaccggtttgtagccatctgtcaccctctatatcattcagccatcatgaacccgtgtttctgtggctttctagttttgttgtcttttttttttctcagtcttttagactcccagctgcacaacttgattgccttacaaatgacctgcttcaaggatgtggaaattcctaatttcttctgtgacccttctcaactcccccatcttgcatgttgtgacaccttcaccaataacataatcatgtatttccctgctgccatatttggttttcttcccatctcggggacccttttctcttactataaaattgtttcctccattctgagggtttcatcatcaggtgggaagtataaagccttctccacctgtgggtctcacctgtcagttgtttgctgattttatggaacaggcgttggagggtacctcagttcagatgtgtcatcttcccccagaaagggtgcagtggcctcagtgatgtacacggtggtcacccccatgctgaaccccttcatctacagcctgagaaacagggatattaaaagtgtcctgcggcggccgcatggcagcacagtctaatctcaacatcttcttatctgttccattccttttgtagggtggtttaaaaaaggcgccaaggtcaaataagctcgtgccgaattcctgcagcc

SEQ ID NO: 663154 - DNA, 200 bp, Homo sapiens
ggcgcttgggctgtcactgggcctggcgcacagctgggtctcttcgtcaagcgcgtgctggagtggtggtgcggcccatcgggctgcccggctcccggtgcctgctctcctggtggcggtggctggaacaagtctggtgggagtgacccagcgcttcgcggcgtctgtgctccggcccacccaccgggccgcgtgcggtt

SEQ ID NO: 663155 - DNA, 531 bp, Homo sapiens
cgggcattctttttcagggttgagccaaagggtttattttgaggaaaggcttctccgggtcatttaacgttgaatggcgggaaagtaaggctagatatccaaaaagaacatttagcgattccttcatgcattcaacaacttttattgagggcttctggtatgcccaaaattgatcaatggccctaaagatcccaggttagggtctgatacatttctgaagtttgcaaagtccacatttgagttcataatggatatttgtaaaaaaaacggtggctttgcgctctttttatgtttatttaagataaaagcagtataacctttgagagaattatatgtaatccttcccctttgaaattaaaggattggaaccaaacgccctggcatgttcctgtaatcccagcctttgggtaacctcaagcagaaggttccctttaggccaccagtttgaaggtgtagtacactataattgcccctgtgactagtcactgcaccccagtctgggcaacataaaaagacccccctctcccccga

SEQ ID NO: 663156 - DNA, 502 bp, Homo sapiens
  misc_feature (23)..(23): n is a, c, g, or t
  misc_feature (62)..(62): n is a, c, g, or t
  misc_feature (64)..(64): n is a, c, g, or t
  misc_feature (69)..(69): n is a, c, g, or t
  misc_feature (72)..(72): n is a, c, g, or t
  misc_feature (75)..(75): n is a, c, g, or t
  misc_feature (79)..(79): n is a, c, g, or t
  misc_feature (84)..(84): n is a, c, g, or t
  misc_feature (92)..(92): n is a, c, g, or t
  misc_feature (109)..(109): n is a, c, g, or t
  misc_feature (115)..(116): n is a, c, g, or t
  misc_feature (120)..(121): n is a, c, g, or t
  misc_feature (124)..(124): n is a, c, g, or t
  misc_feature (141)..(141): n is a, c, g, or t
  misc_feature (170)..(171): n is a, c, g, or t
  misc_feature (174)..(174): n is a, c, g, or t
  misc_feature (185)..(187): n is a, c, g, or t
  misc_feature (191)..(191): n is a, c, g, or t
  misc_feature (193)..(193): n is a, c, g, or t
  misc_feature (195)..(197): n is a, c, g, or t
  misc_feature (199)..(199): n is a, c, g, or t
  misc_feature (203)..(203): n is a, c, g, or t
  misc_feature (206)..(206): n is a, c, g, or t
  misc_feature (208)..(208): n is a, c, g, or t
  misc_feature (215)..(215): n is a, c, g, or t
  misc_feature (218)..(219): n is a, c, g, or t
  misc_feature (221)..(223): n is a, c, g, or t
  misc_feature (240)..(240): n is a, c, g, or t
  misc_feature (243)..(244): n is a, c, g, or t
  misc_feature (248)..(248): n is a, c, g, or t
  misc_feature (255)..(255): n is a, c, g, or t
  misc_feature (257)..(257): n is a, c, g, or t
  misc_feature (268)..(268): n is a, c, g, or t
  misc_feature (271)..(271): n is a, c, g, or t
  misc_feature (283)..(283): n is a, c, g, or t
  misc_feature (301)..(301): n is a, c, g, or t
  misc_feature (306)..(306): n is a, c, g, or t
  misc_feature (315)..(315): n is a, c, g, or t
  misc_feature (333)..(334): n is a, c, g, or t
  misc_feature (345)..(345): n is a, c, g, or t
  misc_feature (348)..(348): n is a, c, g, or t
  misc_feature (354)..(354): n is a, c, g, or t
  misc_feature (358)..(358): n is a, c, g, or t
  misc_feature (362)..(362): n is a, c, g, or t
  misc_feature (367)..(367): n is a, c, g, or t
  misc_feature (370)..(370): n is a, c, g, or t
  misc_feature (374)..(375): n is a, c, g, or t
  misc_feature (378)..(378): n is a, c, g, or t
  misc_feature (386)..(387): n is a, c, g, or t
  misc_feature (391)..(391): n is a, c, g, or t
  misc_feature (394)..(394): n is a, c, g, or t
  misc_feature (400)..(400): n is a, c, g, or t
  misc_feature (412)..(413): n is a, c, g, or t
  misc_feature (418)..(419): n is a, c, g, or t
  misc_feature (434)..(434): n is a, c, g, or t
  misc_feature (447)..(447): n is a, c, g, or t
  misc_feature (455)..(455): n is a, c, g, or t
  misc_feature (474)..(474): n is a, c, g, or t
  misc_feature (476)..(476): n is a, c, g, or t
  misc_feature (481)..(482): n is a, c, g, or t
  misc_feature (484)..(485): n is a, c, g, or t
  misc_feature (502)..(502): n is a, c, g, or t
tgtgaaaaatttttggtcaagtngtgtccattaaaaagtactgattttaaaaacataataantnaaaantgnganaggnaaaanagaaaacnaaagtggtccacaaaanattctnntttnnttntgaaggttttacgatgnattgtgatgattaaccagtatataactannaancttaaatgggnnnttgnangnnnangtantgngnaggatantanncnnnctgcttacgcgtggggnggnngggntgcgggntnatattgatttnggnttgtgagggttntggggcgcgttggtgccnttgcncgcgcccgncgcgttcttgtgccctgnnttgctgcgcanaangggccntgtntgtnttaantgnggcnnagncccgggcnngcanggngagatngtgtgcgaaggnntagannacccgactaggggcntggcgcgggcgcnctcttccncctgggcggcatgcaagcngnattgnngnntaaagggaaaagcttgn

SEQ ID NO: 663157 - DNA, 1270 bp, Homo sapiens
agcggagccgccatcttgtgttgatccgtacccagtgggcagcgccgggagctggaccaagcggccggtgagaggccgctgtagcggtgctcagccacctgtgctgcctgccagggggcgggccgaaacctggaggcccggggggcccagctcccgtagggagccgtgggcgctcggtgcccgggccgggcaggacagaataataagctgaatagaatctgaccattggctttcacctggccaggaccttctatgtagctctccttttgtggcccatgtgctgcatcctctgccctcagtgtgcaactggcccccaacgcaatgtgtgtttgtcaaaccatggaagtggggcagtatggcaagaatgcaagtcgggctggagaccggggagtcctcctggagcccttcatccaccaagtaggcggacacagcagcatgatgcgttacgacgatcacactgtgtgcaagcccctcatctcccgggaacagcgcttttacgagtccctccctcccgaaatgaaggagttcacccctgaatacaaaggcgtggtatctgtctgttttgagggggacagtgatggttacatcaacttagtggcctatccttatgtggaaagtgagactgtggaacaggatgacacaacagaacgggagcaacctcggcgcaaacactcccgccggagcctgcaccggtcaggcagtggcagtgaccacaaggaggagaaagccagcctgtcccttgagacctctgagagccacaggaggcaaagagtccgaaggttgatgctgcacaggccactcagaaggtccctttccaggattgctaaatgtgcaacatgtgggcttgagtttcctgagacggattcatgccacaaacccccttgggagacctgcggtgtcacaaaggcaggccagtctgagccggcatgctgcatcccgaagttccaaagggacccggaaaatgtcttctagcaaggtttccatccttgccttgatgaaaccgtgagtgacaccaacgtttctagtggttaccccccttggcgctggtatggggaccccctttgaagaattgtgcgcagcgcaggggcaaggccattgtggccgaatgaacggccgatacaggccttgatcaacagcgcagtgcccctgggcagagaattccaggaaaaattgccgacggcacaggaatggcagcatttcagggccgcacggccgttgaggtccgtacacagggggtcctgccagggcattgccacaggtgagtagccag

SEQ ID NO: 663158 - DNA, 177 bp, Homo sapiens
tatccgtgtcggggttgctgttctcatccccaatcttgctgtatgtcacagttggccatggatgatggcggctggcgaatgggaggagttgctcacctctcagcacgtccagctcccaggagatgttgtattgcttgacaggcctcagccatgctgattggtgctggaacgtccacc

SEQ ID NO: 663159 - DNA, 919 bp, Homo sapiens
agcggagccgccatcttgtgttgatccgtacccagtgggcagcgccgggagctggaccaagcggccggtgagaggccgctgtagcggtgctcagccacctgtgctgcctgccagggggcgggccgaaacctggaggcccggggggcccagctcccgtagggagccgtgggcgctcggtgcccgggccgggcaggcgtggtatctgtctgttttgagggggacagtgatggttacatcaacttagtggcctatccttatgtggaaagtgagactgtggaacaggatgacacaacagaacgggagcaacctcggcgcaaacactcccgccggagcctgcaccggtcaggcagtggcagtgaccacaaggaggagaaagccagcctgtcccttgagacctctgagagccacaggaggcaaagagtccgaaggttgatgctgcacaggccactcagaaggtccctttccaggattgctaaatgtgcaacatgtgggcttgagtttcctgagacggattcatgccacaaacccccttgggagacctgcggtgtcacaaaggcaggccagtctgagccggcatgctgcatcccgaagttccaaagggacccggaaaatgtcttctagcaaggtttccatccttgccttgatgaaaccgtgagtgacaccaacgtttctagtggttaccccccttggcgctggtatggggaccccctttgaagaattgtgcgcagcgcaggggcaaggccattgtggccgaatgaacggccgatacaggccttgatcaacagcgcagtgcccctgggcagagaattccaggaaaaattgccgacggcacaggaatggcagcatttcagggccgcacggccgttgaggtccgtacacagggggtcctgccagggcattgccacaggtgagtagccag

SEQ ID NO: 663160 - DNA, 308 bp, Homo sapiens
cagcagtagcttgtggtatgtaagttgggtatggacagcgtgtagctcagtcgggagggtgagatgccgggcgtaaaagaaaatatgtacacacaagcattactaggaataggctgatgaggaattcattgtgagggaatacataaggtaggaaagaggtctttggtttatcagctacatgaaagaattaatgcttttctagtctcacagagttcctcattttcttgagaagtctttagacattatcttaaatgctacaatccattagattactttatgacaatatgtacttctggctggttccgctg

SEQ ID NO: 663161 - DNA, 953 bp, Homo sapiens
  misc_feature (947)..(947): n is a, c, g, or t
tttcctttgcttgtttttcgtgttttggtttcttcttactgtttccttgtaattttgttttctgttcctgcatgtctttgggcctttccccttggctcttttccgggcttgacttttttgtcttcttttcccgctccctttttccatgcctccgttactcttctattcttctgccgtccaggttgctagcttgcagtgttcaggaccgtccgggttggtattcatagctatgtttggtgtatctagtactgtatgtcctgtgtactctgtaatgggaagtgttctgttccattggggccttagctatttgaatgggttggttatggctggtatttatatttgcttagtggctgtctatttagcatatttcctctgagtgggtgctttatttggtgtccagtatcgacttttacagattcgtggccagtggtaggatattataatcctatgttactgtttttggtccctctttccgattctattctttcatctgtttgtatctgcgcccagaattctcagttacagtgggggtgagggtggttggcgattgccttagaggcaacccctaaattggttttggtataagtttgtgcccttgaccttaatttcattgctaccactctgatctcttagcacatttcttaggattaagggtccataaatgctgatctaaggggttgccacgatgttgaactatgcaactttttatttaaaaagctctgcactgccatgtatgaaagtctctttatgatgtttgtttttttgtcatttttgttctttacatcaagaatttataatgaattaaatatgcggagaatgtataaccccccagctcctatcagggttgctaaacctggtacattgtatatgaatgtactacactggggttcccttaccggttgctgtacttgttactatatccctgggaatcatgatcaagactaatntcccct

SEQ ID NO: 663162 - DNA, 1610 bp, Homo sapiens
agcggctcccagatgcgggcaccgaagccggggggacagccggtgtggaggacggagagcgccagtgcctgagggctggccggctagtagcgggaaaccagcttctctgaccgaagctctggactccgctgatccggagcgctaaagtgtgtccggtgccaccctgatgctctcctgggagttatgttgctcctggctgagaaatagacttacctcgtttcttagatagcgttcctgcgagtgattttcaggacgctggatgctaagactagacgaagcaagccaaagcccccgcgagccaggcaggccggtgtcacggccctatgattatggcaagggggaccctctgcctggctgctgcttcctgagacccgttcggaacctcacgtacctcgaagctcaccgttttcctcgcaaagaacctggttaaatgtccataatggctgagttttattttggaacataatttctttggttcttcaccagcactttttggagagtggtaatgtcttcctcttttgctttaggagaaggacagaataataagctgaatagaatctgaccattggctttcacctggccaggaccttctatgtagctctccttttgtggcccatgtgctgcatcctctgccctcagtgtgcaactggcccccaacgcaatgtgtgtttgtcaaaccatggaagtggggcagtatggcaagaatgcaagtcgggctggagaccggggagtcctcctggagcccttcatccaccaagtaggcggacacagcagcatgatgcgttacgacgatcacactgtgtgcaagcccctcatctcccgggaacagcgcttttacgagtccctccctcccgaaatgaaggagttcacccctgaatacaaaggcgtggtatctgtctgttttgagggggacagtgatggttacatcaacttagtggcctatccttatgtggaaagtgagactgtggaacaggatgacacaacagaacgggagcaacctcggcgcaaacactcccgccggagcctgcaccggtcaggcagtggcagtgaccacaaggaggagaaagccagcctgtcccttgagacctctgagagccacaggaggcaaagagtccgaaggttgatgctgcacaggccactcagaaggtccctttccaggattgctaaatgtgcaacatgtgggcttgagtttcctgagacggattcatgccacaaacccccttgggagacctgcggtgtcacaaaggcaggccagtctgagccggcatgctgcatcccgaagttccaaagggacccggaaaatgtcttctagcaaggtttccatccttgccttgatgaaaccgtgagtgacaccaacgtttctagtggttaccccccttggcgctggtatggggaccccctttgaagaattgtgcgcagcgcaggggcaaggccattgtggccgaatgaacggccgatacaggccttgatcaacagcgcagtgcccctgggcagagaattccaggaaaaattgccgacggcacaggaatggcagcatttcagggccgcacggccgttgaggtccgtacacagggggtcctgccagggcattgccacaggtgagtagccag

SEQ ID NO: 663163 - DNA, 630 bp, Homo sapiens
  misc_feature (496)..(496): n is a, c, g, or t
tgtgaatctggtaaaagttaatcatcaggtctcaggagttcagcaaccgaccatcatgagctatatagtattagtctgcagctctacctgagagcagcccagaaaccaaataggaatatatcagacattatcccagagagaaggctcagtcaaggatctgcagctgggacctgcatatcttaattcccctgttcctgggaaagttatccaatagctactgaaatacaagatggaaggtatcctctctgtaccatagctaaaggattgctcacaaaaatgaaagtgcaattacagaaaaattatccttgggctatgaccacatctcctgagtattttattgccaccacgactcatgatttcaattctcaggactgagtatctctgctgaacgcaaatttaaattcttaatatgagaagctgcactttccagtcgtgtgtcaatgcaaagtgagtggatttgggtttaactcccttggactgagtgcaattatatgtngggaggggactaacaaggtagcccatgtaacaaatactgtcgtaattatgtgcaatattttcattttttacttctgatcaaccgcaagagtagatgaatgctatggttcagttttgcacttaaaaatgatgatt

SEQ ID NO: 663164 - DNA, 166 bp, Homo sapiens
aaaagagggtgaggaggagaaagtagcgaagagaaaagctgctgtgctttctgatagtgaagataagagaaagcatcagcaaagaagagtcgtgttgtctctgatgcagattgctatggtcttctctcttttgcctgacttgtctgatacagcatcactgtcagag

SEQ ID NO: 663165 - DNA, 1100 bp, Homo sapiens
cgtgaacgcgtggtgcgttggtggctgcttttgtgaaaagcttgaggtggggacgatgaacagtgagggggcttctgaggtgggtggctgctttctgctcctgacctggaacagactgccagagtggagtgcctgtcgtgccaagagtgggcttgagtggcctgaacctgtgggccagtgatggcgtgtggcttggtgatatggcatgtgaccccgaccccactgtgaacggtgaatgtgccagctgtaggtgcgcatgtgctgtggcaggtcccccgaccccaagaagctccagggctgtgtggcgactgtgggcagtgtcttgcagaggggctagtggcagagtgctgactctaatggggagtgtgcaattgggaagatgaggcaacggggtgccacaagtaaggtggtttagaccccgggcagcagaggttaaaatttggttccatgctcttgaggacgctgggtccagtcgaagtcgccaccgtggagcatcaagagggtgcagtagtgtcgcgcaccaccgcgtaccctaagggagacggacgataggccgcctaaaccaggagtgctaaacgtccttgtgggtccctaaaggcatccgtggcgtcacgcagaacatgggcctgtgagagattggggagcccttggggtgaattacacgggggtgtggaacatcacccgcggactacggggggtccaaggcgcgccttgacgaaaaggggcggggacgagagaggcgcagcgagggggaaccgggcgcactaccgaggggtgggagaagcacggcagcgcaggcaacagagcaggcgtaccattctgcccctggccgaagaagccgtgcgaggcagggaggacgcggcgagagtagggaaaaaacaaaaggcccggggactggaacccgctagcgacgggcgagagagggggggaacgaacggagagagaaggaaacgagcgcagggggggcggtaaacaagacgtgggaacaggggagaagacggaaagaggggcaggccggcggacagagcggggaggaaggaacagagagagggagggcacgagcgggacgacgacgacgaacacgcggaggggaaagcgag

SEQ ID NO: 663166 - DNA, 139 bp, Homo sapiens
tcaccggtaccgtacatgaacatctgccttgtgccatgtgacggatccagcaggaagcccttatcacaccagatgtgggcaccttctgcttggactttccagcctccagaactgtgagaaatacatttctgttctctgt

SEQ ID NO: 663167 - DNA, 1245 bp, Homo sapiens
ggagaactagtctcgagttttttttatttttattatggtcttttttttttaaatcaaaggtccctaatgggtcctgttccataattaccgtgaaccaggggaaaacggggagaaggaaccagcgcggcacagggaacggggtacatctccacaaacatgccattatatacaccagaaacctaaagcagacaagccacagaagtcacaatgggcggtaaacaagtgggcagcaatggacaagggggaggacccatggtggggaacatgggggattgttgtgtaaaaaaaaaatacagggctcccccaaacaactaggggtgtgcccttgggggggaacctgaggtgctcgtttacacgccacaaaagggaactcacaagaaaatcaaaaagcacttttgggaaaaagcgccaaaacccgtacaaaggaaatgagaggggacaaaagggaacaatccccaggggcggattagggaaggtgtcatgtgaatagggggcaactctgggggggatcaaaaagggagatataggcgcattcacacaccacgtagagagggaaaaaatacacccgcagaaagaaacccctttacccagggaacttagagagaacaagaaaaaaggggcatcatacccacttgtggaaaacgccccacaaaagggcgccacggaagaatagagagaaatacgacaaaaataatgcatacaaacagagacatggagtggcccaaaaaaagcggtgagcaaccacacaaaaaggctgctatgggaccccactaccaagtgggcaaacattcacacccggctagtttagccccaccaaaacgagataacgctcggaccacaaagagaatgaaaacgaacgcacacacccaatagagaagcacaccctcagaaaagacacatagaacacacaagagaacaaataccaaccaggccgaaaaacccacccctatgagaaaagacaaatcacataaacagtacaaaggacacaacacatgaaaacaactgagcacaaaaaataattacacttagtggacccaataaaaggaggggcaacaaaaacatcaggggggcaccccaaaaaagaagagaacaacccaccaggaaatacctaccaatagttgagcacccacccggttgagatccccacaagaaggtgcgagcaatcaaaaagaagggagcaaaagagcgggcacaaagcccctaataatatcatcgagagcgaaagatgctctgtaaaacacaaag

SEQ ID NO: 663168 - DNA, 291 bp, Homo sapiens
gggggggaaaccccccttaaaaaggggcccttttgttcccccttggggggggggtctttttcgggtggttttttagggggttttcaattttttttttggggggggaaaaaccttttttcccccccccattttccctgggggggtttttttgttttccccccccttttggccatttttttattaaaaaggggtttcctggaagggttcttttttgggggggaaaaaaaaaattcccccaaaaaatttttcaacccccccccccaaaaaaaaaaatgagggggggggggggga

SEQ ID NO: 663169 - DNA, 196 bp, Homo sapiens
gggattacgactgggatatgaccttttgaaccagttgaaatttgaacctgtcccgttgaagaggcgggcattgacacagcaagacgtagaagaccccttattgggagctttttaatttttatttaaattgcaaaaccagttacccttaaccaaaccccaccagggttccttaaacttcccaaaacccttgcattta

SEQ ID NO: 663170 - DNA, 300 bp, Homo sapiens
  misc_feature (279)..(279): n is a, c, g, or t
cctccctccctccaccacctccctctttgtaagttctgggcattgaactcaggtcatcaggcctggcagtaaataatattccctgagcttagaccctgatgtacacagaaaggaggaagccggctgtgcaggagtacgcacccttccttccctcttgactgaaatcagctgcttcaggttcttgccctcctgacttgccctccatggcggattgtcccgttgaactaaacccccaataaaccctgatttcttatgttgcttctgttgggatgttttgtngacgcggccgcgaatttagta

SEQ ID NO: 663171 - DNA, 138 bp, Homo sapiens
  misc_feature (2)..(2): n is a, c, g, or t
  misc_feature (86)..(86): n is a, c, g, or t
angatctgaggggaaagcacaggctgctcgaggcgcctgctcgcttactcgcctgccaggagaccgggctctcagtttggggtgtngtgcaaccttcatctgcactgggccctgtgcccctcctccccatcctccatg

SEQ ID NO: 663172 - DNA, 319 bp, Homo sapiens
ttgtaaatagttttcagttgatttctttgatcttacaggtaggtgcttccccatagattttcgtatactggctgttagtagttcagtgcccttcctcagaaatccctttcctaattaccctgggctattggaacttttcttcttgttgtgggctgtttttgtagtccatcttgttctctgatgatctttttaatgtgtatgtgaacttattttttaacttgcttcacttcgactgagagcttcatacctctcaggtcggtgggagaaaatgagtttactttttgggactgtgatagttttcattcctggcaagtgttgg

SEQ ID NO: 663173 - DNA, 117 bp, Homo sapiens
  misc_feature (19)..(19): n is a, c, g, or t
  misc_feature (53)..(53): n is a, c, g, or t
  misc_feature (86)..(86): n is a, c, g, or t
  misc_feature (88)..(88): n is a, c, g, or t
gctcggcgggtcctaaggnacctggggcagagctggaagaggaaagctctgantccaggccctgtcccctgagctctgccctcggntntccgaccgcccagagcctgcatgcgccgt

SEQ ID NO: 663174 - DNA, 508 bp, Homo sapiens
tatcaacatgtcagatgttgcttctttggttgtgtatccttttaatgaaggaagaagaggtagagaaaaaagaaaatccttgagggacaagcagtattgaagacctaacatttcacagctgctgtgatgtttgaaaatttatgtgaagtctttattttgatgcaacaatttaattgtggcctagagctgagatttgcatctctaaggctattcaatgtagagttacaacgataagatttttttttttaaagaatggaactataatagcactgagcaagaacattccttaaactatcaatggccagaagttttgaagaatatgtggaagacagaaagcatcagttcaatcaatggactcatggagaaagctcagtaggaaatcaaaattcagagcagcttcaagtctgggggtcaatagagagctagaatgagccacagagaaatcatcaaagttactcattttatagaactgtgtttccaataacatggacatttggttgcccctctg

SEQ ID NO: 663175 - DNA, 195 bp, Homo sapiens
gtgagtctctttaaaaaccaattaaaaaaaaaaaaaaagcttttctggacaattatgaacactttttcaatctggtagcagaccaattcaaagattcactctggcagggacttttggtaagataatggttagaggacactgtgagattcgatagaaaaataaccctgcacagttaagggttacgagactccacgt

SEQ ID NO: 663176 - DNA, 259 bp, Homo sapiens
ctcaagtcgtgacgggctataatactagttgagattatatcatttacgggggaaggcgcgtgtgaagtacgccttatttctcttgtccttatcgtacgagggaggaattctcgcaagtagatagaaaccgacctggattactccgtgtctgtactcagatcacgtttagactttacatctgttgaacacaacgaacctttaatagtcggctgcgaccatcggagagtgtcgctgagtccaacatctgaggtctgtaaac

SEQ ID NO: 663177 - DNA, 113 bp, Homo sapiens
ctccctggaagaagggcaagagaaataaggccttttttacaaagggcctttccccgtaaatgatattatttccccttagttttatacccacacccacccaaggacagggttta

SEQ ID NO: 663178 - DNA, 194 bp, Homo sapiens
  misc_feature (73)..(73): n is a, c, g, or t
attcggcacagggctgcgtcctcatcggattccgacgcctgcaactgatgagcaatgaggccaattcgaagtngttggatgcgcactacgacccaatggccaatatccacaccttttctgcctgcctagcgctggcagatttacatggggatggggaatacaagcttgtgggtaggggaccttggccctggtgt

SEQ ID NO: 663179 - DNA, 2628 bp, Homo sapiens
  misc_feature (2625)..(2625): n is a, c, g, or t
ggggtctctagtaacccacctggtctgacactgaggaaacacctacaggctgctgatcccacagtgaggggtgtgtgccgcctgggcatgggcatttgtgagtgaggggccctgctgatcccacagtgaggggtgtgtgccgcctggggtatgggaactcgtgagtggggacccctgttgctctctggccctgttggtgctcgcagctatgtgtgtgggctggcacagatgggactgaaccctccagggccctccagggttcttctagggcaggagtggaagggtgtggtggggggcttggaggggtcttgccctcatcccctgccctgttactgaggtgagtccaacacctgccttggggcccagctggcctgtttttagaagcttcttagagaaggaagaggaggaggagaaggaaggcctgggaagcagggatggagggtcctgggcactgcccactatttactgtcttagatggtgactcaggaagggacctggtgctggagtccacctagggggcaggtcacagtgcatccttctgagctcagccatgaaggcctaaaagtgcctgagaaccacatcatcatccagagcccaggcctgggacactgcgtcttgggagagctcccacaggacaaacaggagagcttcaggagagggtctaggtttggggctgggcgtcaggccaggaggggtctcctgggagggttctgtgccttcactctgtttctgccctgtgcaccttgcactgggcagtgctgggtcctttctggacacccctggggtccagctctgcacaggaggcaacagataccggaaagcccaggcagggaagcgctcgccacactcctgcctttcatctgagttgtgttaggggtgggttcagtttccaggaggactcatggtgccctgtccagcccaccagggctggattggtttggccctccctctgggctaaagcagaaggttctgtgggcagtgtgggcactgccctcgggccaggtttcatgtacttgtgtgctcccccagcgccctcgggcacatggggacagggttccgtgcactttcaatgccacatgtgccctggctgtgagcatgtgcttgccctggagaaggcagatgtaccagagcctcaggatgagcttgtgatgagcttgaagtaggagtttgtggggacagcaggcatgggaggacctggtccttcaaggtagagggctggtggcctgagcagggcctactggggcctcagtctgtggtgctgggggtcccctatgtatggggtgagacctcccacaggaggctggatcaggtaaggttttgcagcttcttataggggtggtctcacctccatcaaatgtggcccctgaaagaaggggctccccaagtactctcccaagatgagtcctggcccagtctgcccaggatgctggccctgagtcccagccccagccgtatgataccccctctcaggcagggcatggtttgtgtgccatgcagggacctgcatctgcctcctgtgcagaggaagggagctgggtccttctggaggagccagacccctaagctggggaagccaggccctgtagggcagcagggtccctggcctggggtctcttgtgcacacttatcccatgaatcaacaaatgtagaagccattttaaggtggcaatctgggtacacaacatttgcttgtcttcacagaaggagcagaggtgttcagagcccgctggactgccctgaaaacctcactattccaggctcctctgcagacccttcccaaggctagaactccaggcagtaggctgggctgtcaccctcttctctgagatccttcccctgtcctgagacctccccattgcccctcagatgccgcatcccttcagattgcccacctcccctgggaccctccatgccccacatgccttacttgatgctgcggcgctctctcaacatggcgtggcttatgaaggtgtggctcacatcaaggtcattctggtgcacgttcactgaggacatcttggcctgcttcattttctatagagcagggccaagcctcagaacagacacaagactcactgtcaaaattgctgtcatgaaatagcagttctggaaggaaaggaggctttttctgcagaaacttctctttatttccaaagccagggaaagtcagcagcacgcagctcacctgtgttgcccatgccactgtctgcccaggatttgtgactgaccccttctgcccccttggggttgactttccctccatctgggtaacggggcttctgacacggtccggcctatgcatcctgctctggctgggactggaaggaccagacctggtatttccctgggttcttggccttcgccttctcgacattcagtagggatgaccatgctgggccccagacatctgtgaggtttcctttgcagatccaatgagacatctgtggacagaagaatgctctggtgagacaggcctcagggtgaccccaagggggatccgaacctaaggattctggaagcttccagcctttggctccacgtttcctcaggagaggttcagtctgcctaggactgggcctcccttcccctgaataaagagtgagcaagagctcaggttgtgaactntga

SEQ ID NO: 663180 - DNA, 226 bp, Homo sapiens
gaactctcggcgcaccctacgatagctcttagactagagtgtaccgcggggcccgaagcgtagactataggaaaaaataagagtagtaacaaagcaggcccgagccgaatgcataccgcagctagaattaataggaataggaccgcggttctattttgttaggtaaacaggaactagaggccataataaagaagggacggccggggttccttacgtaatagcgccg

SEQ ID NO: 663181 - DNA, 156 bp, Homo sapiens
  misc_feature (79)..(79): n is a, c, g, or t
cgcctcccgggttcaagcgattctcctgcctcagcctcctaagtagctgggattataggcataagccaacgtaactggncagatgcatctctttgagtttgggaacgaaaagggtatgatggcagaatcatgtgctggcagtcatgatctcagtga

SEQ ID NO: 663182 - DNA, 935 bp, Homo sapiens
ataaatattcattaaattgaaaattaaaattatgtttttattcttaatactggattagtctgccacacagccagccttctctgtgtaacagcagtgtcaagctgtggtctggtacatttcatcgtgtacagaggaataaggtgagtatggtgcctggtagtttcggcatggggagcagggacagaacagacaatcatagtcgtaagtgccctcttctcgggcaagcattctttctaaactgtagtaaagtggacttatcacatggtcgctgtgtgcaagttgaatgcagcatcccgcttagtctggctcggagaaattctgagctgcgtctcacttattatagctgtctctactaggcagactcttccacagccttatcacagttccatgttccgttaattggcgatggcggaggccaggaccgaaaccaagcactccacttgcgcattcttcgctctttctagcagctgtgggcttatcgattcagggtcctagactagtcaatgctttggaacgtcacaggttcccctcgggagcatccaaacgttacacgggcacaccgtgaatctgacttcacgaattttaaactcttcctcagagttcgactggacatctccgtcggcttcacttcacccacggggctccggcccaccgcgatgcgctccgcccgcaatggatcttgcccctagttcgtcttcggagctcttggcttccaccggcgtttaaatctctgctaccacctggttacacttcctggaaagttccacaggctcgctagtagcgatgcgcgctatctgctggtccctagtctggacccggttcgccctttggtacagattggctcgcgccctaacaagcctcgtccaggattttcggcgctctcctagctccgttctctgaacttcggccgctaactttgtgtatctgcgtatacg

SEQ ID NO: 663183 - DNA, 588 bp, Homo sapiens
atgttccccatcagcctgcggtgatccccaagcagtgctgcatgacgtgaagacggaaactgcagagttgattgggtgccaggcggccagtcttttcctgtgttattgaactggtgtacttttctggttgagtctacgtacccgtggttttccggacagtgttcgtggcccgctgttcgtaacatcccccaagacccctgtgaagcgcacaaagtttgaaccagcccaaaaagcaacccaaggcgttgatttatcgttatctgcgaacgggcgttccggcgtcactttaagtagtacttagtattttatcatacaagttaaacacgcgctatctaagacaaaatccgaagagcacgcagcacgaagaagaacagagaaaacacaagagaacaacaaaacaacacaaatacgaccaaaacaaaagaaacagagctggtgcaggcggcggccgccggcggcgccgccccgggcggcgcgcgcccccccccggcgcggcgagacgaaggaagaagagccccctccccctcgccaacacaaacacaccccacactacccgcagtgatgcgccgcgcacgccccggggggcat

SEQ ID NO: 663184 - DNA, 230 bp, Homo sapiens
aaggtaagcatccacataaaagtctaacgggaaagactcaaataacgcgaacggcatcttcacagcttgtataaggccaagagcttccccacatatctcattgaagagattatcaactttctgttttaggtccgaagattataggcattccaggacctcaaaggcaaaactctctaccctcagtggcttgcaagggaacgttagaacgcgttagtactgggtctggggtt

SEQ ID NO: 663185 - DNA, 311 bp, Homo sapiens
atacgccaagatccgcatgcactgggaaacagagcagactccatctcaagaaaaaaaaaaaggcgatctcatagaagtaaagagcagaatagtggctactagaggctggggaggaatggggagagatgggttgcatgcaaaattacagctagataggaggagtaagtggtgtaatgatcaaatcagggtatttagcatatccatcacctcaaatggagggaatactaaatagcttccctttaagatatttggtagtatacactacaatatggttaaatatagtcacggcagtgtgcaataggacaccagaa

SEQ ID NO: 663186 - DNA, 173 bp, Homo sapiens
cgttgtggtccctgcttaccataagaaataacaatatactatgtcacatgtgataggaacttggctgaaaaattacagatcagggaaaaagcataatgccccactcatgcatggcaggtagagttgttcattaacaaatccgacaaaaatggattggttaggcgcggccatcc

SEQ ID NO: 663187 - DNA, 148 bp, Homo sapiens
gagtacgcaagtgctggcgaagatgtagactagctcgatgacgcatggccgcactgaaggagacggaagctcgagccaagtaccgacagattgtatcggctgtgcactattgtcaccagacacatattgtacacagggacctgaagga

SEQ ID NO: 663188 - DNA, 218 bp, Homo sapiens
ggtagagatgaggtttccctatgtgcctagcctggtattgaactcctgggatcaagtaatcctcctgattcagcctcacaaagtgctgggagtacaggtgtgcgccactgcacccagcccatataacttttacacctacaacaagaaattaaaaattcaatgtaagaacctattttgttacaaagaagcagattaggtggctcagtaaaagattacca

SEQ ID NO: 663189 - DNA, 314 bp, Homo sapiens
tgaaaccacaagcaaattctcttctctcttccagccctcccttcctccctcttgtttcttcagtaggccatctgtgcacttatgttcccattgccacggccctctttcaagcaggcttactctattgaggtgaatttcacgaaaacttcacacttactaaagggacacccccgataattttggccccgttctcccaaaggaattctgttcccccggtggctcggctgccacagatcccctctcaaattaatacacaccccgggacacgggggggggtcttctaggggcttgtccccatcctctttaaaaaacca

SEQ ID NO: 663190 - DNA, 618 bp, Homo sapiens
  misc_feature (1)..(1): n is a, c, g, or t
ntcgcctccccgcggggggggggttattattgaacgcaggccgcgcctgttttttgtgcctcctcccgcctcccctctctgctgtgaggggcgccactcacccccccgcgcttgtggtcctcccgctcctcgaatgatcgccgcggcgggcggacggactcctcccccccgccgccggtgtttttctttctgctcgcccgggcgcggcggagagcgagagacactcgcttctcctccaccgcgcggacggcgctgtctttggccgctcctccctgcgcgctctcttttgtgggcgctcccctctatttgcccctagctgcttgcgtctaaacacgcgcgcgcgtggtgtgctccgccgctccgtgtttactctcgcgcagtgattcttctcgcgcccccccccctccgcgcggggaggtggggccgcccccccccctctagggtgctcccccgagcagtgcctcagggggccccgactacccacccacaaagggggtgtgcgccggcccccccccccccccttttttttgggggggggcgcccccttctcccccccgcgggcgcccccccctttttttttttttcccgtcttggaaaaaaaaaatccttttttgggga

SEQ ID NO: 663191 - DNA, 1078 bp, Homo sapiens
acacacactgtgtggttggtcatcgctggggggcgggctcactcacacacttactctggtcgagtgggtgtgtgagatgatgggacgggcggtgtgtggtgctcttcgatagaggagagataccacttactgcagactccctctttctttatgatagtgtattgtattatcttcttgtgttgcacacgaccctcttctgtgttatgttgtttttattgagtgtgtgtgggggtttgatctactatcacacactgtgatagctacatgtctagttatacactagaagtggtgggtgtgtgcacacacacaacacgtacgacactgctctgtgtggttgatataagcaagtgtgtgtgctcacacatcactcacacacagaggtcgacacagatgagtgaggcgagtcgtgtgtgtgttgatgtaatcaacacactcatgtggggtggcaccacactcgatgttgtttagcatacatcatgtcgtgattgtatgctgcgtgtgggtgatgcgattacactgggtgtgtgtgtggggcgcatcacatcatgagtgagacacacacaagagtgtgcatatgattcgtacactacacaactttgtgcgccacactagtagtggtttgtgagcgtacacacgatagagaagatacacacactatacgcacccacacacacacaccaacacgccagcacgcacacactcatatagatgtgtggtctattatgtcatcgtcatacacaaggtacacacacaccaacaccgagtggtgtcataaaatgagtggggttatgtgtgtagcggactgagacacaccactgtgtgtgtgtgggagccacaccaccaccccactccaccacacatcagagatagaggtggtggggcgctaaaaactgatggtcccacccccccactctcacgcgccacaccaccaccttgtacccaccaggaccacactctagtggctccccaccccactatataaaataaaataaataaaataaaataatatataaaataaaaagggtaaaataaactgcagggatgtgaatgcagggtcagagaagatgagtaggcacac

SEQ ID NO: 663192 - DNA, 599 bp, Homo sapiens
agcaacctttttttgcgtagtgagcaatctacctgagctggatatgcaggcctgggcctcccccataaatcgtttttagttgacgcatcctcaaacaatggaaggcagagcccaccaaaaacgacaccggatttcatgacaaacacgggcacgtgtataccctggcggaccccgtattgctacgtacatggacaaaagaagcaccaaaggcggaatagagcggaaacctgccctctggcggcagagtactccaaaaggaatgggggaaccagcaactaacccacttggcggaataacgaattggttaaaaaacagcttacaatcgatgcccaattgaagcccgtggcacccattaagacatggccattatcgataaaatagacaaatttcgaacgttatcggggaatagtgtagttacaagaaaggctttggtggccgcgttgctcacttcagctcatgactgccgggcggtacaggcctcgggggctattaagaggtcacctgggccaaaactccccaaatcgggtgcggtatacaagcttcgtggccgcgcgtatcacatcagaggacggggattgggcgcttaacggaagaggccg

SEQ ID NO: 663193 - DNA, 263 bp, Homo sapiens
atattgtcaaggcagagtataggcaacaaaagggctaagacatttggaggcagtcatttccatacaccatgcagacattgcagcttcattacaaaggaagtagccaaattcaatggaggtagatagtctgcgtgcaaagtgcctccattcttctagagttatagccattttaaagtatgtcattaatagcccagcaatgaaatccatcccagtccaggcgcaagcaccagctaaccagatgctatcaatatccttgcattcag

SEQ ID NO: 663194 - DNA, 917 bp, Homo sapiens
  misc_feature (80)..(80): n is a, c, g, or t
aagagaagctacacacgaagtggcacgtacatagtgactgcgcgaaggattacgacatagagatgctaaacggagggtgnctggcacaacatacccgcgagcacgaccgcagggtgttacgactcacgccggcgcaccccaccacgctggtgagggccgccgggagactcgtcaaaacacgtggaccctcccgcccaattcatgtgtatctccccggcgccaagggtttttcccaggacgcctagcacaacgggactccggatacacgcggacaaccatacaccaggcaactggccgatatttatcaacagggtcaatgggggccccgggaaatctccgcagcacgttggtgcgcgcgacgaacaccatggcttgcgtaattctatgccgtactaccccgtctttgtcggtcgcgccgaaaagggcagtgcctcttcggggggcttcttgataaagggcgcacattaccatggagaaacttgaatcttttagcaacctttctatagatacttcatcgtcctgcatcaaatcgaacctgcagttctgaagaacactaagtgtcatccactccggcggctgcccacaagcctatatatgggcaactcggcgaatttaatagatgtccctgcgagtgtttaaatggcccctcgaggggtgagggcggtgcaacttgtataagaagcaacacaaagggccccgttctgttggtctacacgcgagcttaagagtgtcgccccccattgccacgcaatacaaaaggctcacaccacgccccagacaatccacccaatttatcttgtctaagcaaagagagaagaattattatgattcgcagtggtagcaaaattcggcgcaaaaacaaagcggggggggcttttgtataaaaaccacaaacaaaaacaccgatccacatgaca

SEQ ID NO: 663195 - DNA, 1007 bp, Homo sapiens
  misc_feature (54)..(54): n is a, c, g, or t
  misc_feature (76)..(76): n is a, c, g, or t
  misc_feature (86)..(86): n is a, c, g, or t
  misc_feature (104)..(105): n is a, c, g, or t
  misc_feature (113)..(114): n is a, c, g, or t
  misc_feature (116)..(116): n is a, c, g, or t
  misc_feature (120)..(120): n is a, c, g, or t
  misc_feature (126)..(127): n is a, c, g, or t
  misc_feature (142)..(142): n is a, c, g, or t
  misc_feature (149)..(149): n is a, c, g, or t
  misc_feature (152)..(152): n is a, c, g, or t
  misc_feature (160)..(160): n is a, c, g, or t
  misc_feature (176)..(176): n is a, c, g, or t
  misc_feature (201)..(201): n is a, c, g, or t
  misc_feature (203)..(203): n is a, c, g, or t
  misc_feature (207)..(210): n is a, c, g, or t
  misc_feature (212)..(214): n is a, c, g, or t
  misc_feature (217)..(217): n is a, c, g, or t
  misc_feature (219)..(219): n is a, c, g, or t
  misc_feature (224)..(224): n is a, c, g, or t
  misc_feature (228)..(228): n is a, c, g, or t
  misc_feature (231)..(232): n is a, c, g, or t
  misc_feature (248)..(248): n is a, c, g, or t
  misc_feature (256)..(256): n is a, c, g, or t
  misc_feature (266)..(266): n is a, c, g, or t
  misc_feature (268)..(268): n is a, c, g, or t
  misc_feature (272)..(272): n is a, c, g, or t
  misc_feature (316)..(316): n is a, c, g, or t
  misc_feature (368)..(368): n is a, c, g, or t
  misc_feature (462)..(462): n is a, c, g, or t
  misc_feature (678)..(678): n is a, c, g, or t
  misc_feature (744)..(744): n is a, c, g, or t
  misc_feature (748)..(748): n is a, c, g, or t
  misc_feature (771)..(771): n is a, c, g, or t
  misc_feature (946)..(946): n is a, c, g, or t
  misc_feature (973)..(973): n is a, c, g, or t
attacaaagtaatataatcaccctccttcccccttattgtttcaaactattgtngtaaaaataaataaataaagcnctggagtggnggctcacgcctgtaatgnnagcacttnngnaagntgaagnnggtggatcacctgangtcaggngtncgagagcngcccggacaacatggngaaaccccgtctctactaaaatttngngttnnnntnnnggngngcgcntgtnatnngagcgcgccaccacgntggggganggagtaagantnagtntcaaaggcatgacgaaaatagcaaaaatgctttagtgttatacntgttacgaatttaatggaaattacaagtaggagcccattacaatctctagcnttaaaatgctgaaaacatacacagtgtgacaataagtaaacttcgagacccaataagggggaaagtccaacgtggaaagtatttggtaggagtnaagaacagagtgacaactgcttagtcccactggatatttcgctcctcttcaggaagaatactccagtttggggaggccatatcccgggccagccagttaaaatcgtcaacatcgttccagttatttttgtctcctatctaaaccagagctctcgaagtccttgtcgatctccgggtagctccaggtgtaaggggcgaactggatcccactgcagtnctccacgatggccctgctggtcacctgcaggaagatgcgggtgtctttcgtactgtgtatgcggantgtntggcaggccactgcagacacgcntcactgcagttctccaggaaaacagaggtagacaccggaccgcagagcagcttgcagctgtggggccttgggttagccgcagggtgttggggatttccatacagtctgaccgtgcagttgctcagttcggtcaaaagaacgtcgcgctggtgcactcgctggctctcttctccanacttgggactcaggttggagaaacggngaccagctggggcgggtctcttccgcttcttggg

SEQ ID NO: 663196 - DNA, 162 bp, Homo sapiens
aaagttgttgttggagttgagctcgggcggctgtggtaggttgtggatacttcaacagtgtgctgttgcggtgctaggaggtgaagccgtcgtagactaccacagcagcctagaaacaacgggaacaagtagtcctacctgcccgcgtccacaactctcagg

SEQ ID NO: 663197 - DNA, 299 bp, Homo sapiens
gacccctggcgcagtaaacatcccacgtgggattttggagttcaggcttagcagcacgccagaactcgctatccgagacttaaagataattctttattgcaaaacgagcggaagagctgctctttctgccttagctctgggtgagatgggctacgtcaatgtgtcttctatcgctggaggctttgatgcttgggtagcagaggctaaggcagtagctacgccaagcctccctgcgtttgaataagtgagtctcggtttttggtactgcacttcgtttggcatccactgagtcgtcgacg

SEQ ID NO: 663198 - DNA, 859 bp, Homo sapiens
ggacatgcctaagatccatgtatccaagatctagtacgggctattcatggttctgaggcatgtccagcatgcaggcaattatctgttcacattgcggtaaaacagacaagtttgctgatgcggaatggcccattagcttaagtcaccagctggacagctaggtacgtgacgcctaccactaagagttctttatcaaaagccccagtggctcatgaacggcttggtgcggtacttgactgtacagaaattattccaaaggtgactctaagatcatgctacccaagatctagtacgggactatagcatgattactgaggcatgtaccatcatgcaggaaaaagttatcttgtatcacaaatggagggggttaaaacaaaaggacgcaaaaaaaacacctttacaccaagtctcaaccagaatggcatacgatagacatacgaacctaacaccttgctaggctgtcatgaaatctcaaagcgcacacaggaatgatacttatcttagccctgaacaaacaagacgcgtccaatgggtcgacgacatatccatgtattgagtgtcagtaatagcacacccaaaaatatacagccgtccttcttctccaacgacaatcaatttaagttatacagaagaaggttacaagaatggacagcaaaaaattcgttgatatgacaggaaactttgtactaagtgatgtagatgtggacaggaaattatcgtgtcacatacgaggagaaagtgtagcatgttagtcaaggtttgtgcaatatagggggtaaaaatcagataagcaaagaaaccgaatggcgacataacataggattgaggagactggtagacaggaaggcaaattaagaaa

SEQ ID NO: 663199 - DNA, 229 bp, Homo sapiens
  misc_feature (194)..(194): n is a, c, g, or t
tcttcctgttcatccaggatcggatcatgtgccgcctttgactggggccgactctgagatctttctttgtgttgactgttttgggaagtgtcacctcttctacataggggactggtgagggctcgtccatgtccttttgtacaggtcttctatgctccctcttcttcttgtggccacgcctttgaacttatgtnaaggtgtagagggaacttacttaacatttttcttc

SEQ ID NO: 663200 - DNA, 768 bp, Homo sapiens
cacatccctggcctcagcccgccgacatcacccgtgacctgcttacgcccagatttgcttcaatcacatcatgaataaatcacttagaaagaaatgcttatagcttcagttgcaccatgtgtggctatttggaggcgctgtttgtgcatgctgaatgactatgccgttctcatgtctcagctgtctgatatgctatgaagattgcactacagaggtccagtatgctagttccgtatcgagaatgttcaatggatacgaccaacgtgctgctttggatttcacacggttggcggtcgttgacccgctgtaaggaatgcagcccaattcgcatatgagagaaatactccgataattctgtggcctctgttacaactggtgaaactctacaacccactaacgaaggatgcaacctacgcacttgttgaagatttgaataccagaccaaagtggatggtgagcataactcctttcattcttttagtgacacaaggagggaattgagcaaacaattagtatgttggatggtgtgttggcatatgttttactgtatactgccaataagcaaacgtgttcctgggtaggagatacattatggagtcagaccctttgtttaaaagcacatgacagaagatgggactctaggctgtatgtcagaagctaaaggtcttgtacattgaagcactccggactcccttttaaaagtggagcatttcttctggacactatgagtttggcttaaagcaatggcaagttgctcgtggaatgtta

SEQ ID NO: 663201 - DNA, 164 bp, Homo sapiens
acgctcattttgtgctgtggctctgccagaagtgcgattccagaaagcatcagttgtagtagtgtgctgagggaactgtgatgggtggggcctaagaactcccaagagtatatgccctttgtcttctgctaccagggtggatagggaaggaccatcaggtggtc

SEQ ID NO: 663202 - DNA, 675 bp, Homo sapiens
gacaatggacctgcgcagatggtgactgtggtgccatctttgcttcatcaggacctggcagccttgggtaatcagtgatgctcctgttacaggcatggtttctgcgtcagaacttgctgtgagagaacaagagcgaatcccttcactccaggccatcgctgctcaggtcggttggctgttcacgaactcctttctgcagacaggaatttgctggatcctcctctcagcatcagccagcgtccgatgcccatctgaaattatggtttcgcagaaagagtgtccccaaggaattgccaccaggctactaagtcctctccaggttggtcctgggtcggctggcccgtttggactccttccccatcttcagcagaagtactcctctggactcaaggtgtttgtccctttggagtctgttatgcccagcagtcctgccgcctctcattgctgtatgaccggaatggattcagaattctgctccacttctcccagacgggagcccctgggacacccatgaggtacaggtgctgctcttgaccatgatgagcagcggctccccagcactgtctgggatatcatgtttcaagtggctgtgccaaatgtcaatgagagtgaagctgcagccgagatccagctcctagcttcctgtcattcagtcctttgatggctccagtgtga

SEQ ID NO: 663203 - DNA, 246 bp, Homo sapiens
cactttggaaagatggcataaccctgtctcaccctggacttaaggcgtctggctctaattcacagtgctcttttctcctccacggttccagtcctcaagaccatcaggtcacttctttcagatattcgcatattcatatataatagctctaaaaaaaaaaaaggctattgctcgcttagctagtacgctgggagtgtggcttggttgccattgtatgtgtacgcgtgtgggatgtcgtgttaattc

SEQ ID NO: 663204 - DNA, 127 bp, Homo sapiens
tgggattcattttggaaattgagttatacatgacagcaagcagtaagtgaagtgcattcttcttctaagatgcaaagcagtatacataagagtaggccgtggcgcggtggctcacacctattatccc

SEQ ID NO: 663205 - DNA, 137 bp, Homo sapiens
tcgtatcgcctagctatctagagtatccctccttccgcacgctatcaattgtaggggactgtacgaagatagggtcagctcagctgcagtaagatataacgtctcaggaagcaagcatgctctggagtcaaggcaga

SEQ ID NO: 663206 - DNA, 827 bp, Homo sapiens
  misc_feature (144)..(144): n is a, c, g, or t
  misc_feature (167)..(167): n is a, c, g, or t
  misc_feature (183)..(183): n is a, c, g, or t
  misc_feature (347)..(347): n is a, c, g, or t
  misc_feature (798)..(798): n is a, c, g, or t
  misc_feature (807)..(807): n is a, c, g, or t
  misc_feature (809)..(809): n is a, c, g, or t
cttacgatgcactatgtacggtggcccaatcatgacatgtgttaagcatcaactgtaactttgtgcttcccaaatcactttttggtttttaagaattccttgatactcttatagtcctgccttcaattttgatcctttattctnttctattttgtacatgtgcaccnagattaccttcctgtnttagccttctgtcttgtcaccaaccatttcttacttggtggccatgtacttggaaaaaggccgcatgatctttctggctccactcagtgtctaaggcaccctgcgttcctcttgcttgcatcccacagactatttccctcatcctatttactgcagcgaatctnctccttagttgatgagacctgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatcccaaacactgttttgttgcttgttttattatgacctcagattaaattgggaaatattggcccttttgaataattgtcccaaaattacattnaaataaaantncaatggagaaaaaaaaaa

SEQ ID NO: 663207 - DNA, 236 bp, Homo sapiens
ccttggaaatgtcccttcccctttttggcccccagtttcccccctgggacattgtgtgctgcaaaccccttggttgggctattttttcaaaggcccttacttacccagggaagccccccttttttccccttttccccaaagccctttggcatgtaaacaaacaaaagccctccctttatagggtaacctggaacattttttaggttatatcaaaataaaccaatgtaaatggtgga

SEQ ID NO: 663208 - DNA, 293 bp, Homo sapiens
acgctgcacgacggtcaaatatattcctgaggatctccctggcgcgctcagattcttaacactaatatgagaatacagaatgtaaaccagaaagtaccttgagacgggtctcaatcaatttaggagttaattttgccacggttaagaatcatgaccagtgacgcagcctcgggaggtcctgagaataggcccaaggcagttggattacagcttggttttatgttttagggagacatgagacatcaatcaaaataagtggggtaatcactggtttgaaccggcggtgcggcgtg

SEQ ID NO: 663209 - DNA, 839 bp, Homo sapiens
  misc_feature (43)..(43): n is a, c, g, or t
  misc_feature (70)..(70): n is a, c, g, or t
  misc_feature (156)..(156): n is a, c, g, or t
  misc_feature (179)..(179): n is a, c, g, or t
  misc_feature (195)..(195): n is a, c, g, or t
  misc_feature (359)..(359): n is a, c, g, or t
  misc_feature (810)..(810): n is a, c, g, or t
  misc_feature (819)..(819): n is a, c, g, or t
  misc_feature (821)..(821): n is a, c, g, or t
catattcatttccaacttttaatccacaattttcttttcccancattacattttttttcattaactttanttttttttctcccaaatcactttttggtttttaagaattccttgatactcttatagtcctgccttcaattttgatcctttattctnttctattttgtacatgtgcaccnagattaccttcctgtnttagccttctgtcttgtcaccaaccatttcttacttggtggccatgtacttggaaaaaggccgcatgatctttctggctccactcagtgtctaaggcaccctgcgttcctcttgcttgcatcccacagactatttccctcatcctatttactgcagcgaatctnctccttagttgatgagacctgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatcccaaacactgttttgttgcttgttttattatgacctcagattaaattgggaaatattggcccttttgaataattgtcccaaaattacattnaaataaaantncaatggagaaaaaaaaaa

SEQ ID NO: 663210 - DNA, 833 bp, Homo sapiens
  misc_feature (173)..(173): n is a, c, g, or t
  misc_feature (189)..(189): n is a, c, g, or t
  misc_feature (353)..(353): n is a, c, g, or t
  misc_feature (804)..(804): n is a, c, g, or t
  misc_feature (813)..(813): n is a, c, g, or t
  misc_feature (815)..(815): n is a, c, g, or t
aagccaccattgttccttggcccatcacgacattgggtagcattaaactgtaagttgtgtgattcgcaaatcactgctctggttctttaagaagtgtcgggataactcgtgtatcagccttgccaatacgattcgagatcctgctattcatgtcaatttgtacatgtgcaccnagattaccttcctgtnttagccttctgtcttgtcaccaaccatttcttacttggtggccatgtacttggaaaaaggccgcatgatctttctggctccactcagtgtctaaggcaccctgcgttcctcttgcttgcatcccacagactatttccctcatcctatttactgcagcgaatctnctccttagttgatgagacctgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatcccaaacactgttttgttgcttgttttattatgacctcagattaaattgggaaatattggcccttttgaataattgtcccaaaattacattnaaataaaantncaatggagaaaaaaaaaa

SEQ ID NO: 663211 - DNA, 2038 bp, Homo sapiens
  misc_feature (738)..(738): n is a, c, g, or t
gcagcatttggtcttcctctaagcgcctggctccgctgttctcaggagtgggttctgaagtctctggagaacaggatacgtggagggttaggaaggggccaggcctagagacgggagactccctcccggagcaggtggaggcacaggaccattcgctaccccatctgccggcacctgcgggggagcccaggcattctttgtaagccctcctgaccacctggctcaaagaaaacagaagcatggaggccgccaagtattttcaagaaataaccccatgaatattccatcacttttttagaaagaggggcttggggcaggcagaggagagaagggagagcaaactgagagccaagtttccagacagtcctgcaggaggagaggatgcagctgcccagagggaagcaggatcacatttaaggaagtgtgtggggtccctggatgacaccagcacccagtgcggctctgtctggcaaccgctcccaaggtgggaggagtgggtgtcccctgtgtgtcagtgggcagctcctgctgaacccgcagctcactagggagcctgacagtgggtccatgcgcctgacactcctctctgcttgtggacctggcaaggcagggagcagaaaacagagccacttgaaggctttctgtctgcgtctgtgtgcagtgtggatttagttgtgcttttttcttgctgggagagcacagccaccatttacaagcagtgtcaccgtcgtgggtggngaggacagaacaggagcctctgctctctgtacctatctgggcccggtgggctcccttgtcctggcttccatctctgtctcagcgaccattgagccctgcgcaggaacacatgttgcttagaaaagccaaatccagccttgtctctgcctcctctggtctcatgatgtgcatctgttaccttgaaactggaaaccagtctatcaatgtctgtgccaattttttattccctccccaacctccttccccataggactttttatttatgtaggatgtgtgctgtctaatgatgggatgaccacacttttccatgttctaaaagtgctcctctcctgcagggtcccagggctggtggttgctttgggtctacagctacgtcttacccgcctcctgcctcaacagcctgtgtggtggcaaagccggtgtggggctggggaacgcagcgttctccaggagggggacccggctctccttctgcaatgcaggcgaaggcctagatgccagtgtgacctcccacaaggcgtggcttccagactccccggccggaagtgatgcttttttgccttgggccctgggtttgaagcagcctggctttctcttggtaagtggctggtgtcttagcagctgcaatctgagctcagccacctacacaccaccgtggccgacactttcattaaaaagtttcctgagaaaaaaaaaaaacaaacccaaaaaaacaaacccaacaccagcacccacacacaacgcacaccgacaggacacacagcgacaacagcaaagcagcgcacgcagaagaggaggggcgcggcacccgcataacgcagcgcgcgtcagaggggggaccgcgacggcatgcgcgcgcggcgcggctcgtagacgcgagcaggccggcccccaaagggcgcggcgccgcaacgccaagaagagacgccgcggccgcgcgaacgccgcgccgcagccgcgaaggagacggcgggaccacacgcaactcggcggcatagagaggagggagaaacgaccacaagcacgccagcggcagacccgcacacacccgcccagacaaaagcaaacgacagccacagcgccacaagccgcaagcccgcggcagggcggaagaacacaaataacacggacgaagcgaggcgcgagcgcgacaagggagggagagaagaacgcgccaaaagcgacgaacaggaggacaagacgatcaggggagacagaggcgggaggcagaagacagcgggacgggacagagaagatcagaaccacgtagacaagaaggagaggcagcaggcggaacaca

SEQ ID NO: 663212 - DNA, 1424 bp, Homo sapiens
gagccaggtggtcaggagggtttacaaagaatgcctgggctcccccgcaggtgccggcagatggggtagcgaacggtcctgtgcctccacctgctccgggagggagtctcccgtctctaggcctggccccttcctaaccctccacgtatcctgttctccagagacttcagaacccactcctgagaacagcggagccaggcgcttagaggaagaccaaatgctgccaggaacacatgttgcttagaaaagccaaatccagccttgtctctgcctcctctggtctcatgatgtgcatctgttaccttgaaactggaaaccagtctatcaatgtctgtgccaattttttattccctccccaacctccttccccataggactttttatttatgtaggatgtgtgctgtctaatgatgggatgaccacacttttccatgttctaaaagtgctcctctcctgcagggtcccagggctggtggttgctttgggtctacagctacgtcttacccgcctcctgcctcaacagcctgtgtggtggcaaagccggtgtggggctggggaacgcagcgttctccaggagggggacccggctctccttctgcaatgcaggcgaaggcctagatgccagtgtgacctcccacaaggcgtggcttccagactccccggccggaagtgatgcttttttgccttgggccctgggtttgaagcagcctggctttctcttggtaagtggctggtgtcttagcagctgcaatctgagctcagccacctacacaccaccgtggccgacactttcattaaaaagtttcctgagaaaaaaaaaaaacaaacccaaaaaaacaaacccaacaccagcacccacacacaacgcacaccgacaggacacacagcgacaacagcaaagcagcgcacgcagaagaggaggggcgcggcacccgcataacgcagcgcgcgtcagaggggggaccgcgacggcatgcgcgcgcggcgcggctcgtagacgcgagcaggccggcccccaaagggcgcggcgccgcaacgccaagaagagacgccgcggccgcgcgaacgccgcgccgcagccgcgaaggagacggcgggaccacacgcaactcggcggcatagagaggagggagaaacgaccacaagcacgccagcggcagacccgcacacacccgcccagacaaaagcaaacgacagccacagcgccacaagccgcaagcccgcggcagggcggaagaacacaaataacacggacgaagcgaggcgcgagcgcgacaagggagggagagaagaacgcgccaaaagcgacgaacaggaggacaagacgatcaggggagacagaggcgggaggcagaagacagcgggacgggacagagaagatcagaaccacgtagacaagaaggagaggcagcaggcggaacaca

SEQ ID NO: 663213 - DNA, 138 bp, Homo sapiens
tgagatagaattcacaaaccacaaaatgtaccttttcaaagtttacaattcggtggttttttggtacagtcacagggttgtgccaacattaccgctacctaattctagaacattttcttcactccacaaagaaaccca

SEQ ID NO: 663214 - DNA, 155 bp, Homo sapiens
gtgtgacatctagaggatcccggaataccccgctacggtcgagggggacatgctagacctgtgtctcacctgcaggtctcttctggggtctacgagccagttgtgattgaaatgccattgaggagcaggtgtccggagctggatgacagagtcct

SEQ ID NO: 663215 - DNA, 324 bp, Homo sapiens
ctgagaaagcacaccccacccagcagcccagaaatggaacgatcttgctctttttttgtgtacattttattctgagctgttctggttttttttctcgctattggttggcacagaaagttctcaacgaatctaagactaaacaggaggtgatttttttcttatacaaaggggaactgttaggaacgaagatggacaggagaaggagaggaaatagttggcctgcggcctgacgcttcggggtttccttcagcggattttatgtaaaatccctaaatacttgaggttgatgggtgtcattcacaggggacctatagagtcagacct

SEQ ID NO: 663216 - DNA, 1778 bp, Homo sapiens
  misc_feature (738)..(738): n is a, c, g, or t
  misc_feature (1540)..(1540): n is a, c, g, or t
  misc_feature (1551)..(1551): n is a, c, g, or t
  misc_feature (1686)..(1686): n is a, c, g, or t
  misc_feature (1717)..(1717): n is a, c, g, or t
gcagcatttggtcttcctctaagcgcctggctccgctgttctcaggagtgggttctgaagtctctggagaacaggatacgtggagggttaggaaggggccaggcctagagacgggagactccctcccggagcaggtggaggcacaggaccattcgctaccccatctgccggcacctgcgggggagcccaggcattctttgtaagccctcctgaccacctggctcaaagaaaacagaagcatggaggccgccaagtattttcaagaaataaccccatgaatattccatcacttttttagaaagaggggcttggggcaggcagaggagagaagggagagcaaactgagagccaagtttccagacagtcctgcaggaggagaggatgcagctgcccagagggaagcaggatcacatttaaggaagtgtgtggggtccctggatgacaccagcacccagtgcggctctgtctggcaaccgctcccaaggtgggaggagtgggtgtcccctgtgtgtcagtgggcagctcctgctgaacccgcagctcactagggagcctgacagtgggtccatgcgcctgacactcctctctgcttgtggacctggcaaggcagggagcagaaaacagagccacttgaaggctttctgtctgcgtctgtgtgcagtgtggatttagttgtgcttttttcttgctgggagagcacagccaccatttacaagcagtgtcaccgtcgtgggtggngaggacagaacaggagcctctgctctctgtacctatctgggcccggtgggctcccttgtcctggcttccatctctgtctcagcgaccattgagccctgcgcaggaacacatgttgcttagaaaagccaaatccagccttgtctctgcctcctctggtctcatgatgtgcatctgttaccttgaaactggaaaccagtctatcaatgtctgtgccaattttttattccctccccaacctccttccccataggactttttatttatgtaggatgtgtgctgtctaatgatgggatgaccacacttttccatgttctaaaagtgctcctctcctgcagggtcccagggctggtggttgctttgggtctacagctacgtcttacccgcctcctgcctcaacagcctgtgtggtggcaaagccggtgtggggctggggaacgcagcgttctccaggagggggacccggctctccttctgcaatgcaggcgaaggcctagatgccagtgtgacctcccacaaggcgtggcttccagactccccggccggaagtgatgcttttttgccttgggccctgggtttgaagcagcctggctttctcttggtaagtggctggtgtcttagcagctgcaatctgagctcagccacctacacaccaccgtggccgacactttcattaaaaagtttcctgagacgacttgcgtgcatgttgacttcatgatcagcgccgctgggaagaacccctgagccggtggggtggggctgtggccaccgctctggcacgagcccctcagtcttgggtggtttntgcctggtccnggatttggtgttgctgctgagtccagcctttccaccacctccgcatgggctgtgggtgttgtcagctgcctcccgccttggcttcagtagctcacccagcttacaggggagctgccctgggctggagatgggcangcaccctgggtcctacttgaatgaatgcagnttgaggagacccggccatatacactgggccacgggttaccttcggcaatgcccacatcagc

SEQ ID NO: 663217 - DNA, 369 bp, Homo sapiens
tttaattggagataccaattccatataccttataacagttccacccccatttgaaagtgtaccagttccaggctgtaccacggaggctcatgccctgtaatccccaacactctgggaggctgaggtggaaggattgtttgagccccaggagtttgagatcagcgtgggcaacatagtgagacctctctacaaaaatagaaaattagctgagtgtcgtggcacatgcctgtcatcttagctactctggaggctgaggcaggagcattgcttgagcccaggaggtcaaggctacagtgattgcaccactgcactccaactatgatcatggcactgcacttcagcctgggtgacagaatgagaccctgtcag

SEQ ID NO: 663218 - DNA, 1839 bp, Homo sapiens
  misc_feature (738)..(738): n is a, c, g, or t
gcagcatttggtcttcctctaagcgcctggctccgctgttctcaggagtgggttctgaagtctctggagaacaggatacgtggagggttaggaaggggccaggcctagagacgggagactccctcccggagcaggtggaggcacaggaccattcgctaccccatctgccggcacctgcgggggagcccaggcattctttgtaagccctcctgaccacctggctcaaagaaaacagaagcatggaggccgccaagtattttcaagaaataaccccatgaatattccatcacttttttagaaagaggggcttggggcaggcagaggagagaagggagagcaaactgagagccaagtttccagacagtcctgcaggaggagaggatgcagctgcccagagggaagcaggatcacatttaaggaagtgtgtggggtccctggatgacaccagcacccagtgcggctctgtctggcaaccgctcccaaggtgggaggagtgggtgtcccctgtgtgtcagtgggcagctcctgctgaacccgcagctcactagggagcctgacagtgggtccatgcgcctgacactcctctctgcttgtggacctggcaaggcagggagcagaaaacagagccacttgaaggctttctgtctgcgtctgtgtgcagtgtggatttagttgtgcttttttcttgctgggagagcacagccaccatttacaagcagtgtcaccgtcgtgggtggngaggacagaacaggagcctctgctctctgtacctatctgggcccggtgggctcccttgtcctggcttccatctctgtctcagcgaccattgagccctgcgcaggaacacatgttgcttagaaaagccaaatccagccttgtctctgcctcctctggtctcatgatgtgcatctgttaccttgaaactggaaaccagtctatcaatgtctgtgccaattttttattccctccccaacctccttccccataggactttttatttatgtaggatgtgtgctgtctaatgatgggatgaccacacttttccatgttctaaaagtgctcctctcctgcagggtcccagggctggtggttgctttgggtctacagctacgtcttacccgcctcctgcctcaacagcctgtgtggtggcaaagccggtgtggggctggggaacgcagcgttctccaggagggggacccggctctccttctgcaatgcaggcgaaggcctagatgccagtgtgacctcccacaaggcgtggcttccagactccccggccggaagtgatgcttttttgccttgggccctgggtttgaagcagcctggctttctcttggtaagtggctggtgtcttagcagctgcaatctgagctcagccacctacacaccaccgtggccgacactttcattaaaaagtttcctgagacgacttgcgtgcatgttgacttcatgatcagcgccgctgggaagaacccctgagccggtggggtggggctggaagcagcaggtgcagtgatagggctgggtgcccaggaggcctcagtgctcaatcaggccaaggtggccaagcccaggctgcagggaaggccggcctggggggtgtgggtgagcacaggcaggcaccagctgggcagtgttaggatgctggagcagcatccgtaactccactgagtggggtagtctggttggggcagggaccgctgttgctttggcagagagagaggatccccactggggagaggctgttctgactctgcaggtgggacagggacagatggcccccagggtgacccggctggtcttcctttgctatgctaagccctgggacatggaggattc

SEQ ID NO: 663219 - DNA, 951 bp, Homo sapiens
  misc_feature (621)..(621): n is a, c, g, or t
ggactcctggatctcttgtgtaataatgtgaaacatctgtacgttcttcctcctcctggatgggagctcccaatgggtcctgtcccacgtgcatcgtgctcggattcgggaccaagaatggtgaatccttgctcatacttctgtgcctcacctgcaagtgtctctgtctgtctgcagtacagcacgatgcgctaggttagcgtagcgtgggacgactcggagtcgcgcgcaagtgccagcgcaggcgcaaggggacctgtgcgtggggtagttggcgcgtactcgtatagcgcagctgggacgcagcacatctagcaagactctcttcctctcaaggagcatcgagtctaccctagtaatctagctatgacagccgtcacaagaaaaagcgacgttgtcatcctcgttgagagctgatccgtctggtggaccgcgcgcctagagcagcggggcgctagtagttatcctgtagacgagagtggcggagttcactagtggctgacgggcgacgcgtgtatctcgagatacctgaggcgcaaggacacggctggattacgcgcttcacctgcatgcagatggactgtagccaataccttattctacgctgcacggacaaactgntccgatctgtcccaacgttccgataacgcaggctagaccggcgcgtttggtgtgaaacatgcgatcggcagcaaggagctccgcctttaacggcagtacatcgatgttacgtccctgtgaaaggaccgggaacctctcgtgcacctgcggtagccacgcgagcgtatttgctaacttgcgtgcggggacagcggccgggatgatacccatcctccctaaaagggtgcaatgcgtgactgccgaggaggacccctggcagggccgcgagataggaccggggatgccctggtgcaatagatgacaaactccacgattggccttgaagaagag

SEQ ID NO: 663220 - DNA, 304 bp, Homo sapiens
taaaaagtttttaataaacccaaaggatgtatgaatccttgttgacaattcagccttttaaaaaagagaaggggagaaaatagatcctagaaaccggctcggtgaggctgggagcggtggctcacgcctgtaatccccgcactttgggcggccgaggcaggtggattacctgaggtccggagatcgagacccatcctggcccacattgtgaacacccatcgctactaaagataccaaaattagctgggcgtggtggcgggcgccctgtagtcccagctactcgggaggctgaaacagcatatca

SEQ ID NO: 663221 - DNA, 503 bp, Homo sapiens
atgacgttctatcataatcttcttctcatagcgactcataaagtaatcatctgattcaatctctgcattcttcaatgttataccatgcatctttaccactctgagcactgatcgtcgctccttcaatactttcttgtactccagtacaaggtgaactcctgtatcatccatgagcttacaggtgtccacagagcagatattccggatatcactagttctatccaaatgaggaaaaaacaccagtcctgtactgatactctaggtgctggaggctcacttggaattcagttaactggggctggaagccgatggcttcattgggtaccacaaaggcccctagcgccagtggttcggtagatactgagcttctgcgggccaggattaccttataaaggtgtgaggggactgccacgttgtcctcgccaatcacctggtaactaactattttctttccatcgcctctagtctgaggtaaggtcaaaggcccagataccacccaaaca
